United States Patent 7,745,391 (HUMAN THROMBOSPONDIN POLYPEPTIDE) - sequence listing, part 184

SEQ ID NO: 447896 - DNA, 5029 bp, Homo sapiens
caagagtagtgtcctcttcagtctacccgctggcttgagtttgtgctgacagaacgtatttgccatcgtcgtaacttgggagaaccctgacgctggaacacgttgtcacgtttcggtggaacggcatgtctcgattggagaaggtgtatctgaagaacagtgtcatggagctgattgcaaatggaacattgaacattttggaagaggagaaccatattaaagatgctctgtctcgaattgtagtggaaatgatcaagcgagagtggccacagcattggcctgacatgctaatagaattggacactctttccaaacaaggggaaacacagacagaattggtgatgtttatccttttgcgactggcagaggatgtagtgacttttcagacacttccccctcaaagaagaagggacatccagcaaacattaacccagaacatggaaaggatcttcagttttctgcttaacacacttcaagaaaatgtaaacaagtatcagcaagtgaagacagatacttctcaggagtcaaaggcgcaagcaaactgtcgagtaggagttgcagcactgaatactctagcaggctatattgactgggtgtctatgagtcacatcactgctgaaaactgtaaactcctggagatactgtgtttgctgttgaatgaacaggaacttcagttgggagccgctgagtgtcttctcattgcagtcagcagaaaaggcaagttggaagaccggaagcccttgatggtcttatttggagatgttgccatgcattatatactctccgccgcacagactgctgatggaggaggtttggtagaaaaacactacgtctttctgaagaggctctgtcaggtgttgtgtgcgctgggcaatcagctgtgtgcattgctgggtgcagattctgatgtagaaacaccatcaaactttggaaaatacctggaatcttttcttgctttcacaacccatccaagtcagtttctacgctcttcaactcagatgacttggggagccctcttcaggcatgaaatcctgtcccgtgatcctttgctattagcaataataccaaaatatcttcgtgcttccatgactaacttggtcaagatgggctttccttctaaaacagacagccctagctgtgaatattctcggtttgattttgatagcgatgaggacttcaatgctttcttcaactcctcccgagcacaacaaggagaggtgatgaggttggcatgtcgtttggatcccaaaactagcttccagatggctggggagtggctaaagtatcaactatcaacttttcttgatgctggttctgtgaattcttgttctgcagttggaactggagaaggaagcctctgttccgtcttctcaccttcattcgtgcagtgggaagccatgactctttttttggaaagtgttatcacccagatgtttcgaacactaaatagagaagaaattcctgttaatgatggaatagagctattgcagatggttctgaactttgataccaaggatcccctcatcctgtcctgcgtccttactaatgtctctgcactctttccatttgtcacctacagaccagagttcctgccccaggtcttctctaagctattttcatctgtcacttttgaaactgttgaagaaagtaaggcccccagaacccgggcagtgaggaatgtgaggaggcatgcttgttcctccatcatcaagatgtgtcgtgactacccccagcttgtgctgcccaattttgacatgctttataaccatgtgaagcaactcctctccaatgagctactcctgacacaaatggagaagtgtgccctcatggaagccctggttctcattagcaaccaatttaagaactacgagcgtcagaaggtgttcctagaggagctgatggcaccagtggccagcatctggctttctcaagacatgcacagagtgctgtcagatgttgatgctttcattgcgtatgtgggtacagatcagaagagctgtgacccaggcctggaggatccgtgtggcttaaaccgtgcacgaatgagcttttgtgtatacagcattctgggtgtggtgaaacgaacttgctggcccactgacctagaagaggccaaagctgggggatttgtggtgggttatacatccagtggaaatccaatcttccgtaacccctgcacagagcagattctgaaacttcttgacaatttgcttgcgcttataagaacccacaatacattatatgcaccagaaatgctagccaaaatggcagagcctttcaccaaggctctggatatgcttgacgcggaaaaatctgctatattaggattacctcaacctctcttggaactcaatgactctcctgtcttcaaaaccgtcttggaaagaatgcagcgtttcttctctaccctctatgaaaactgttttcatatcctagggaaggcaggcccttccatgcagcaagacttctatactgtggaggaccttgctacccagcttctcagctcagcctttgtcaacttgaacaatattcctgactaccgactcagacccatgcttcgggtctttgtaaagcctctggtgctcttctgtcccccagagcactatgaagccctggtatcccccatcctcggacctcttttcacctacctccatatgaggctttctcagaaatggcaagttatcaaccaaaggagcctgctgtgtggagaagatgaggctgcagatgaaaacccagagtctcaagagatgctggaggagcaactggtgaggatgttaacccgagaagtcatggacctaatcacggtttgctgtgtttcaaagaagggtgctgaccacagtagtgctcccccagcagatggagacgatgaagaaatgatggccacagaggtcaccccctcagctatggcagagcttacagacctgggcaaatgtctgatgaagcatgaggatgtttgtacagcgctattaattacagccttcaattccctggcctggaaagatactctgtcctgccagaggacaacctcacagctctgctggcctctcctcaaacaagtgctgtcagggacactgctcgcagatgcagttacgtggcttttcaccagtgtgctgaaaggcttacagatgcacgggcagcacgacgggtgcatggcttccctggtccatctggccttccagatatacgaggcactgcgccccaggtacctggagataagagctgtaatggagcaaatccctgaaatacagaaggactcactggaccagtttgactgcaagcttttaaacccctccctgcagaaagtggctgacaagcgccgaaaggaccaattcaaacgcctcattgctggttgcattgggaaacccttgggagagcagttccgaaaagaagttcacattaagaatcttccctcacttttcaaaaaaacaaagccaatgctggagacggaggtgctggacaatgatgggggtggcctggccaccatctttgaaccctgaatcaagcttttgggcatccttcctcggcctttcttgtcatctcttctttccctttgtagccgatctctaggcccttcttgcactgccacctcactttccaccactgtcagcctggaaagagatccaggtctggagctggagagaacaggccctgtgcaggaccagaagtaattatactaaagtatcaagaaagggagttagggcttaaactattctgtctagatgtcccagatagttcccattctacttggagatttggcttttccaagaaaagctagagcagagcagcccttctcccacaagccctcccacccccgtgcagccacatacctgtacagaatggtaactaagggtgctgtgcccaaccctgcgactagcaaggctcgcagcaagagcacagccctcaactacttgtgccagagtttctcttggaccactccaactcccactgagcccttttgctgctgggctggcaggaaactttccccactccctaaggggcatgtctgggttaggtgctaagtgctgaagagaacttggtcagttctctcaactttgctttgggcaagaatctggtcacctgatgggatccatggtacaggctactgctaaacttggcacagtatcaagtatagtacctccaaggaccagggctgggcagtctttagtgctaacatcccctttagagttcacacatcttgcccttccatgaatgacccctcagtctggcctccccagcctcaaggtccactcaggcacaagagccacagtaccctagatagtgtcacatgacaccgttgtcatccaaggataatacagaccaactaggctacatctgtgatgagcagctagcaaagccgctggtcttctcctaggactaagtccaggtgccttccacaatctcatggtctttcaggtccctggttacttttctcaaaggccatttccaaaagaatacatgccttcacatcacaacctgtactgtgagtccattctagaggtcactgaaaggccctgtaaagagaggacatggatacgggacctggccctgaggttattactggccgtaaggcagagttaatccatacagaaaccagtgtgtccatgtgctctgcacaaaaacagacctgttgtccatccagtccactgacaagagggtttccccgagagccgaagtggactgaagctacagtttttagctggtgcgggccacaggcagggtcagattgagaagaagcaaagctggggaagcagaagttgggagtcttgtgttgctccctcttcctgtgtggtgctctgggtttctgtggatcgtgaaggcgatctcaagagtgtttccctccaaacctgatagctgcctattcctgtctggttggggctgtggaggatgtagttgtatttattgcattgtaatatttttaacatcctgtgacttcatgctagaaattttctattgtttatagaaactttttgtagaaacattaactctaaagcacatctgcatgtcagtaaaaatctcagtttcgtacaga

SEQ ID NO: 447897 - DNA, 3086 bp, Homo sapiens
gtcttttctatgaagtcattattttggctttaaggatctctaaatagctctgaagactgaaggtgtaatgaggaagtaggtcagaacttggtcagcaggatgagcttttgtgtatacagcattctgggtgtggtgaaacgaacttgctggcccactgacctagaagaggccaaagctgggggatttgtggtgggttatacatccagtggaaatccaatcttccgtaacccctgcacagagcagattctgaaacttcttgacaatttgcttgcgcttataagaacccacaatacattatatgcaccagaaatgctagccaaaatggcagagcctttcaccaaggctctggatatgcttgacgcggaaaaatctgctatattaggattacctcaacctctcttggaactcaatgactctcctgtcttcaaaaccgtcttggaaagaatgcagcgtttcttctctaccctctatgaaaactgttttcatatcctagggaaggcaggcccttccatgcagcaagacttctatactgtggaggaccttgctacccagcttctcagctcagcctttgtcaacttgaacaatattcctgactaccgactcagacccatgcttcgggtctttgtaaagcctctggtgctcttctgtcccccagagcactatgaagccctggtatcccccatcctcggacctcttttcacctacctccatatgaggctttctcagaaatggcaagttatcaaccaaaggagcctgctgtgtggagaagatgaggctgcagatgaaaacccagagtctcaagagatgctggaggagcaactggtgaggatgttaacccgagaagtcatggacctaatcacggtttgctgtgtttcaaagaagggtgctgaccacagtagtgctcccccagcagatggagacgatgaagaaatgatggccacagaggtcaccccctcagctatggcagagcttacagacctgggcaaatgtctgatgaagcatgaggatgtttgtacagcgctattaattacagccttcaattccctggcctggaaagatactctgtcctgccagaggacaacctcacagctctgctggcctctcctcaaacaagtgctgtcagggacactgctcgcagatgcagttacgtggcttttcaccagtgtgctgaaaggcttacagatgcacgggcagcacgacgggtgcatggcttccctggtccatctggccttccagatatacgaggcactgcgccccaggtacctggagataagagctgtaatggagcaaatccctgaaatacagaaggactcactggaccagtttgactgcaagcttttaaacccctccctgcagaaagtggctgacaagcgccgaaaggaccaattcaaacgcctcattgctggttgcattgggaaacccttgggagagcagttccgaaaagaagttcacattaagaatcttccctcacttttcaaaaaaacaaagccaatgctggagacggaggtgctggacaatgatgggggtggcctggccaccatctttgaaccctgaatcaagcttttgggcatccttcctcggcctttcttgtcatctcttctttccctttgtagccgatctctaggcccttcttgcactgccacctcactttccaccactgtcagcctggaaagagatccaggtctggagctggagagaacaggccctgtgcaggaccagaagtaattatactaaagtatcaagaaagggagttagggcttaaactattctgtctagatgtcccagatagttcccattctacttggagatttggcttttccaagaaaagctagagcagagcagcccttctcccacaagccctcccacccccgtgcagccacatacctgtacagaatggtaactaagggtgctgtgcccaaccctgcgactagcaaggctcgcagcaagagcacagccctcaactacttgtgccagagtttctcttggaccactccaactcccactgagcccttttgctgctgggctggcaggaaactttccccactccctaaggggcatgtctgggttaggtgctaagtgctgaagagaacttggtcagttctctcaactttgctttgggcaagaatctggtcacctgatgggatccatggtacaggctactgctaaacttggcacagtatcaagtatagtacctccaaggaccagggctgggcagtctttagtgctaacatcccctttagagttcacacatcttgcccttccatgaatgacccctcagtctggcctccccagcctcaaggtccactcaggcacaagagccacagtaccctagatagtgtcacatgacaccgttgtcatccaaggataatacagaccaactaggctacatctgtgatgagcagctagcaaagccgctggtcttctcctaggactaagtccaggtgccttccacaatctcatggtctttcaggtccctggttacttttctcaaaggccatttccaaaagaatacatgccttcacatcacaacctgtactgtgagtccattctagaggtcactgaaaggccctgtaaagagaggacatggatacgggacctggccctgaggttattactggccgtaaggcagagttaatccatacagaaaccagtgtgtccatgtgctctgcacaaaaacagacctgttgtccatccagtccactgacaagagggtttccccgagagccgaagtggactgaagctacagtttttagctggtgcgggccacaggcagggtcagattgagaagaagcaaagctggggaagcagaagttgggagtcttgtgttgctccctcttcctgtgtggtgctctgggtttctgtggatcgtgaaggcgatctcaagagtgtttccctccaaacctgatagctgcctattcctgtctggttggggctgtggaggatgtagttgtatttattgcattgtaatatttttaacatcctgtgacttcatgctagaaattttctattgtttatagaaactttttgtagaaacattaactctaaagcacatctgcatgtcagtaaaaatctcagtttcgtacaga

SEQ ID NO: 447898 - DNA, 5457 bp, Homo sapiens
gcgcagcgccggcttcttcccagcgcgagttgctgctaacgctcctcctccagcttcccacccccgccgcccgccgcggcccggtaccaacgggtggtctcgccgagggagctgtcgtgcctcgtggtcccgggactgcagtggtgtgcgctctcggcgcgtggcgctaggcatggcgatggatcaagtaaacgcgctgtgcgagcagctggtgaaagcggtgacggtcatgatggaccccaactccacccagcgctaccggctggaagccctcaagttttgtgaggagtttaaagaaaagtgtcctatctgtgtcccctgtggcttgaggttggctgagaaaacacaagttgccatcgtcagacattttggccttcagatcctggaacacgttgtcaagtttcggtggaacggcatgtctcgattggagaaggtgtatctgaagaacagtgtcatggagctgattgcaaatggaacattgaacattttggaagaggagaaccatattaaagatgctctgtctcgaattgtagtggaaatgatcaagcgagagtggccacagcattggcctgacatgctaatagaattggacactctttccaaacaaggggaaacacagacagaattggtgatgtttatccttttgcgactggcagaggatgtagtgacttttcagacacttccccctcaaagaagaagggacatccagcaaacattaacccagaacatggaaaggatcttcagttttctgcttaacacacttcaagaaaatgtaaacaagtatcagcaagtgaagacagatacttctcaggagtcaaaggcgcaagcaaactgtcgagtaggagttgcagcactgaatactctagcaggctatattgactgggtgtctatgagtcacatcactgctgaaaactgtaaactcctggagatactgtgtttgctgttgaatgaacaggaacttcagttgggagccgctgagtgtcttctcattgcagtcagcagaaaaggcaagttggaagaccggaagcccttgatggtcttatttggagatgttgccatgcattatatactctccgccgcacagactgctgatggaggaggtttggtagaaaaacactacgtctttctgaagaggctctgtcaggtgttgtgtgcgctgggcaatcagctgtgtgcattgctgggtgcagattctgatgtagaaacaccatcaaactttggaaaatacctggaatcttttcttgctttcacaacccatccaagtcagtttctacgctcttcaactcagatgacttggggagccctcttcaggcatgaaatcctgtcccgtgatcctttgctattagcaataataccaaaatatcttcgtgcttccatgactaacttggtcaagatgggctttccttctaaaacagacagccctagctgtgaatattctcggtttgattttgatagcgatgaggacttcaatgctttcttcaactcctcccgagcacaacaaggagaggtgatgaggttggcatgtcgtttggatcccaaaactagcttccagatggctggggagtggctaaagtatcaactatcaacttttcttgatgctggttctgtgaattcttgttctgcagttggaactggagaaggaagcctctgttccgtcttctcaccttcattcgtgcagtgggaagccatgactctttttttggaaagtgttatcacccagatgtttcgaacactaaatagagaagaaattcctgttaatgatggaatagagctattgcagatggttctgaactttgataccaaggatcccctcatcctgtcctgcgtccttactaatgtctctgcactctttccatttgtcacctacagaccagagttcctgccccaggtcttctctaagctattttcatctgtcacttttgaaactgttgaagaaagtaaggcccccagaacccgggcagtgaggaatgtgaggaggcatgcttgttcctccatcatcaagatgtgtcgtgactacccccagcttgtgctgcccaattttgacatgctttataaccatgtgaagcaactcctctccaatgagctactcctgacacaaatggagaagtgtgccctcatggaagccctggttctcattagcaaccaatttaagaactacgagcgtcagaaggtgttcctagaggagctgatggcaccagtggccagcatctggctttctcaagacatgcacagagtgctgtcagatgttgatgctttcattgcgtatgtgggtacagatcagaagagctgtgacccaggcctggaggatccgtgtggcttaaaccgtgcacgaatgagcttttgtgtatacagcattctgggtgtggtgaaacgaacttgctggcccactgacctagaagaggccaaagctgggggatttgtggtgggttatacatccagtggaaatccaatcttccgtaacccctgcacagagcagattctgaaacttcttgacaatttgcttgcgcttataagaacccacaatacattatatgcaccagaaatgctagccaaaatggcagagcctttcaccaaggctctggatatgcttgacgcggaaaaatctgctatattaggattacctcaacctctcttggaactcaatgactctcctgtcttcaaaaccgtcttggaaagaatgcagcgtttcttctctaccctctatgaaaactgttttcatatcctagggaaggcaggcccttccatgcagcaagacttctatactgtggaggaccttgctacccagcttctcagctcagcctttgtcaacttgaacaatattcctgactaccgactcagacccatgcttcgggtctttgtaaagcctctggtgctcttctgtcccccagagcactatgaagccctggtatcccccatcctcggacctcttttcacctacctccatatgaggctttctcagaaatggcaagttatcaaccaaaggagcctgctgtgtggagaagatgaggctgcagatgaaaacccagagtctcaagagatgctggaggagcaactggtgaggatgttaacccgagaagtcatggacctaatcacggtttgctgtgtttcaaagaagggtgctgaccacagtagtgctcccccagcagatggagacgatgaagaaatgatggccacagaggtcaccccctcagctatggcagagcttacagacctgggcaaatgtctgatgaagcatgaggatgtttgtacagcgctattaattacagccttcaattccctggcctggaaagatactctgtcctgccagaggacaacctcacagctctgctggcctctcctcaaacaagtatggttattcaccccttttccctgcccctcatggaaggtttgggtcatgcagactgactaaatcattcagaagaactggggtgctgaggccttgagagaggccccctgtggccctaaagcacagttgtctccccaggtgctgtcagggacactgctcgcagatgcagttacgtggcttttcaccagtgtgctgaaaggcttacagatgcacgggcagcacgacgggtgcatggcttccctggtccatctggccttccagatatacgaggcactgcgccccaggtacctggagataagagctgtaatggagcaaatccctgaaatacagaaggactcactggaccagtttgactgcaagcttttaaacccctccctgcagaaagtggctgacaagcgccgaaaggaccaattcaaacgcctcattgctggttgcattgggaaacccttgggagagcagttccgaaaagaagttcacattaagaatcttccctcacttttcaaaaaaacaaagccaatgctggagacggaggtgctggacaatgatgggggtggcctggccaccatctttgaaccctgaatcaagcttttgggcatccttcctcggcctttcttgtcatctcttctttccctttgtagccgatctctaggcccttcttgcactgccacctcactttccaccactgtcagcctggaaagagatccaggtctggagctggagagaacaggccctgtgcaggaccagaagtaattatactaaagtatcaagaaagggagttagggcttaaactattctgtctagatgtcccagatagttcccattctacttggagatttggcttttccaagaaaagctagagcagagcagcccttctcccacaagccctcccacccccgtgcagccacatacctgtacagaatggtaactaagggtgctgtgcccaaccctgcgactagcaaggctcgcagcaagagcacagccctcaactacttgtgccagagtttctcttggaccactccaactcccactgagcccttttgctgctgggctggcaggaaactttccccactccctaaggggcatgtctgggttaggtgctaagtgctgaagagaacttggtcagttctctcaactttgctttgggcaagaatctggtcacctgatgggatccatggtacaggctactgctaaacttggcacagtatcaagtatagtacctccaaggaccagggctgggcagtctttagtgctaacatcccctttagagttcacacatcttgcccttccatgaatgacccctcagtctggcctccccagcctcaaggtccactcaggcacaagagccacagtaccctagatagtgtcacatgacaccgttgtcatccaaggataatacagaccaactaggctacatctgtgatgagcagctagcaaagccgctggtcttctcctaggactaagtccaggtgccttccacaatctcatggtctttcaggtccctggttacttttctcaaaggccatttccaaaagaatacatgccttcacatcacaacctgtactgtgagtccattctagaggtcactgaaaggccctgtaaagagaggacatggatacgggacctggccctgaggttattactggccgtaaggcagagttaatccatacagaaaccagtgtgtccatgtgctctgcacaaaaacagacctgttgtccatccagtccactgacaagagggtttccccgagagccgaagtggactgaagctacagtttttagctggtgcgggccacaggcagggtcagattgagaagaagcaaagctggggaagcagaagttgggagtcttgtgttgctccctcttcctgtgtggtgctctgggtttctgtggatcgtgaaggcgatctcaagagtgtttccctccaaacctgatagctgcctattcctgtctggttggggctgtggaggatgtagttgtatttattgcattgtaatatttttaacatcctgtgacttcatgctagaaattttctattgtttatagaaactttttgtagaaacattaactctaaagcacatctgcatgtcagtaaaaatctcagtttcgtacaga

SEQ ID NO: 447899 - DNA, 5929 bp, Homo sapiens
gcgcagcgccggcttcttcccagcgcgagttgctgctaacgctcctcctccagcttcccacccccgccgcccgccgcggcccggtaccaacgggtggtctcgccgagggagctgtcgtgcctcgtggtcccgggactgcagtggtgtgcgctctcggcgcgtggcgctaggcatggcgatggatcaagtaaacgcgctgtgcgagcagctggtgaaagcggtgacggtcatgatggaccccaactccacccagcgctaccggctggaagccctcaagttttgtgaggagtttaaagaaaagtgtcctatctgtgtcccctgtggcttgaggttggctgagaaaacacaagttgccatcgtcagacattttggccttcagatcctggaacacgttgtcaagtttcggtggaacggcatgtctcgattggagaaggtgtatctgaagaacagtgtcatggagctgattgcaaatggaacattgaacattttggaagaggagaaccatattaaagatgctctgtctcgaattgtagtggaaatgatcaagcgagagtggccacagcattggcctgacatgctaatagaattggacactctttccaaacaaggggaaacacagacagaattggtgatgtttatccttttgcgactggcagaggatgtagtgacttttcagacacttccccctcaaagaagaagggacatccagcaaacattaacccagaacatggaaaggatcttcagttttctgcttaacacacttcaagaaaatgtaaacaagtatcagcaagtgaagacagatacttctcaggagtcaaaggcgcaagcaaactgtcgagtaggagttgcagcactgaatactctagcaggctatattgactgggtgtctatgagtcacatcactgctgaaaactgtaaactcctggagatactgtgtttgctgttgaatgaacaggaacttcagttgggagccgctgagtgtcttctcattgcagtcagcagaaaaggcaagttggaagaccggaagcccttgatggtcttatttggagatgttgccatgcattatatactctccgccgcacagactgctgatggaggaggtttggtagaaaaacactacgtctttctgaagaggctctgtcaggtgttgtgtgcgctgggcaatcagctgtgtgcattgctgggtgcagattctgatgtagaaacaccatcaaactttggaaaatacctggaatcttttcttgctttcacaacccatccaagtcagtttctacgctcttcaactcagatgacttggggagccctcttcaggcatgaaatcctgtcccgtgatcctttgctattagcaataataccaaaatatcttcgtgcttccatgactaacttggtcaagatgggctttccttctaaaacagacagccctagctgtgaatattctcggtttgattttgatagcgatgaggacttcaatgctttcttcaactcctcccgagcacaacaaggagaggtgatgaggttggcatgtcgtttggatcccaaaactagcttccagatggctggggagtggctaaagtatcaactatcaacttttcttgatgctggttctgtgaattcttgttctgcagttggaactggagaaggaagcctctgttccgtcttctcaccttcattcgtgcagtgggaagccatgactctttttttggaaagtgttatcacccagatgtttcgaacactaaatagagaagaaattcctgttaatgatggaatagagctattgcagatggttctgaactttgataccaaggatcccctcatcctgtcctgcgtccttactaatgtctctgcactctttccatttgtcacctacagaccagagttcctgccccaggtcttctctaagctattttcatctgtcacttttgaaactgttgaagaaagtaaggcccccagaacccgggcagtgaggaatgtgaggaggcatgcttgttcctccatcatcaagatgtgtcgtgactacccccagcttgtgctgcccaattttgacatgctttataaccatgtgaagcaactcctctccaatgagctactcctgacacaaatggagaagtgtgccctcatggaagccctggttctcattagcaaccaatttaagaactacgagcgtcagaaggtgttcctagaggagctgatggcaccagtggccagcatctggctttctcaagacatgcacagagtgctgtcagatgttgatgctttcattgcgtatgtgggtacagatcagaagagctgtgacccaggcctggaggatccgtgtggcttaaaccgtgcacgaatgagcttttgtgtatacagcattctgggtgtggtgaaacgaacttgctggcccactgacctagaagaggccaaagctgggggatttgtggtgggttatacatccagtggaaatccaatcttccgtaacccctgcacagagcagattctgaaacttcttgacaatttgcttgcgcttataagaacccacaatacattatatgcaccagaaatgctagccaaaatggcagagcctttcaccaaggctctggatatgcttgacgcggaaaaatctgctatattaggattacctcaacctctcttggaactcaatgactctcctgtcttcaaaaccgtcttggaaagaatgcagcgtttcttctctaccctctatgaaaactgttttcatatcctagggaaggcaggcccttccatgcagcaagacttctatactgtggaggaccttgctacccagcttctcagctcagcctttgtcaacttgaacaatattcctgactaccgactcagacccatgcttcgggtctttgtaaagcctctggtgctcttctgtcccccagagcactatgaagccctggtatcccccatcctcggacctcttttcacctacctccatatgaggctttctcagaaatggcaagttatcaaccaaaggagcctgctgtgtggagaagatgaggctgcagatgaaaacccagagtctcaagagatgctggaggagcaactggtgaggatgttaacccgagaagtcatggacctaatcacggtttgctgtgtttcaaagaagggtgctgaccacagtagtgctcccccagcagatggagacgatgaagaaatgatggccacagaggtcaccccctcagctatggcagagcttacagacctgggcaaatgtctgatgaagcatgaggatgtttgtacagcgctattaattacagccttcaattccctggcctggaaagatactctgtcctgccagaggacaacctcacagctctgctggcctctcctcaaacaagtgctgtcagggacactgctcgcagatgcagttacgtggcttttcaccagtgtgctgaaaggcttacagatgcacgggcagcacgacgggtgcatggcttccctggtccatctggccttccagatatacgaggcactgcgccccaggtacctggagataagagctgtaatggagcaaatccctgaaatacagaaggactcactggaccagtttgactgcaagcttttaaacccctccctgcagaaagtggctgacaagcgccgaaaggaccaattcaaacgcctcattgctggttgcattgggaaacccttgggagagcagttccgaaaagaagttcacattaagaatcttccctcacttttcaaaaaaacaaagccaatgctggagacggaggtgctggacaatgatgggggtggcctggccaccatctttgaaccctgaatcaagcttttgggcatccttcctcggcctttcttgtcatctcttctttccctttgtagccgatctctaggcccttcttgcactgccacctcactttccaccactgtcagcctggaaagagatccaggtctggagctggagagaacaggccctgtgcaggaccagaagtaattatactaaagtatcaagaaagggagttagggcttaaactattctgtctagatgtcccagatagttcccattctacttggagatttggcttttccaagaaaagctagagcagagcagcccttctcccacaagccctcccacccccgtgcagccacatacctgtacagaatggtaactaagggtgctgtgcccaaccctgcgactagcaaggctcgcagcaagagcacagccctcaactacttgtgccagagtttctcttggaccactccaactcccactgagcccttttgctgctgggctggcaggaaactttccccactccctaaggggcatgtctgggttaggtgctaagtgctgaagagaacttggtcagttctctcaactttgctttgggcaagaatctggtcacctgatgggatccatggtacaggctactgctaaacttggcacagtatcaagtatagtacctccaaggaccagggctgggcagtctttagtgctaacatcccctttagagttcacacatcttgcccttccatgaatgacccctcagtctggcctccccagcctcaaggtccactcaggcacaagagccacagtaccctagatagtgtcacatgacaccgttgtcatccaaggataatacagaccaactaggctacatctgtgatgagcagctagcaaagccgctggtcttctcctaggactaagtccaggtgccttccacaatctcatggtctttcaggtccctggttacttttctcaaaggccatttccaaaagaatacatgccttcacatcacaacctgtactgtgagtccattctagaggtcactgaaaggccctgtaaagagaggacatggatacgggacctggccctgaggttattactggccgtaaggcagagttaatccatacagaaaccagtgtgtccatgtgctctgcacaaaaacagacctgttgtccatccagtccactgacaagagggtttccccgagagccgaagtggactgaagctacagtttttagctggtgcgggccacaggcagggtcagattgagaagaagcaaagctggggaagcagaagttgggagtcttgtgttgctccctcttcctgtgtggtgctctgggtttctgtggatcgtgaaggcgatctcaagagtgtttccctccaaacctgatagctgcctattcctgtctggttggggctgtggaggatgtagttgtatttattgcattgtaatatttttaacatcctgtgacttcatgctagaaattttctattgtttatagaaactttttgtagaaacattaactctaaagcacatctgcatgtcagtaaaaatctcagtttcgtacagaaagggacccatctgcctttttcaacctagtcttaaaaccagtgacatactccagggttacttcatgagcacccgggactaaaacaggaagaaatgtgactgatgattctggtctttcaagctttctgaaatggtgtgccagttagaaaaggatttctattcctgacatacccagactaggcagcccataccattctcacagtgtctttcgtgtgtggctgctgggcctggcccacaggaattgctactgttctttgttggagctgtcaatagcaacatgaacttccctggtaaaccaggagataggtgaagtggcacattcactctagcttgaatgtttttctagggtttggctgtgctcccagaaaccaccttaatttgccaattctcaggaggtgttctttctgttgtttttgaaacagggtctcactgttacccgggctggagtgcacatctgatgttcttaattggtaaatgctaaaccagttctgaagtgaggccccctgtttttcgcggtggctcacacctgtaatcccaacactttgggaggccccaaggcaggcgtatcacttgaggtcaggagtttgacaccagcctgaccaacatggtga

SEQ ID NO: 447900 - DNA, 2491 bp, Homo sapiens
tagtaggcacactgatgcagatccctggtgtttagcctccccaagccaggcctgagctttgtctccatcctacacatacaggttttctcacattttgattttttctttttgactggcaatacacaaaaatagaggaagtaaactccttttatttttcctgcttagctatttaaaactccagctcctaagccaggcatggtggcacacacctgtagtcccagctattcgggaggcttagatgggagaatagcttgagcccaggagttcaggaccagcctgggcaacaaaacaaacccatctttagagggggggaggaaaaaaaaaaaaccctccggctcctgatgtgtaataatcatcagagaaaactgtgcttctttttccattgtaactcttcatcttttcctgttcaggatgtttgtacagcgctattaattacagccttcaattccctggcctggaaagatactctgtcctgccagaggacaacctcacagctctgctggcctctcctcaaacaagtgctgtcagggacactgctcgcagatgcagttacgtggcttttcaccagtgtgctgaaaggcttacagatgcacgggcagcacgacgggtgcatggcttccctggtccatctggccttccagatatacgaggcactgcgccccaggtacctggagataagagctgtaatggagcaaatccctgaaatacagaaggactcactggaccagtttgactgcaagcttttaaacccctccctgcagaaagtggctgacaagcgccgaaaggaccaattcaaacgcctcattgctggttgcattgggaaacccttgggagagcagttccgaaaagaagttcacattaagaatcttccctcacttttcaaaaaaacaaagccaatgctggagacggaggtgctggacaatgatgggggtggcctggccaccatctttgaaccctgaatcaagcttttgggcatccttcctcggcctttcttgtcatctcttctttccctttgtagccgatctctaggcccttcttgcactgccacctcactttccaccactgtcagcctggaaagagatccaggtctggagctggagagaacaggccctgtgcaggaccagaagtaattatactaaagtatcaagaaagggagttagggcttaaactattctgtctagatgtcccagatagttcccattctacttggagatttggcttttccaagaaaagctagagcagagcagcccttctcccacaagccctcccacccccgtgcagccacatacctgtacagaatggtaactaagggtgctgtgcccaaccctgcgactagcaaggctcgcagcaagagcacagccctcaactacttgtgccagagtttctcttggaccactccaactcccactgagcccttttgctgctgggctggcaggaaactttccccactccctaaggggcatgtctgggttaggtgctaagtgctgaagagaacttggtcagttctctcaactttgctttgggcaagaatctggtcacctgatgggatccatggtacaggctactgctaaacttggcacagtatcaagtatagtacctccaaggaccagggctgggcagtctttagtgctaacatcccctttagagttcacacatcttgcccttccatgaatgacccctcagtctggcctccccagcctcaaggtccactcaggcacaagagccacagtaccctagatagtgtcacatgacaccgttgtcatccaaggataatacagaccaactaggctacatctgtgatgagcagctagcaaagccgctggtcttctcctaggactaagtccaggtgccttccacaatctcatggtctttcaggtccctggttacttttctcaaaggccatttccaaaagaatacatgccttcacatcacaacctgtactgtgagtccattctagaggtcactgaaaggccctgtaaagagaggacatggatacgggacctggccctgaggttattactggccgtaaggcagagttaatccatacagaaaccagtgtgtccatgtgctctgcacaaaaacagacctgttgtccatccagtccactgacaagagggtttccccgagagccgaagtggactgaagctacagtttttagctggtgcgggccacaggcagggtcagattgagaagaagcaaagctggggaagcagaagttgggagtcttgtgttgctccctcttcctgtgtggtgctctgggtttctgtggatcgtgaaggcgatctcaagagtgtttccctccaaacctgatagctgcctattcctgtctggttggggctgtggaggatgtagttgtatttattgcattgtaatatttttaacatcctgtgacttcatgctagaaattttctattgtttatagaaactttttgtagaaacattaactctaaagcacatctgcatgtcagtaaaaatctcagtttcgtacaga

SEQ ID NO: 447901 - DNA, 4619 bp, Homo sapiens
gcgcagcgccggcttcttcccagcgcgagttgctgctaacgctcctcctccagcttcccacccccgccgcccgccgcggcccggtaccaacgggtggtctcgccgagggagctgtcgtgcctcgtggtcccgggactgcagtggtgtgcgctctcggcgcgtggcgctaggcatggcgatggatcaagtaaacgcgctgtgcgagcagctggtgaaagcggtgacggtcatgatggaccccaactccacccagcgctaccggctggaagccctcaagttttgtgaggagtttaaagaaaagtgtcctatctgtgtcccctgtggcttgaggttggctgagaaaacacaagttgccatcgtcagacattttggccttcagatcctggaacacgttgtcaagtttcggtggaacggcatgtctcgattggagaaggtgtatctgaagaacagtgtcatggagctgattgcaaatggaacattgaacattttggaagaggagaaccatattaaagatgctctgtctcgaattgtagtggaaatgatcaagcgagagtggccacagcattggcctgacatgctaatagaattggacactctttccaaacaaggggaaacacagacagaattggtgatgtttatccttttgcgactggcagaggatgtagtgacttttcagacacttccccctcaaagaagaagggacatccagcaaacattaacccagaacatggaaaggatcttcagttttctgcttaacacacttcaagaaaatgtaaacaagtatcagcaagtgaagacagatacttctcaggagtcaaaggcgcaagcaaactgtcgagtaggagttgcagcactgaatactctagcaggctatattgactgggtgtctatgagtcacatcactgctgaaaactgtaaactcctggagatactgtgtttgctgttgaatgaacaggaacttcagttgggagccgctgagtgtcttctcattgcagtcagcagaaaaggcaagttggaagaccggaagcccttgatggtcttatttggagatgttgccatgcattatatactctccgccgcacagactgctgatggaggaggtttggtagaaaaacactacgtctttctgaagaggctctgtcaggtgttgtgtgcgctgggcaatcagctgtgtgcattgctgggtgcagattctgatgtagaaacaccatcaaactttggaaaatacctggaatcttttcttgctttcacaacccatccaagtcagtttctacgctcttcaactcagatgacttggggagccctcttcaggcatgaaatcctgtcccgtgatcctttgctattagcaataataccaaaatatcttcgtgcttccatgactaacttggtcaagatgggctttccttctaaaacagacagccctagctgtgaatattctcggtttgattttgatagcgatgaggacttcaatgctttcttcaactcctcccgagcacaacaaggagaggtgatgaggttggcatgtcgtttggatcccaaaactagcttccagatggctggggagtggctaaagtatcaactatcaacttttcttgatgctggttctgtgaattcttgttctgcagttggaactggagaaggaagcctctgttccgtcttctcaccttcattcgtgcagtgggaagccatgactctttttttggaaagtgttatcacccagatgtttcgaacactaaatagagaagaaattcctgttaatgatggaatagagctattgcagatggttctgaactttgataccaaggatcccctcatcctgtcctgcgtccttactaatgtctctgcactctttccatttgtcacctacagaccagagttcctgccccaggtcttctctaagctattttcatctgtcacttttgaaactgttgaagaaagtaaggcccccagaacccgggcagtgaggaatgtgaggaggcatgcttgttcctccatcatcaagatgtgtcgtgactacccccagcttgtgctgcccaattttgacatgctttataaccatgtgaagcaactcctctccaatgagctactcctgacacaaatggagaagtgtgccctcatggaagccctggttctcattagcaaccaatttaagaactacgagcgtcagaaggtgttcctagaggagctgatggcaccagtggccagcatctggctttctcaagacatgcacagagtgctgtcagatgttgatgctttcattgcgtatgtgggtacagatcagaagagctgtgacccaggcctggaggatccgtgtggcttaaaccgtgcacgaatgagcttttgtgtatacagcattctgggtgtggtgaaacgaacttgctggcccactgacctagaagaggccaaagctgggggatttgtggtgggttatacatccagtggaaatccaatcttccgtaacccctgcacagagcagattctgaaacttcttgacaatttgcttgcgcttataagaacccacaatacattatatgcaccagaaatgctagccaaaatggcagagcctttcaccaaggctctggatatgcttgacgcggaaaaatctgctatattaggattacctcaacctctcttggaactcaatgactctcctgtcttcaaaaccgtcttggaaagaatgcagcgtttcttctctaccctctatgaaaactgttttcatatcctagggaaggcaggcccttccatgcagcaagacttctatactgtggaggaccttgctacccagcttctcagctcagcctttgtcaacttgaacaatattcctgactaccgactcagacccatgcttcgggtctttgtaaagcctctggtgctcttctgtcccccagagcactatgaagccctggtatcccccatcctcggacctcttttcacctacctccatatgaggctttctcagaaatggcaagttatcaaccaaaggagcctgctgtgtggagaagatgaggctgcagatgaaaacccagagtctcaagagatgctggaggagcaactggtgaggatgttaacccgagaagtcatggacctaatcacggtttgctgtgtttcaaagaagggtgctgaccacagtagtgctcccccagcagatggagacgatgaagaaatgatggccacagaggtcaccccctcagctatggcagagcttacagacctgggcaaatgtctgatgaagcatgaggatgtttgtacagcgctattaattacagccttcaattccctggcctggaaagatactctgtcctgccagaggacaacctcacagctctgctggcctctcctcaaacaagtgctgtcagggacactgctcgcagatgcagttacgtggcttttcaccagtgtgctgaaaggcttacagatgcacgggcagcacgacgggtgcatggcttccctggtccatctggccttccagatatacgaggcactgcgccccaggtacctggagataagagctgtaatggagcaaatccctgaaatacagaaggactcactggaccagtttgactgcaagcttttaaacccctccctgcagaaagtggctgacaagcgccgaaaggaccaattcaaacgcctcattgctggttgcattgggaaacccttgggagagcagttccgaaaagaagttcacattaagaatcttccctttgtagccgatctctaggcccttcttgcactgccacctcactttccaccactgtcagcctggaaagagatccaggtctggagctggagagaacaggccctgtgcaggaccagaagtaattatactaaagtatcaagaaagggagttagggcttaaactattctgtctagatgtcccagatagttcccattctacttggagatttggcttttccaagaaaagctagagcagagcagcccttctcccacaagccctcccacccccgtgcagccacatacctgtacagaatggtaactaagggtgctgtgcccaaccctgcgactagcaaggctcgcagcaagagcacagccctcaactacttgtgccagagtttctcttggaccactccaactcccactgagcccttttgctgctgggctggcaggaaactttccccactccctaaggggcatgtctgggttaggtgctaagtgctgaagagaacttggtcagttctctcaactttgctttgggcaagaatctggtcacctgatgggatccatggtacaggctactgctaaacttggcacagtatcaagtatagtacctccaaggaccagggctgggcagtctttagtgctaacatcccctttagagttcacacatcttgcccttccatgaatgacccctcagtctggcctccccagcctcaaggtccactcaggcacaagagccacagtaccctagatagtgtcacatgacaccgttgtcatccaaggataatacagaccaactaggctacatctgtgatgagcagctagcaaagccgctggtcttctcctaggactaagtccaggtgccttccacaatctcatggtctttcaggtccctggttacttttctcaaaggccatttccaaaagaatacatgccttcacatc

SEQ ID NO: 447902 - DNA, 1792 bp, Homo sapiens
tgtgtaccacgggctgcacgaatacagcacgagcatcctcggacctcttttcacctacctccatatgaggctttctcagaaatggcaagttatcaaccaaaggagcctgctgtgtggagaagatgaggctgcagatggagaagtcatggacctaatcacggtttgctgtgtttcaaagaagggtgctgaccacagtagtgctcccccagcagatggagacgaatgatgggggtggcctggccaccatctttgaaccctgaatcaagcttttgggcatccttcctcggcctttcttgtcatctcttctttccctttgtagccgatctctaggcccttcttgcactgccacctcactttccaccactgtcagcctggaaagagatccaggtctggagctggagagaacaggccctgtgcaggaccagaagtaattatactaaagtatcaagaaagggagttagggcttaaactattctgtctagatgtcccagatagttcccattctacttggagatttggcttttccaagaaaagctagagcagagcagcccttctcccacaagccctcccacccccgtgcagccacatacctgtacagaatggtaactaagggtgctgtgcccaaccctgcgactagcaaggctcgcagcaagagcacagccctcaactacttgtgccagagtttctcttggaccactccaactcccactgagcccttttgctgctgggctggcaggaaactttccccactccctaaggggcatgtctgggttaggtgctaagtgctgaagagaacttggtcagttctctcaactttgctttgggcaagaatctggtcacctgatgggatccatggtacaggctactgctaaacttggcacagtatcaagtatagtacctccaaggaccagggctgggcagtctttagtgctaacatcccctttagagttcacacatcttgcccttccatgaatgacccctcagtctggcctccccagcctcaaggtccactcaggcacaagagccacagtaccctagatagtgtcacatgacaccgttgtcatccaaggataatacagaccaactaggctacatctgtgatgagcagctagcaaagccgctggtcttctcctaggactaagtccaggtgccttccacaatctcatggtctttcaggtccctggttacttttctcaaaggccatttccaaaagaatacatgccttcacatcacaacctgtactgtgagtccattctagaggtcactgaaaggccctgtaaagagaggacatggatacgggacctggccctgaggttattactggccgtaaggcagagttaatccatacagaaaccagtgtgtccatgtgctctgcacaaaaacagacctgttgtccatccagtccactgacaagagggtttccccgagagccgaagtggactgaagctacagtttttagctggtgcgggccacaggcagggtcagattgagaagaagcaaagctggggaagcagaagttgggagtcttgtgttgctccctcttcctgtgtggtgctctgggtttctgtggatcgtgaaggcgatctcaagagtgtttccctccaaacctgatagctgcctattcctgtctggttggggctgtggaggatgtagttgtatttattgcattgtaatatttttaacatcctgtgacttcatgctagaaattttctattgtttatagaaactttttgtagaaacattaactctaaagcacatctgcatgtcagtaaaaatctcagtttcgtacaga

SEQ ID NO: 447903 - DNA, 1792 bp, Homo sapiens
  misc_feature (43)..(43): n is a, c, g, or t
tcagatgttgatgctttcattgcgtatgtgggtacagatcagnaagagctgtgacccagggcctggaggatccgtgcagtgggaagccatgactctttttttggaaagtgttatcacccagatgtttcgaacactaaatagagaagaaattcctgttaatgatggaatagagctattgcagatggttctgaactttgataccaaggatcccctcatcctgtcctgcgtccttactaatgtctctgcactctttccatttgtcacctacagaccagagttcctgccccaggtcttctctaagctattttcatctgtcacttttgaaactgttgaagaaagtaagtgccacctcactttccaccactgtcagcctggaaagagatccaggtctggagctggagagaacaggccctgtgcaggaccagaagtaattatactaaagtatcaagaaagggagttagggcttaaactattctgtctagatgtcccagatagttcccattctacttggagatttggcttttccaagaaaagctagagcagagcagcccttctcccacaagccctcccacccccgtgcagccacatacctgtacagaatggtaactaagggtgctgtgcccaaccctgcgactagcaaggctcgcagcaagagcacagccctcaactacttgtgccagagtttctcttggaccactccaactcccactgagcccttttgctgctgggctggcaggaaactttccccactccctaaggggcatgtctgggttaggtgctaagtgctgaagagaacttggtcagttctctcaactttgctttgggcaagaatctggtcacctgatgggatccatggtacaggctactgctaaacttggcacagtatcaagtatagtacctccaaggaccagggctgggcagtctttagtgctaacatcccctttagagttcacacatcttgcccttccatgaatgacccctcagtctggcctccccagcctcaaggtccactcaggcacaagagccacagtaccctagatagtgtcacatgacaccgttgtcatccaaggataatacagaccaactaggctacatctgtgatgagcagctagcaaagccgctggtcttctcctaggactaagtccaggtgccttccacaatctcatggtctttcaggtccctggttacttttctcaaaggccatttccaaaagaatacatgccttcacatcacaacctgtactgtgagtccattctagaggtcactgaaaggccctgtaaagagaggacatggatacgggacctggccctgaggttattactggccgtaaggcagagttaatccatacagaaaccagtgtgtccatgtgctctgcacaaaaacagacctgttgtccatccagtccactgacaagagggtttccccgagagccgaagtggactgaagctacagtttttagctggtgcgggccacaggcagggtcagattgagaagaagcaaagctggggaagcagaagttgggagtcttgtgttgctccctcttcctgtgtggtgctctgggtttctgtggatcgtgaaggcgatctcaagagtgtttccctccaaacctgatagctgcctattcctgtctggttggggctgtggaggatgtagttgtatttattgcattgtaatatttttaacatcctgtgacttcatgctagaaattttctattgtttatagaaactttttgtagaaacattaactctaaagcacatctgcatgtcagtaaaaatctcagtttcgtacaga

SEQ ID NO: 447904 - DNA, 3241 bp, Homo sapiens
gcgcagcgccggcttcttcccagcgcgagttgctgctaacgctcctcctccagcttcccacccccgccgcccgccgcggcccggtaccaacgggtggtctcgccgagggagctgtcgtgcctcgtggtcccgggactgcagtggtgtgcgctctcggcgcgtggcgctaggcatggcgatggatcaagtaaacgcgctgtgcgagcagctggtgaaagcggtgacggtcatgatggaccccaactccacccagcgctaccggctggaagccctcaagttttgtgaggagtttaaagaaaagtgtcctatctgtgtcccctgtggcttgaggttggctgagaaaacacaagttgccatcgtcagacattttggccttcagatcctggaacacgttgtcaagtttcggtggaacggcatgtctcgattggagaaggtgtatctgaagaacagtgtcatggagctgattgcaaatggaacattgaacattttggaagaggagaaccatattaaagatgctctgtctcgaattgtagtggaaatgatcaagcgagagtggccacagcattggcctgacatgctaatagaattggacactctttccaaacaaggggaaacacagacagaattggtgatgtttatccttttgcgactggcagaggatgtagtgacttttcagacacttccccctcaaagaagaagggacatccagcaaacattaacccagaacatggaaaggatcttcagttttctgcttaacacacttcaagaaaatgtaaacaagtatcagcaagtgaagacagatacttctcaggagtcaaaggcgcaagcaaactgtcgagtaggagttgcagcactgaatactctagcaggctatattgactgggtgtctatgagtcacatcactgctgaaaactgtaaactcctggagatactgtgtttgctgttgaatgaacaggaacttcagttgggagccgctgagtgtcttctcattgcagtcagcagaaaaggcaagttggaagaccggaagcccttgatggtcttatttggagatgttgccatgcattatatactctccgccgcacagactgctgatggaggaggtttggtagaaaaacactacgtctttctgaagaggctctgtcaggtgttgtgtgcgctgggcaatcagctgtgtgcattgctgggtgcagattctgatgtagaaacaccatcaaactttggaaaatacctggaatcttttcttgctttcacaacccatccaagtcagtttctacgctcttcaactcagatgacttggggagccctcttcaggcatgaaatcctgtcccgtgatcctttgctattagcaataataccaaaatatcttcgtgcttccatgactaacttggtcaagatgggctttccttctaaaacagacagccctagctgtgaatattctcggtttgattttgatagcgatgaggacttcaatgctttcttcaactcctcccgagcacaacaaggagaggtgatgaggttggcatgtcgtttggatcccaaaactagcttccagatggctggggagtggctaaagtatcaactatcaacttttcttgatgctggttctgtgaattcttgttctgcagttggaactggagaaggaagcctctgttccgtcttctcaccttcattcgtgcagtgggaagccatgactctttttttggaaagtgttatcacccagatgtttcgaacactaaatagagaagaaattcctgttaatgatggaatagagctattgcagatggttctgaactttgataccaaggatcccctcatcctgtcctgcgtccttactaatgtctctgcactctttccatttgtcacctacagaccagagttcctgccccaggtcttctctaagctattttcatctgtcacttttgaaactgttgaagaaagtaaggcccccagaacccgggcagtgaggaatgtgaggaggcatgcttgttcctccatcatcaagatgtgtcgtgactacccccagcttgtgctgcccaattttgacatgctttataaccatgtgaagcaactcctctccaatgagctactcctgacacaaatggagaagtgtgccctcatggaagccctggttctcattagcaaccaatttaagaactacgagcgtcagaaggtgttcctagaggagctgatggcaccagtggccagcatctggctttctcaagacatgcacagagtgctgtcagatgttgatgctttcattgcgtatgtgggtacagatcagaagagctgtgacccaggcctggaggatccgtgtggcttaaaccgtgcacgaatgagcttttgtgtatacagcattctgggtgtggtgaaacgaacttgctggcccactgacctagaagaggccaaagctgggggatttgtggtgggttatacatccagtggaaatccaatcttccgtaacccctgcacagagcagattctgaaacttcttgacaatttgcttgcgcttataagaacccacaatacattatatgcaccagaaatgctagccaaaatggcagagcctttcaccaaggctctggatatgcttgacgcggaaaaatctgctatattaggattacctcaacctctcttggaactcaatgactctcctgtcttcaaaaccgtcttggaaagaatgcagcgtttcttctctaccctctatgaaaactgttttcatatcctagggaaggcaggcccttccatgcagcaagacttctatactgtggaggaccttgctacccagcttctcagctcagcctttgtcaacttgaacaatattcctgactaccgactcagacccatgcttcgggtctttgtaaagcctctggtgctcttctgtcccccagagcactatgaagccctggtatcccccatcctcggacctcttttcacctacctccatatgaggctttctcagaaatggcaagttatcaaccaaaggagcctgctgtgtggagaagatgaggctgcagatgaaaacccagagtctcaagagatgctggaggagcaactggtgaggatgttaacccgagaagtcatggacctaatcacggtttgctgtgtttcaaagaagggtgctgaccacagtagtgctcccccagcagatggagacgaatgatgggggtggcctggccaccatctttgaaccctgaatcaagcttttgggcatccttcctcggcctttcttgtcatctcttct

SEQ ID NO: 447905 - DNA, 2271 bp, Homo sapiens
gcgcagcgccggcttcttcccagcgcgagttgctgctaacgctcctcctccagcttcccacccccgccgcccgccgcggcccggtaccaacgggtggtctcgccgagggagctgtcgtgcctcgtggtcccgggactgcagtggtgtgcgctctcggcgcgtggcgctaggcatggcgatggatcaagtaaacgcgctgtgcgagcagctggtgaaagcggtgacggtcatgatggaccccaactccacccagcgctaccggctggaagccctcaagttttgtgaggagtttaaagaaaagtgtcctatctgtgtcccctgtggcttgaggttggctgagaaaacacaagttgccatcgtcagacattttggccttcagatcctggaacacgttgtcaagtttcggtggaacggcatgtctcgattggagaaggtgtatctgaagaacagtgtcatggagctgattgcaaatggaacattgaacattttggaagaggagaaccatattaaagatgctctgtctcgaattgtagtggaaatgatcaagcgagagtggccacagcattggcctgacatgctaatagaattggacactctttccaaacaaggggaaacacagacagaattggtgatgtttatccttttgcgactggcagaggatgtagtgacttttcagacacttccccctcaaagaagaagggacatccagcaaacattaacccagaacatggaaaggatcttcagttttctgcttaacacacttcaagaaaatgtaaacaagtatcagcaagtgaagacagatacttctcaggagtcaaaggcgcaagcaaactgtcgagtaggagttgcagcactgaatactctagcaggctatattgactgggtgtctatgagtcacatcactgctgaaaactgtaaactcctggagatactgtgtttgctgttgaatgaacaggaacttcagttgggagccgctgagtgtcttctcattgcagtcagcagaaaaggcaagttggaagaccggaagcccttgatggtcttatttggagatgttgccatgcattatatactctccgccgcacagactgctgatggaggaggtttggtagaaaaacactacgtctttctgaagaggctctgtcaggtgttgtgtgcgctgggcaatcagctgtgtgcattgctgggtgcagattctgatgtagaaacaccatcaaactttggaaaatacctggaatcttttcttgctttcacaacccatccaagtcagtttctacgctcttcaactcagatgacttggggagccctcttcaggcatgaaatcctgtcccgtgatcctttgctattagcaataataccaaaatatcttcgtgcttccatgactaacttggtcaagatgggctttccttctaaaacagacagccctagctgtgaatattctcggtttgattttgatagcgatgaggacttcaatgctttcttcaactcctcccgagcacaacaaggagaggtgatgaggttggcatgtcgtttggatcccaaaactagcttccagatggctggggagtggctaaagtatcaactatcaacttttcttgatgctggttctgtgaattcttgttctgcagttggaactggagaaggaagcctctgttccgtcttctcaccttcattcgtgcagtgggaagccatgactctttttttggaaagtgttatcacccagatgtttcgaacactaaatagagaagaaattcctgttaatgatggaatagagctattgcagatggttctgaactttgataccaaggatcccctcatcctgtcctgcgtccttactaatgtctctgcactctttccatttgtcacctacagaccagagttcctgccccaggtcttctctaagctattttcatctgtcacttttgaaactgttgaagaaagtaaggcccccagaacccgggcagtgaggaatgtgaggaggcatgcttgttcctccatcatcaagatgtgtcgtgactacccccagcttgtgctgcccaattttgacatgctttataaccatgtgaagcaactcctctccaatgagctactcctgacacaaatggagaagtgtgccctcatggaagccctggttctcattagcaaccaatttaagaactacgagcgtcagaaggtgttcctagaggagctgatggcaccagtggccagcatctggctttctcaagacatgcacagagtgctgtcagatgttgatgctggacgacgggtaccgag

SEQ ID NO: 447906 - DNA, 517 bp, Homo sapiens
gatgtttttattacagcctttttaattttgttggtgatataaggaattctcatcttacaggactgctgatggaggaggtttggtagaaaaacactacgtctttctgaagaggctctgtcaggtgttgtgtgcgctgggcaatcagctgtgtgcattgctggtgagctagtgtttgctttctggagagcttcaagcccatttgggaagagcatttagaaacttatgtttcaatgaggggttgcaaatgtcattgattttagcctgatggggcagtgccatacaagttattgcatgattctatagattaaattatcttaatagaatagtgtttgagtgatctaaatttcttttaacaataaaatagttataccaacgtcagatatccacgtctattattccataaagtcaacgttggtttcttgtgaattttggtacttacagaacctcaatctgctgagtgctttatgcttttacattctgttagcccacgaaacatggacttgaataaagaactctt

SEQ ID NO: 447907 - DNA, 459 bp, Homo sapiens
aaattcatgggacagggctggcagtaacagatgttggatttgtcattttcaatgctctttttttcccctttacagttttcatatcctagggaaggcaggcccttccatgcagcaagacttctatactgtggaggaccttgctacccagcttctcagctcagcctttgtcaacttgaacaatattcctgactaccgactcagacccatgcttcatatcctttcaaaagtctctacataacccaaaaggtcagaaaattagagagagaaacaaaacaggtcacagcaaccagagggaagaggcagaactggaaggaagagatgagattatgtatctaagtgtatcatgtcattaaaaacactggcagattgcagggaaaacatgaaggcagtccagatggccataaacttttccttaggggtaaatttttaccttcccccttctcggaattattacagata

SEQ ID NO: 447908 - DNA, 355 bp, Homo sapiens
tagaattaagcagggggaccagctgggtggagaacaggtatgtctagagacccaggaattctaaaaatgttgttaattctttccaagcaaagaggtgtttgagataccaccttcatcagggatgtgggataggttacagaaaccatagatgttttttttaaccttgtggtgtggagtctacagaagttgtcattgatgcctagaatcatccttggctaattttaatcatgaagtggacttgactttagatattatgtgttccaatcctttccccaattctagcatttatttcctttgtgttttcccagaggctttctcagaaatggcaagttatcaaccaaaggagcctgctgtg

SEQ ID NO: 447909 - DNA, 5319 bp, Homo sapiens
gcgcagcgccggcttcttcccagcgcgagttgctgctaacgctcctcctccagcttcccacccccgccgcccgccgcggcccggtaccaacgggtggtctcgccgagggagctgtcgtgcctcgtggtcccgggactgcagtggtgtgcgctctcggcgcgtggcgctaggcatggcgatggatcaagtaaacgcgctgtgcgagcagctggtgaaagcggtgacggtcatgatggaccccaactccacccagcgctaccggctggaagccctcaagttttgtgaggagtttaaagaaaagtgtcctatctgtgtcccctgtggcttgaggttggctgagaaaacacaagttgccatcgtcagacattttggccttcagatcctggaacacgttgtcaagtttcggtggaacggcatgtctcgattggagaaggtgtatctgaagaacagtgtcatggagctgattgcaaatggaacattgaacattttggaagaggagaaccatattaaagatgctctgtctcgaattgtagtggaaatgatcaagcgagagtggccacagcattggcctgacatgctaatagaattggacactctttccaaacaaggggaaacacagacagaattggtgatgtttatccttttgcgactggcagaggatgtagtgacttttcagacacttccccctcaaagaagaagggacatccagcaaacattaacccagaacatggaaaggatcttcagttttctgcttaacacacttcaagaaaatgtaaacaagtatcagcaagtgaagacagatacttctcaggagtcaaaggcgcaagcaaactgtcgagtaggagttgcagcactgaatactctagcaggctatattgactgggtgtctatgagtcacatcactgctgaaaactgtaaactcctggagatactgtgtttgctgttgaatgaacaggaacttcagttgggagccgctgagtgtcttctcattgcagtcagcagaaaaggcaagttggaagaccggaagcccttgatggtcttatttggagatgttgccatgcattatatactctccgccgcacagactgctgatggaggaggtttggtagaaaaacactacgtctttctgaagaggctctgtcaggtgttgtgtgcgctgggcaatcagctgtgtgcattgctgggtgcagattctgatgtagaaacaccatcaaactttggaaaatacctggaatcttttcttgctttcacaacccatccaagtcagtttctacgctcttcaactcagatgacttggggagccctcttcaggcatgaaatcctgtcccgtgatcctttgctattagcaataataccaaaatatcttcgtgcttccatgactaacttggtcaagatgggctttccttctaaaacagacagccctagctgtgaatattctcggtttgattttgatagcgatgaggacttcaatgctttcttcaactcctcccgagcacaacaaggagaggtgatgaggttggcatgtcgtttggatcccaaaactagcttccagatggctggggagtggctaaagtatcaactatcaacttttcttgatgctggttctgtgaattcttgttctgcagttggaactggagaaggaagcctctgttccgtcttctcaccttcattcgtgcagtgggaagccatgactctttttttggaaagtgttatcacccagatgtttcgaacactaaatagagaagaaattcctgttaatgatggaatagagctattgcagatggttctgaactttgataccaaggatcccctcatcctgtcctgcgtccttactaatgtctctgcactctttccatttgtcacctacagaccagagttcctgccccaggtcttctctaagctattttcatctgtcacttttgaaactgttgaagaaagtaaggcccccagaacccgggcagtgaggaatgtgaggaggcatgcttgttcctccatcatcaagatgtgtcgtgactacccccagcttgtgctgcccaattttgacatgctttataaccatgtgaagcaactcctctccaatgagctactcctgacacaaatggagaagtgtgccctcatggaagccctggttctcattagcaaccaatttaagaactacgagcgtcagaaggtgttcctagaggagctgatggcaccagtggccagcatctggctttctcaagacatgcacagagtgctgtcagatgttgatgctttcattgcgtatgtgggtacagatcagaagagctgtgacccaggcctggaggatccgtgtggcttaaaccgtgcacgaatgagcttttgtgtatacagcattctgggtgtggtgaaacgaacttgctggcccactgacctagaagaggccaaagctgggggatttgtggtgggttatacatccagtggaaatccaatcttccgtaacccctgcacagagcagattctgaaacttcttgacaatttgcttgcgcttataagaacccacaatacattatatgcaccagaaatgctagccaaaatggcagagcctttcaccaaggctctggatatgcttgacgcggaaaaatctgctatattaggattacctcaacctctcttggaactcaatgactctcctgtcttcaaaaccgtcttggaaagaatgcagcgtttcttctctaccctctatgaaaactgttttcatatcctagggaaggcaggcccttccatgcagcaagacttctatactgtggaggaccttgctacccagcttctcagctcagcctttgtcaacttgaacaatattcctgactaccgactcagacccatgcttcgggtctttgtaaagcctctggtgctcttctgtcccccagagcactatgaagccctggtatcccccatcctcggacctcttttcacctacctccatatgaggctttctcagaaatggcaagttatcaaccaaaggagcctgctgtgtggagaagatgaggctgcagatgaaaacccagagtctcaagagatgctggaggagcaactggtgaggatgttaacccgagaagtcatggacctaatcacggtttgctgtgtttcaaagaagggtgctgaccacagtagtgctcccccagcagatggagacgatgaagaaatgatggccacagaggtcaccccctcagctatggcagagcttacagacctgggcaaatgtctgatgaagcatgaggatgtttgtacagcgctattaattacagccttcaattccctggcctggaaagatactctgtcctgccagaggacaacctcacagctctgctggcctctcctcaaacaagtgctgtcagggacactgctcgcagatgcagttacgtggcttttcaccagtgtgctgaaaggcttacagatgcacgggcagcacgacgggtgcatggcttccctggtccatctggccttccagatatacgaggcactgcgccccaggtacctggagataagagctgtaatggagcaaatccctgaaatacagaaggactcactggaccagtttgactgcaagcttttaaacccctccctgcagaaagtggctgacaagcgccgaaaggaccaattcaaacgcctcattgctggttgcattgggaaacccttgggagagcagttccgaaaagaagttcacattaagaatcttccctcacttttcaaaaaaacaaagccaatgctggagacggaggtgctggacaatgatgggggtggcctggccaccatctttgaaccctgaatcaagcttttgggcatccttcctcggcctttcttgtcatctcttctttccctttgtagccgatctctaggcccttcttgcactgccacctcactttccaccactgtcagcctggaaagagatccaggtctggagctggagagaacaggccctgtgcaggaccagaagtaattatactaaagtatcaagaaagggagttagggcttaaactattctgtctagatgtcccagatagttcccattctacttggagatttggcttttccaagaaaagctagagcagagcagcccttctcccacaagccctcccacccccgtgcagccacatacctgtacagaatggtaactaagggtgctgtgcccaaccctgcgactagcaaggctcgcagcaagagcacagccctcaactacttgtgccagagtttctcttggaccactccaactcccactgagcccttttgctgctgggctggcaggaaactttccccactccctaaggggcatgtctgggttaggtgctaagtgctgaagagaacttggtcagttctctcaactttgctttgggcaagaatctggtcacctgatgggatccatggtacaggctactgctaaacttggcacagtatcaagtatagtacctccaaggaccagggctgggcagtctttagtgctaacatcccctttagagttcacacatcttgcccttccatgaatgacccctcagtctggcctccccagcctcaaggtccactcaggcacaagagccacagtaccctagatagtgtcacatgacaccgttgtcatccaaggataatacagaccaactaggctacatctgtgatgagcagctagcaaagccgctggtcttctcctaggactaagtccaggtgccttccacaatctcatggtctttcaggtccctggttacttttctcaaaggccatttccaaaagaatacatgccttcacatcacaacctgtactgtgagtccattctagaggtcactgaaaggccctgtaaagagaggacatggatacgggacctggccctgaggttattactggccgtaaggcagagttaatccatacagaaaccagtgtgtccatgtgctctgcacaaaaacagacctgttgtccatccagtccactgacaagagggtttccccgagagccgaagtggactgaagctacagtttttagctggtgcgggccacaggcagggtcagattgagaagaagcaaagctggggaagcagaagttgggagtcttgtgttgctccctcttcctgtgtggtgctctgggtttctgtggatcgtgaaggcgatctcaagagtgtttccctccaaacctgatagctgcctattcctgtctggttggggctgtggaggatgtagttgtatttattgcattgtaatatttttaacatcctgtgacttcatgctagaaattttctattgtttatagaaactttttgtagaaacattaactctaaagcacatctgcatgtcagtaaaaatctcagtttcgtacaga

SEQ ID NO: 447910 - DNA, 296 bp, Homo sapiens
gttcagaggatcccgctgtcagttatagatgtgtcgtgactacccccagctgtgctgcccaattttgacatgctttataaccatgtgaagcaactcctctccaatgagctactcctgacacaaatggagaagtgtgccctcatggaagccctggttctcattagcaaccaatttaagaactacgagcgtcagaaggtgttcctagaggagctgatggcaccagtggccagcatctggctttctcaagacatgcacagagtgctgtcagatgttgatgctggacgacgggtaccgag

SEQ ID NO: 447911 - DNA, 5282 bp, Homo sapiens
gcgcagcgccggcttcttcccagcgcgagttgctgctaacgctcctcctccagcttcccacccccgccgcccgccgcggcccggtaccaacgggtggtctcgccgagggagctgtcgtgcctcgtggtcccgggactgcagtggtgtgcgctctcggcgcgtggcgctaggcatggcgatggatcaagtaaacgcgctgtgcgagcagctggtgaaagcggtgacggtcatgatggaccccaactccacccagcgctaccggctggaagccctcaagttttgtgaggagtttaaagaaaagtgtcctatctgtgtcccctgtggcttgaggttggctgagaaaacacaagttgccatcgtcagacattttggccttcagatcctggaacacgttgtcaagtttcggtggaacggcatgtctcgattggagaaggtgtatctgaagaacagtgtcatggagctgattgcaaatggaacattgaacattttggaagaggagaaccatattaaagatgctctgtctcgaattgtagtggaaatgatcaagcgagagtggccacagcattggcctgacatgctaatagaattggacactctttccaaacaaggggaaacacagacagaattggtgatgtttatccttttgcgactggcagaggatgtagtgacttttcagacacttccccctcaaagaagaagggacatccagcaaacattaacccagaacatggaaaggatcttcagttttctgcttaacacacttcaagaaaatgtaaacaagtatcagcaagtgaagacagatacttctcaggagtcaaaggcgcaagcaaactgtcgagtaggagttgcagcactgaatactctagcaggctatattgactgggtgtctatgagtcacatcactgctgaaaactgtaaactcctggagatactgtgtttgctgttgaatgaacaggaacttcagttgggagccgctgagtgtcttctcattgcagtcagcagaaaaggcaagttggaagaccggaagcccttgatggtcttatttggagatgttgccatgcattatatactctccgccgcacagactgctgatggaggaggtttggtagaaaaacactacgtctttctgaagaggctctgtcaggtgttgtgtgcgctgggcaatcagctgtgtgcattgctgggtgcagattctgatgtagaaacaccatcaaactttggaaaatacctggaatcttttcttgctttcacaacccatccaagtcagtttctacgctcttcaactcagatgacttggggagccctcttcaggcatgaaatcctgtcccgtgatcctttgctattagcaataataccaaaatatcttcgtgcttccatgactaacttggtcaagatgggctttccttctaaaacagacagccctagctgtgaatattctcggtttgattttgatagcgatgaggacttcaatgctttcttcaactcctcccgagcacaacaaggagaggtgatgaggttggcatgtcgtttggatcccaaaactagcttccagatggctggggagtggctaaagtatcaactatcaacttttcttgatgctggttctgtgaattcttgttctgcagttggaactggagaaggaagcctctgttccgtcttctcaccttcattcgtgcagtgggaagccatgactctttttttggaaagtgttatcacccagatgtttcgaacactaaatagagaagaaattcctgttaatgatggaatagagctattgcagatggttctgaactttgataccaaggatcccctcatcctgtcctgcgtccttactaatgtctctgcactctttccatttgtcacctacagaccagagttcctgccccaggtcttctctaagctattttcatctgtcacttttgaaactgttgaagaaagtaaggcccccagaacccgggcagtgaggaatgtgaggaggcatgcttgttcctccatcatcaagatgtgtcgtgactacccccagcttgtgctgcccaattttgacatgctttataaccatgtgaagcaactcctctccaatgagctactcctgacacaaatggagaagtgtgccctcatggaagccctggttctcattagcaaccaatttaagaactacgagcgtcagaaggtgttcctagaggagctgatggcaccagtggccagcatctggctttctcaagacatgcacagagtgctgtcagatgttgatgctttcattgcgtatgtgggtacagatcagaagagctgtgacccaggcctggaggatccgtgtggcttaaaccgtgcacgaatgagcttttgtgtatacagcattctgggtgtggtgaaacgaacttgctggcccactgacctagaagaggccaaagctgggggatttgtggtgggttatacatccagtggaaatccaatcttccgtaacccctgcacagagcagattctgaaacttcttgacaatttgcttgcgcttataagaacccacaatacattatatgcaccagaaatgctagccaaaatggcagagcctttcaccaaggctctggatatgcttgacgcggaaaaatctgctatattaggattacctcaacctctcttggaactcaatgactctcctgtcttcaaaaccgtcttggaaagaatgcagcgtttcttctctaccctctatgaaaactgttttcatatcctagggaaggcaggcccttccatgcagcaagacttctatactgtggaggaccttgctacccagcttctcagctcagcctttgtcaacttgaacaatattcctgactaccgactcagacccatgcttcgggtctttgtaaagcctctggtgctcttctgtcccccagagcactatgaagccctggtatcccccatcctcggacctcttttcacctacctccatatgaggctttctcagaaatggcaagttatcaaccaaaggagcctgctgtgtggagaagatgaggctgcagatgaaaacccagagtctcaagagatgctggaggagcaactgcggtttgctgtgtttcaaagaagggtgctgaccacagtagtgctcccccagcagatggagacgatgaagaaatgatggccacagaggtcaccccctcagctatggcagagcttacagacctgggcaaatgtctgatgaagcatgaggatgtttgtacagcgctattaattacagccttcaattccctggcctggaaagatactctgtcctgccagaggacaacctcacagctctgctggcctctcctcaaacaagtgctgtcagggacactgctcgcagatgcagttacgtggcttttcaccagtgtgctgaaaggcttacagatgcacgggcagcacgacgggtgcatggcttccctggtccatctggccttccagatatacgaggcactgcgccccaggtacctggagataagagctgtaatggagcaaatccctgaaatacagaaggactcactggaccagtttgactgcaagcttttaaacccctccctgcagaaagtggctgacaagcgccgaaaggaccaattcaaacgcctcattgctggttgcattgggaaacccttgggagagcagttccgaaaagaagttcacattaagaatcttccctcacttttcaaaaaaacaaagccaatgctggagacggaggtgctggacaatgatgggggtggcctggccaccatctttgaaccctgaatcaagcttttgggcatccttcctcggcctttcttgtcatctcttctttccctttgtagccgatctctaggcccttcttgcactgccacctcactttccaccactgtcagcctggaaagagatccaggtctggagctggagagaacaggccctgtgcaggaccagaagtaattatactaaagtatcaagaaagggagttagggcttaaactattctgtctagatgtcccagatagttcccattctacttggagatttggcttttccaagaaaagctagagcagagcagcccttctcccacaagccctcccacccccgtgcagccacatacctgtacagaatggtaactaagggtgctgtgcccaaccctgcgactagcaaggctcgcagcaagagcacagccctcaactacttgtgccagagtttctcttggaccactccaactcccactgagcccttttgctgctgggctggcaggaaactttccccactccctaaggggcatgtctgggttaggtgctaagtgctgaagagaacttggtcagttctctcaactttgctttgggcaagaatctggtcacctgatgggatccatggtacaggctactgctaaacttggcacagtatcaagtatagtacctccaaggaccagggctgggcagtctttagtgctaacatcccctttagagttcacacatcttgcccttccatgaatgacccctcagtctggcctccccagcctcaaggtccactcaggcacaagagccacagtaccctagatagtgtcacatgacaccgttgtcatccaaggataatacagaccaactaggctacatctgtgatgagcagctagcaaagccgctggtcttctcctaggactaagtccaggtgccttccacaatctcatggtctttcaggtccctggttacttttctcaaaggccatttccaaaagaatacatgccttcacatcacaacctgtactgtgagtccattctagaggtcactgaaaggccctgtaaagagaggacatggatacgggacctggccctgaggttattactggccgtaaggcagagttaatccatacagaaaccagtgtgtccatgtgctctgcacaaaaacagacctgttgtccatccagtccactgacaagagggtttccccgagagccgaagtggactgaagctacagtttttagctggtgcgggccacaggcagggtcagattgagaagaagcaaagctggggaagcagaagttgggagtcttgtgttgctccctcttcctgtgtggtgctctgggtttctgtggatcgtgaaggcgatctcaagagtgtttccctccaaacctgatagctgcctattcctgtctggttggggctgtggaggatgtagttgtatttattgcattgtaatatttttaacatcctgtgacttcatgctagaaattttctattgtttatagaaactttttgtagaaacattaactctaaagcacatctgcatgtcagtaaaaatctcagtttcgtacaga

SEQ ID NO: 447912 - DNA, 4758 bp, Homo sapiens
gcgcagcgccggcttcttcccagcgcgagttgctgctaacgctcctcctccagcttcccacccccgccgcccgccgcggcccggtaccaacgggtggtctcgccgagggagctgtcgtgcctcgtggtcccgggactgcagtggtgtgcgctctcggcgcgtggcgctaggcatggcgatggatcaagtaaacgcgctgtgcgagcagctggtgaaagcggtgacggtcatgatggaccccaactccacccagcgctaccggctggaagccctcaagttttgtgaggagtttaaagaaaagtgtcctatctgtgtcccctgtggcttgaggttggctgagaaaacacaagttgccatcgtcagacattttggccttcagatcctggaacacgttgtcaagtttcggtggaacggcatgtctcgattggagaaggtgtatctgaagaacagtgtcatggagctgattgcaaatggaacattgaacattttggaagaggagaaccatattaaagatgctctgtctcgaattgtagtggaaatgatcaagcgagagtggccacagcattggcctgacatgctaatagaattggacactctttccaaacaaggggaaacacagacagaattggtgatgtttatccttttgcgactggcagaggatgtagtgacttttcagacacttccccctcaaagaagaagggacatccagcaaacattaacccagaacatggaaaggatcttcagttttctgcttaacacacttcaagaaaatgtaaacaagtatcagcaagtgaagacagatacttctcaggagtcaaaggcgcaagcaaactgtcgagtaggagttgcagcactgaatactctagcaggctatattgactgggtgtctatgagtcacatcactgctgaaaactgtaaactcctggagatactgtgtttgctgttgaatgaacaggaacttcagttgggagccgctgagtgtcttctcattgcagtcagcagaaaaggcaagttggaagaccggaagcccttgatggtcttatttggagatgttgccatgcattatatactctccgccgcacagactgctgatggaggaggtttggtagaaaaacactacgtctttctgaagaggctctgtcaggtgttgtgtgcgctgggcaatcagctgtgtgcattgctgggtgcagattctgatgtagaaacaccatcaaactttggaaaatacctggaatcttttcttgctttcacaacccatccaagtcagtttctacgctcttcaactcagatgacttggggagccctcttcaggcatgaaatcctgtcccgtgatcctttgctattagcaataataccaaaatatcttcgtgcttccatgactaacttggtcaagatgggctttccttctaaaacagacagccctagctgtgaatattctcggtttgattttgatagcgatgaggacttcaatgctttcttcaactcctcccgagcacaacaaggagaggtgatgaggttggcatgtcgtttggatcccaaaactagcttccagatggctggggagtggctaaagtatcaactatcaacttttcttgatgctggttctgtgaattcttgttctgcagttggaactggagaaggaagcctctgttccgtcttctcaccttcattcgtgcagtgggaagccatgactctttttttggaaagtgttatcacccagatgtttcgaacactaaatagagaagaaattcctgttaatgatggaatagagctattgcagatggttctgaactttgataccaaggatcccctcatcctgtcctgcgtccttactaatgtctctgcactctttccatttgtcacctacagaccagagttcctgccccaggtcttctctaagctattttcatctgtcacttttgaaactgttgaagaaagtaaggcccccagaacccgggcagtgaggaatgtgaggaggcatgcttgttcctccatcatcaagatgtgtcgtgactacccccagcttgtgctgcccaattttgacatgctttataaccatgtgaagcaactcctctccaatgagctactcctgacacaaatggagaagtgtgccctcatggaagccctggttctcattagcaaccaatttaagaactacgagcgtcagaaggtgttcctagaggagctgatggcaccagtggccagcatctggctttctcaagacatgcacagagtgctgtcagatgttgatgctttcattgcgtatgtgggtacagatcagaagagctgtgacccaggcctggaggatccgtgtggcttaaaccgtgcacgaatgagcttttgtgtatacagcattctgggtgtggtgaaacgaacttgctggcccactgacctagaagaggccaaagctgggggatttgtggtgggttatacatccagtggaaatccaatcttccgtaacccctgcacagagcagattctgaaacttcttgacaatttgcttgcgcttataagaacccacaatacattatatgcaccagaaatgctagccaaaatggcagagcctttcaccaaggctctggatatgcttgacgcggaaaaatctgctatattaggattacctcaacctctcttggaactcaatgactctcctgtcttcaaaaccgtcttggaaagaatgcagcgtttcttctctaccctctatgaaaactgttttcatatcctagggaaggcaggcccttccatgcagcaagacttctatactgtggaggaccttgctacccagcttctcagctcagcctttgtcaacttgaacaatattcctgactaccgactcagacccatgcttcgggtctttgtaaagcctctggtgctcttctgtcccccagagcactatgaagccctggtatcccccatcctcggacctcttttcacctacctccatatgaggctttctcagaaatggcaagttatcaaccaaaggagcctgctgtgtggagaagatgaggctgcagatgaaaacccagagtctcaagagatgctggaggagcaactggtgaggatgttaacccgagaagtcatggacctaatcacggtttgctgtgtttcaaagaagggtgctgaccacagtagtgctcccccagcagatggagacgatgaagaaatgatggccacagaggtcaccccctcagctatggcagagcttacagacctgggcaaatgtctgatgaagcatgaggatgtttgtacagcgctattaattacagccttcaattccctggcctggaaagatactctgtcctgccagaggacaacctcacagctctgctggcctctcctcaaacaagtgctgtcagggacactgctcgcagatgcagttacgtggcttttcaccagtgtgctgaaaggcttacagatgcacgggcagcacgacgggtgcatggcttccctggtccatctggccttccagatatacgaggcactgcgccccaggtacctggagataagagctgtaatggagcaaatccctgaaatacagaaggactcactggaccagtttgactgcaagcttttaaacccctccctgcagaaagtggctgacaagcgccgaaaggaccaattcaaacgcctcattgctggttgcattgggaaacccttgggagagcagttccgaaaagaagttcacattaagaatcttccctcacttttcaaaaaaacaaagccaatgctggagacggaggtgctggacaatgatgggggtggcctggccaccatctttgaaccctgaatcaagcttttgggcatccttcctcggcctttcttgtcatctcttctttccctttgtagccgatctctaggcccttcttgcactgccacctcactttccaccactgtcagcctggaaagagatccaggtctggagctggagagaacaggccctgtgcaggaccagaagtaattatactaaagtatcaagaaagggagttagggcttaaactattctgtctagatgtcccagatagttcccattctacttggagatttggcttttccaagaaaagctagagcagagcagcccttctcccacaagccctcccacccccgtgcagccacatacctgtacagaatggtaactaagggtgctgtgcccaaccctgcgactagcaaggctcgcagcaagagcacagccctcaactacttgtgccagagtttctcttggaccactccaactcccactgagcccttttgctgctgggctggcaggaaactttccccactccctaaggggcatgtctgggttaggtgctaagtgctgaagagaacttggtcagttctctcaactttgctttgggcaagaatctggtcacctgatgggatccatggtacaggctactgctaaacttggcacagtatcaagtatagtacctccaaggaccagggctgggcagtctttagtgctaacatcccctttagagttcacacatcttgcccttccatgaatgacccctcagtctggcctccccagcctcaaggtccactcaggcacaagagccacagtaccctagatagtgtcacatgacaccgttgtcatccaaggataatacagaccaactaggctacatctgtgatgagcagctagcaaagccgctggtcttctcctaggactaagtccaggtgccttccacaatctcatggtctttcaggtccctggttacttttctcaaaggccatttccaaaagaatacatgccttcacatc

SEQ ID NO: 447913 - DNA, 2629 bp, Homo sapiens
caaccccagctactctgtattcctctgctttattcttcttcatagcagttgtcactacccaacattatgtttttatttatgtattcctttcttacctatctcccatgttagaatgtagactcccatcagggaagggacctattgtcctataccttttatccccagtaactaaatcagtgtctggtgctcaaatatttgtccaacaacaaagtaacttcagtatttgcagcattttgtgtttctgcctagaagctcccatttccctcatgtacagcttgagtgcatctctagaagatcagccatgggcatgggcattatgtggaggtgggagggctcctagtactacttagccaccacttagcctagaacactcagctttgctttgttttttgcgcttctgtcagtacaagatattcttctctgttctgaaaggatggagcttaacattctactctctgataacagatgaagaaatgatggccacagaggtcaccccctcagctatggcagagcttacagacctgggcaaatgtctgatgaagcatgaggatgtttgtacagcgctattaattacagccttcaattccctggcctggaaagatactctgtcctgccagaggacaacctcacagctctgctggcctctcctcaaacaagtgctgtcagggacactgctcgcagatgcagttacgtggcttttcaccagtgtgctgaaaggcttacagatgcacgggcagcacgacgggtgcatggcttccctggtccatctggccttccagatatacgaggcactgcgccccaggtacctggagataagagctgtaatggagcaaatccctgaaatacagaaggactcactggaccagtttgactgcaagcttttaaacccctccctgcagaaagtggctgacaagcgccgaaaggaccaattcaaacgcctcattgctggttgcattgggaaacccttgggagagcagttccgaaaagaagttcacattaagaatcttccctcacttttcaaaaaaacaaagccaatgctggagacggaggtgctggacaatgatgggggtggcctggccaccatctttgaaccctgaatcaagcttttgggcatccttcctcggcctttcttgtcatctcttctttccctttgtagccgatctctaggcccttcttgcactgccacctcactttccaccactgtcagcctggaaagagatccaggtctggagctggagagaacaggccctgtgcaggaccagaagtaattatactaaagtatcaagaaagggagttagggcttaaactattctgtctagatgtcccagatagttcccattctacttggagatttggcttttccaagaaaagctagagcagagcagcccttctcccacaagccctcccacccccgtgcagccacatacctgtacagaatggtaactaagggtgctgtgcccaaccctgcgactagcaaggctcgcagcaagagcacagccctcaactacttgtgccagagtttctcttggaccactccaactcccactgagcccttttgctgctgggctggcaggaaactttccccactccctaaggggcatgtctgggttaggtgctaagtgctgaagagaacttggtcagttctctcaactttgctttgggcaagaatctggtcacctgatgggatccatggtacaggctactgctaaacttggcacagtatcaagtatagtacctccaaggaccagggctgggcagtctttagtgctaacatcccctttagagttcacacatcttgcccttccatgaatgacccctcagtctggcctccccagcctcaaggtccactcaggcacaagagccacagtaccctagatagtgtcacatgacaccgttgtcatccaaggataatacagaccaactaggctacatctgtgatgagcagctagcaaagccgctggtcttctcctaggactaagtccaggtgccttccacaatctcatggtctttcaggtccctggttacttttctcaaaggccatttccaaaagaatacatgccttcacatcacaacctgtactgtgagtccattctagaggtcactgaaaggccctgtaaagagaggacatggatacgggacctggccctgaggttattactggccgtaaggcagagttaatccatacagaaaccagtgtgtccatgtgctctgcacaaaaacagacctgttgtccatccagtccactgacaagagggtttccccgagagccgaagtggactgaagctacagtttttagctggtgcgggccacaggcagggtcagattgagaagaagcaaagctggggaagcagaagttgggagtcttgtgttgctccctcttcctgtgtggtgctctgggtttctgtggatcgtgaaggcgatctcaagagtgtttccctccaaacctgatagctgcctattcctgtctggttggggctgtggaggatgtagttgtatttattgcattgtaatatttttaacatcctgtgacttcatgctagaaattttctattgtttatagaaactttttgtagaaacattaactctaaagcacatctgcatgtcagtaaaaatctcagtttcgtacaga

SEQ ID NO: 447914 - DNA, 2629 bp, Homo sapiens
tagtaggcacactgatgcagatccctggtgtttagcctccccaagccaggcctgagctttgtctccatcctacacatacaggttttctcacattttgattttttctttttgactggcaatacacaaaaatagaggaagtaaactccttttatttttcctgcttagctatttaaaactccagctcctaagccaggcatggtggcacacacctgtagtcccagctattcgggaggcttagatgggagaatagcttgagcccaggagttcaggaccagcctgggcaacaaaacaaacccatctttagagggggggaggaaaaaaaaaaaaccctccggctcctgatgtgtaataatcatcagagaaaactgtgcttctttttccattgtaactcttcatcttttcctgttcaggatgtttgtacagcgctattaattacagccttcaattccctggcctggaaagatactctgtcctgccagaggacaacctcacagctctgctggcctctcctcaaacaagtatggttattcaccccttttccctgcccctcatggaaggtttgggtcatgcagactgactaaatcattcagaagaactggggtgctgaggccttgagagaggccccctgtggccctaaagcacagttgtctccccaggtgctgtcagggacactgctcgcagatgcagttacgtggcttttcaccagtgtgctgaaaggcttacagatgcacgggcagcacgacgggtgcatggcttccctggtccatctggccttccagatatacgaggcactgcgccccaggtacctggagataagagctgtaatggagcaaatccctgaaatacagaaggactcactggaccagtttgactgcaagcttttaaacccctccctgcagaaagtggctgacaagcgccgaaaggaccaattcaaacgcctcattgctggttgcattgggaaacccttgggagagcagttccgaaaagaagttcacattaagaatcttccctcacttttcaaaaaaacaaagccaatgctggagacggaggtgctggacaatgatgggggtggcctggccaccatctttgaaccctgaatcaagcttttgggcatccttcctcggcctttcttgtcatctcttctttccctttgtagccgatctctaggcccttcttgcactgccacctcactttccaccactgtcagcctggaaagagatccaggtctggagctggagagaacaggccctgtgcaggaccagaagtaattatactaaagtatcaagaaagggagttagggcttaaactattctgtctagatgtcccagatagttcccattctacttggagatttggcttttccaagaaaagctagagcagagcagcccttctcccacaagccctcccacccccgtgcagccacatacctgtacagaatggtaactaagggtgctgtgcccaaccctgcgactagcaaggctcgcagcaagagcacagccctcaactacttgtgccagagtttctcttggaccactccaactcccactgagcccttttgctgctgggctggcaggaaactttccccactccctaaggggcatgtctgggttaggtgctaagtgctgaagagaacttggtcagttctctcaactttgctttgggcaagaatctggtcacctgatgggatccatggtacaggctactgctaaacttggcacagtatcaagtatagtacctccaaggaccagggctgggcagtctttagtgctaacatcccctttagagttcacacatcttgcccttccatgaatgacccctcagtctggcctccccagcctcaaggtccactcaggcacaagagccacagtaccctagatagtgtcacatgacaccgttgtcatccaaggataatacagaccaactaggctacatctgtgatgagcagctagcaaagccgctggtcttctcctaggactaagtccaggtgccttccacaatctcatggtctttcaggtccctggttacttttctcaaaggccatttccaaaagaatacatgccttcacatcacaacctgtactgtgagtccattctagaggtcactgaaaggccctgtaaagagaggacatggatacgggacctggccctgaggttattactggccgtaaggcagagttaatccatacagaaaccagtgtgtccatgtgctctgcacaaaaacagacctgttgtccatccagtccactgacaagagggtttccccgagagccgaagtggactgaagctacagtttttagctggtgcgggccacaggcagggtcagattgagaagaagcaaagctggggaagcagaagttgggagtcttgtgttgctccctcttcctgtgtggtgctctgggtttctgtggatcgtgaaggcgatctcaagagtgtttccctccaaacctgatagctgcctattcctgtctggttggggctgtggaggatgtagttgtatttattgcattgtaatatttttaacatcctgtgacttcatgctagaaattttctattgtttatagaaactttttgtagaaacattaactctaaagcacatctgcatgtcagtaaaaatctcagtttcgtacaga

SEQ ID NO: 447915 - DNA, 3616 bp, Homo sapiens
gcgcagcgccggcttcttcccagcgcgagttgctgctaacgctcctcctccagcttcccacccccgccgcccgccgcggcccggtaccaacgggtggtctcgccgagggagctgtcgtgcctcgtggtcccgggactgcagtggtgtgcgctctcggcgcgtggcgctaggcatggcgatggatcaagtaaacgcgctgtgcgagcagctggtgaaagcggtgacggtcatgatggaccccaactccacccagcgctaccggctggaagccctcaagttttgtgaggagtttaaagaaaagtgtcctatctgtgtcccctgtggcttgaggttggctgagaaaacacaagttgccatcgtcagacattttggccttcagatcctggaacacgttgtcaagtttcggtggaacggcatgtctcgattggagaaggtgtatctgaagaacagtgtcatggagctgattgcaaatggaacattgaacattttggaagaggagaaccatattaaagatgctctgtctcgaattgtagtggaaatgatcaagcgagagtggccacagcattggcctgacatgctaatagaattggacactctttccaaacaaggggaaacacagacagaattggtgatgtttatccttttgcgactggcagaggatgtagtgacttttcagacacttccccctcaaagaagaagggacatccagcaaacattaacccagaacatggaaaggatcttcagttttctgcttaacacacttcaagaaaatgtaaacaagtatcagcaagtgaagacagatacttctcaggagtcaaaggcgcaagcaaactgtcgagtaggagttgcagcactgaatactctagcaggctatattgactgggtgtctatgagtcacatcactgctgaaaactgtaaactcctggagatactgtgtttgctgttgaatgaacaggaacttcagttgggagccgctgagtgtcttctcattgcagtcagcagaaaaggcaagttggaagaccggaagcccttgatggtcttatttggagatgttgccatgcattatatactctccgccgcacagactgctgatggaggaggtttggtagaaaaacactacgtctttctgaagaggctctgtcaggtgttgtgtgcgctgggcaatcagctgtgtgcattgctgggtgcagattctgatgtagaaacaccatcaaactttggaaaatacctggaatcttttcttgctttcacaacccatccaagtcagtttctacgctcttcaactcagatgacttggggagccctcttcaggcatgaaatcctgtcccgtgatcctttgctattagcaataataccaaaatatcttcgtgcttccatgactaacttggtcaagatgggctttccttctaaaacagacagccctagctgtgaatattctcggtttgattttgatagcgatgaggacttcaatgctttcttcaactcctcccgagcacaacaaggagaggtgatgaggttggcatgtcgtttggatcccaaaactagcttccagatggctggggagtggctaaagtatcaactatcaacttttcttgatgctggttctgtgaattcttgttctgcagttggaactggagaaggaagcctctgttccgtcttctcaccttcattcgtgcagtgggaagccatgactctttttttggaaagtgttatcacccagatgtttcgaacactaaatagagaagaaattcctgttaatgatggaatagagctattgcagatggttctgaactttgataccaaggatcccctcatcctgtcctgcgtccttactaatgtctctgcactctttccatttgtcacctacagaccagagttcctgccccaggtcttctctaagctattttcatctgtcacttttgaaactgttgaagaaagtaaggcccccagaacccgggcagtgaggaatgtgaggaggcatgcttgttcctccatcatcaagatgtgtcgtgactacccccagcttgtgctgcccaattttgacatgctttataaccatgtgaagcaactcctctccaatgagctactcctgacacaaatggagaagtgtgccctcatggaagccctggttctcattagcaaccaatttaagaactacgagcgtcagaaggtgttcctagaggagctgatggcaccagtggccagcatctggctttctcaagacatgcacagagtgctgtcagatgttgatgctttcattgcgtatgtgggtacagatcagaagagctgtgacccaggcctggaggatccgtgtggcttaaaccgtgcacgaatgagcttttgtgtatacagcattctgggtgtggtgaaacgaacttgctggcccactgacctagaagaggccaaagctgggggatttgtggtgggttatacatccagtggaaatccaatcttccgtaacccctgcacagagcagattctgaaacttcttgacaatttgcttgcgcttataagaacccacaatacattatatgcaccagaaatgctagccaaaatggcagagcctttcaccaaggctctggatatgcttgacgcggaaaaatctgctatattaggattacctcaacctctcttggaactcaatgactctcctgtcttcaaaaccgtcttggaaagaatgcagcgtttcttctctaccctctatgaaaactgttttcatatcctagggaaggcaggcccttccatgcagcaagacttctatactgtggaggaccttgctacccagcttctcagctcagcctttgtcaacttgaacaatattcctgactaccgactcagacccatgcttcgggtctttgtaaagcctctggtgctcttctgtcccccagagcactatgaagccctggtatcccccatcctcggacctcttttcacctacctccatatgaggctttctcagaaatggcaagttatcaaccaaaggagcctgctgtgtggagaagatgaggctgcagatgaaaacccagagtctcaagagatgctggaggagcaactggtgaggatgttaacccgagaagtcatggacctaatcacggtttgctgtgtttcaaagaagggtgctgaccacagtagtgctcccccagcagatggagacgatgaagaaatgatggccacagaggtcaccccctcagctatggcagagcttacagacctgttgtccatccagtccactgacaagagggtttccccgagagccgaagtggactgaagctacagtttttagctggtgcgggccacaggcagggtcagattgagaagaagcaaagctggggaagcagaagttgggagtcttgtgttgctccctcttcctgtgtggtgctctgggtttctgtggatcgtgaaggcgatctcaagagtgtttccctccaaacctgatagctgcctattcctgtctggttggggctgtggaggatgtagttgtatttattgcattgtaatatttttaacatcctgtgacttcatgctagaaattttctattgtttatagaaactttttgtagaaacattaactctaaagcacatctgcatgtcagtaaaaatctcagtttcgtacaga

SEQ ID NO: 447916 - DNA, 4226 bp, Homo sapiens
gcgcagcgccggcttcttcccagcgcgagttgctgctaacgctcctcctccagcttcccacccccgccgcccgccgcggcccggtaccaacgggtggtctcgccgagggagctgtcgtgcctcgtggtcccgggactgcagtggtgtgcgctctcggcgcgtggcgctaggcatggcgatggatcaagtaaacgcgctgtgcgagcagctggtgaaagcggtgacggtcatgatggaccccaactccacccagcgctaccggctggaagccctcaagttttgtgaggagtttaaagaaaagtgtcctatctgtgtcccctgtggcttgaggttggctgagaaaacacaagttgccatcgtcagacattttggccttcagatcctggaacacgttgtcaagtttcggtggaacggcatgtctcgattggagaaggtgtatctgaagaacagtgtcatggagctgattgcaaatggaacattgaacattttggaagaggagaaccatattaaagatgctctgtctcgaattgtagtggaaatgatcaagcgagagtggccacagcattggcctgacatgctaatagaattggacactctttccaaacaaggggaaacacagacagaattggtgatgtttatccttttgcgactggcagaggatgtagtgacttttcagacacttccccctcaaagaagaagggacatccagcaaacattaacccagaacatggaaaggatcttcagttttctgcttaacacacttcaagaaaatgtaaacaagtatcagcaagtgaagacagatacttctcaggagtcaaaggcgcaagcaaactgtcgagtaggagttgcagcactgaatactctagcaggctatattgactgggtgtctatgagtcacatcactgctgaaaactgtaaactcctggagatactgtgtttgctgttgaatgaacaggaacttcagttgggagccgctgagtgtcttctcattgcagtcagcagaaaaggcaagttggaagaccggaagcccttgatggtcttatttggagatgttgccatgcattatatactctccgccgcacagactgctgatggaggaggtttggtagaaaaacactacgtctttctgaagaggctctgtcaggtgttgtgtgcgctgggcaatcagctgtgtgcattgctgggtgcagattctgatgtagaaacaccatcaaactttggaaaatacctggaatcttttcttgctttcacaacccatccaagtcagtttctacgctcttcaactcagatgacttggggagccctcttcaggcatgaaatcctgtcccgtgatcctttgctattagcaataataccaaaatatcttcgtgcttccatgactaacttggtcaagatgggctttccttctaaaacagacagccctagctgtgaatattctcggtttgattttgatagcgatgaggacttcaatgctttcttcaactcctcccgagcacaacaaggagaggtgatgaggttggcatgtcgtttggatcccaaaactagcttccagatggctggggagtggctaaagtatcaactatcaacttttcttgatgctggttctgtgaattcttgttctgcagttggaactggagaaggaagcctctgttccgtcttctcaccttcattcgtgcagtgggaagccatgactctttttttggaaagtgttatcacccagatgtttcgaacactaaatagagaagaaattcctgttaatgatggaatagagctattgcagatggttctgaactttgataccaaggatcccctcatcctgtcctgcgtccttactaatgtctctgcactctttccatttgtcacctacagaccagagttcctgccccaggtcttctctaagctattttcatctgtcacttttgaaactgttgaagaaagtaaggcccccagaacccgggcagtgaggaatgtgaggaggcatgcttgttcctccatcatcaagatgtgtcgtgactacccccagcttgtgctgcccaattttgacatgctttataaccatgtgaagcaactcctctccaatgagctactcctgacacaaatggagaagtgtgccctcatggaagccctggttctcattagcaaccaatttaagaactacgagcgtcagaaggtgttcctagaggagctgatggcaccagtggccagcatctggctttctcaagacatgcacagagtgctgtcagatgttgatgctttcattgcgtatgtgggtacagatcagaagagctgtgacccaggcctggaggatccgtgtggcttaaaccgtgcacgaatgagcttttgtgtatacagcattctgggtgtggtgaaacgaacttgctggcccactgacctagaagaggccaaagctgggggatttgtggtgggttatacatccagtggaaatccaatcttccgtaacccctgcacagagcagattctgaaacttcttgacaatttgcttgcgcttataagaacccacaatacattatatgcaccagaaatgctagccaaaatggcagagcctttcaccaaggctctggatatgcttgacgcggaaaaatctgctatattaggattacctcaacctctcttggaactcaatgactctcctgtcttcaaaaccgtcttggaaagaatgcagcgtttcttctctaccctctatgaaaactgttttcatatcctagggaaggcaggcccttccatgcagcaagacttctatactgtggaggaccttgctacccagcttctcagctcagcctttgtcaacttgaacaatattcctgactaccgactcagacccatgcttcgggtctttgtaaagcctctggtgctcttctgtcccccagagcactatgaagccctggtatcccccatcctcggacctcttttcacctacctccatatgaggctttctcagaaatggcaagttatcaaccaaaggagcctgctgtgtggagaagatgaggctgcagatgaaaacccagagtctcaagagatgctggaggagcaactggtgaggatgttaacccgagaagtcatggacctaatcacggtttgctgtgtttcaaagaagggtgctgaccacagtagtgctcccccagcagatggagacgatgaagaaatgatggccacagaggtcaccccctcagctatggcagagcttacagacctgttgtccatccagtccactgacaagagggtttccccgagagccgaagtggactgaagctacagtttttagctggtgcgggccacaggcagggtcagattgagaagaagcaaagctggggaagcagaagttgggagtcttgtgttgctccctcttcctgtgtggtgctctgggtttctgtggatcgtgaaggcgatctcaagagtgtttccctccaaacctgatagctgcctattcctgtctggttggggctgtggaggatgtagttgtatttattgcattgtaatatttttaacatcctgtgacttcatgctagaaattttctattgtttatagaaactttttgtagaaacattaactctaaagcacatctgcatgtcagtaaaaatctcagtttcgtacagaaagggacccatctgcctttttcaacctagtcttaaaaccagtgacatactccagggttacttcatgagcacccgggactaaaacaggaagaaatgtgactgatgattctggtctttcaagctttctgaaatggtgtgccagttagaaaaggatttctattcctgacatacccagactaggcagcccataccattctcacagtgtctttcgtgtgtggctgctgggcctggcccacaggaattgctactgttctttgttggagctgtcaatagcaacatgaacttccctggtaaaccaggagataggtgaagtggcacattcactctagcttgaatgtttttctagggtttggctgtgctcccagaaaccaccttaatttgccaattctcaggaggtgttctttctgttgtttttgaaacagggtctcactgttacccgggctggagtgcacatctgatgttcttaattggtaaatgctaaaccagttctgaagtgaggccccctgtttttcgcggtggctcacacctgtaatcccaacactttgggaggccccaaggcaggcgtatcacttgaggtcaggagtttgacaccagcctgaccaacatggtga

SEQ ID NO: 447917 - DNA, 2891 bp, Homo sapiens
gcgcagcgccggcttcttcccagcgcgagttgctgctaacgctcctcctccagcttcccacccccgccgcccgccgcggcccggtaccaacgggtggtctcgccgagggagctgtcgtgcctcgtggtcccgggactgcagtggtgtgcgctctcggcgcgtggcgctaggcatggcgatggatcaagtaaacgcgctgtgcgagcagctggtgaaagcggtgacggtcatgatggaccccaactccacccagcgctaccggctggaagccctcaagttttgtgaggagtttaaagaaaagtgtcctatctgtgtcccctgtggcttgaggttggctgagaaaacacaagttgccatcgtcagacattttggccttcagatcctggaacacgttgtcaagtttcggtggaacggcatgtctcgattggagaaggtgtatctgaagaacagtgtcatggagctgattgcaaatggaacattgaacattttggaagaggagaaccatattaaagatgctctgtctcgaattgtagtggaaatgatcaagcgagagtggccacagcattggcctgacatgctaatagaattggacactctttccaaacaaggggaaacacagacagaattggtgatgtttatccttttgcgactggcagaggatgtagtgacttttcagacacttccccctcaaagaagaagggacatccagcaaacattaacccagaacatggaaaggatcttcagttttctgcttaacacacttcaagaaaatgtaaacaagtatcagcaagtgaagacagatacttctcaggagtcaaaggcgcaagcaaactgtcgagtaggagttgcagcactgaatactctagcaggctatattgactgggtgtctatgagtcacatcactgctgaaaactgtaaactcctggagatactgtgtttgctgttgaatgaacaggaacttcagttgggagccgctgagtgtcttctcattgcagtcagcagaaaaggcaagttggaagaccggaagcccttgatggtcttatttggagatgttgccatgcattatatactctccgccgcacagactgctgatggaggaggtttggtagaaaaacactacgtctttctgaagaggctctgtcaggtgttgtgtgcgctgggcaatcagctgtgtgcattgctgggtgcagattctgatgtagaaacaccatcaaactttggaaaatacctggaatcttttcttgctttcacaacccatccaagtcagtttctacgctcttcaactcagatgacttggggagccctcttcaggcatgaaatcctgtcccgtgatcctttgctattagcaataataccaaaatatcttcgtgcttccatgactaacttggtcaagatgggctttccttctaaaacagacagccctagctgtgaatattctcggtttgattttgatagcgatgaggacttcaatgctttcttcaactcctcccgagcacaacaaggagaggtgatgaggttggcatgtcgtttggatcccaaaactagcttccagatggctggggagtggctaaagtatcaactatcaacttttcttgatgctggttctgtgaattcttgttctgcagttggaactggagaaggaagcctctgttccgtcttctcaccttcattcgtgcagtgggaagccatgactctttttttggaaagtgttatcacccagatgtttcgaacactaaatagagaagaaattcctgttaatgatggaatagagctattgcagatggttctgaactttgataccaaggatcccctcatcctgtcctgcgtccttactaatgtctctgcactctttccatttgtcacctacagaccagagttcctgccccaggtcttctctaagctattttcatctgtcacttttgaaactgttgaagaaagtaaggcccccagaacccgggcagtgaggaatgtgaggaggcatgcttgttcctccatcatcaagatgtgtcgtgactacccccagcttgtgctgcccaattttgacatgctttataaccatgtgaagcaactcctctccaatgagctactcctgacacaaatggagaagtgtgccctcatggaagccctggttctcattagcaaccaatttaagaactacgagcgtcagaaggtgttcctagaggagctgatggcaccagtggccagcatctggctttctcaagacatgcacagagtgctgtcagatgttgatgctttcattgcgtatgtgggtacagatcagaagagctgtgacccaggcctggaggatccgtgtggcttaaaccgtgcacgaatgagcttttgtgtatacagcattctgggtgtggtgaaacgaacttgctggcccactgacctagaagaggccaaagctgggggatttgtggtgggttatacatccagtggaaatccaatcttccgtaacccctgcacagagcagattctgaaacttcttgacaatttgcttgcgcttataaggtgagtcagaataatggcttttctctgttgttttctactttaccttaaaaatttcaaaagtttagtctgtttacatgtcttcatatcttagtggtattaatgagggattgatttaagtcttatttctttctagagggtgtctcagttttggataatcccgggcttttcccattttgagcctcctctttgttgttcttccatttctttatacttcatccctatttttacttgtaagttttatttggtctaaattttttagtaaaggaattgctcattgggagcagggcagttgccttctataatgatgcttgtctaggtggtattcatatgagctaatctgaatttatcaatactgagtctgagctcagatgaaccaa

SEQ ID NO: 447918 - DNA, 845 bp, Homo sapiens
tgtaatgaattctgccactaagagaaaatgaatacaatctctttcttcacttctgaaataagattagctgtgatcttataggtgtctataaactcaaggtgatggtggtggttgcagaccatgacctgagccactacagaactggaagttccacttctttacctcaaatttctgtattcttgtatttctatattttgctttttttctaaatgacagataatgtataattgatagatagaatatgtgtagaataagtgccacattaacatggaaactatagaaatgtctgcattttacttggtttattttaccctcattttgttggagagaaaaagatacacattggtttcttcctatttttcccagctattgacctgaaaagtggttctggaaaagtgtaccaaggccctgcaaaaggtgctgctgatacaacaatcatactttcagatgaagatttcatggaggtggtcctgggcaagcttgaccctcagaaggcattctttagtggcaggctgaaggccagagggaacatcatgctgagccagaaacttcagatgattcttaaagactacgccaagctctgaagggcacactacactattaataaaaatggaatcattaaatactctcttcacccaaatatgcttgattattctgcaaaagtgattagaactaagatgcaggggaaattgcttaacattttcagatatcagataactgcagattttcattttctactaatttttcatgtatcattatttttacaaggaactatatataagctagcacataattatccttctgttcttagatctgtatcttcataataaaaaaattttgcccaa

SEQ ID NO: 447919 - DNA, 546 bp, Homo sapiens
  misc_feature (3)..(3): n is a, c, g, or t
  misc_feature (20)..(20): n is a, c, g, or t
  misc_feature (29)..(29): n is a, c, g, or t
  misc_feature (45)..(45): n is a, c, g, or t
  misc_feature (60)..(60): n is a, c, g, or t
agnaaaaacccttggggggngggagtttnagacacctttgtattngaggaaatatggggntaagtggctattgacctgaaaagtggttctggaaaagtgtaccaaggccctgcaaaaggtgctgctgatacaacaatcatactttcagatgaagatttcatggaggtggtcctgggcaagcttgaccctcagaaggcattctttagtggcaggctgaaggccagagggaacatcatgctgagccagaaacttcagatgattcttaaagactacgccaagctctgaagggcacactacactattaataaaaatggaatcattaaatactctcttcacccaaatatgcttgattattctgcaaaagtgattagaactaagatgcaggggaaattgcttaacattttcagatatcagataactgcagattttcattttctactaatttttcatgtatcattatttttacaaggaactatatataagctagcacataattatccttctgttcttagatctgtatcttcataataaaaaaattttgcccaa

SEQ ID NO: 447920 - DNA, 564 bp, Homo sapiens
cactgtcttccacagtggttgaactaatttacactcccaccaacagtgtaaaagcgttcttatttctccacatcctctgcagcatctgttgttcaggaacactatttcaaaccatagttttttagttttgctgagcttacagtggaaatgctattaaattctttcacatcttattatagtaatctttggtttttaagacactgtatttcttttacttttctttctaggaaaattaaaatgtgaagcagttgttgctgatgtcctagataaaggatccggtgtagtgattattatggatggtaatttatttacaattcttataataatattgttagattgataggctttgtgtatgacataatacttcaccatagaagttgattaataagttagtatttgtcttccaatttgttagaaaacaagataagcatttttatataactggctttaacttttcttttgacaggccaagccttggttctaaactgtttcctttttgactgttaaaacaccgaggacgcatgcaccggaactttcttggtttttttttggctcccccattgg

SEQ ID NO: 447921 - DNA, 2551 bp, Homo sapiens
attccccgcctcctcctgtcccgcagtcggcgtccagcggctctgcttgttcgtgtgtgtgtcgttgcaggccttattcatgggctcaccgctgaggttcgacgggcgggtggtactggtcaccggcgcgggggcaggattgggccgagcctatgccctggcttttgcagaaagaggagcgttagttgttgtgaatgatttgggaggggacttcaaaggagttggtaaaggctccttagctgctgataaggttgttgaagaaataagaaggagaggtggaaaagcagtggccaactatgattcagtggaagaaggagagaaggttgtgaagacagccctggatgcttttggaagaatagatgttgtggtcaacaatgctggaattctgagggatcgttcctttgctaggataagtgatgaagactgggatataatccacagagttcatttgcggggttcattccaagtgacacgggcagcatgggaacacatgaagaaacagaagtatggaaggattattatgacttcatcagcttcaggaatatatggcaactttggccaggccaattatagtgctgcaaagttgggtcttctgggccttgcaaattctcttgcaattgaaggcaggaaaagcaacattcattgtaacaccattgctcctaatgcgggatcacggatgactcagacagttatgcctgaagatcttgtggaagccctgaagccagagtatgtggcacctcttgtcctttggctttgtcacgagagttgtgaggagaatggtggcttgtttgaggttggagcaggatggattggaaaattacgctgggagcggactcttggagctattgtaagacaaaagaatcacccaatgactcctgaggcagtcaaggctaactggaagaagatctgtgactttgagaatgccagcaagcctcagagtatccaagaatcaactggcagtataattgaagttctgagtaaaatagattcagaaggaggagtttcagcaaatcatactagtcgtgcaacgtctacagcaacatcaggatttgctggagctattggccagaaactccctccattttcttatgcttatacggaactggaagctattatgtatgcccttggagtgggagcgtcaatcaaggatccaaaagatttgaaatttatttatgaaggaagttctgatttctcctgtttgcccaccttcggagttatcataggtcagaaatctatgatgggtggaggattagcagaaattcctggactttcaatcaactttgcaaaggttcttcatggagagcagtacttagagttatataaaccacttcccagagcaggaaaattaaaatgtgaagcagttgttgctgatgtcctagataaaggatccggtgtagtgattattatggatgtctattcttattctgagaaggaacttatatgccacaatcagttctctctctttcttgttggctctggaggctttggtggaaaacggacatcagacaaagtcaaggtagctgtagccatacctaatagacctcctgatgctgtacttacagataccacctctcttaatcaggctgctttgtaccgcctcagtggagactggaatcccttacacattgatcctaactttgctagtctagcaggttttgacaagcccatattacatggattatgtacatttggattttctgccaggcgtgtgttacagcagtttgcagataatgatgtgtcaagattcaaggcaattaaggctcgttttgcaaaaccagtatatccaggacaaactctacaaactgagatgtggaaggaaggaaacagaattcattttcaaaccaaggtccaagaaactggagacattgtcatttcaaatgcatatgtggatcttgcaccaacatctggtacttcagctaagacaccctctgagggcgggaagcttcagagtacctttgtatttgaggaaataggacgccgcctaaaggatattgggcctgaggtggtgaagaaagtaaatgctgtatttgagtggcatataaccaaaggcggaaatattggggctaagtggactattgacctgaaaagtggttctggaaaagtgtaccaaggccctgcaaaaggtgctgctgatacaacaatcatactttcagatgaagatttcatggaggtggtcctgggcaagcttgaccctcagaaggcattctttagtggcaggctgaaggccagagggaacatcatgctgagccagaaacttcagatgattcttaaagactacgccaagctctgaagggcacactacactattaataaaaatggaatcattaaatactctcttcacccaaatatgcttgattattctgcaaaagtgattagaactaagatgcaggggaaattgcttaacattttcagatatcagataactgcagattttcattttctactaatttttcatgtatcattatttttacaaggaactatatataagctagcacataattatccttctgttcttagatctgtatcttcataataaaaaaattttgcccaa

SEQ ID NO: 447922 - DNA, 2550 bp, Homo sapiens
catctcttgaggaggaaagagccggaaacacctggtctctcaagcaggattgggccgagcctatgccctggcttttgcagaaagaggagcgttagttgttgtgaatgatttgggaggggacttcaaaggagttggtaaaggctccttagctgctgataaggttgttgaagaaataagaaggagaggtggaaaagcagtggccaactatgattcagtggaagaaggagagaaggttgtgaagacagccctggatgcttttggaagaatagatgttgtggtcaacaatgctggaattctgagggatcgttcctttgctaggataagtgatgaagactgggatataatccacagagttcatttgcggggttcattccaagtgacacgggcagcatgggaacacatgaagaaacagaagtatggaaggattattatgacttcatcagcttcaggaatatatggcaactttggccaggccaattatagtgctgcaaagttgggtcttctgggccttgcaaattctcttgcaattgaaggcaggaaaagcaacattcattgtaacaccattgctcctaatgcgggatcacggatgactcagacagttatgcctgaagatcttgtggaagccctgaagccagagtatgtggcacctcttgtcctttggctttgtcacgagagttgtgaggagaatggtggcttgtttgaggttggagcaggatggattggaaaattacgctgggagcggactcttggagctattgtaagacaaaagaatcacccaatgactcctgaggcagtcaaggctaactggaagaagatctgtgactttgagaatgccagcaagcctcagagtatccaagaatcaactggcagtataattgaagttctgagtaaaatagattcagaaggaggagtttcagcaaatcatactagtcgtgcaacgtctacagcaacatcaggatttgctggagctattggccagaaactccctccattttcttatgcttatacggaactggaagctattatgtatgcccttggagtgggagcgtcaatcaaggatccaaaagatttgaaatttatttatgaaggaagttctgatttctcctgtttgcccaccttcggagttatcataggtcagaaatctatgatgggtggaggattagcagaaattcctggactttcaatcaactttgcaaaggttcttcatggagagcagtacttagagttatataaaccacttcccagagcaggaaaattaaaatgtgaagcagttgttgctgatgtcctagataaaggatccggtgtagtgattattatggatgtctattcttattctgagaaggaacttatatgccacaatcagttctctctctttcttgttggctctggaggctttggtggaaaacggacatcagacaaagtcaaggtagctgtagccatacctaatagacctcctgatgctgtacttacagataccacctctcttaatcaggctgctttgtaccgcctcagtggagactggaatcccttacacattgatcctaactttgctagtctagcaggttttgacaagcccatattacatggattatgtacatttggattttctgccaggcgtgtgttacagcagtttgcagataatgatgtgtcaagattcaaggcaattaaggctcgttttgcaaaaccagtatatccaggacaaactctacaaactgagatgtggaaggaaggaaacagaattcattttcaaaccaaggtccaagaaactggagacattgtcatttcaaatgcatatgtggatcttgcaccaacatctggtacttcagctaagacaccctctgagggcgggaagcttcagagtacctttgtatttgaggaaataggacgccgcctaaaggatattgggcctgaggtggtgaagaaagtaaatgctgtatttgagtggcatataaccaaaggcggaaatattggggctaagtggactattgacctgaaaagtggttctggaaaagtgtaccaaggccctgcaaaaggtgctgctgatacaacaatcatactttcagatgaagatttcatggaggtggtcctgggcaagcttgaccctcagaaggcattctttagtggcaggctgaaggccagagggaacatcatgctgagccagaaacttcagatgattcttaaagactacgccaagctctgaagggcacactacactattaataaaaatggaatcattaaatactctcttcacccaaatatgcttgattattctgcaaaagtgattagaactaagatgcaggggaaattgcttaacattttcagatatcagataactgcagattttcattttctactaatttttcatgtatcattatttttacaaggaactatatataagctagcacataattatccttctgttcttagatctgtatcttcataataaaaaaattttgcccaagtcctgtttccttagaatttgtgatagcattgataagttgaaaggaaaattaaatcaataaaggcctttgatacctttaaaaattggaa

SEQ ID NO: 447923 - DNA, 2371 bp, Homo sapiens
agaagagttagtgtctttgatttagaattaagctaagaagagcttttagtttctgcttcccttgtaacaactggggtaaaaaagaagctgagaaagataggatttgctggcaaagggggcctatgttggtgcttttcttggtgctgcaacgggactgagatataatccacagagttcatttgcggggttcattccaagtgacacgggcagcatgggaacacatgaagaaacagaagtatggaaggattattatgacttcatcagcttcaggaatatatggcaactttggccaggccaattatagtgctgcaaagttgggtcttctgggccttgcaaattctcttgcaattgaaggcaggaaaagcaacattcattgtaacaccattgctcctaatgcgggatcacggatgactcagacagttatgcctgaagatcttgtggaagccctgaagccagagtatgtggcacctcttgtcctttggctttgtcacgagagttgtgaggagaatggtggcttgtttgaggttggagcaggatggattggaaaattacgctgggagcggactcttggagctattgtaagacaaaagaatcacccaatgactcctgaggcagtcaaggctaactggaagaagatctgtgactttgagaatgccagcaagcctcagagtatccaagaatcaactggcagtataattgaagttctgagtaaaatagattcagaaggaggagtttcagcaaatcatactagtcgtgcaacgtctacagcaacatcaggatttgctggagctattggccagaaactccctccattttcttatgcttatacggaactggaagctattatgtatgcccttggagtgggagcgtcaatcaaggatccaaaagatttgaaatttatttatgaaggaagttctgatttctcctgtttgcccaccttcggagttatcataggtcagaaatctatgatgggtggaggattagcagaaattcctggactttcaatcaactttgcaaaggttcttcatggagagcagtacttagagttatataaaccacttcccagagcaggaaaattaaaatgtgaagcagttgttgctgatgtcctagataaaggatccggtgtagtgattattatggatgtctattcttattctgagaaggaacttatatgccacaatcagttctctctctttcttgttggctctggaggctttggtggaaaacggacatcagacaaagtcaaggtagctgtagccatacctaatagacctcctgatgctgtacttacagataccacctctcttaatcaggctgctttgtaccgcctcagtggagactggaatcccttacacattgatcctaactttgctagtctagcaggttttgacaagcccatattacatggattatgtacatttggattttctgccaggcgtgtgttacagcagtttgcagataatgatgtgtcaagattcaaggcaattaaggctcgttttgcaaaaccagtatatccaggacaaactctacaaactgagatgtggaaggaaggaaacagaattcattttcaaaccaaggtccaagaaactggagacattgtcatttcaaatgcatatgtggatcttgcaccaacatctggtacttcagctaagacaccctctgagggcgggaagcttcagagtacctttgtatttgaggaaataggacgccgcctaaaggatattgggcctgaggtggtgaagaaagtaaatgctgtatttgagtggcatataaccaaaggcggaaatattggggctaagtggactattgacctgaaaagtggttctggaaaagtgtaccaaggccctgcaaaaggtgctgctgatacaacaatcatactttcagatgaagatttcatggaggtggtcctgggcaagcttgaccctcagaaggcattctttagtggcaggctgaaggccagagggaacatcatgctgagccagaaacttcagatgattcttaaagactacgccaagctctgaagggcacactacactattaataaaaatggaatcattaaatactctcttcacccaaatatgcttgattattctgcaaaagtgattagaactaagatgcaggggaaattgcttaacattttcagatatcagataactgcagattttcattttctactaatttttcatgtatcattatttttacaaggaactatatataagctagcacataattatccttctgttcttagatctgtatcttcataataaaaaaattttgcccaagtcctgtttccttagaatttgtgatagcattgataagttgaaaggaaaattaaatcaataaaggcctttgatacctttaaaaattggaa

SEQ ID NO: 447924 - DNA, 2169 bp, Homo sapiens
aaaccggttacgcctgagtgccctggttgttgtgcttgacaatttctgtgtcgactgaggcgcagtcggcgtccagcggctctgcttgttcgtgtgtgtgtcgttgcaggccttattcatgggctcaccgctgaggttcgacgggcgggtggtactggtcaccggcgcgggggcaggattgggccgagcctatgccctggcttttgcagaaagaggagcgttagttgttgatcttgtggaagccctgaagccagagtatgtggcacctcttgtcctttggctttgtcacgagagttgtgaggagaatggtggcttgtttgaggttggagcaggatggattggaaaattacgctgggagcggactcttggagctattgtaagacaaaagaatcacccaatgactcctgaggcagtcaaggctaactggaagaagatctgtgactttgagaatgccagcaagcctcagagtatccaagaatcaactggcagtataattgaagttctgagtaaaatagattcagaaggaggagtttcagcaaatcatactagtcgtgcaacgtctacagcaacatcaggatttgctggagctattggccagaaactccctccattttcttatgcttatacggaactggaagctattatgtatgcccttggagtgggagcgtcaatcaaggatccaaaagatttgaaatttatttatgaaggaagttctgatttctcctgtttgcccaccttcggagttatcataggtcagaaatctatgatgggtggaggattagcagaaattcctggactttcaatcaactttgcaaaggttcttcatggagagcagtacttagagttatataaaccacttcccagagcaggaaaattaaaatgtgaagcagttgttgctgatgtcctagataaaggatccggtgtagtgattattatggatgtctattcttattctgagaaggaacttatatgccacaatcagttctctctctttcttgttggctctggaggctttggtggaaaacggacatcagacaaagtcaaggtagctgtagccatacctaatagacctcctgatgctgtacttacagataccacctctcttaatcaggctgctttgtaccgcctcagtggagactggaatcccttacacattgatcctaactttgctagtctagcaggttttgacaagcccatattacatggattatgtacatttggattttctgccaggcgtgtgttacagcagtttgcagataatgatgtgtcaagattcaaggcaattaaggctcgttttgcaaaaccagtatatccaggacaaactctacaaactgagatgtggaaggaaggaaacagaattcattttcaaaccaaggtccaagaaactggagacattgtcatttcaaatgcatatgtggatcttgcaccaacatctggtacttcagctaagacaccctctgagggcgggaagcttcagagtacctttgtatttgaggaaataggacgccgcctaaaggatattgggcctgaggtggtgaagaaagtaaatgctgtatttgagtggcatataaccaaaggcggaaatattggggctaagtggactattgacctgaaaagtggttctggaaaagtgtaccaaggccctgcaaaaggtgctgctgatacaacaatcatactttcagatgaagatttcatggaggtggtcctgggcaagcttgaccctcagaaggcattctttagtggcaggctgaaggccagagggaacatcatgctgagccagaaacttcagatgattcttaaagactacgccaagctctgaagggcacactacactattaataaaaatggaatcattaaatactctcttcacccaaatatgcttgattattctgcaaaagtgattagaactaagatgcaggggaaattgcttaacattttcagatatcagataactgcagattttcattttctactaatttttcatgtatcattatttttacaaggaactatatataagctagcacataattatccttctgttcttagatctgtatcttcataataaaaaaattttgcccaagtcctgtttccttagaatttgtgatagcattgataagttgaaaggaaaattaaatcaataaaggcctttgatacctttaaaaattggaa

SEQ ID NO: 447925 - DNA, 2313 bp, Homo sapiens
agaagagttagtgtctttgatttagaattaagctaagaagagcttttagtttctgcttcccttgtaacaactggggtaaaaaagaagctgagaaagataggatttgctggcaaagggggcctatgttggtgcttttcttggtgctgcaacgggactgagatataatccacagagttcatttgcggggttcattccaagtgacacgggcagcatgggaacacatgaagaaacagaagtatggaaggattattatgacttcatcagcttcaggaatatatggcaactttggccaggccaattatagtgctgcaaagttgggtcttctgggccttgcaaattctcttgcaattgaaggcaggaaaagcaacattcattgtaacaccattgctcctaatgcgggatcacggatgactcagacagttatgcctgaagatcttgtggaagccctgaagccagagtatgtggcacctcttgtcctttggctttgtcacgagagttgtgaggagaatggtggcttgtttgaggttggagcaggatggattggaaaattacgctgggagcggactcttggagctattgtaagacaaaagaatcacccaatgactcctgaggcagtcaagaatcaactggcagtataattgaagttctgagtaaaatagattcagaaggaggagtttcagcaaatcatactagtcgtgcaacgtctacagcaacatcaggatttgctggagctattggccagaaactccctccattttcttatgcttatacggaactggaagctattatgtatgcccttggagtgggagcgtcaatcaaggatccaaaagatttgaaatttatttatgaaggaagttctgatttctcctgtttgcccaccttcggagttatcataggtcagaaatctatgatgggtggaggattagcagaaattcctggactttcaatcaactttgcaaaggttcttcatggagagcagtacttagagttatataaaccacttcccagagcaggaaaattaaaatgtgaagcagttgttgctgatgtcctagataaaggatccggtgtagtgattattatggatgtctattcttattctgagaaggaacttatatgccacaatcagttctctctctttcttgttggctctggaggctttggtggaaaacggacatcagacaaagtcaaggtagctgtagccatacctaatagacctcctgatgctgtacttacagataccacctctcttaatcaggctgctttgtaccgcctcagtggagactggaatcccttacacattgatcctaactttgctagtctagcaggttttgacaagcccatattacatggattatgtacatttggattttctgccaggcgtgtgttacagcagtttgcagataatgatgtgtcaagattcaaggcaattaaggctcgttttgcaaaaccagtatatccaggacaaactctacaaactgagatgtggaaggaaggaaacagaattcattttcaaaccaaggtccaagaaactggagacattgtcatttcaaatgcatatgtggatcttgcaccaacatctggtacttcagctaagacaccctctgagggcgggaagcttcagagtacctttgtatttgaggaaataggacgccgcctaaaggatattgggcctgaggtggtgaagaaagtaaatgctgtatttgagtggcatataaccaaaggcggaaatattggggctaagtggactattgacctgaaaagtggttctggaaaagtgtaccaaggccctgcaaaaggtgctgctgatacaacaatcatactttcagatgaagatttcatggaggtggtcctgggcaagcttgaccctcagaaggcattctttagtggcaggctgaaggccagagggaacatcatgctgagccagaaacttcagatgattcttaaagactacgccaagctctgaagggcacactacactattaataaaaatggaatcattaaatactctcttcacccaaatatgcttgattattctgcaaaagtgattagaactaagatgcaggggaaattgcttaacattttcagatatcagataactgcagattttcattttctactaatttttcatgtatcattatttttacaaggaactatatataagctagcacataattatccttctgttcttagatctgtatcttcataataaaaaaattttgcccaagtcctgtttccttagaatttgtgatagcattgataagttgaaaggaaaattaaatcaataaaggcctttgatacctttaaaaattggaa

SEQ ID NO: 447926 - DNA, 1527 bp, Homo sapiens
cactgtcttccacagtggttgaactaatttacactcccaccaacagtgtaaaagcgttcttatttctccacatcctctgcagcatctgttgttcaggaacactatttcaaaccatagttttttagttttgctgagcttacagtggaaatgctattaaattctttcacatcttattatagtaatctttggtttttaagacactgtatttcttttacttttctttctaggaaaattaaaatgtgaagcagttgttgctgatgtcctagataaaggatccggtgtagtgattattatggatgtctattcttattctgagaaggaacttatatgccacaatcagttctctctctttcttgttggctctggaggctttggtggaaaacggacatcagacaaagtcaaggtagctgtagccatacctaatagacctcctgatgctgtacttacagataccacctctcttaatcaggctgctttgtaccgcctcagtggagactggaatcccttacacattgatcctaactttgctagtctagcaggttttgacaagcccatattacatggattatgtacatttggattttctgccaggcgtgtgttacagcagtttgcagataatgatgtgtcaagattcaaggcaattaaggctcgttttgcaaaaccagtatatccaggacaaactctacaaactgagatgtggaaggaaggaaacagaattcattttcaaaccaaggtccaagaaactggagacattgtcatttcaaatgcatatgtggatcttgcaccaacatctggtacttcagctaagacaccctctgagggcgggaagcttcagagtacctttgtatttgaggaaataggacgccgcctaaaggatattgggcctgaggtggtgaagaaagtaaatgctgtatttgagtggcatataaccaaaggcggaaatattggggctaagtggactattgacctgaaaagtggttctggaaaagtgtaccaaggccctgcaaaaggtgctgctgatacaacaatcatactttcagatgaagatttcatggaggtggtcctgggcaagcttgaccctcagaaggcattctttagtggcaggctgaaggccagagggaacatcatgctgagccagaaacttcagatgattcttaaagactacgccaagctctgaagggcacactacactattaataaaaatggaatcattaaatactctcttcacccaaatatgcttgattattctgcaaaagtgattagaactaagatgcaggggaaattgcttaacattttcagatatcagataactgcagattttcattttctactaatttttcatgtatcattatttttacaaggaactatatataagctagcacataattatccttctgttcttagatctgtatcttcataataaaaaaattttgcccaagtcctgtttccttagaatttgtgatagcattgataagttgaaaggaaaattaaatcaataaaggcctttgatacctttaaaaattggaa

SEQ ID NO: 447927 - DNA, 2654 bp, Homo sapiens
attccccgcctcctcctgtcccgcagtcggcgtccagcggctctgcttgttcgtgtgtgtgtcgttgcaggccttattcatgggctcaccgctgaggttcgacgggcgggtggtactggtcaccggcgcgggggcaggattgggccgagcctatgccctggcttttgcagaaagaggagcgttagttgttgtgaatgatttgggaggggacttcaaaggagttggtaaaggctccttagctgctgataaggttgttgaagaaataagaaggagaggtggaaaagcagtggccaactatgattcagtggaagaaggagagaaggttgtgaagacagccctggatgcttttggaagaatagatgttgtggtcaacaatgctggaattctgagggatcgttcctttgctaggataagtgatgaagactgggatataatccacagagttcatttgcggggttcattccaagtgacacgggcagcatgggaacacatgaagaaacagaagtatggaaggattattatgacttcatcagcttcaggaatatatggcaactttggccaggccaattatagtgctgcaaagttgggtcttctgggccttgcaaattctcttgcaattgaaggcaggaaaagcaacattcattgtaacaccattgctcctaatgcgggatcacggatgactcagacagttatgcctgaagatcttgtggaagccctgaagccagagtatgtggcacctcttgtcctttggctttgtcacgagagttgtgaggagaatggtggcttgtttgaggttggagcaggatggattggaaaattacgctgggagcggactcttggagctattgtaagacaaaagaatcacccaatgactcctgaggcagtcaaggctaactggaagaagatctgtgactttgagaatgccagcaagcctcagagtatccaagaatcaactggcagtataattgaagttctgagtaaaatagattcagaaggaggagtttcagcaaatcatactagtcgtgcaacgtctacagcaacatcaggatttgctggagctattggccagaaactccctccattttcttatgcttatacggaactggaagctattatgtatgcccttggagtgggagcgtcaatcaaggatccaaaagatttgaaatttatttatgaaggaagttctgatttctcctgtttgcccaccttcggagttatcataggtcagaaatctatgatgggtggaggattagcagaaattcctggactttcaatcaactttgcaaaggttcttcatggagagcagtacttagagttatataaaccacttcccagagcaggaaaattaaaatgtgaagcagttgttgctgatgtcctagataaaggatccggtgtagtgattattatggatgtctattcttattctgagaaggaacttatatgccacaatcagttctctctctttcttgttggctctggaggctttggtggaaaacggacatcagacaaagtcaaggtagctgtagccatacctaatagacctcctgatgctgtacttacagataccacctctcttaatcaggctgctttgtaccgcctcagtggagactggaatcccttacacattgatcctaactttgctagtctagcaggttttgacaagcccatattacatggattatgtacatttggattttctgccaggcgtgtgttacagcagtttgcagataatgatgtgtcaagattcaaggcaattaaggctcgttttgcaaaaccagtatatccaggacaaactctacaaactgagatgtggaaggaaggaaacagaattcattttcaaaccaaggtccaagaaactggagacattgtcatttcaaatgcatatgtggatcttgcaccaacatctggtacttcagctaagacaccctctgagggcgggaagcttcagagtacctttgtatttgaggaaataggacgccgcctaaaggatattgggcctgaggtggtgaagaaagtaaatgctgtatttgagtggcatataaccaaaggcggaaatattggggctaagtggactattgacctgaaaagtggttctggaaaagtgtaccaaggccctgcaaaaggtgctgctgatacaacaatcatactttcagatgaagatttcatggaggtggtcctgggcaagcttgaccctcagaaggcattctttagtggcaggctgaaggccagagggaacatcatgctgagccagaaacttcagatgattcttaaagactacgccaagctctgaagggcacactacactattaataaaaatggaatcattaaatactctcttcacccaaatatgcttgattattctgcaaaagtgattagaactaagatgcaggggaaattgcttaacattttcagatatcagataactgcagattttcattttctactaatttttcatgtatcattatttttacaaggaactatatataagctagcacataattatccttctgttcttagatctgtatcttcataataaaaaaattttgcccaagtcctgtttccttagaatttgtgatagcattgataagttgaaaggaaaattaaatcaataaaggcctggcctcgttggcctcagcggtggagctcgtcggccg

SEQ ID NO: 447928 - DNA, 2579 bp, Homo sapiens
attccccgcctcctcctgtcccgcagtcggcgtccagcggctctgcttgttcgtgtgtgtgtcgttgcaggccttattcatgggctcaccgctgaggttcgacgggcgggtggtactggtcaccggcgcgggggcaggattgggccgagcctatgccctggcttttgcagaaagaggagcgttagttgttgtgaatgatttgggaggggacttcaaaggagttggtaaaggctccttagctgctgataaggttgttgaagaaataagaaggagaggtggaaaagcagtggccaactatgattcagtggaagaaggagagaaggttgtgaagacagccctggatgcttttggaagaatagatgttgtggtcaacaatgctggaattctgagggatcgttcctttgctaggataagtgatgaagactgggatataatccacagagttcatttgcggggttcattccaagtgacacgggcagcatgggaacacatgaagaaacagaagtatggaaggattattatgacttcatcagcttcaggaatatatggcaactttggccaggccaattatagtgctgcaaagttgggtcttctgggccttgcaaattctcttgcaattgaaggcaggaaaagcaacattcattgtaacaccattgctcctaatgcgggatcacggatgactcagacagttatgcctgaagatcttgtggaagccctgaagccagagtatgtggcacctcttgtcctttggctttgtcacgagagttgtgaggagaatggtggcttgtttgaggttggagcaggatggattggaaaattacgctgggagcggactcttggagctattgtaagacaaaagaatcacccaatgactcctgaggcagtcaaggctaactggaagaagatctgtgactttgagaatgccagcaagcctcagagtatccaagaatcaactggcagtataattgaagttctgagtaaaatagattcagaaggaggagtttcagcaaatcatactagtcgtgcaacgtctacagcaacatcaggatttgctggagctattggccagaaactccctccattttcttatgcttatacggaactggaagctattatgtatgcccttggagtgggagcgtcaatcaaggatccaaaagatttgaaatttatttatgaaggaagttctgatttctcctgtttgcccaccttcggagttatcataggtcagaaatctatgatgggtggaggattagcagaaattcctggactttcaatcaactttgcaaaggttcttcatggagagcagtacttagagttatataaaccacttcccagagcaggaaaattaaaatgtgaagcagttgttgctgatgtcctagataaaggatccggtgtagtgattattatggatgtctattcttattctgagaaggaacttatatgccacaatcagttctctctctttcttgttggctctggaggctttggtggaaaacggacatcagacaaagtcaaggtagctgtagccatacctaatagacctcctgatgctgtacttacagataccacctctcttaatcaggctgctttgtaccgcctcagtggagactggaatcccttacacattgatcctaactttgctagtctagcaggttttgacaagcccatattacatggattatgtacatttggattttctgccaggcgtgtgttacagcagtttgcagataatgatgtgtcaagattcaaggcaattaaggctcgttttgcaaaaccagtatatccaggacaaactctacaaactgagatgtggaaggaaggaaacagaattcattttcaaaccaaggtccaagaaactggagacattgtcatttcaaatgcatatgtggatcttgcaccaacatctggtacttcagctaagacaccctctgagggcgggaagcttcagagtacctttgtatttgaggaaataggacgccgcctaaaggatattgggcctgaggtggtgaagaaagtaaatgctgtatttgagtggcatataaccaaaggcggaaatattggggctaagtggactattgacctgaaaagtggttctggaaaagtgtaccagtggtcctgggcaagcttgaccctcagaaggcattctttagtggcaggctgaaggccagagggaacatcatgctgagccagaaacttcagatgattcttaaagactacgccaagctctgaagggcacactacactattaataaaaatggaatcattaaatactctcttcacccaaatatgcttgattattctgcaaaagtgattagaactaagatgcaggggaaattgcttaacattttcagatatcagataactgcagattttcattttctactaatttttcatgtatcattatttttacaaggaactatatataagctagcacataattatccttctgttcttagatctgtatcttcataataaaaaaattttgcccaagtcctgtttccttagaatttgtgatagcattgataagttgaaaggaaaattaaatcaataaaggcctttgatacctttaaaaattggaa

SEQ ID NO: 447929 - DNA, 2642 bp, Homo sapiens
  misc_feature (2057)..(2057): n is a, c, g, or t
  misc_feature (2069)..(2069): n is a, c, g, or t
  misc_feature (2074)..(2074): n is a, c, g, or t
  misc_feature (2087)..(2087): n is a, c, g, or t
  misc_feature (2089)..(2089): n is a, c, g, or t
  misc_feature (2105)..(2105): n is a, c, g, or t
  misc_feature (2121)..(2122): n is a, c, g, or t
  misc_feature (2140)..(2141): n is a, c, g, or t
  misc_feature (2144)..(2145): n is a, c, g, or t
  misc_feature (2149)..(2150): n is a, c, g, or t
  misc_feature (2173)..(2173): n is a, c, g, or t
  misc_feature (2186)..(2186): n is a, c, g, or t
  misc_feature (2196)..(2196): n is a, c, g, or t
  misc_feature (2198)..(2198): n is a, c, g, or t
  misc_feature (2201)..(2201): n is a, c, g, or t
attccccgcctcctcctgtcccgcagtcggcgtccagcggctctgcttgttcgtgtgtgtgtcgttgcaggccttattcatgggctcaccgctgaggttcgacgggcgggtggtactggtcaccggcgcgggggcaggattgggccgagcctatgccctggcttttgcagaaagaggagcgttagttgttgtgaatgatttgggaggggacttcaaaggagttggtaaaggctccttagctgctgataaggttgttgaagaaataagaaggagaggtggaaaagcagtggccaactatgattcagtggaagaaggagagaaggttgtgaagacagccctggatgcttttggaagaatagatgttgtggtcaacaatgctggaattctgagggatcgttcctttgctaggataagtgatgaagactgggatataatccacagagttcatttgcggggttcattccaagtgacacgggcagcatgggaacacatgaagaaacagaagtatggaaggattattatgacttcatcagcttcaggaatatatggcaactttggccaggccaattatagtgctgcaaagttgggtcttctgggccttgcaaattctcttgcaattgaaggcaggaaaagcaacattcattgtaacaccattgctcctaatgcgggatcacggatgactcagacagttatgcctgaagatcttgtggaagccctgaagccagagtatgtggcacctcttgtcctttggctttgtcacgagagttgtgaggagaatggtggcttgtttgaggttggagcaggatggattggaaaattacgctgggagcggactcttggagctattgtaagacaaaagaatcacccaatgactcctgaggcagtcaaggctaactggaagaagatctgtgactttgagaatgccagcaagcctcagagtatccaagaatcaactggcagtataattgaagttctgagtaaaatagattcagaaggaggagtttcagcaaatcatactagtcgtgcaacgtctacagcaacatcaggatttgctggagctattggccagaaactccctccattttcttatgcttatacggaactggaagctattatgtatgcccttggagtgggagcgtcaatcaaggatccaaaagatttgaaatttatttatgaaggaagttctgatttctcctgtttgcccaccttcggagttatcataggtcagaaatctatgatgggtggaggattagcagaaattcctggactttcaatcaactttgcaaaggttcttcatggagagcagtacttagagttatataaaccacttcccagagcaggaaaattaaaatgtgaagcagttgttgctgatgtcctagataaaggatccggtgtagtgattattatggatgtctattcttattctgagaaggaacttatatgccacaatcagttctctctctttcttgttggctctggaggctttggtggaaaacggacatcagacaaagtcaaggtagctgtagccatacctaatagacctcctgatgctgtacttacagataccacctctcttaatcaggctgctttgtaccgcctcagtggagactggaatcccttacacattgatcctaactttgctagtctagcaggttttgacaagcccatattacatggattatgtacatttggattttctgccaggcgtgtgttacagcagtttgcagataatgatgtgtcaagattcaaggcaattaaggctcgttttgcaaaaccagtatatccaggacaaactctacaaactgagatgtggaaggaaggaaacagaattcattttcaaaccaaggtccaagaaactggagacattgtcatttcaaatgcatatgtggatcttgcaccaacatctggtacttcagctaagacaccctctgagggcgggaagcttcagagtacctttgtatttgaggaaataggacgccgcctaaaggatattgggcctgaggtggtgggggaggtgggggcggggggtggggggcggggtagccgggggcgggggnggggggctgggngggcngttggcctggaangnggggctggaagggggngccagggccctgcagnnggggcggcgggtgcggcnngcnnactnncgggtggggatgggcatgggggngggcgctgggcangctgggcccncnggnggcattctttagtggcaggctgaaggccagagggaacatcatgctgagccagaaacttcagatgattcttaaagactacgccaagctctgaagggcacactacactattaataaaaatggaatcattaaatactctcttcacccaaatatgcttgattattctgcaaaagtgattagaactaagatgcaggggaaattgcttaacattttcagatatcagataactgcagattttcattttctactaatttttcatgtatcattatttttacaaggaactatatataagctagcacataattatccttctgttcttagatctgtatcttcataataaaaaaattttgcccaagtcctgtttccttagaatttgtgatagcattgataagttgaaaggaaaattaaatcaataaaggcctttgatacctttaaaaattggaa

SEQ ID NO: 447930 - DNA, 2377 bp, Homo sapiens
  misc_feature (2342)..(2342): n is a, c, g, or t
attccccgcctcctcctgtcccgcagtcggcgtccagcggctctgcttgttcgtgtgtgtgtcgttgcaggccttattcatgggctcaccgctgaggttcgacgggcgggtggtactggtcaccggcgcgggggcaggattgggccgagcctatgccctggcttttgcagaaagaggagcgttagttgttgtgaatgatttgggaggggacttcaaaggagttggtaaaggctccttagctgctgataaggttgttgaagaaataagaaggagaggtggaaaagcagtggccaactatgattcagtggaagaaggagagaaggttgtgaagacagccctggatgcttttggaagaatagatgttgtggtcaacaatgctggaattctgagggatcgttcctttgctaggataagtgatgaagactgggatataatccacagagttcatttgcggggttcattccaagtgacacgggcagcatgggaacacatgaagaaacagaagtatggaaggattattatgacttcatcagcttcaggaatatatggcaactttggccaggccaattatagtgctgcaaagttgggtcttctgggccttgcaaattctcttgcaattgaaggcaggaaaagcaacattcattgtaacaccattgctcctaatgcgggatcacggatgactcagacagttatgcctgaagatcttgtggaagccctgaagccagagtatgtggcacctcttgtcctttggctttgtcacgagagttgtgaggagaatggtggcttgtttgaggttggagcaggatggattggaaaattacgctgggagcggactcttggagctattgtaagacaaaagaatcacccaatgactcctgaggcagtcaaggctaactggaagaagatctgtgactttgagaatgccagcaagcctcagagtatccaagaatcaactggcagtataattgaagttctgagtaaaatagattcagaaggaggagtttcagcaaatcatactagtcgtgcaacgtctacagcaacatcaggatttgctggagctattggccagaaactccctccattttcttatgcttatacggaactggaagctattatgtatgcccttggagtgggagcgtcaatcaaggatccaaaagatttgaaatttatttatgaaggaagttctgatttctcctgtttgcccaccttcggagttatcataggtcagaaatctatgatgggtggaggattagcagaaattcctggactttcaatcaactttgcaaaggttcttcatggagagcagtacttagagttatataaaccacttcccagagcaggaaaattaaaatgtgaagcagttgttgctgatgtcctagataaaggatccggtgtagtgattattatggatgtctattcttattctgagaaggaacttatatgccacaatcagttctctctctttcttgttggctctggaggctttggtggaaaacggacatcagacaaagtcaaggtagctgtagccatacctaatagacctcctgatgctgtacttacagataccacctctcttaatcaggctgctttgtaccgcctcagtggagactggaatcccttacacattgatcctaactttgctagtctagcaggttttgacaagcccatattacatggattatgtacatttggattttctgccaggcgtgtgttacagcagtttgcagataatgatgtgtcaagattcaaggcaattaaggctcgttttgcaaaaccagtatatccaggacaaactctacaaactgagatgtggaaggaaggaaacagaattcattttcaaaccaaggtccaagaaactggagacattgtcatttcaaatgcatatgtggatcttgcaccaacatctggtacttcagctaagacaccctctgagggcgggaagcttcagagtacctttgtatttgaggaaataggacgccgcctaaaggatattgggcctgaggtggtgaagaaagtaaatgctgtatttgagtggcatataaccaaaggcggaaatattggggctaagtggactattgacctgaaaagtggttctggaaaagtgtaccaaggccctgcaaaaggtgctgctgatacaacaatcatactttcagatgaagatttcatggaggtggtcctgggcaagcttgaccctcagaaggcattctttagtggcaggctgaaggccagagggaacatcatgctgagccagaaacttcagatgattcttaaagactacgccaagctctgaagggcacactacactattaataaaaatggaatcatgcgcgccagcctccctnctcttctaaatagcacgcacaactaaccctcgcac

SEQ ID NO: 447931 - DNA, 1925 bp, Homo sapiens
attccccgcctcctcctgtcccgcagtcggcgtccagcggctctgcttgttcgtgtgtgtgtcgttgcaggccttattcatgggctcaccgctgaggttcgacgggcgggtggtactggtcaccggcgcgggggcaggattgggccgagcctatgccctggcttttgcagaaagaggagcgttagttgttgtgaatgatttgggaggggacttcaaaggagttggtaaaggctccttagctgctgataaggttgttgaagaaataagaaggagaggtggaaaagcagtggccaactatgattcagtggaagaaggagagaaggttgtgaagacagccctggatgcttttggaagaatagatgttgtggtcaacaatgctggaattctgagggatcgttcctttgctaggataagtgatgaagactgggatataatccacagagttcatttgcggggttcattccaagtgacacgggcagcatgggaacacatgaagaaacagaagtatggaaggattattatgacttcatcagcttcaggaatatatggcaactttggccaggccaattatagtgctgcaaagttgggtcttctgggccttgcaaattctcttgcaattgaaggcaggaaaagcaacattcattgtaacaccattgctcctaatgcgggatcacggatgactcagacagttatgcctgaagatcttgtggaagccctgaagccagagtatgtggcacctcttgtcctttggctttgtcacgagagttgtgaggagaatggtggcttgtttgaggttggagcaggatggattggaaaattacgctgggagcggactcttggagctattgtaagacaaaagaatcacccaatgactcctgaggcagtcaaggctaactggaagaagatctgtgactttgagaatgccagcaagcctcagagtatccaagaatcaactggcagtataattgaagttctgagtaaaatagattcagaaggaggagtttcagcaaatcatactagtcgtgcaacgtctacagcaacatcaggatttgctggagctattggccagaaactccctccattttcttatgcttatacggaactggaagctattatgtatgcccttggagtgggagcgtcaatcaaggatccaaaagatttgaaatttatttatgaaggaagttctgatttctcctgtttgcccaccttcggagttatcataggtcagaaatctatgatgggtggaggattagcagaaattcctggactttcaatcaactttgcaaaggttcttcatggagagcagtacttagagttatataaaccacttcccagagcaggaaaattaaaatgtgaagcagttgttgctgatgtcctagataaaggatccggtgtagtgattattatggatgtctattcttattctgagaaggaacttatatgccacaatcagttctctctctttcttgttggctctggaggctttggtggaaaacggacatcagacaaagtcaaggtagctgtagccatacctaatagacctcctgatgctgtacttacagataccacctctcttaatcaggctgctttgtaccgcctcagtggagactggaatcccttacacattgatcctaactttgctagtctagcaggttttgacaagcccatattacatggattatgtacatttggattttctgccaggcgtgtgttacagcagtttgcagataatgatgtgtcaagattcaaggcaattaaggctcgttttgcaaaaccagtatatccaggacaaactctacaaactgagatgtggaaggaaggaaacagaattcattttcaaaccaaggtcctgcaactgggacgttgtcatttcaaacgcatatgtgcatcgataacaccggtccggctcgattcgtactctgttc

SEQ ID NO: 447932 - DNA, 934 bp, Homo sapiens
tgtaatgaattctgccactaagagaaaatgaatacaatctctttcttcacttctgaaataagattagctgtgatcttataggtgtctataaactcaaggtgatggtggtggttgcagaccatgacctgagccactacagaactggaagttccacttctttacctcaaatttctgtattcttgtatttctatattttgctttttttctaaatgacagataatgtataattgatagatagaatatgtgtagaataagtgccacattaacatggaaactatagaaatgtctgcattttacttggtttattttaccctcattttgttggagagaaaaagatacacattggtttcttcctatttttcccagctattgacctgaaaagtggttctggaaaagtgtaccaaggccctgcaaaaggtgctgctgatacaacaatcatactttcagatgaagatttcatggaggtggtcctgggcaagcttgaccctcagaaggcattctttagtggcaggctgaaggccagagggaacatcatgctgagccagaaacttcagatgattcttaaagactacgccaagctctgaagggcacactacactattaataaaaatggaatcattaaatactctcttcacccaaatatgcttgattattctgcaaaagtgattagaactaagatgcaggggaaattgcttaacattttcagatatcagataactgcagattttcattttctactaatttttcatgtatcattatttttacaaggaactatatataagctagcacataattatccttctgttcttagatctgtatcttcataataaaaaaattttgcccaagtcctgtttccttagaatttgtgatagcattgataagttgaaaggaaaattaaatcaataaaggcctttgatacctttaaaaattggaa

SEQ ID NO: 447933 - DNA, 1525 bp, Homo sapiens
attccccgcctcctcctgtcccgcagtcggcgtccagcggctctgcttgttcgtgtgtgtgtcgttgcaggccttattcatgggctcaccgctgaggttcgacgggcgggtggtactggtcaccggcgcgggggcaggattgggccgagcctatgccctggcttttgcagaaagaggagcgttagttgttgtgaatgatttgggaggggacttcaaaggagttggtaaaggctccttagctgctgataaggttgttgaagaaataagaaggagaggtggaaaagcagtggccaactatgattcagtggaagaaggagagaaggttgtgaagacagccctggatgcttttggaagaatagatgttgtggtcaacaatgctggaattctgagggatcgttcctttgctaggataagtgatgaagactgggatataatccacagagttcatttgcggggttcattccaagtgacacgggcagcatgggaacacatgaagaaacagaagtatggaaggattattatgacttcatcagcttcaggaatatatggcaactttggccaggccaattatagtgctgcaaagttgggtcttctgggccttgcaaattctcttgcaattgaaggcaggaaaagcaacattcattgtaacaccattgctcctaatgcgggatcacggatgactcagacagttatgcctgaagatcttgtggaagccctgaagccagagtatgtggcacctcttgtcctttggctttgtcacgagagttgtgaggagaatggtggcttgtttgaggttggagcaggatggattggaaaattacgctgggagcggactcttggagctattgtaagacaaaagaatcacccaatgactcctgaggcagtcaaggctaactggaagaagatctgtgactttgagaatgccagcaagcctcagagtatccaagaatcaactggcagtataattgaagttctgagtaaaatagattcagaaggaggagtttcagcaaatcatactagtcgtgcaacgtctacagcaacatcaggatttgctggagctattggccagaaactccctccattttcttatgcttatacggaactggaagctattatgtatgcccttggagtgggagcgtcaatcaaggatccaaaagatttgaaatttatttatgaaggaagttctgatttctcctgtttgcccaccttcggagttatcataggtcagaaatctatgatgggtggaggattagcagaaattcctggactttcaatcaactttgcaaaggtatgcctaataaaaaacctttattttgcttttctatttctgtaaatattattcattaatgtcatatcttatatatatgtgtgtggtgccagtcctgggtgtccagtggccccatacccttgcgttttagtaaaatgctgcccccattaccaccctggtctgtgcactttcggcacttggaatttggccattcttccaatccccaatgggggcaagccatggagcccttaaactttt

SEQ ID NO: 447934 - DNA, 494 bp, Homo sapiens
  misc_feature (52)..(52): n is a, c, g, or t
acaacacacaaacaacccaagcaaaacaacaaaaccccttttaggatacttntagcattctttagtggcaggctgaaggccagagggaacatcatgctgagccagaaacttcagatgattcttaaagactacgccaagctctgaagggcacactacactattaataaaaatggaatcattaaatactctcttcacccaaatatgcttgattattctgcaaaagtgattagaactaagatgcaggggaaattgcttaacattttcagatatcagataactgcagattttcattttctactaatttttcatgtatcattatttttacaaggaactatatataagctagcacataattatccttctgttcttagatctgtatcttcataataaaaaaattttgcccaagtcctgtttccttagaatttgtgatagcattgataagttgaaaggaaaattaaatcaataaaggcctttgatacctttaaaaattggaa

SEQ ID NO: 447935 - DNA, 453 bp, Homo sapiens
  misc_feature (346)..(346): n is a, c, g, or t
aaaccggttacgcctgagtgccctggttgttgtgcttgacaatttctgtgtcgactgaggcgcagtcggcgtccagcggctctgcttgttcgtgtgtgtgtcgttgcaggccttattcatgggctcaccgctgaggttcgacgggcgggtggtactggtcaccggcgcgggggcagattgggccgagcctatgccctggcttttgcaaaaaataggtcaggcctgcaatgcaggtagtgagaagcagaaagtgagaaagaaaagcagtgtaaagaccgtctcctcctcagcaacaacagtagcagaccccgttttcttaatgctttctatactccaagcactctgntaggcagtctgtatgcattatcttatttaagcttcatgacaagtgtaaaagctacaaatcatcatttgattttttaggtaacacttcataaagggctctctatagca

SEQ ID NO: 447936 - DNA, 608 bp, Homo sapiens
tcaaaccatagttttttagttttgctgagcttacagtggaaatgctattaaattctttcacatcttattatagtaatctttggtttttaagacactgtatttcttttacttttctttctaggaaaattaaaatgtgaagcagttgttgctgatgtcctagataaaggatccggtgtagtgattattatggatggtaatttatttacaattcttataataatattgttagattgataggctttgtgtatgacataatacttcaccatagaagttgattaataagttagtatttgtcttccaatttgttagaaaacaagataagcatttttaaactctttaagaaaaataaagaaggagggggagaagcatttatttctgggcttaggctgggaagggtgaggcatttcattggatttaagacaacataaccaaagcacaaaggtgataaatgtggcttgtattgataatgtagaggagaattaagcttgctggagtatgtttttggcaggaaggaatattagatagtcctcacttgacaattaggctgtgttttaggtattctttaatgtgttagctatttggaacttggaacatatttgaacactaaa

SEQ ID NO: 447937 - DNA, 352 bp, Homo sapiens
attattatgacttcatcagcttcaggaatatatggcaactttggccaggccaattatagtgctgcaaagttgggtcttctgggccttgcaaattctcttgcaattgaaggcaggaaaagcaacattcattgtaacaccattgctcctaatgcgggatcacggatgactcagacagttatgcctgaaggtaagtaagcaagcttatatttttcagtgctgttacttacaaacctatgtggaatgagctttacaaaagtatttaattttctgaatacttaaaaattattatttttttcaatttcgaaagcattatctgtaaattgtgttcattgtggaaaatttagaaaagcac

SEQ ID NO: 447938 - DNA, 152 bp, Homo sapiens
atgatttgggaggggacttcaaaggagttggtaaaggctccttagctgctgataaggttgttgaagaaataagaaggagaggtggaaaagcagtggccaactatggtatggtatttgagagaactatactatttattttccttcaactaatg

SEQ ID NO: 447939 - DNA, 768 bp, Homo sapiens
tcggcgtccagcggctctgcttgttcgtgtgtgtgtcgttgcaggccttattcatgggctcaccgctgaggttcgacgggcgggtggtactggtcaccggcgcgggggcaggtgagcatgcgaaggttggaggccgcgccccttgctgaggcgcagctggctgctcttttcgggccggcatacgcgcgcagccgcagctgaggtcaccccgctgaggtggtggggaggggaatggttattcttgaggcaccgcatctcttgaggaggaaagagccggaaacacctggtctctcaagcaggtacagcccgcttctccccagcaccccggtgtgggcttcccaaggtcctgcctgagaggagaggccaggctgggctgctgattgcaaaactgggtgaaagttctccctgacccttatctgtgggcatcgattgttactcttcctgcaattaactctcttagatctttgcctagtcttttaaaggactgaaaagccgcgaggggcgggggctggaattcgccccctgaagcgcagagatgtcagctcctgaaaagtcattcggtcgttcagtgtttgtttccctctgtcgtaagattttaagttcgtgagaggaccttctttaaagagggcgtctgataagagcccttccccgttggagtttgtatgcttagcaagtcacaatctgttctcgaaatccactggagtcttggcagaggttgtaagctcaaatgcgcacaggggtcaggcgtatgatggagaaagaaaatgg

SEQ ID NO: 447940 - DNA, 2679 bp, Homo sapiens
aaaccggttacgcctgagtgccctggttgttgtgcttgacaatttctgtgtcgactgaggcgcagtcggcgtccagcggctctgcttgttcgtgtgtgtgtcgttgcaggccttattcatgggctcaccgctgaggttcgacgggcgggtggtactggtcaccggcgcgggggcaggattgggccgagcctatgccctggcttttgcagaaagaggagcgttagttgttgtgaatgatttgggaggggacttcaaaggagttggtaaaggctccttagctgctgataaggttgttgaagaaataagaaggagaggtggaaaagcagtggccaactatgattcagtggaagaaggagagaaggttgtgaagacagccctggatgcttttggaagaatagatgttgtggtcaacaatgctggaattctgagggatcgttcctttgctaggataagtgatgaagactgggatataatccacagagttcatttgcggggttcattccaagtgacacgggcagcatgggaacacatgaagaaacagaagtatggaaggattattatgacttcatcagcttcaggaatatatggcaactttggccaggccaattatagtgctgcaaagttgggtcttctgggccttgcaaattctcttgcaattgaaggcaggaaaagcaacattcattgtaacaccattgctcctaatgcgggatcacggatgactcagacagttatgcctgaagatcttgtggaagccctgaagccagagtatgtggcacctcttgtcctttggctttgtcacgagagttgtgaggagaatggtggcttgtttgaggttggagcaggatggattggaaaattacgctgggagcggactcttggagctattgtaagacaaaagaatcacccaatgactcctgaggcagtcaaggctaactggaagaagatctgtgactttgagaatgccagcaagcctcagagtatccaagaatcaactggcagtataattgaagttctgagtaaaatagattcagaaggaggagtttcagcaaatcatactagtcgtgcaacgtctacagcaacatcaggatttgctggagctattggccagaaactccctccattttcttatgcttatacggaactggaagctattatgtatgcccttggagtgggagcgtcaatcaaggatccaaaagatttgaaatttatttatgaaggaagttctgatttctcctgtttgcccaccttcggagttatcataggtcagaaatctatgatgggtggaggattagcagaaattcctggactttcaatcaactttgcaaaggttcttcatggagagcagtacttagagttatataaaccacttcccagagcaggaaaattaaaatgtgaagcagttgttgctgatgtcctagataaaggatccggtgtagtgattattatggatgtctattcttattctgagaaggaacttatatgccacaatcagttctctctctttcttgttggctctggaggctttggtggaaaacggacatcagacaaagtcaaggtagctgtagccatacctaatagacctcctgatgctgtacttacagataccacctctcttaatcaggctgctttgtaccgcctcagtggagactggaatcccttacacattgatcctaactttgctagtctagcaggttttgacaagcccatattacatggattatgtacatttggattttctgccaggcgtgtgttacagcagtttgcagataatgatgtgtcaagattcaaggcaattaaggctcgttttgcaaaaccagtatatccaggacaaactctacaaactgagatgtggaaggaaggaaacagaattcattttcaaaccaaggtccaagaaactggagacattgtcatttcaaatgcatatgtggatcttgcaccaacatctggtacttcagctaagacaccctctgagggcgggaagcttcagagtacctttgtatttgaggaaataggacgccgcctaaaggatattgggcctgaggtggtgaagaaagtaaatgctgtatttgagtggcatataaccaaaggcggaaatattggggctaagtggactattgacctgaaaagtggttctggaaaagtgtaccaaggccctgcaaaaggtgctgctgatacaacaatcatactttcagatgaagatttcatggaggtggtcctgggcaagcttgaccctcagaaggcattctttagtggcaggctgaaggccagagggaacatcatgctgagccagaaacttcagatgattcttaaagactacgccaagctctgaagggcacactacactattaataaaaatggaatcattaaatactctcttcacccaaatatgcttgattattctgcaaaagtgattagaactaagatgcaggggaaattgcttaacattttcagatatcagataactgcagattttcattttctactaatttttcatgtatcattatttttacaaggaactatatataagctagcacataattatccttctgttcttagatctgtatcttcataataaaaaaattttgcccaagtcctgtttccttagaatttgtgatagcattgataagttgaaaggaaaattaaatcaataaaggcctttgatacctttaaaaattggaa

SEQ ID NO: 447941 - DNA, 2640 bp, Homo sapiens
attccccgcctcctcctgtcccgcagtcggcgtccagcggctctgcttgttcgtgtgtgtgtcgttgcaggccttattcatgggctcaccgctgaggttcgacgggcgggtggtactggtcaccggcgcgggggcaggattgggccgagcctatgccctggcttttgcagaaagaggagcgttagttgttgtgaatgatttgggaggggacttcaaaggagttggtaaaggctccttagctgctgataaggttgttgaagaaataagaaggagaggtggaaaagcagtggccaactatgattcagtggaagaaggagagaaggttgtgaagacagccctggatgcttttggaagaatagatgttgtggtcaacaatgctggaattctgagggatcgttcctttgctaggataagtgatgaagactgggatataatccacagagttcatttgcggggttcattccaagtgacacgggcagcatgggaacacatgaagaaacagaagtatggaaggattattatgacttcatcagcttcaggaatatatggcaactttggccaggccaattatagtgctgcaaagttgggtcttctgggccttgcaaattctcttgcaattgaaggcaggaaaagcaacattcattgtaacaccattgctcctaatgcgggatcacggatgactcagacagttatgcctgaagatcttgtggaagccctgaagccagagtatgtggcacctcttgtcctttggctttgtcacgagagttgtgaggagaatggtggcttgtttgaggttggagcaggatggattggaaaattacgctgggagcggactcttggagctattgtaagacaaaagaatcacccaatgactcctgaggcagtcaaggctaactggaagaagatctgtgactttgagaatgccagcaagcctcagagtatccaagaatcaactggcagtataattgaagttctgagtaaaatagattcagaaggaggagtttcagcaaatcatactagtcgtgcaacgtctacagcaacatcaggatttgctggagctattggccagaaactccctccattttcttatgcttatacggaactggaagctattatgtatgcccttggagtgggagcgtcaatcaaggatccaaaagatttgaaatttatttatgaaggaagttctgatttctcctgtttgcccaccttcggagttatcataggtcagaaatctatgatgggtggaggattagcagaaattcctggactttcaatcaactttgcaaaggttcttcatggagagcagtacttagagttatataaaccacttcccagagcaggaaaattaaaatgtgaagcagttgttgctgatgtcctagataaaggatccggtgtagtgattattatggatgtctattcttattctgagaaggaacttatatgccacaatcagttctctctctttcttgttggctctggaggctttggtggaaaacggacatcagacaaagtcaaggtagctgtagccatacctaatagacctcctgatgctgtacttacagataccacctctcttaatcaggctgctttgtaccgcctcagtggagactggaatcccttacacattgatcctaactttgctagtctagcaggttttgacaagcccatattacatggattatgtacatttggattttctgccaggcgtgtgttacagcagtttgcagataatgatgtgtcaagattcaaggcaattaaggctcgttttgcaaaaccagtatatccaggacaaactctacaaactgagatgtggaaggaaggaaacagaattcattttcaaaccaaggtccaagaaactggagacattgtcatttcaaatgcatatgtggatcttgcaccaacatctggtacttcagctaagacaccctctgagggcgggaagcttcagagtacctttgtatttgaggaaataggacgccgcctaaaggatattgggcctgaggtggtgaagaaagtaaatgctgtatttgagtggcatataaccaaaggcggaaatattggggctaagtggactattgacctgaaaagtggttctggaaaagtgtaccaaggccctgcaaaaggtgctgctgatacaacaatcatactttcagatgaagatttcatggaggtggtcctgggcaagcttgaccctcagaaggcattctttagtggcaggctgaaggccagagggaacatcatgctgagccagaaacttcagatgattcttaaagactacgccaagctctgaagggcacactacactattaataaaaatggaatcattaaatactctcttcacccaaatatgcttgattattctgcaaaagtgattagaactaagatgcaggggaaattgcttaacattttcagatatcagataactgcagattttcattttctactaatttttcatgtatcattatttttacaaggaactatatataagctagcacataattatccttctgttcttagatctgtatcttcataataaaaaaattttgcccaagtcctgtttccttagaatttgtgatagcattgataagttgaaaggaaaattaaatcaataaaggcctttgatacctttaaaaattggaa

SEQ ID NO: 447942 - DNA, 2625 bp, Homo sapiens
aaaccggttacgcctgagtgccctggttgttgtgcttgacaatttctgtgtcgactgaggcgcagtcggcgtccagcggctctgcttgttcgtgtgtgtgtcgttgcaggccttattcatgggctcaccgctgaggttcgacgggcgggtggtactggtcaccggcgcgggggcaggattgggccgagcctatgccctggcttttgcagaaagaggagcgttagttgttgtgaatgatttgggaggggacttcaaaggagttggtaaaggctccttagctgctgataaggttgttgaagaaataagaaggagaggtggagccctggatgcttttggaagaatagatgttgtggtcaacaatgctggaattctgagggatcgttcctttgctaggataagtgatgaagactgggatataatccacagagttcatttgcggggttcattccaagtgacacgggcagcatgggaacacatgaagaaacagaagtatggaaggattattatgacttcatcagcttcaggaatatatggcaactttggccaggccaattatagtgctgcaaagttgggtcttctgggccttgcaaattctcttgcaattgaaggcaggaaaagcaacattcattgtaacaccattgctcctaatgcgggatcacggatgactcagacagttatgcctgaagatcttgtggaagccctgaagccagagtatgtggcacctcttgtcctttggctttgtcacgagagttgtgaggagaatggtggcttgtttgaggttggagcaggatggattggaaaattacgctgggagcggactcttggagctattgtaagacaaaagaatcacccaatgactcctgaggcagtcaaggctaactggaagaagatctgtgactttgagaatgccagcaagcctcagagtatccaagaatcaactggcagtataattgaagttctgagtaaaatagattcagaaggaggagtttcagcaaatcatactagtcgtgcaacgtctacagcaacatcaggatttgctggagctattggccagaaactccctccattttcttatgcttatacggaactggaagctattatgtatgcccttggagtgggagcgtcaatcaaggatccaaaagatttgaaatttatttatgaaggaagttctgatttctcctgtttgcccaccttcggagttatcataggtcagaaatctatgatgggtggaggattagcagaaattcctggactttcaatcaactttgcaaaggttcttcatggagagcagtacttagagttatataaaccacttcccagagcaggaaaattaaaatgtgaagcagttgttgctgatgtcctagataaaggatccggtgtagtgattattatggatgtctattcttattctgagaaggaacttatatgccacaatcagttctctctctttcttgttggctctggaggctttggtggaaaacggacatcagacaaagtcaaggtagctgtagccatacctaatagacctcctgatgctgtacttacagataccacctctcttaatcaggctgctttgtaccgcctcagtggagactggaatcccttacacattgatcctaactttgctagtctagcaggttttgacaagcccatattacatggattatgtacatttggattttctgccaggcgtgtgttacagcagtttgcagataatgatgtgtcaagattcaaggcaattaaggctcgttttgcaaaaccagtatatccaggacaaactctacaaactgagatgtggaaggaaggaaacagaattcattttcaaaccaaggtccaagaaactggagacattgtcatttcaaatgcatatgtggatcttgcaccaacatctggtacttcagctaagacaccctctgagggcgggaagcttcagagtacctttgtatttgaggaaataggacgccgcctaaaggatattgggcctgaggtggtgaagaaagtaaatgctgtatttgagtggcatataaccaaaggcggaaatattggggctaagtggactattgacctgaaaagtggttctggaaaagtgtaccaaggccctgcaaaaggtgctgctgatacaacaatcatactttcagatgaagatttcatggaggtggtcctgggcaagcttgaccctcagaaggcattctttagtggcaggctgaaggccagagggaacatcatgctgagccagaaacttcagatgattcttaaagactacgccaagctctgaagggcacactacactattaataaaaatggaatcattaaatactctcttcacccaaatatgcttgattattctgcaaaagtgattagaactaagatgcaggggaaattgcttaacattttcagatatcagataactgcagattttcattttctactaatttttcatgtatcattatttttacaaggaactatatataagctagcacataattatccttctgttcttagatctgtatcttcataataaaaaaattttgcccaagtcctgtttccttagaatttgtgatagcattgataagttgaaaggaaaattaaatcaataaaggcctttgatacctttaaaaattggaa

SEQ ID NO: 447943 - DNA, 2586 bp, Homo sapiens
attccccgcctcctcctgtcccgcagtcggcgtccagcggctctgcttgttcgtgtgtgtgtcgttgcaggccttattcatgggctcaccgctgaggttcgacgggcgggtggtactggtcaccggcgcgggggcaggattgggccgagcctatgccctggcttttgcagaaagaggagcgttagttgttgtgaatgatttgggaggggacttcaaaggagttggtaaaggctccttagctgctgataaggttgttgaagaaataagaaggagaggtggaaaagcagtggccaactatgattcagtggaagaaggagagaaggttgtgaagacagccctggatgcttttggaagaatagatgttgtggtcaacaatgctggaattctgagggatcgttcctttgctaggataagtgatgaagactgggatataatccacagagttcatttgcggggttcattccaagtgacacgggcagcatgggaacacatgaagaaacagaagtatggaaggattattatgacttcatcagcttcaggaatatatggcaactttggccaggccaattatagtgctgcaaagttgggtcttctgggccttgcaaattctcttgcaattgaaggcaggaaaagcaacattcattgtaacaccattgctcctaatgcgggatcacggatgactcagacagttatgcctgaagatcttgtggaagccctgaagccagagtatgtggcacctcttgtcctttggctttgtcacgagagttgtgaggagaatggtggcttgtttgaggttggagcaggatggattggaaaattacgctgggagcggactcttggagctattgtaagacaaaagaatcacccaatgactcctgaggcagtcaaggctaactggaagaagatctgtgactttgagaatgccagcaagcctcagagtatccaagaatcaactggcagtataattgaagttctgagtaaaatagattcagaaggaggagtttcagcaaatcatactagtcgtgcaacgtctacagcaacatcaggatttgctggagctattggccagaaactccctccattttcttatgcttatacggaactggaagctattatgtatgcccttggagtgggagcgtcaatcaaggatccaaaagatttgaaatttatttatgaaggaagttctgatttctcctgtttgcccaccttcggagttatcataggtcagaaatctatgatgggtggaggattagcagaaattcctggactttcaatcaactttgcaaaggttcttcatggagagcagtacttagagttatataaaccacttcccagagcaggaaaattaaaatgtgaagcagttgttgctgatgtcctagataaaggatccggtgtagtgattattatggatgtctattcttattctgagaaggaacttatatgccacaatcagttctctctctttcttgttggctctggaggctttgctcctgatgctgtacttacagataccacctctcttaatcaggctgctttgtaccgcctcagtggagactggaatcccttacacattgatcctaactttgctagtctagcaggttttgacaagcccatattacatggattatgtacatttggattttctgccaggcgtgtgttacagcagtttgcagataatgatgtgtcaagattcaaggcaattaaggctcgttttgcaaaaccagtatatccaggacaaactctacaaactgagatgtggaaggaaggaaacagaattcattttcaaaccaaggtccaagaaactggagacattgtcatttcaaatgcatatgtggatcttgcaccaacatctggtacttcagctaagacaccctctgagggcgggaagcttcagagtacctttgtatttgaggaaataggacgccgcctaaaggatattgggcctgaggtggtgaagaaagtaaatgctgtatttgagtggcatataaccaaaggcggaaatattggggctaagtggactattgacctgaaaagtggttctggaaaagtgtaccaaggccctgcaaaaggtgctgctgatacaacaatcatactttcagatgaagatttcatggaggtggtcctgggcaagcttgaccctcagaaggcattctttagtggcaggctgaaggccagagggaacatcatgctgagccagaaacttcagatgattcttaaagactacgccaagctctgaagggcacactacactattaataaaaatggaatcattaaatactctcttcacccaaatatgcttgattattctgcaaaagtgattagaactaagatgcaggggaaattgcttaacattttcagatatcagataactgcagattttcattttctactaatttttcatgtatcattatttttacaaggaactatatataagctagcacataattatccttctgttcttagatctgtatcttcataataaaaaaattttgcccaagtcctgtttccttagaatttgtgatagcattgataagttgaaaggaaaattaaatcaataaaggcctttgatacctttaaaaattggaa

SEQ ID NO: 447944 - DNA, 2436 bp, Homo sapiens
gtttatacctctggtttttaaaaagaaaacaatgttaaaaattctccttatgcagcagtaatggtttttatgaatctgtgcattctaactgacttcttgtggaaatagaggtagagcaaagagaaggtaagggagaattatttggggccacctgttacactaaatttttgttaactgaagtctttgacctattatttactattagtcttcagtttgctaactcagcgaagctctattcagttatcttcattttataaacaagaagaatgaagtatattactttggggatctgtggtcatgaagtcagtcttttgatgtgattattatataattaaactttttcacatacagcataacattctacctttagtactgtctggcatagtcagaggagaaatttttcccttcagcttcaaatgtttctttaaattgaccttatcctagtgggtttgttgggaaaaattcattttaaggcttatggtaaaactctttaggagttagaatccctttttttctgaatttcctttctctttaaaaatgaaagggttcttatgcatcttactttctgtctctcaactatgtgctcagtatgttagttttgtttctataaccagtacgctgggagcggactcttggagctattgtaagacaaaagaatcacccaatgactcctgaggcagtcaaggctaactggaagaagatctgtgactttgagaatgccagcaagcctcagagtatccaagaatcaactggcagtataattgaagttctgagtaaaatagattcagaaggaggagtttcagcaaatcatactagtcgtgcaacgtctacagcaacatcaggatttgctggagctattggccagaaactccctccattttcttatgcttatacggaactggaagctattatgtatgcccttggagtgggagcgtcaatcaaggatccaaaagatttgaaatttatttatgaaggaagttctgatttctcctgtttgcccaccttcggagttatcataggtcagaaatctatgatgggtggaggattagcagaaattcctggactttcaatcaactttgcaaaggttcttcatggagagcagtacttagagttatataaaccacttcccagagcaggaaaattaaaatgtgaagcagttgttgctgatgtcctagataaaggatccggtgtagtgattattatggatgtctattcttattctgagaaggaacttatatgccacaatcagttctctctctttcttgttggctctggaggctttggtggaaaacggacatcagacaaagtcaaggtagctgtagccatacctaatagacctcctgatgctgtacttacagataccacctctcttaatcaggctgctttgtaccgcctcagtggagactggaatcccttacacattgatcctaactttgctagtctagcaggttttgacaagcccatattacatggattatgtacatttggattttctgccaggcgtgtgttacagcagtttgcagataatgatgtgtcaagattcaaggcaattaaggctcgttttgcaaaaccagtatatccaggacaaactctacaaactgagatgtggaaggaaggaaacagaattcattttcaaaccaaggtccaagaaactggagacattgtcatttcaaatgcatatgtggatcttgcaccaacatctggtacttcagctaagacaccctctgagggcgggaagcttcagagtacctttgtatttgaggaaataggacgccgcctaaaggatattgggcctgaggtggtgaagaaagtaaatgctgtatttgagtggcatataaccaaaggcggaaatattggggctaagtggactattgacctgaaaagtggttctggaaaagtgtaccaaggccctgcaaaaggtgctgctgatacaacaatcatactttcagatgaagatttcatggaggtggtcctgggcaagcttgaccctcagaaggcattctttagtggcaggctgaaggccagagggaacatcatgctgagccagaaacttcagatgattcttaaagactacgccaagctctgaagggcacactacactattaataaaaatggaatcattaaatactctcttcacccaaatatgcttgattattctgcaaaagtgattagaactaagatgcaggggaaattgcttaacattttcagatatcagataactgcagattttcattttctactaatttttcatgtatcattatttttacaaggaactatatataagctagcacataattatccttctgttcttagatctgtatcttcataataaaaaaattttgcccaagtcctgtttccttagaatttgtgatagcattgataagttgaaaggaaaattaaatcaataaaggcctttgatacctttaaaaattggaa

SEQ ID NO: 447945 - DNA, 2576 bp, Homo sapiens
attccccgcctcctcctgtcccgcagtcggcgtccagcggctctgcttgttcgtgtgtgtgtcgttgcaggccttattcatgggctcaccgctgaggttcgacgggcgggtggtactggtcaccggcgcgggggcaggattgggccgagcctatgccctggcttttgcagaaagaggagcgttagttgttgtgaatgatttgggaggggacttcaaaggagttggtaaaggctccttagctgctgataaggttgttgaagaaataagaaggagaggtggaaaagcagtggccaactatgattcagtggaagaaggagagaaggttgtgaagacagccctggatgcttttggaagaatagatgttgtggtcaacaatgctggaattctgagggatcgttcctttgctaggataagtgatgaagactgggatataatccacagagttcatttgcggggttcattccaagtgacacgggcagcatgggaacacatgaagaaacagaagtatggaaggattattatgacttcatcagcttcaggaatatatggcaactttggccaggccaattatagtgctgcaaagttgggtcttctgggccttgcaaattctcttgcaattgaaggcaggaaaagcaacattcattgtaacaccattgctcctaatgcgggatcacggatgactcagacagttatgcctgaagatcttgtggaagccctgaagccagagtatgtggcacctcttgtcctttggctttgtcacgagagttgtgaggagaatggtggcttgtttgaggttggagcaggatggattggaaaattacgctgggagcggactcttggagctattgtaagacaaaagaatcacccaatgactcctgaggcagtcaaggctaactggaagaagatctgtgactttgagaatgccagcaagcctcagagtatccaagaatcaactggcagtataattgaagttctgagtaaaatagattcagaaggaggagtttcagcaaatcatactagtcgtgcaacgtctacagcaacatcaggatttgctggagctattggccagaaactccctccattttcttatgcttatacggaactggaagctattatgtatgcccttggagtgggagcgtcaatcaaggatccaaaagatttgaaatttatttatgaaggaagttctgatttctcctgtttgcccaccttcggagttatcataggtcagaaatctatgatgggtggaggattagcagaaattcctggactttcaatcaactttgcaaaggttcttcatggagagcagtacttagagttatataaaccacttcccagagcaggaaaattaaaatgtgaagcagttgttgctgatgtcctagataaaggatccggtgtagtgattattatggatgtctattcttattctgagaaggaacttatatgccacaatcagttctctctctttcttgttggctctggaggctttggtggaaaacggacatcagacaaagtcaaggtagctgtagccatacctaatagacctcctgatgctgtacttacagataccacctctcttaatcaggctgctttgtaccgcctcagtggagactggaatcccttacacattgatcctaactttgctagtctagcaggttttgacaagcccatattacatggattatgtacatttggattttctgccaggcgtgtgttacagcagtttgcagataatgatgtgtcaagattcaaggcaattaaggctcgttttgcaaaaccagtatatccaggacaaactctacaaactgagatgtggaaggaaggaaacagaattcattttcaaaccaaggtccaagaaactggagacattgtcatttcaaatgcatatgtggatcttgcaccaacatctggtacttcagctaagacaccctctgagggcgggaagcttcagagtacctttgtatttgaggaaataggacgccgcctaaaggatattgggcctgaggtggtgaagaaagtaaatgctgtatttgagtggcatataaccaaggccctgcaaaaggtgctgctgatacaacaatcatactttcagatgaagatttcatggaggtggtcctgggcaagcttgaccctcagaaggcattctttagtggcaggctgaaggccagagggaacatcatgctgagccagaaacttcagatgattcttaaagactacgccaagctctgaagggcacactacactattaataaaaatggaatcattaaatactctcttcacccaaatatgcttgattattctgcaaaagtgattagaactaagatgcaggggaaattgcttaacattttcagatatcagataactgcagattttcattttctactaatttttcatgtatcattatttttacaaggaactatatataagctagcacataattatccttctgttcttagatctgtatcttcataataaaaaaattttgcccaagtcctgtttccttagaatttgtgatagcattgataagttgaaaggaaaattaaatcaataaaggcctttgatacctttaaaaattggaa

SEQ ID NO: 447946 - DNA, 3549 bp, Homo sapiens
attccccgcctcctcctgtcccgcagtcggcgtccagcggctctgcttgttcgtgtgtgtgtcgttgcaggccttattcatgggctcaccgctgaggttcgacgggcgggtggtactggtcaccggcgcgggggcaggattgggccgagcctatgccctggcttttgcagaaagaggagcgttagttgttgtgaatgatttgggaggggacttcaaaggagttggtaaaggctccttagctgctgataaggttgttgaagaaataagaaggagaggtggaaaagcagtggccaactatgattcagtggaagaaggagagaaggttgtgaagacagccctggatgcttttggaagaatagatgttgtggtcaacaatgctggaattctgagggatcgttcctttgctaggataagtgatgaagactgggatataatccacagagttcatttgcggggttcattccaagtgacacgggcagcatgggaacacatgaagaaacagaagtatggaaggattattatgacttcatcagcttcaggaatatatggcaactttggccaggccaattatagtgctgcaaagttgggtcttctgggccttgcaaattctcttgcaattgaaggcaggaaaagcaacattcattgtaacaccattgctcctaatgcgggatcacggatgactcagacagttatgcctgaagatcttgtggaagccctgaagccagagtatgtggcacctcttgtcctttggctttgtcacgagagttgtgaggagaatggtggcttgtttgaggttggagcaggatggattggaaaattacgctgggagcggactcttggagctattgtaagacaaaagaatcacccaatgactcctgaggcagtcaaggctaactggaagaagatctgtgactttgagaatgccagcaagcctcagagtatccaagaatcaactggcagtataattgaagttctgagtaaaatagattcagaaggaggagtttcagcaaatcatactagtcgtgcaacgtctacagcaacatcaggatttgctggagctattggccagaaactccctccattttcttatgcttatacggaactggaagctattatgtatgcccttggagtgggagcgtcaatcaaggatccaaaagatttgaaatttatttatgaaggaagttctgatttctcctgtttgcccaccttcggagttatcataggtcagaaatctatgatgggtggaggattagcagaaattcctggactttcaatcaactttgcaaaggttcttcatggagagcagtacttagagttatataaaccacttcccagagcaggaaaattaaaatgtgaagcagttgttgctgatgtcctagataaaggatccggtgtagtgattattatggatgtctattcttattctgagaaggaacttatatgccacaatcagttctctctctttcttgttggctctggaggctttggtggaaaacggacatcagacaaagtcaaggtagctgtagccatacctaatagacctcctgatgctgtacttacagataccacctctcttaatcaggctgctttgtaccgcctcagtggagactggaatcccttacacattgatcctaactttgctagtctagcaggttttgacaagcccatattacatggattatgtacatttggattttctgccaggcgtgtgttacagcagtttgcagataatgatgtgtcaagattcaaggcaattaaggctcgttttgcaaaaccagtatatccaggacaaactctacaaactgagatgtggaaggaaggaaacagaattcattttcaaaccaaggtccaagaaactggagacattgtcatttcaaatgcatatgtggatcttgcaccaacatctggtacttcagctaagacaccctctgagggcgggaagcttcagagtacctttgtatttgaggaaataggacgccgcctaaaggatattgggcctgaggtggtgaagaaagtaaatgctgtatttgagtggcatataaccaaaggcggaaatattggggctaagtggactattgacctgaaaagtggttctggaaaagtgtaccaaggccctgcaaaaggtgctgctgatacaacaatcatactttcagatgaagatttcatggaggtggtcctgggcaagcttgaccctcagaaggcattctttagtggcaggctgaaggccagagggaacatcatgctgagccagaaacttcagatgattcttaaagactacgccaagctctgaagggcacactacactattaataaaaatggaatcattaaatactctcttcacccaaatatgcttgattattctgcaaaagtgattagaactaagatgcaggggaaattgcttaacattttcagatatcagataactgcagattttcattttctactaatttttcatgtatcattatttttacaaggaactatatataagctagcacataattatccttctgttcttagatctgtatcttcataataaaaaaattttgcccaaaaaaaaaaaaaaaaaaaaaaaaaaaaaaaaaaaaaaaaaaaaaggggggggagcgaaaaaaactccacccaggggggcacaagaaaacgagaccccagcatacgagggaaacaagggggcacacaaaagagagggcgacataaaaaaacaaagaaagaggggcacaaaccacaacacccggcagaaacgggacacaacaacgaaaccacagggcgacaccgggtgcgcgacaggacaccactcacaacgacggaggaagagacaccaacaggggggcccccaccacccgacaaagagcatacagcaaggccagcagaaggacaacaaaacaaacaccacacggagagcaaccagggagcaaaacccacacgcgggaaaaaacgaaggagccaccgacaacacacacagcgcgaacacacgggcgaacacaacacaacaaacaaacccccaccaccgcaagaaggaacctacaagaccacacacagcacaggaggagcgccggagggaggaggagggcaaggagcggacgagggaagagaggaggagaggaagaggacggaggcaggggcgggaggcgcggagaacagaagggaagcgcgggaccgagcgcacagccgggaggccggagacagacgacgaaacagacccacaaaacaacaaaagcaaccaccacacacgcaccagaacaataacctagcctacagaaaacagcgaacacaaagaagacagacagcgcggacgacgaggcgccacgacaagaaggagtacaggacagatacagaccgaagaagagaccgcgaggagcagaccagaacagccaagacgacgacagataagcaagcagatgacacaaaaaacagacaagcgtaaacggaaggcgcgagacgcaacacagcaagcacaagaagaacaagcggaagcgaccgagacaatcaacacagcagaaaagacgaaagacgtaaaacaacaccaagcccagaacacacgaaagacacaaa

SEQ ID NO: 447947 - DNA, 905 bp, Homo sapiens
catgatgtgattgttcatgatgtgattgttcatgatgtgattgttcatgatgtgattgttctacaaactgagatgtggaaggaaggaaacagaattcattttcaaaccaaggtccaagaaactggagacattgtcatttcaaatgcatatgtggatcttgcaccaacatctggtacttcagctaagacaccctctgagggcgggaagcttcagagtacctttgtatttgaggaaataggacgccgcctaaaggatattgggcctgaggtggtgaagaaagtaaatgctgtatttgagtggcatataaccaaaggcggaaatattggggctaagtggactattgacctgaaaagtggttctggaaaagtgtaccaaggccctgcaaaaggtgctgctgatacaacaatcatactttcagatgaagatttcatggaggtggtcctgggcaagcttgaccctcagaaggcattctttagtggcaggctgaaggccagagggaacatcatgctgagccagaaacttcagatgattcttaaagactacgccaagctctgaagggcacactacactattaataaaaatggaatcattaaatactctcttcacccaaatatgcttgattattctgcaaaagtgattagaactaagatgcaggggaaattgcttaacattttcagatatcagataactgcagattttcattttctactaatttttcatgtatcattatttttacaaggaactatatataagctagcacataattatccttctgttcttagatctgtatcttcataataaaaaaattttgcccaagtcctgtttccttagaatttgtgatagcattgataagttgaaaggaaaattaaatcaataaaggcctttgatacctttaaaaattggaa

SEQ ID NO: 447948 - DNA, 1970 bp, Homo sapiens
attccccgcctcctcctgtcccgcagtcggcgtccagcggctctgcttgttcgtgtgtgtgtcgttgcaggccttattcatgggctcaccgctgaggttcgacgggcgggtggtactggtcaccggcgcgggggcaggattgggccgagcctatgccctggcttttgcagaaagaggagcgttagttgttgtgaatgatttgggaggggacttcaaaggagttggtaaaggctccttagctgctgataaggttgttgaagaaataagaaggagaggtggaaaagcagtggccaactatgattcagtggaagaaggagagaaggttgtgaagacagccctggatgcttttggaagaatagatgttgtggtcaacaatgctggaattctgagggatcgttcctttgctaggataagtgatgaagactgggatataatccacagagttcatttgcggggttcattccaagtgacacgggcagcatgggaacacatgaagaaacagaagtatggaaggattattatgacttcatcagcttcaggaatatatggcaactttggccaggccaattatagtgctgcaaagttgggtcttctgggccttgcaaattctcttgcaattgaaggcaggaaaagcaacattcattgtaacaccattgctcctaatgcgggatcacggatgactcagacagttatgcctgaagatcttgtggaagccctgaagccagagtatgtggcacctcttgtcctttggctttgtcacgagagttgtgaggagaatggtggcttgtttgaggttggagcaggatggattggaaaattacgctgggagcggactcttggagctattgtaagacaaaagaatcacccaatgactcctgaggcagtcaaggctaactggaagaagatctgtgactttgagaatgccagcaagcctcagagtatccaagaatcaactggcagtataattgaagttctgagtaaaatagattcagaaggaggagtttcagcaaatcatactagtcgtgcaacgtctacagcaacatcaggatttgctggagctattggccagaaactccctccattttcttatgcttatacggaactggaagctattatgtatgcccttggagtgggagcgtcaatcaaggatccaaaagatttgaaatttatttatgaaggaagttctgatttctcctgtttgcccaccttcggagttatcataggtcagaaatctatgatgggtggaggattagcagaaattcctggactttcaatcaactttgcaaaggttcttcatggagagcagtacttagagttatataaaccacttcccagagcaggaaaattaaaatgtgaagcagttgttgctgatgtcctagataaaggatccggtgtagtgattattatggatgtctattcttattctgagaaggaacttatatgccacaatcagttctctctctttcttgttggctctggaggctttggtggaaaacggacatcagacaaagtcaaggtagctgtagccatacctaatagacctcctgatgctgtacttacagataccacctctcttaatcaggctgctttgtaccgcctcagtggagactggaatcccttacacattgatcctaactttgctagtctagcaggttttgacaagcccatattacatggattatgtacatttggattttctgccaggcgtgtgttacagcagtttgcagataatgatgtgtcaagattcaaggcaattaaggctcgttttgcaaaaccagtatatccaggacaaactctacaaactgagatgtggaaggaaggaaacagaattcattttcaaaccaaggtccaagaaactggagactaagaaattaagtttcgttttgacatcttcagtcctgtgtgctttcagaaaaccattttctctgcaaagaaaggaaacagatttgcaaactttaaagtctgtcgtg

SEQ ID NO: 447949 - DNA, 686 bp, Homo sapiens
  misc_feature (632)..(632): n is a, c, g, or t
attccccgcctcctcctgtcccgcagtcggcgtccagcggctctgcttgttcgtgtgtgtgtcgttgcaggccttattcatgggctcaccgctgaggttcgacgggcgggtggtactggtcaccggcgcgggggcaggattgggccgagcctatgccctggcttttgcagaaagaggagcgttagttgttgtgaatgatttgggaggggacttcaaaggagttggtaaaggctccttagctgctgataaggttgttgaagaaataagaaggagaggtggaaaagcagtggccaactatgattcagtggaagaaggagagaaggttgtgaagacagccctggatgcttttggaagaatagatgttgtggtcaacaatgctggaattctgagggatcgttcctttgctaggataagtgatgaagactgggatataatccacagagttcatttgcggggttcattccaagtgacacgggcagcatgggaacacatgaagaaacagaagtatggaaggattattatgacttcatcagcttcaggaatatatggcaactttggccaggccaattatagtgctgcaaagttgggtcttctgggccttgcaaattctcttgcaattgaaggcaggacanacaggtatgcctgaagatcttgtggaagccctgaaccacaattgtggcctctgg

SEQ ID NO: 447950 - DNA, 577 bp, Homo sapiens
acgcggcggcgtgccagcctagccactctagcgacggcggggaagagtgtgtacgtggtgggggcttcctcggtggcgggcatggaggcttcgcgctgccggctcagtcccagcggcgacaggtcagacagggccgtggcaggtctcctcctgagcgaggcggaggggcgaagcgagaaggcggagtgtttgtccctgattcgggatggtctgactgatttgccagtgggccacaccccttgtttgtgcgcctctttctctgccagagggagagcctcggaaaaaaaaggatccaaaatctcagcgtgtcactttcttgttcgctaggttaatgagaagttaatgggaagccgtttgaaatcattggttagaaactttggcgtcatctgaggatttaagccctacacgccaactgtataccccgctttttattccattaccaagacaaagatttggggccaggcgccttggaacacgtctattatccccagcactttgggaggccaaggcaggaggatcgcttggtctcaggagttcgagaccagcctggacaagatagcgagacccccatctctag

SEQ ID NO: 447951 - DNA, 3108 bp, Homo sapiens
acgcggcggcgtgccagcctagccactctagcgacggcggggaagagtgtgtacgtggtgggggcttcctcggtggcgggcatggaggcttcgcgctgccggctcagtcccagcggcgacagtgtcttccatgaagaaatgatgaagatgcgacaggctaagctggattatcagaggctactacttgagaagaggcaaaggaaaaagcgccttgagccatttatggtgcagcccaatccagaagccaggctacgtcgggcaaagccaagggccagtgatgagcagactcccttggtgaactgtcatactccccacagcaatgtcatcttacatggtattgatggtccagctgctgtcctgaaaccagacgaagttcatgctccatcagtaagctcctctgttgtggaagaagatgctgaaaacaccgtggatactgcttccaagccaggacttcaggagcgtctccaaaagcatgatatctctgaaagtgtgaacttcgatgaggagactgatggaatatcccagtcagcatgtttagaaagacccaattctgcatcaagccagaattcaaccgatacaggcacttccggttctgctactgccgcccaaccagctgataacctcctgggagacatagacgacctggaggactttgtgtatagtcctgcccctcaaggtgtcacagtaagatgtcggataatccgggataaaaggggaatggatcggggtctcttccccacctactatatgtacttggaaaaagaagaaaatcagaagatatttcttcttgcagctagaaagcggaaaaagagcaaaacagccaactaccttatctccattgatccagttgatttatctcgtgaaggagaaagttatgtcggcaagcttagatccaacctcatggggaccaagtttacagtttatgaccgtggcatctgccccatgaagggccggggtttggtaggagcggcccacacccggcaggagctggctgccatctcctatgaaacaaacgtacttggatttaaaggtcctaggaaaatgtctgtgatcattcctggaatgacactgaatcataagcagatcccctatcagccacaaaacaaccatgacagtttgctctcaaggtggcagaacagaactatggaaaatctggttgagctgcacaacaaggcccccgtctggaacagtgacactcagtcctatgtcctcaacttccgtggccgggtcactcaggcgtctgtgaagaacttccagatagtccacaaaaatgaccctgattatatagtcatgcagtttggacgtgtggcagatgacgtgttcacactggattacaactacccactttgtgcagtacaggcctttggcatcggtctttctagctttgacagtaagctggcgtgtgaatgagagaacagtcaggcagggagcccttctccccacagagctttcaggagcagacagtggcctccccttcccctccctgccccaggacttaaagagcaatagtttgccccttttggaatgatctctgaatatataaaacacacacacaaagagcaatagtttgccccttttggaacgacccctgaatatataaaacacacacacgaagagcaatagtttgccccttttggaacgacccctgaatatataaaacacacacgaagagcaatagtttgccccttttggaacgacccctgaatatataaaacacacacacgaagagcaatagtttgccccttttggaacgacccctgaatatataaaacacacacacaccccgcgcactctcactccttttccaggtttcatagacttggtgagggatcacagcttagcatgggtgagagatgatttaaagcacagggagattcttgtcacattggggtctccaaagctagaatgggatttcatgtgcttggaaacttgcagtagaatcagggactgacatcgcagttcctctcctctcttcattccctcacagcagattggccggcaccaatcttagtcaagagtggctgtgatcacatttgtgatcaattatgtgagaattttatataattgtcttcatttcaattaaggctgaaagcataaactctagaggtgactcagtcaggactgacagtaatgtgataattgccttcattttcaacccaggagtgcctctcacagctatatgactacggatccattagtgaggagcgacacacacacctgtaggcatcctgtgcaaacactttgtcattatcaagagagatggcagtattgaccatttagtttagttaaaaaaaaaaaaaaaggtggcaggagaggctttggggaggatcagccagcagacatgagcactgctggcccgtgtggcagagctgtggactttcttctcggctccctcaaccctggctcaggcacagaaggtgttttgctacgtttttttgattattacacccctccacgtattatgtgactcttacaccagttcacccttcccagaacgtatccaaaccttgagaatgcaggagctctgtgagctccaccgtcagcaccattcagctgcatcccttgtgcacagaactgtttgccagcgttgggtgggacacccgtggcggctgctccctcagacctcccttctgtggactgacctctcacctccgcctgttgttcctgcaccacatcagataagcatgtgaaggagggccaactggcagctgcgggacccttggcttgtcccccaccgacaagtcccacctgctgggtgaggacgagactgtttccatctcaggcatgtatcccaccaagtgcctccctcacagccatgcccagaagcctcacacctcgtcaccaccaccaccccccaccccatcctgaggcactgcctggcagataaccctggttggccacagaagctattaatacacgacagcatgtggggaaggacttatggtgggccaggtggacctcatcctgcttcttcctccctctggtttaaagagatatataaactaatttcacataatttgtgtgtgcaggtgattggtttttacataagtcctatttataccttttatatgttacagaaataaaagttaatttatataaaaaaagtca

SEQ ID NO: 447952 - DNA, 2532 bp, Homo sapiens
acgcggcggcgtgccagcctagccactctagcgacggcggggaagagtgtgtacgtggtgggggcttcctcggtggcgggcatggaggcttcgcgctgccggctcagtcccagcggcgacagtgtcttccatgaagaaatgatgaagatgcgacaggctaagctggattatcagaggctactacttgagaagaggcaaaggaaaaagcgccttgagccatttatggtgcagcccaatccagaagccaggctacgtcgggcaaagccaagggccagtgatgagcagactcccttggtgaactgtcatactccccacagcaatgtcatcttacatggtattgatggtccagctgctgtcctgaaaccagacgaagttcatgctccatcagtaagctcctctgttgtggaagaagatgctgaaaacaccgtggatactgcttccaagccaggacttcaggagcgtctccaaaagcatgatatctctgaaagtgtgaacttcgatgaggagactgatggaatatcccagtcagcatgtttagaaagacccaattctgcatcaagccagaattcaaccgatacaggcacttccggttctgctactgccgcccaaccagctgataacctcctgggagacatagacgacctggaggactttgtgtatagtcctgcccctcaaggtgtcacagtaagatgtcggataatccgggataaaaggggaatggatcggggtctcttccccacctactatatgtacttggaaaaagaagaaaatcagaagatatttcttcttgcagctagaaagcggaaaaagagcaaaacagccaactaccttatctccattgatccagttgatttatctcgtgaaggagaaagttatgtcggcaagcttagatccaacctcatggggaccaagtttacagtttatgaccgtggcatctgccccatgaagggccggggtttggtaggagcggcccacacccggcaggagctggctgccatctcctatgaaacaaacgtacttggatttaaaggtcctaggaaaatgtctgtgatcattcctggaatgacactgaatcataagcagatcccctatcagccacaaaacaaccatgacagtttgctctcaaggtggcagaacagaactatggaaaatctggttgagctgcacaacaaggcccccgtctggaacagtgacactcagtcctatgtcctcaacttccgtggccgggtcactcaggcgtctgtgaagaacttccagatagtccacaaaaatgaccctgattatatagtcatgcagtttggacgtgtggcagatgacgtgttcacactggattacaactacccactttgtgcagtacaggcctttggcatcggtctttctagctttgacagtaagctggcgtgtgaatgagagaacagtcaggcagggagcccttctccccacagagctttcaggagcagacagtggcctccccttcccctccctgccccaggacttaaagagcaatagtttgccccttttggaatgatctctgaatatataaaacacacacacgaagagcaatagtttgccccttttggaacgacccctgaatatataaaacacacacacgaagagcaatagtttgccccttttggaacgacccctgaatatataaaacacacacacaccccgcgcactctcactccttttccaggtttcatagacttggtgagggatcacagcttagcatgggtgagagatgatttaaagcacagggagattcttgtcacattggggtctccaaagctagaatgggatttcatgtgcttggaaacttgcagtagaatcagggactgacatcgcagttcctctcctctcttcattccctcacagcagattggccggcaccaatcttagtcaagagtggctgtgatcacatttgtgatcaattatgtgagaattttatataattgtcttcatttcaattaaggctgaaagcataaactctagaggtgactcagtcaggactgacagtaatgtgataattgccttcattttcaacccaggagtgcctctcacagctatatgactacggatccattagtgaggagcgacacacacacctgtaggcatcctgtgcaaacactttgtcattatcaagagagatggcagtattgaccatttagtttagttaaaaaaaaaaaaaaaggtggcaggagaggctttggggaggatcagccagcagacatgagcactgctggcccgtgtggcagagctgtggactttcttctcggctccctcaaccctggctcaggcacagaaggtgttttgctacgtttttttgattattacacccctccacgtattatgtgactcttacaccagttcacccttcccagactcatcctgcttcttcctccctctggtttaaagagatatataaactaatttcacataatttgtgtgtgcaggtgattggtttttacataagtcctatttataccttttatatgttacagaaataaaagttaatttatataaaaaaagtca

SEQ ID NO: 447953 - DNA, 2499 bp, Homo sapiens
attctgataagagagttagagaaagggataaaggcccaaagattaacagcttgacatatgctgaggacttgctaagcactggctgaatgaatatgtaggacaaccatgaccagaggtggggcaggttctctggacttcatttttgactgacactttttcttttcccagatatttcttcttgcagctagaaagcggaaaaagagcaaaacagccaactaccttatctccattgatccagttgatttatctcgtgaaggagaaagttatgtcggcaagcttagatccaacctcatggggaccaagtttacagtttatgaccgtggcatctgccccatgaagggccggggtttggtaggagcggcccacacccggcaggagctggctgccatctcctatgaaacaaacgtacttggatttaaaggtcctaggaaaatgtctgtgatcattcctggaatgacactgaatcataagcagatcccctatcagccacaaaacaaccatgacagtttgctctcaaggtggcagaacagaactatggaaaatctggttgagctgcacaacaaggcccccgtctggaacagtgacactcagtcctatgtcctcaacttccgtggccgggtcactcaggcgtctgtgaagaacttccagatagtccacaaaaatgaccctgattatatagtcatgcagtttggacgtgtggcagatgacgtgttcacactggattacaactacccactttgtgcagtacaggcctttggcatcggtctttctagctttgacagtaagctggcgtgtgaatgagagaacagtcaggcagggagcccttctccccacagagctttcaggagcagacagtggcctccccttcccctccctgccccaggacttaaagagcaatagtttgccccttttggaatgatctctgaatatataaaacacacacacaaagagcaatagtttgccccttttggaacgacccctgaatatataaaacacacacacgaagagcaatagtttgccccttttggaacgacccctgaatatataaaacacacacgaagagcaatagtttgccccttttggaacgacccctgaatatataaaacacacacacgaagagcaatagtttgccccttttggaacgacccctgaatatataaaacacacacacaccccgcgcactctcactccttttccaggtttcatagacttggtgagggatcacagcttagcatgggtgagagatgatttaaagcacagggagattcttgtcacattggggtctccaaagctagaatgggatttcatgtgcttggaaacttgcagtagaatcagggactgacatcgcagttcctctcctctcttcattccctcacagcagattggccggcaccaatcttagtcaagagtggctgtgatcacatttgtgatcaattatgtgagaattttatataattgtcttcatttcaattaaggctgaaagcataaactctagaggtgactcagtcaggactgacagtaatgtgataattgccttcattttcaacccaggagtgcctctcacagctatatgactacggatccattagtgaggagcgacacacacacctgtaggcatcctgtgcaaacactttgtcattatcaagagagatggcagtattgaccatttagtttagttaaaaaaaaaaaaaaaggtggcaggagaggctttggggaggatcagccagcagacatgagcactgctggcccgtgtggcagagctgtggactttcttctcggctccctcaaccctggctcaggcacagaaggtgttttgctacgtttttttgattattacacccctccacgtattatgtgactcttacaccagttcacccttcccagaacgtatccaaaccttgagaatgcaggagctctgtgagctccaccgtcagcaccattcagctgcatcccttgtgcacagaactgtttgccagcgttgggtgggacacccgtggcggctgctccctcagacctcccttctgtggactgacctctcacctccgcctgttgttcctgcaccacatcagataagcatgtgaaggagggccaactggcagctgcgggacccttggcttgtcccccaccgacaagtcccacctgctgggtgaggacgagactgtttccatctcaggcatgtatcccaccaagtgcctccctcacagccatgcccagaagcctcacacctcgtcaccaccaccaccccccaccccatcctgaggcactgcctggcagataaccctggttggccacagaagctattaatacacgacagcatgtggggaaggacttatggtgggccaggtggacctcatcctgcttcttcctccctctggtttaaagagatatataaactaatttcacataatttgtgtgtgcaggtgattggtttttacataagtcctatttataccttttatatgttacagaaataaaagttaatttatataaaaaaagtca

SEQ ID NO: 447954 - DNA, 2338 bp, Homo sapiens
acgcggcggcgtgccagcctagccactctagcgacggcggggaagagtgtgtacgtggtgggggcttcctcggtggcgggcatggaggcttcgcgctgccggctcagtcccagcggcgacagtgtcttccatgaagaaatgatgaagatgcgacaggctaagctggattatcagaggctactacttgagaagaggcaaaggaaaaagcgccttgagccatttatggtgcagcccaatccagaagccaggctacgtcgggcaaagccaagggccagtgatgagcagactcccttggtgaactgtcatactccccacagcaatgtcatcttacatggtattgatggtccagctgctgtcctgaaaccagacgaagttcatgctccatcagtaagctcctctgttgtggaagaagatgctgaaaacaccgtggatactgcttccaagccaggacttcaggagcgtctccaaaagcatgatatctctgaaagtgtgaacttcgatgaggagactgatggaatatcccagtcagcatgtttagaaagacccaattctgcatcaagccagaattcaaccgatacaggcacttccggttctgctactgccgcccaaccagctgataacctcctgggagacatagacgacctggaggactttgtgtatagtcctgcccctcaaggtgtcacagtaagatgtcggataatccgggataaaaggggaatggatcggggtctcttccccacctactatatgtacttggaaaaagaagaaaatcagaagatatttcttcttgcagctagaaagcggaaaaagagcaaaacagccaactaccttatctccattgatccagttgatttatctcgtgaaggagaaagttatgtcggcaagcttagatccaacctcatggggaccaagtttacagtttatgaccgtggcatctgccccatgaagggccggggtttggtaggagcggcccacacccggcaggagctggctgccatctcctatgaaacaaacgtacttggatttaaaggtcctaggaaaatgtctgtgatcattcctggaatgacactgaatcataagcagatcccctatcagccacaaaacaaccatgacagtttgctctcaaggtggcagaacagaactatggaaaatctggttgagctgcacaacaaggcccccgtctggaacagtgacactcagtcctatgtcctcaacttccgtggccgggtcactcaggcgtctgtgaagaacttccagatagtccacaaaaatgaccctgattatatagtcatgcagtttggacgtgtggcagatgacgtgttcacactggattacaactacccactttgtgcagtacaggcctttggcatcggtctttctagctttgacagagtgcctctcacagctatatgactacggatccattagtgaggagcgacacacacacctgtaggcatcctgtgcaaacactttgtcattatcaagagagatggcagtattgaccatttagtttagttaaaaaaaaaaaaaaaggtggcaggagaggctttggggaggatcagccagcagacatgagcactgctggcccgtgtggcagagctgtggactttcttctcggctccctcaaccctggctcaggcacagaaggtgttttgctacgtttttttgattattacacccctccacgtattatgtgactcttacaccagttcacccttcccagaacgtatccaaaccttgagaatgcaggagctctgtgagctccaccgtcagcaccattcagctgcatcccttgtgcacagaactgtttgccagcgttgggtgggacacccgtggcggctgctccctcagacctcccttctgtggactgacctctcacctccgcctgttgttcctgcaccacatcagataagcatgtgaaggagggccaactggcagctgcgggacccttggcttgtcccccaccgacaagtcccacctgctgggtgaggacgagactgtttccatctcaggcatgtatcccaccaagtgcctccctcacagccatgcccagaagcctcacacctcgtcaccaccaccaccccccaccccatcctgaggcactgcctggcagataaccctggttggccacagaagctattaatacacgacagcatgtggggaaggacttatggtgggccaggtggacctcatcctgcttcttcctccctctggtttaaagagatatataaactaatttcacataatttgtgtgtgcaggtgattggtttttacataagtcctatttataccttttatatgttacagaaataaaagttaatttatataaaaaaagtca

SEQ ID NO: 447955 - DNA, 1001 bp, Homo sapiens
acgcggcggcgtgccagcctagccactctagcgacggcggggaagagtgtgtacgtggtgggggcttcctcggtggcgggcatggaggcttcgcgctgccggctcagtcccagcggcgacagtgtcttccatgaagaaatgatgaagatgcgacaggctaagctggattatcagaggctactacttgagaagaggcaaaggaaaaagcgccttgagccatttatggtgcagcccaatccagaagccaggctacgtcgggcaaagccaagggccagtgatgagcagactcccttggtgaactgtcatactccccacagcaatgtcatcttacatggtattgatggtccagctgctgtcctgaaaccagacgaagttcatgctccatcagtaagctcctctgttgtggaagaagatgctgaaaacaccgtggatactgcttccaagccaggacttcaggagcgtctccaaaagcatgatatctctgaaagtgtgaacttcgatgaggagactgatggaatatcccagtcagcatgtttagaaagacccaattctgcatcaagccagaattcaaccgatacaggcacttccggttctgctactgccgcccaaccagctgataacctcctgggagacatagacgacctggaggactttgtgtatagtcctgcccctcaaggtgtcacagtaagatgtcggataatccgggataaaaggggaatggatcggggtctcttccccacctactatatgtacttggaaaaagaagaaaatcagaagatatttcttcttgcagctagaaagcggaaaaagagcaaaacagccaactaccttatctccattgatccagttgatttatctcgtgaaggagaaagttatgtcggcaagcttaggtgaaagcaaccttagatcactgtcctattctttctgatagtcttattcctatagttgcagaacagtccttatcttggttacaactagcatgtattgatgttgtaatctta

SEQ ID NO: 447956 - DNA, 225 bp, Homo sapiens
tgggacgggaggtcaaggctgcagtgagctgtggtcattccactaggctccagccagggcgacagagcaaaaccccatctaagaaaaggaagaaaaagaaaaagatttccctgagtgcaaccacattatattctaacatgttgatttctttctgtttctagctgattatatagtcatgcagtttggacgtgtggcagatgacgtgttcacactggattacaacta

SEQ ID NO: 447957 - DNA, 2996 bp, Homo sapiens
acgcggcggcgtgccagcctagccactctagcgacggcggggaagagtgtgtacgtggtgggggcttcctcggtggcgggcatggaggcttcgcgctgccggctcagtcccagcggcgacagtgtcttccatgaagaaatgatgaagatgcgacaggctaagctggattatcagaggctactacttgagaagaggcaaaggaaaaagcgccttgagccatttatggtgcagcccaatccagaagccaggctacgtcgggcaaagccaagggccagtgatgagcagactcccttggtgaactgtcatactccccacagcaatgtcatcttacatggtattgatggtccagctgctgtcctgaaaccagacgaagttcatgctccatcagtaagctcctctgttgtggaagaagatgctgaaaacaccgtggatactgcttccaagccaggacttcaggagcgtctccaaaagcatgatatctctgaaagtgtgaacttcgatgaggagactgatggaatatcccagtcagcatgtttagaaagacccaattctgcatcaagccagaattcaaccgatacaggcacttccggttctgctactgccgcccaaccagctgataacctcctgggagacatagacgacctggaggactttgtgtatagtcctgcccctcaaggtgtcacagtaagatgtcggataatccgggataaaaggggaatggatcggggtctcttccccacctactatatgtacttggaaaaagaagaaaatcagaagatatttcttcttgcagctagaaagcggaaaaagagcaaaacagccaactaccttatctccattgatccagttgatttatctcgtgaaggagaaagttatgtcggcaagcttagatccaacctcatggggaccaagtttacagtttatgaccgtggcatctgccccatgaagggccggggtttggtaggagcggcccacacccggcaggagctggctgccatctcctatgaaacaaacgtacttggatttaaaggtcctaggaaaatgtctgtgatcattcctggaatgacactgaatcataagcagatcccctatcagccacaaaacaaccatgacagtttgctctcaaggtggcagaacagaactatggaaaatctggttgagctgcacaacaaggcccccgtctggaacagtgacactcagtcctatgtcctcaacttccgtggccgggtcactcaggcgtctgtgaagaacttccagatagtccacaaaaatgaccctgattatatagtcatgcagtttggacgtgtggcagatgacgtgttcacactggattacaactacccactttgtgcagtacaggcctttggcatcggtctttctagctttgacagtaagctggcgtgtgaatgagagaacagtcaggcagggagcccttctccccacagagctttcaggagcagacagtggcctccccttcccctccctgccccaggacttaaagagcaatagtttgccccttttggaatgatctctgaatatataaaacacacacacgaagagcaatagtttgccccttttggaacgacccctgaatatataaaacacacacacgaagagcaatagtttgccccttttggaacgacccctgaatatataaaacacacacacaccccgcgcactctcactccttttccaggtttcatagacttggtgagggatcacagcttagcatgggtgagagatgatttaaagcacagggagattcttgtcacattggggtctccaaagctagaatgggatttcatgtgcttggaaacttgcagtagaatcagggactgacatcgcagttcctctcctctcttcattccctcacagcagattggccggcaccaatcttagtcaagagtggctgtgatcacatttgtgatcaattatgtgagaattttatataattgtcttcatttcaattaaggctgaaagcataaactctagaggtgactcagtcaggactgacagtaatgtgataattgccttcattttcaacccaggagtgcctctcacagctatatgactacggatccattagtgaggagcgacacacacacctgtaggcatcctgtgcaaacactttgtcattatcaagagagatggcagtattgaccatttagtttagttaaaaaaaaaaaaaaaggtggcaggagaggctttggggaggatcagccagcagacatgagcactgctggcccgtgtggcagagctgtggactttcttctcggctccctcaaccctggctcaggcacagaaggtgttttgctacgtttttttgattattacacccctccacgtattatgtgactcttacaccagttcacccttcccagaacgtatccaaaccttgagaatgcaggagctctgtgagctccaccgtcagcaccattcagctgcatcccttgtgcacagaactgtttgccagcgttgggtgggacacccgtggcggctgctccctcagacctcccttctgtggactgacctctcacctccgcctgttgttcctgcaccacatcagataagcatgtgaaggagggccaactggcagctgcgggacccttggcttgtcccccaccgacaagtcccacctgctgggtgaggacgagactgtttccatctcaggcatgtatcccaccaagtgcctccctcacagccatgcccagaagcctcacacctcgtcaccaccaccaccccccaccccatcctgaggcactgcctggcagataaccctggttggccacagaagctattaatacacgacagcatgtggggaaggacttatggtgggccaggtggacctcatcctgcttcttcctccctctggtttaaagagatatataaactaatttcacataatttgtgtgtgcaggtgattggtttttacataagtcctatttataccttttatatgttacagaaataaaagttaatttatataaaaaaagtca

SEQ ID NO: 447958 - DNA, 2792 bp, Homo sapiens
gtaagctcaaatttagtttatgatctaattttttctgtctcaggtcagctattgtgaggctttgtcccattttgatacttacttttcattactctcaatattcatatacttaatttaacttttcagttttcctcattctgtcagaagactgaagacacgggtaaattactaagttgctttgtccactaagtgtttttcaaagagaatcagattttgagtctcggcctgttgttgctcatgtatggctgtcctttcaggatacaggcacttccggttctgctactgccgcccaaccagctgataacctcctgggagacatagacgacctggaggactttgtgtatagtcctgcccctcaaggtgtcacagtaagatgtcggataatccgggataaaaggggaatggatcggggtctcttccccacctactatatgtacttggaaaaagaagaaaatcagaagatatttcttcttgcagctagaaagcggaaaaagagcaaaacagccaactaccttatctccattgatccagttgatttatctcgtgaaggagaaagttatgtcggcaagcttagatccaacctcatggggaccaagtttacagtttatgaccgtggcatctgccccatgaagggccggggtttggtaggagcggcccacacccggcaggagctggctgccatctcctatgaaacaaacgtacttggatttaaaggtcctaggaaaatgtctgtgatcattcctggaatgacactgaatcataagcagatcccctatcagccacaaaacaaccatgacagtttgctctcaaggtggcagaacagaactatggaaaatctggttgagctgcacaacaaggcccccgtctggaacagtgacactcagtcctatgtcctcaacttccgtggccgggtcactcaggcgtctgtgaagaacttccagatagtccacaaaaatgaccctgattatatagtcatgcagtttggacgtgtggcagatgacgtgttcacactggattacaactacccactttgtgcagtacaggcctttggcatcggtctttctagctttgacagtaagctggcgtgtgaatgagagaacagtcaggcagggagcccttctccccacagagctttcaggagcagacagtggcctccccttcccctccctgccccaggacttaaagagcaatagtttgccccttttggaatgatctctgaatatataaaacacacacacaaagagcaatagtttgccccttttggaacgacccctgaatatataaaacacacacacgaagagcaatagtttgccccttttggaacgacccctgaatatataaaacacacacgaagagcaatagtttgccccttttggaacgacccctgaatatataaaacacacacacgaagagcaatagtttgccccttttggaacgacccctgaatatataaaacacacacacaccccgcgcactctcactccttttccaggtttcatagacttggtgagggatcacagcttagcatgggtgagagatgatttaaagcacagggagattcttgtcacattggggtctccaaagctagaatgggatttcatgtgcttggaaacttgcagtagaatcagggactgacatcgcagttcctctcctctcttcattccctcacagcagattggccggcaccaatcttagtcaagagtggctgtgatcacatttgtgatcaattatgtgagaattttatataattgtcttcatttcaattaaggctgaaagcataaactctagaggtgactcagtcaggactgacagtaatgtgataattgccttcattttcaacccaggagtgcctctcacagctatatgactacggatccattagtgaggagcgacacacacacctgtaggcatcctgtgcaaacactttgtcattatcaagagagatggcagtattgaccatttagtttagttaaaaaaaaaaaaaaaggtggcaggagaggctttggggaggatcagccagcagacatgagcactgctggcccgtgtggcagagctgtggactttcttctcggctccctcaaccctggctcaggcacagaaggtgttttgctacgtttttttgattattacacccctccacgtattatgtgactcttacaccagttcacccttcccagaacgtatccaaaccttgagaatgcaggagctctgtgagctccaccgtcagcaccattcagctgcatcccttgtgcacagaactgtttgccagcgttgggtgggacacccgtggcggctgctccctcagacctcccttctgtggactgacctctcacctccgcctgttgttcctgcaccacatcagataagcatgtgaaggagggccaactggcagctgcgggacccttggcttgtcccccaccgacaagtcccacctgctgggtgaggacgagactgtttccatctcaggcatgtatcccaccaagtgcctccctcacagccatgcccagaagcctcacacctcgtcaccaccaccaccccccaccccatcctgaggcactgcctggcagataaccctggttggccacagaagctattaatacacgacagcatgtggggaaggacttatggtgggccaggtggacctcatcctgcttcttcctccctctggtttaaagagatatataaactaatttcacataatttgtgtgtgcaggtgattggtttttacataagtcctatttataccttttatatgttacagaaataaaagttaatttatataaaaaaagtca

SEQ ID NO: 447959 - DNA, 1857 bp, Homo sapiens
acgcggcggcgtgccagcctagccactctagcgacggcggggaagagtgtgtacgtggtgggggcttcctcggtggcgggcatggaggcttcgcgctgccggctcagtcccagcggcgacagtgtcttccatgaagaaatgatgaagatgcgacaggctaagctggattatcagaggctactacttgagaagaggcaaaggaaaaagcgccttgagccatttatggtgcagcccaatccagaagccaggctacgtcgggcaaagccaagggccagtgatgagcagactcccttggtgaactgtcatactccccacagcaatgtcatcttacatggtattgatggtccagctgctgtcctgaaaccagacgaagttcatgctccatcagtaagctcctctgttgtggaagaagatgctgaaaacaccgtggatactgcttccaagccaggacttcaggagcgtctccaaaagcatgatatctctgaaagtgtgaacttcgatgaggagactgatggaatatcccagtcagcatgtttagaaagacccaattctgcatcaagccagaattcaaccgatacaggcacttccggttctgctactgccgcccaaccagctgataacctcctgggagacatagacgacctggaggactttgtgtatagtcctgcccctcaaggtgtcacagtaagatgtcggataatccgggataaaaggggaatggatcggggtctcttccccacctactatatgtacttggaaaaagaagaaaatcagaagatatttcttcttgcagctagaaagcggaaaaagagcaaaacagccaactaccttatctccattgatccagttgatttatctcgtgaaggagaaagttatgtcggcaagcttagatccaacctcatggggaccaagtttacagtttatgaccgtggcatctgccccatgaagggccggggtttggtaggagcggcccacacccggcaggagctggctgccatctcctatgaaacaaacgtacttggatttaaaggtcctaggaaaatgtctgtgatcattcctggaatgacactgaatcataagcagatcccctatcagccacaaaacaaccatgacagtttgctctcaaggtggcagaacagaactatggaaaatctggttgagctgcacaacaaggcccccgtctggaacagtgacactcagtcctatgtcctcaacttccgtggccgggtcactcaggcgtctgtgaagaacttccagatagtccacaaaaatgaccctgattatatagtcatgcagtttggacgtgtggcagatgacgtgttcacactggattacaactacccactttgtgcagtacaggcctttggcatcggtctttctagctttgacagtaagctggcgtgtgaatgagagaacagtcaggcagggagcccttctccccacagagctttcaggagcagacagtggcctccccttcccctccctgccccaggacttaaagagcaatagtttgccccttttggaatgatctctgaatatataaaacacacacacaaagagcaatagtttgccccttttggaacgacccctgaatatataaaacacacacacgaagagcaatagtttgccccttttggaacgacccctgaatatataaaacacacacgaagagcaatagtttgccccttttggaacgacccctgaatatataaaacacacacacgaagagcaatagtttgccccttttggaacgacccctgaatatataaaacacacacgatgagcaatagttcgcccctttgggaacgacgcatgaatatataaaacacacggcacgaagaagcatagtttggccct

SEQ ID NO: 447960 - DNA, 2004 bp, Homo sapiens
acgcggcggcgtgccagcctagccactctagcgacggcggggaagagtgtgtacgtggtgggggcttcctcggtggcgggcatggaggcttcgcgctgccggctcagtcccagcggcgacagtgtcttccatgaagaaatgatgaagatgcgacaggctaagctggattatcagaggctactacttgagaagaggcaaaggaaaaagcgccttgagccatttatggtgcagcccaatccagaagccaggctacgtcgggcaaagccaagggccagtgatgagcagactcccttggtgaactgtcatactccccacagcaatgtcatcttacatggtattgatggtccagctgctgtcctgaaaccagacgaagttcatgctccatcagtaagctcctctgttgtggaagaagatgctgaaaacaccgtggatactgcttccaagccaggacttcaggagcgtctccaaaagcatgatatctctgaaagtgtgaacttcgatgaggagactgatggaatatcccagtcagcatgtttagaaagacccaattctgcatcaagccagaattcaaccgatacaggcacttccggttctgctactgccgcccaaccagctgataacctcctgggagacatagacgacctggaggactttgtgtatagtcctgcccctcaaggtgtcacagtaagatgtcggataatccgggataaaaggggaatggatcggggtctcttccccacctactatatgtacttggaaaaagaagaaaatcagaagatatttcttcttgcagctagaaagcggaaaaagagcaaaacagccaactaccttatctccattgatccagttgatttatctcgtgaaggagaaagttatgtcggcaagcttagatccaacctcatggggaccaagtttacagtttatgaccgtggcatctgccccatgaagggccggggtttggtaggagcggcccacacccggcaggagctggctgccatctcctatgaaacaaacgtacttggatttaaaggtcctaggaaaatgtctgtgatcattcctggaatgacactgaatcataagcagatcccctatcagccacaaaacaaccatgacagtttgctctcaaggtggcagaacagaactatggaaaatctggttgagctgcacaacaaggcccccgtctggaacagtgacactcagtcctatgtcctcaacttccgtggccgggtcactcaggcgtctgtgaagaacttccagatagtccacaaaaatgaccctgattatatagtcatgcagtttggacgtgtggcagatgacgtgttcacactggattacaactacccactttgtgcagtacaggcctttggcatcggtctttctagctttgacaacgtatccaaaccttgagaatgcaggagctctgtgagctccaccgtcagcaccattcagctgcatcccttgtgcacagaactgtttgccagcgttgggtgggacacccgtggcggctgctccctcagacctcccttctgtggactgacctctcacctccgcctgttgttcctgcaccacatcagataagcatgtgaaggagggccaactggcagctgcgggacccttggcttgtcccccaccgacaagtcccacctgctgggtgaggacgagactgtttccatctcaggcatgtatcccaccaagtgcctccctcacagccatgcccagaagcctcacacctcgtcaccaccaccaccccccaccccatcctgaggcactgcctggcagataaccctggttggccacagaagctattaatacacgacagcatgtggggaaggacttatggtgggccaggtggacctcatcctgcttcttcctccctctggtttaaagagatatataaactaatttcacataatttgtgtgtgcaggtgattggtttttacataagtcctatttataccttttatatgttacagaaataaaagttaatttatataaaaaaagtca

SEQ ID NO: 447961 - DNA, 2109 bp, Homo sapiens
attagtagaatctgaaatgagatttttagatcatcaaagtctcttcttgtaaatgtgttagataggctttgtatctgcattttattttctaagagcatgttagggttttccttatgtgggaggtatgttacttgaaaaaagtgtaagtaaatgattattttaaaatgtattcttgtttaataaacgagtaaaaaattcatatagctgtcagctacatagtcgcctgatttgtttcatatattttgtggattattagtctttgccttatgtttgcactcagattctggcaattaaccgtggagaaaatttgaaggtactgacggttaaggtcaatatttctgatggagtgaaggatgaattctgtaggtggtgcatccaaaacaggtctgtttacagatatttacagaattttctttgtttcttttctaaaatatgataccgatatctatatgtactgatatgtaaagatgtctattacgtgaacatttttaaaaagccagtgacaggccgggcgcggtggctcacgcctgtaatcccagcactttcggaggcttgtcttgaactcctgacctagggtgatccacccgcctcggccaatacatacaatcttaatgtaatttccacaagggaagtacttccagtaggacttaattcagtggagacaaaaaggcaacctattacgttggtgcaaaagtaattgcggtttttgcctttttgttgtataacggcaaaaaccacaattatttttgctccaaccttaacacgtcatgatcactgttgaaacttgtgattccacatttgacttaaggcatttgcattattctctttcatttgcttttaaaaaaataaattggaacttaacctttttatgatatcattattataaaacatcacctcctgaagaaaattccacatttaggaggaataaagaggcagaggagtcactggcaaaaataccagatcagatattcaagcatctccctctggtgtcttttgtgtccaataaaagcctcaaagatcagtgtcatacactttgacctctgaatgttaaacggtaccagaatccaagttcataccatggctacaaagttaccaaggatttacatacttgtacatgaagttacatggtgttgtagggagatgaagggttccctgagtctggctgtgatcagctctaaacagaggattcaggtagtcggcccgattcttccacaggtgagcccataatgagtatgttctttcttgaatcctgttataaagaaaataagtctataaatgacctattttggtgcttacacacagtagatatgttatattaatgctggaaaggaactaataattgttacctgaaaaccacgtgtctgttcgatagcaggtaaatgtatcatcttggtgacttcatggtatagagggagaacactgtaataatctcaacttcaccaccatctgtactggccttgacaaggtgttcgattcgtgtgtgtgtgtgtgtgtgttaagctgttcttttggggggagttttttcccccaaatagtcattggacatttataatttgtcacacactattctaaatgttccacgttttctctcatttaatcctcactgagttgctgtgagctatgtctaatttacagatgaagaaactgaggaatagagagaataagtggtttcccaaagtcctatagctagtaagtggaaaagccatattcagacccaagcagatactgttagaattggctagtcaggtacaagaaaacaggtgaccctaaaggatacactctgctccttctaaatcatctccatctccatggaatcacacttgagcttccttagagaaaacaaactagtatccactacaaaaattaattttctttatgagtccatttcatttgaactgatcattccccaaattaaatctgataatgttgtatacaccatagttaaaaccatttcattttatgaaaatttaaaaaatgttctctcatgtatactgcctaaatcactttgttgtaagttttttactgtcacttattttaaagtccacaatttatctacttttacccttggataaatcaatacagttttaatctgaataaattctggctttt

SEQ ID NO: 447962 - DNA, 2591 bp, Homo sapiens
caggggagctcagtctgctatcgtacattaggcctgacgttaaagggctttcaacgcttcaggatattgaaataggagtgcagcatattttagcagatatgattgctaaagacaaagacacgcttgacttcattcggaacttgtgccagaagagacatgtttgtatccagtcatctctggcaaaagtatcctcaaaaaaggtaaatgagaaagatgttgataagtttctgctctaccagcatttttcctgcaacataagaaacattcaccatcatcagattctggcaattaaccgtggagaaaatttgaaggtactgacggttaaggtcaatatttctgatggagtgaaggatgaattctgtaggtggtgcatccaaaacaggtggagaccacgtagctttgcaaggccagagttaatgaagatcttatataattcactgaatgattcctttaaacgccttatttatcctcttctctgtagagaattcagagccaaactaacatcagatgcagagaaggaatcagtaatgatgtttggacggaaccttcgtcagctccttttaacaagccctgttccagggcgcaccttaatgggagtggatcctggttataaacatggttgcaaattagctataatttctcctactagtcagatacttcatactgatgtggtttacttgcattgtggacaaggcttccgagaggcggagaaaataaagacacttttgctgaatttcaactgcagcacagtagtgattggaaatggaactgcctgcagggaaacagaagcttactttgctgacctgataatgaagaattattttgcaccactggatgttgtttactgtatcgtcagtgaagcaggagcatcaatctacagtgtcagccctgaagctaacaaagagatgccagggctggaccctaatttgagaagtgcagtttccatagcaaggcgtgtacaagatccattagctgagctagtgaaaattgagccaaagcacattggagttggaatgtatcagcatgacgtatcccagactttactcaaggcaacactggacagtgttgtagaagaatgtgtcagctttgtgggagtggatattaacatctgttcagaagttttgttaaggcatattgcaggactcaatgccaacagggccaaaaatattattgaatggcgagagaaaaatggaccctttatcaaccgagaacagctgaagaaagtgaaagggctgggcccaaaatccttccaacagtgtgctggcttcatcagaatcaaccaggattatatccgaacgttttgcagtcagcaaactgaaacttcaggccaaattcaaggagttgctgtgacatcttcagcagacgttgaggtcacaaatgagaagcagggcaaaaagaagagcaaaactgcagtgaatgttttactgaagccaaatcctttggaccaaacttgtattcatccagaatcatatgacatagcaatgaggtttttgtcatccattggagggacactgtatgaggttggaaagcctgaaatgcaacaaaaaataaattcattccttgaaaaggaaggaatggagaaaattgcagaaagattgcaaacaacagtacacaccttacaggtcatcatagatggtctcagccagcctgaaagctttgactttcgaacagattttgataaacctgatttcaagagaagcatagtatgcctggaagatctgcagattgggacagttcttacaggcaaagttgagaatgccactctctttggaatttttgtggatataggagtggggaaatctgggctgattcccatacgaaatgtaacagaagcaaaactttcaaaaacaaagaagagaagaagccttggactgggccccggagaaagagtggaagtccaagtactcaacattgacatcccccgatctaggattactctggacctcattcgggtgttatgagtatcccacgaaggccagacgctgattttattttctcatttccacagattgacaaggataagtcagttgtttgtaaactctaggtagcagatgagaaataattcacttaatatcagaaatattttccaaacactttcctttattttttcttctgaataaatagaaaaccaacagtttgatttccttttcccttaaaggaaacaactaatacacattcttatatggctttatgtagtaatagttttctgactaaaattttgttttttattttttgtaatttatctttaactccttttgcattttgtataacagattgcttaacttctacttgccaacatctgccttgctggacttgtatgggattgtcttcttgatttgaattgtaccgtctttgttgacacagtagggctgggcagtgtttaatccttccattttatagatttttttttaatcaggccttttggacttcattcataattttgcaataatctcttttcccttgtcatgcaagccaaaaatataccagtaaaacagattctgacgtgtttgtagttatcaaatgaatggctcgaaacacttctcaaaaggatatacgtattgaccccaacaataaatgtttgtggctagtga

SEQ ID NO: 447963 - DNA, 2340 bp, Homo sapiens
gggtcttcctgtgtgtcaggattttttattctggcaattaaccgtggagaaaatttgaaggtactgacggttaaggtcaatatttctgatggagtgaaggatgaattctgtaggtggtgcatccaaaacaggtggagaccacgtagctttgcaaggccagagttaatgaagatcttatataattcactgaatgattcctttaaacgccttatttatcctcttctctgtagagaattcagagccaaactaacatcagatgcagagaaggaatcagtaatgatgtttggacggaaccttcgtcagctccttttaacaagccctgttccagggcgcaccttaatgggagtggatcctggttataaacatggttgcaaattagctataatttctcctactagtcagatacttcatactgatgtggtttacttgcattgtggacaaggcttccgagaggcggagaaaataaagacacttttgctgaatttcaactgcagcacagtagtgattggaaatggaactgcctgcagggaaacagaagcttactttgctgacctgataatgaagaattattttgcaccactggatgttgtttactgtatcgtcagtgaagcaggagcatcaatctacagtgtcagccctgaagctaacaaagagatgccagggctggaccctaatttgagaagtgcagtttccatagcaaggcgtgtacaagatccattagctgagctagtgaaaattgagccaaagcacattggagttggaatgtatcagcatgacgtatcccagactttactcaaggcaacactggacagtgttgtagaagaatgtgtcagctttgtgggagtggatattaacatctgttcagaagttttgttaaggcatattgcaggactcaatgccaacagggccaaaaatattattgaatggcgagagaaaaatggaccctttatcaaccgagaacagctgaagaaagtgaaagggctgggcccaaaatccttccaacagtgtgctggcttcatcagaatcaaccaggattatatccgaacgttttgcagtcagcaaactgaaacttcaggccaaattcaaggagttgctgtgacatcttcagcagacgttgaggtcacaaatgagaagcagggcaaaaagaagagcaaaactgcagtgaatgttttactgaagccaaatcctttggaccaaacttgtattcatccagaatcatatgacatagcaatgaggtttttgtcatccattggagggacactgtatgaggttggaaagcctgaaatgcaacaaaaaataaattcattccttgaaaaggaaggaatggagaaaattgcagaaagattgcaaacaacagtacacaccttacaggtcatcatagatggtctcagccagcctgaaagctttgactttcgaacagattttgataaacctgatttcaagagaagcatagtatgcctggaagatctgcagattgggacagttcttacaggcaaagttgagaatgccactctctttggaatttttgtggatataggagtggggaaatctgggctgattcccatacgaaatgtaacagaagcaaaactttcaaaaacaaagaagagaagaagccttggactgggccccggagaaagagtggaagtccaagtactcaacattgacatcccccgatctaggattactctggacctcattcgggtgttatgagtatcccacgaaggccagacgctgattttattttctcatttccacagattgacaaggataagtcagttgtttgtaaactctaggtagcagatgagaaataattcacttaatatcagaaatattttccaaacactttcctttattttttcttctgaataaatagaaaaccaacagtttgatttccttttcccttaaaggaaacaactaatacacattcttatatggctttatgtagtaatagttttctgactaaaattttgttttttattttttgtaatttatctttaactccttttgcattttgtataacagattgcttaacttctacttgccaacatctgccttgctggacttgtatgggattgtcttcttgatttgaattgtaccgtctttgttgacacagtagggctgggcagtgtttaatccttccattttatagatttttttttaatcaggccttttggacttcattcataattttgcaataatctcttttcccttgtcatgcaagccaaaaatataccagtaaaacagattctgacgtgtttgtagttatcaaatgaatggctcgaaacacttctcaaaaggatatacgtattgaccccaacaataaatgtttgtggctagtga

SEQ ID NO: 447964 - DNA, 1232 bp, Homo sapiens
agcaatcagagagactccgtgggcgtaggaccctccgagccatgtgcgggatataatctcgtggtgcgccgttttttaagccggtccgaaaagcgcaatattcgggtgggagtgacccgattttccagtttttgtcatccattggagggacactgtatgaggttggaaagcctgaaatgcaacaaaaaataaattcattccttgaaaaggaaggaatggagaaaattgcagaaagattgcaaacaacagtacacaccttacaggtcatcatagatggtctcagccagcctgaaagctttgactttcgaacagattttgataaacctgatttcaagagaagcatagtatgcctggaagatctgcagattgggacagttcttacaggcaaagttgagaatgccactctctttggaatttttgtggatataggagtggggaaatctgggctgattcccatacgaaatgtaacagaagcaaaactttcaaaaacaaagaagagaagaagccttggactgggccccggagaaagagtggaagtccaagtactcaacattgacatcccccgatctaggattactctggacctcattcgggtgttatgagtatcccacgaaggccagacgctgattttattttctcatttccacagattgacaaggataagtcagttgtttgtaaactctaggtagcagatgagaaataattcacttaatatcagaaatattttccaaacactttcctttattttttcttctgaataaatagaaaaccaacagtttgatttccttttcccttaaaggaaacaactaatacacattcttatatggctttatgtagtaatagttttctgactaaaattttgttttttattttttgtaatttatctttaactccttttgcattttgtataacagattgcttaacttctacttgccaacatctgccttgctggacttgtatgggattgtcttcttgatttgaattgtaccgtctttgttgacacagtagggctgggcagtgtttaatccttccattttatagatttttttttaatcaggccttttggacttcattcataattttgcaataatctcttttcccttgtcatgcaagccaaaaatataccagtaaaacagattctgacgtgtttgtagttatcaaatgaatggctcgaaacacttctcaaaaggatatacgtattgaccccaacaataaatgtttgtggctagtga

SEQ ID NO: 447965 - DNA, 2496 bp, Homo sapiens
caggggagctcagtctgctatcgtacattaggcctgacgttaaagggctttcaacgcttcaggatattgaaataggagtgcagcatattttagcagatatgattgctaaagacaaagacacgcttgacttcattcggaacttgtgccagaagagacatgtttgtatccagtcatctctggcaaaagtatcctcaaaaaaggtaaatgagaaagatgttgataagtttctgctctaccagcatttttcctgcaacataagaaacattcaccatcatcagattctggcaattaaccgtggagaaaatttgaaggtactgacggttaaggtcaatatttctgatggagtgaaggatgaattctgtaggtggtgcatccaaaacaggtggagaccacgtagctttgcaaggccagagttaatgaagatcttatataattcactgaatgattcctttaaacgccttatttatcctcttctctgtagagaattcagagccaaactaacatcagatgcagagaaggaatcagtaatgatgtttggacggaaccttcgtcagctccttttaacaagccctgttccagggcgcaccttaatgggagtggatcctggttataaacatggttgcaaattagctataatttctcctactagtcagatacttcatactgatgtggtttacttgcattgtggacaaggcttccgagaggcggagaaaataaagacacttttgctgaatttcaactgcagcacagtagtgattggaaatggaactgcctgcagggaaacagaagcttactttgctgacctgataatgaagaattattttgcaccactggatgttgtttactgtatcgtcagtgaagcaggagcatcaatctacagtgtcagccctgaagctaacaaagagatgccagggctggaccctaatttgagaagtgcagtttccatagcaaggcgtgtacaagatccattagctgagctagtgaaaattgagccaaagcacattggagttggaatgtatcagcatgacgtatcccagactttactcaaggcaacactggacagtgttgtagaagaatgtgtcagctttgtgggagtggatattaacatctgttcagaagttttgttaaggcatattgcaggactcaatgccaacagggccaaaaatattattgaatggcgagagaaaaatggaccctttatcaaccgagaacagctgaagaaagtgaaagggctgggcccaaaatccttccaacagtgtgctggcttcatcagaatcaaccaggattatatccgaacgttttgcagtcagcaaactgaaacttcaggccaaattcaaggagttgctgtgacatcttcagcagacgttgaggtcacaaatgagaagcagggcaaaaagaagagcaaaactgcagtgaatgttttactgaagccaaatcctttggaccaaacttgtattcatccagaatcatatgacatagcaatgaggtttttgtcatccattggagggacactgtatgaggttggaaagcctgaaatgcaacaaaaaataaattcattccttgaaaaggaaggaatggagaaaattgcagaaagattgcaaacaacagtacacaccttacaggtcatcatagatggtctcagccagcctgaaagctttgactttcgaacagattttgataaacctgatttcaagagaagcatagtatgcctggaagatctgcagattgggacagttcttacaggcaaagttgagaatgccactctctttggaatttttgtggatataggagtggggaaatctgggctgattcccatacgaaatgtaacagaagcaaaactttcaaaaacaaagaagagaagaagccttggactgggccccggagaaagagtggaagtccaagtactcaacattgacatcccccgatctaggattactctggacctcattcgggtgttatgagtatcccacgaaggccagacgctgattttattttctcatttccacagattgacaaggataagtcagttgtttgtaaactctaggtagcagatgagaaataattcacttaatatcagaaatattttccaaacactttcctttattttttcttctgaataaatagaaaaccaacagtttgatttccttttcccttaaaggaaacaactaatacacattcttatatggctttatgtagtaatagttttctgactaaaattttgttttttattttttgtaatttatctttaactccttttgcattttgtataacagattgcttaacttctacttgccaacatctgccttgctggacttgtatgggattgtcttcttgatttgaattgtaccgtctttgttgacacagtagggctgggcagtgtttaatccttccattttatagatttttttttaatcaggccttttggacttcattcataattttgcaataatctcttttcccttgtcatgcaagccaaaaatataccagtaaaacaga

SEQ ID NO: 447966 - DNA, 2529 bp, Homo sapiens
caggggagctcagtctgctatcgtacattaggcctgacgttaaagggctttcaacgcttcaggatattgaaataggagtgcagcatattttagcagatatgattgctaaagacaaagacacgcttgacttcattcggaacttgtgccagaagagacatgtttgtatccagtcatctctggcaaaagtatcctcaaaaaaggtaaatgagaaagatgttgataagtttctgctctaccagcatttttcctgcaacataagaaacattcaccatcatcagattctggcaattaaccgtggagaaaatttgaaggtactgacggttaaggtcaatatttctgatggagtgaaggatgaattctgtaggtggtgcatccaaaacaggtggagaccacgtagctttgcaaggccagagttaatgaagatcttatataattcactgaatgattcctttaaacgccttatttatcctcttctctgtagagaattcagagccaaactaacatcagatgcagagaaggaatcagtaatgatgtttggacggaaccttcgtcagctccttttaacaagccctgttccagggcgcaccttaatgggagtggatcctggttataaacatggttgcaaattagctataatttctcctactagtcagatacttcatactgatgtggtttacttgcattgtggacaaggcttccgagaggcggagaaaataaagacacttttgctgaatttcaactgcagcacagtagtgattggaaatggaactgcctgcagggaaacagaagcttactttgctgacctgataatgaagaattattttgcaccactggatgttgtttactgtatcgtcagtgaagcaggagcatcaatctacagtgtcagccctgaagctaacaaagagatgccagggctggaccctaatttgagaagtgcagtttccatagcaaggcgtgtacaagatccattagctgagctagtgaaaattgagccaaagcacattggagttggaatgtatcagctttgtgggagtggatattaacatctgttcagaagttttgttaaggcatattgcaggactcaatgccaacagggccaaaaatattattgaatggcgagagaaaaatggaccctttatcaaccgagaacagctgaagaaagtgaaagggctgggcccaaaatccttccaacagtgtgctggcttcatcagaatcaaccaggattatatccgaacgttttgcagtcagcaaactgaaacttcaggccaaattcaaggagttgctgtgacatcttcagcagacgttgaggtcacaaatgagaagcagggcaaaaagaagagcaaaactgcagtgaatgttttactgaagccaaatcctttggaccaaacttgtattcatccagaatcatatgacatagcaatgaggtttttgtcatccattggagggacactgtatgaggttggaaagcctgaaatgcaacaaaaaataaattcattccttgaaaaggaaggaatggagaaaattgcagaaagattgcaaacaacagtacacaccttacaggtcatcatagatggtctcagccagcctgaaagctttgactttcgaacagattttgataaacctgatttcaagagaagcatagtatgcctggaagatctgcagattgggacagttcttacaggcaaagttgagaatgccactctctttggaatttttgtggatataggagtggggaaatctgggctgattcccatacgaaatgtaacagaagcaaaactttcaaaaacaaagaagagaagaagccttggactgggccccggagaaagagtggaagtccaagtactcaacattgacatcccccgatctaggattactctggacctcattcgggtgttatgagtatcccacgaaggccagacgctgattttattttctcatttccacagattgacaaggataagtcagttgtttgtaaactctaggtagcagatgagaaataattcacttaatatcagaaatattttccaaacactttcctttattttttcttctgaataaatagaaaaccaacagtttgatttccttttcccttaaaggaaacaactaatacacattcttatatggctttatgtagtaatagttttctgactaaaattttgttttttattttttgtaatttatctttaactccttttgcattttgtataacagattgcttaacttctacttgccaacatctgccttgctggacttgtatgggattgtcttcttgatttgaattgtaccgtctttgttgacacagtagggctgggcagtgtttaatccttccattttatagatttttttttaatcaggccttttggacttcattcataattttgcaataatctcttttcccttgtcatgcaagccaaaaatataccagtaaaacagattctgacgtgtttgtagttatcaaatgaatggctcgaaacacttctcaaaaggatatacgtattgaccccaacaataaatgtttgtggctagtga

SEQ ID NO: 447967 - DNA, 2537 bp, Homo sapiens
caggggagctcagtctgctatcgtacattaggcctgacgttaaagggctttcaacgcttcaggatattgaaataggagtgcagcatattttagcagatatgattgctaaagacaaagacacgcttgacttcattcggaacttgtgccagaagagacatgtttgtatccagtcatctctggcaaaagtatcctcaaaaaaggtaaatgagaaagatgttgataagtttctgctctaccagcatttttcctgcaacataagaaacattcaccatcatcagattctggcaattaaccgtggagaaaatttgaaggtactgacggttaaggtcaatatttctgatggagtgaaggatgaattctgtaggtggtgcatccaaaacaggtggagaccacgtagctttgcaaggccagagttaatgaagatcttatataattcactgaatgattcctttaaacgccttatttatcctcttctctgtagagaattcagagccaaactaacatcagatgcagagaaggaatcagtaatgatgtttggacggaaccttcgtcagctccttttaacaagccctgttccagggcgcaccttaatgggagtggatcctggttataaacatggttgcaaattagctataatttctcctactagtcagatacttcatactgatgtggtttacttgcattgtggacaaggcttccgagaggcggagaaaataaagacacttttgctgaatttcaactgcagcacagtagtgattggaaatggaactgcctgcagggaaacagaagcttactttgctgacctgataatgaagaattattttgcaccactggatgttgtttactgtatcgtcagtgaagcaggagcatcaatctacagtgtcagccctgaagctaacaaagagatgccagggctggaccctaatttgagaagtgcagtttccatagcaaggcgtgtacaagatccattagctgagctagtgaaaattgagccaaagcacattggagttggaatgtatcagcatgacgtatcccagactttactcaaggcaacactggacagtgttgtagaagaatgtgtcagctttgtgggagtggatattaacatctgttcagaagttttgttaaggcatattgcaggactcaatgccaacagggccaaaaatattattgaatggcgagagaaaaatggaccctttatcaaccgagaacagctgaagaaagtgaaagggctgggcccaaaatccttccaacagtgtgctggcttcatcagaatcaaccaggattatatccgaacgttttgcagtcagcaaactgaaacttcaggccaaattcaaggagttgctgtgacatcttcagcagacgttgaggtcacaaatgagaagcagggcaaaaagaagagcaaaactgcagtgaatgttttactgaagccaaatcctttggaccaaacttgtattcatccagaatcatatgacatagcaatgaggtttttgtcatccattggagggacactgtatgaggttggaaagcctgaaatgcaacaaaaaataaattcattccttgaaaaggaaggaatggagaaaattgcagaaagattgcaaacaacagtacacaccttacaggtcatcatagatggtctcagccagcctgaaagctttgactttcgaacagattttgataaacctgatttcaagagaagcatagtatgcctggaagatctgcagattgggacagttcttacaggcaaagttgagaatgccactctctttggaatttttgtggatataggagtggggaaatctgggctgattcccatacgaaatgtaacagaagcaaaactttcaaaaacaaagaagagaagaagccttggactgggccccggagaaagagtggaagtccaagtactcaacattgacatcccccgatctaggattactctggacctcattcgggtgttatgagtatcccacgaaggccagacgctgattttattttctcatttccacagattgacaaggataagtcagttgtttgtaaactctaggtagcagatgagaaataattcacttaatatcagaaatattttccaaacactttcctttattttttcttctgaataaatagaaaaccaacagtttgatttccttttcccttaaaggaaacaactaatacacattcttatatggctttatgtagtaatagttttctgagtataacagattgcttaacttctacttgccaacatctgccttgctggacttgtatgggattgtcttcttgatttgaattgtaccgtctttgttgacacagtagggctgggcagtgtttaatccttccattttatagatttttttttaatcaggccttttggacttcattcataattttgcaataatctcttttcccttgtcatgcaagccaaaaatataccagtaaaacagattctgacgtgtttgtagttatcaaatgaatggctcgaaacacttctcaaaaggatatacgtattgaccccaacaataaatgtttgtggctagtga

SEQ ID NO: 447968 - DNA, 1468 bp, Homo sapiens
gaaagagccgaggtgggctcgaggccgacgcgaccatcgtttgtcgacgccgctgccaccgcctgcctgagagaagtcgtcgcggccgaccccgtcgcctccgccggctaccatgtccgcccaggcgcagatgcgggccctgctggaccagctcatgggcacggctcgggacggagacgaaaccagacagagggtcaagtttacagatgaccgtgtctgcaagagtcaccttctggactgctgcccccatgacatcctggctgggacgcgcatggatttaggagaatgtaccaaaatccacgacttggccctccgagcagattatgagattgcaagtaaagaaagagacctgttttttgaattagatgcaatggatcacttggagtcctttattgctgaatgtgatcggagaactgagctcgccaagaagcggctggcagaaacacaggaggaaatcagtgcggaagtttctgcaaaggcagaaaaagtacatgagttaaatgaagaaataggaaaactccttgctaaagccgaacagctaggggctgaaggtaatgtggatgaatcccagaagattcttatggaagtggaaaaagttcgtgcgaagaaaaaagaagctgaggaagaatacagaaattccatgcctgcatccagttttcagcagcaaaagctgcgtgtctgcgaggtctgttcagcctaccttggtctccatgacaatgaccgtcgcctggcagaccacttcggtggcaagttacacttggggttcattcagatccgagagaagcttgatcagttgaggaaaactgtcgctgaaaagcaggagaagagaaatcaggatcgcttgaggaggagagaggagagggaacgggaggagcgtctgagcaggaggtcgggatcaagaaccagagatcgcaggaggtcacgctcccgggatcggcgtcggaggcggtcaagatctacctcccgagagcgacggaaattgtcccggtcccggtcccgagatagacatcggcgccaccgcagccgttcccggagccacagccggggacatcgtcgggcttcccgggaccgaagtgcgaaatacaagttctccagagagcgggcatccagagaggagtcctgggagagcgggcggagcgagcgagggcccccggactggaggcttgagagctccaacgggaagatggcttcacggaggtcagaagagaaggaggccggcgagatctgaacccgtctcccgggtgctgtaaatagtctgataaacgttcacacagtctaaaattaccctttatatttgctgaatacaactcatcttttgtagtttaaaatttctattgttttggagctagctgtgagtttctagaagtgtacagagttgctcctgtgttcccgggtcatgttgagtaggaataaataaatctgatgctgcctcctgaggctgcggggggtttctgctgtcctctgcgta

SEQ ID NO: 447969 - DNA, 316 bp, Homo sapiens
  misc_feature (21)..(21): n is a, c, g, or t
  misc_feature (304)..(304): n is a, c, g, or t
tctagagtttcccctgtgganaagaggagatgtgggaagaatagatctagattatttaacagtcttcgatagagtttgaaagctttcttcttcattcaattttgggcaaaatactgcctctgcatttgttcataacaaaaagattagattaataagtagcttttgttggtggaaattaccagctctataagtcacccttggtggttcatggacctctgattagcttgggttttgcccaaaattgaatgaagaagaaagctttcaaactctatcgaagactgttaaataatctagatctattctncacatatcctgt

SEQ ID NO: 447970 - DNA, 1436 bp, Homo sapiens
gaaagagccgaggtgggctcgaggccgacgcgaccatcgtttgtcgacgccgctgccaccgcctgcctgagagaagtcgtcgcggccgaccccgtcgcctccgccggctaccatgtccgcccaggcgcagatgcgggccctgctggaccagctcatgggcacggctcgggacggagacgaaaccagacagagggtcaagtttacagatgaccgtgtctgcaagagtcaccttctggactgctgcccccatgacatcctggctgggacgcgcatggatttaggagaatgtaccaaaatccacgacttggccctccgagcagattatgagattgcaagtaaagaaagagacctgttttttgaattagatgcaatggatcacttggagtcctttattgctgaatgtgatcggagaactgagctcgccaagaagcggctggcagaaacacaggaggaaatcagtgcggaagtttctgcaaaggcagaaaaagtacatgagttaaatgaagaaataggaaaactccttgctaaagccgaacagctaggggctgaaggtaatgtggatgaatcccagaagattcttatggaagtggaaaaagttcgtgcgaagaaaaaagaagctgaggaagaatacagaaattccatgcctgcatccagttttcagcagcaaaagctgcgtgtctgcgaggtctgttcagcctaccttggtctccatgacaatgaccgtcgcctggcagaccacttcggtggcaagttacacttggggttcattcagatccgagagaagcttgatcagttgaggaaaactgtcgctgaaaagcaggagaagagaaatcaggatcgcttgaggaggagagaggagagggaacgggaggagcgtctgagcaggaggtcgggatcaagaaccagagatcgcaggaggtcacgctcccgggatcggcgtcggaggcggtcaagatctacctcccgagagcgacggaaattgtcccggtcccggtcccgagatagacatcggcgccaccgcagccgttcccggagccacagccggggacatcgtcgggcttcccgggaccgaagtgcgaaatacaagttctccagagagcgggcatccagagaggagtcctgggagagcgggcggagcgagcgagggcccccggactggaggcttgagagctccaacgggaagatggcttcacggaggtcagaagagaaggaggccggcgagatctgaacccgtctcccgggtgctgtaaatagtctgataaacgttcacacagtctaaaattaccctttatatttgctgaatacaactcatcttttgtagtttaaaatttctattgttttggagctagctgtgagtttctagaagtgtacagagttgctcctgtgttcccgggtcatgttgagtaggaataaataaatctgatgctgcctcctga

SEQ ID NO: 447971 - DNA, 1531 bp, Homo sapiens
gaaagagccgaggtgggctcgaggccgacgcgaccatcgtttgtcgacgccgctgccaccgcctgcctgagagaagtcgtcgcggccgaccccgtcgcctccgccggctaccatgtccgcccaggcgcagatgcgggccctgctggaccagctcatgggcacggctcgggacggagacgaaaccagacagagggtcaagtttacagatgaccgtgtctgcaagagtcaccttctggactgctgcccccatgacatcctggctgggacgcgcatggatttaggagaatgtaccaaaatccacgacttggccctccgagcagattatgagattgcaagtaaagaaagagacctgttttttgaattagatgcaatggatcacttggagtcctttattgctgaatgtgatcggagaactgagctcgccaagaagcggctggcagaaacacaggaggaaatcagtgcggaagtttctgcaaaggcagaaaaagtacatgagttaaatgaagaaataggaaaactccttgctaaagccgaacagctaggggctgaaggtaatgtggatgaatcccagaagattcttatggaagtggaaaaagttcgtgcgaagaaaaaagaagctgaggaagaatacagaaattccatgcctgcatccagttttcagcagcaaaagctgcgtgtctgcgaggtctgttcagcctaccttggtctccatgacaatgaccgtcgcctggcagaccacttcggtggcaagttacacttggggttcattcagatccgagagaagcttgatcagttgaggaaaactgtcgctgaaaagcaggagaagagaaatcaggatcgcttgaggaggagagaggagagggaacgggaggagcgtctgagcaggaggtcgggatcaagaaccagagatcgcaggaggtcacgctcccgggatcggcgtcggaggcggtcaagatctacctcccgagagcgacggaaattgtcccggtcccggtcccgagatagacatcggcgccaccgcagccgttcccggagccacagccggggacatcgtcgggcttcccgggaccgaagtgcgaaatacaagtaactactctgactccttcggtagctgcaaccaggagtgagcccttctctgtgttcccagggtctgctgagggccgtgtctggtggggatggggctgggctcaccctcaggagtagggctggggagtcgtgaacgggactcaggtgtgggaagaggcgagagggctgtggaggagctcgcacggcgccaggtgatgggctgcacaggcactgtcccctgcctgcgtcctggggcctgtgcactgttgcgtccatgctcagagtggctgagacttgtgtcctgaccaggccctgcttacctctgttttggtttttgtttttgatatttttttttccattgtgtttttacgtagtgtcatgttctgtgcatatagtgttgtattctcctttgcactgtttatgttacagtgaaggctctccttattaaaaatcttcgcaaaggtca

SEQ ID NO: 447972 - DNA, 3378 bp, Homo sapiens
  misc_feature (1993)..(1993): n is a, c, g, or t
gaaagagccgaggtgggctcgaggccgacgcgaccatcgtttgtcgacgccgctgccaccgcctgcctgagagaagtcgtcgcggccgaccccgtcgcctccgccggctaccatgtccgcccaggcgcagatgcgggccctgctggaccagctcatgggcacggctcgggacggtgagtcagagcggccaaccaggcgagggtctggggtgggagtgaggcgaggccgccgggcggcctgaggcgggggccgcgatcgtctgcgcctgcgcctgcgcggggcatcgctcctcctcccccgcgctccgaccgcaggcgccgggcctttgtctaagccggtgcgtctctgaggcggccgtgggtccaggtcgggctcctctctcggagtctgcgccatggatggggcttcagcctccttcctatgtaccgtcctgctacttcctccccggcgggcgccgcggctccgtgcccctccgcgaactgtggagtcggcggagggctggaatcagcgtgggctccaggtcgctggcagccgggtggcagaactcttccgaggctccttgggaagaagctacacccgagggagccggatgggcctcgaaaacctggcccgctctggttctgtaccattgcaaggggaaccgtaaactgagcttttctaacgtgggtttctgccaagtacttttccagctgcccccttccccccagcacacaggagagcctctgtgtagccagcgcttgacagtcgttaggtaggttgtactgtgtagggaggagctcaagatcatgatggttgtcacaggagaaagcggttgcatctttgcaaaactatatacctgctgtggtttgtgttttcttttctgctgagtaatgaagttgtaagttcacactggcacattctcagggctgtgcagattatttgcactttatttcataggtgaataagtgctttttagctttctttgtatattgagttgcttttgaattgcttcccatatttttatttcatacaaactgaacaattgtggcccctctattttatttataaaggttcagtgtatctttgcctgcctacatcaatctgcaagggagttgcagaaagcctcatgttcatcgagccgtgagtcacaaccaatttctaagctgttataacaaaaaagtgtttgctttttttcacaagtaactttaaaagtgtagtttagaaagaaaacattttcaataaaaagacactacattaatcctggatgcttgcaaatcctaaaatatattcctcctctagcgttgcacagctctgtgttgtatacacagactagctttaaaatttgtcacataccactttacctttacttttatgtatcattcccccgacttccttactgcaggtgtgggcaagaaaacttttcctttaacacttttcaacagcgggcataaaattctgcagctgaggtcttgaagaatgcagatgggtacagtatgtgttggagctcacagtgtgtattgactaacctagttccttttttgctttttttggtattgtcttgttaaaagtgactcccaggtagcaactctcttttttaagggtgggaacgaaagggacgtaggaagaatagatctagattatttaacagtcttcgatagagtttgaaagctttcttcttcattcaattttgggcaaaatactgcctctgcatttgttcataacaaaaagattagattaataagtagcttttgttggtggaaattaccagctctataagtcacccttggtggttcatggacctctgattagcttgggttttgcagtctcattgccacatgtatatgtggagccaatggccttttggtgctcagctgtttacgtctgactccttgacttctttggtacagtgatggagtcagatctcattaagtgtgattctccatgatataactagcctcaaaaaaatgtgtattccactccagttgtaaatatctttagatcagcttttcattgnatttgatggggagaacacagaaatgatagtctgcaaatcatccaggtgaattgttatactagttattttttggtggttaatgtgataatattgtcttatttaaaaccacaaatgaatttcaggagacgaaaccagacagagggtcaagtttacagatgaccgtgtctgcaagagtcaccttctggactgctgcccccatgacatcctggctgggacgcgcatggatttaggagaatgtaccaaaatccacgacttggccctccgagcagattatgagattgcaagtaaagaaagagacctgttttttgaattagatgcaatggatcacttggagtcctttattgctgaatgtgatcggagaactgagctcgccaagaagcggctggcagaaacacaggaggaaatcagtgcggaagtttctgcaaaggcagaaaaagtacatgagttaaatgaagaaataggaaaactccttgctaaagccgaacagctaggggctgaaggtaatgtggatgaatcccagaagattcttatggaagtggaaaaagttcgtgcgaagaaaaaagaagctgaggaagaatacagaaattccatgcctgcatccagttttcagcagcaaaagctgcgtgtctgcgaggtctgttcagcctaccttggtctccatgacaatgaccgtcgcctggcagaccacttcggtggcaagttacacttggggttcattcagatccgagagaagcttgatcagttgaggaaaactgtcgctgaaaagcaggagaagagaaatcaggatcgcttgaggaggagagaggagagggaacgggaggagcgtctgagcaggaggtcgggatcaagaaccagagatcgcaggaggtcacgctcccgggatcggcgtcggaggcggtcaagatctacctcccgagagcgacggaaattgtcccggtcccggtcccgagatagacatcggcgccaccgcagccgttcccggagccacagccggggacatcgtcgggcttcccgggaccgaagtgcgaaatacaagttctccagagagcgggcatccagagaggagtcctgggagagcgggcggagcgagcgagggcccccggactggaggcttgagagctccaacgggaagatggcttcacggaggtcagaagagaaggaggccggcgagatctgaacccgtctcccgggtgctgtaaatagtctgataaacgttcacacagtctaaaattaccctttatatttgctgaatacaactcatcttttgtagtttaaaatttctattgttttggagctagctgtgagtttctagaagtgtacagagttgctcctgtgttcccgggtcatgttgagtaggaataaataaatctgatgctgcctcctga

SEQ ID NO: 447973 - DNA, 3080 bp, Homo sapiens
  misc_feature (1695)..(1695): n is a, c, g, or t
gaaagagccgaggtgggctcgaggccgacgcgaccatcgtttgtcgacgccgctgccaccgcctgcctgagagaagtcgtcgcggccgaccccgtcgcctccgccggctaccatgtccgcccaggcgcagatgcgggccctgctggaccagctcatgggcacggctcgggacggtgagtcagagcggccaaccaggcgagggtctggggtgggagtgaggcgaggccgccgggcggcctgaggcgggggccgcgatcgtctgcgcctgcgcctgcgcggggcatcgctcctcctcccccgcgctccgaccgcaggcgccgggcctttgtctaagccggtgcgtctctgaggcggccgtgggtccaggtcgggctcctctctcggagtctgcgccatggatggggcttcagcctccttcctatgtaccgtcctgctacttcctccccggcgggcgccgcggctccgtgcccctccgcgaactgtggagtcggcggagggctggaatcagcgtgggctccaggtcgctggcagccgggtggcagaactcttccgaggctccttgggaagaagctacacccgagggagccggatgggcctcgaaaacctggcccgctctggttctgtaccattgcaaggggaaccgtaaactgagcttttctaacgtgggtttctgccaagtacttttccagctgcccccttccccccagcacacaggagagcctctgtgtagccagcgcttgacagtcgttaggttcagtgtatctttgcctgcctacatcaatctgcaagggagttgcagaaagcctcatgttcatcgagccgtgagtcacaaccaatttctaagctgttataacaaaaaagtgtttgctttttttcacaagtaactttaaaagtgtagtttagaaagaaaacattttcaataaaaagacactacattaatcctggatgcttgcaaatcctaaaatatattcctcctctagcgttgcacagctctgtgttgtatacacagactagctttaaaatttgtcacataccactttacctttacttttatgtatcattcccccgacttccttactgcaggtgtgggcaagaaaacttttcctttaacacttttcaacagcgggcataaaattctgcagctgaggtcttgaagaatgcagatgggtacagtatgtgttggagctcacagtgtgtattgactaacctagttccttttttgctttttttggtattgtcttgttaaaagtgactcccaggtagcaactctcttttttaagggtgggaacgaaagggacgtaggaagaatagatctagattatttaacagtcttcgatagagtttgaaagctttcttcttcattcaattttgggcaaaatactgcctctgcatttgttcataacaaaaagattagattaataagtagcttttgttggtggaaattaccagctctataagtcacccttggtggttcatggacctctgattagcttgggttttgcagtctcattgccacatgtatatgtggagccaatggccttttggtgctcagctgtttacgtctgactccttgacttctttggtacagtgatggagtcagatctcattaagtgtgattctccatgatataactagcctcaaaaaaatgtgtattccactccagttgtaaatatctttagatcagcttttcattgnatttgatggggagaacacagaaatgatagtctgcaaatcatccaggtgaattgttatactagttattttttggtggttaatgtgataatattgtcttatttaaaaccacaaatgaatttcaggagacgaaaccagacagagggtcaagtttacagatgaccgtgtctgcaagagtcaccttctggactgctgcccccatgacatcctggctgggacgcgcatggatttaggagaatgtaccaaaatccacgacttggccctccgagcagattatgagattgcaagtaaagaaagagacctgttttttgaattagatgcaatggatcacttggagtcctttattgctgaatgtgatcggagaactgagctcgccaagaagcggctggcagaaacacaggaggaaatcagtgcggaagtttctgcaaaggcagaaaaagtacatgagttaaatgaagaaataggaaaactccttgctaaagccgaacagctaggggctgaaggtaatgtggatgaatcccagaagattcttatggaagtggaaaaagttcgtgcgaagaaaaaagaagctgaggaagaatacagaaattccatgcctgcatccagttttcagcagcaaaagctgcgtgtctgcgaggtctgttcagcctaccttggtctccatgacaatgaccgtcgcctggcagaccacttcggtggcaagttacacttggggttcattcagatccgagagaagcttgatcagttgaggaaaactgtcgctgaaaagcaggagaagagaaatcaggatcgcttgaggaggagagaggagagggaacgggaggagcgtctgagcaggaggtcgggatcaagaaccagagatcgcaggaggtcacgctcccgggatcggcgtcggaggcggtcaagatctacctcccgagagcgacggaaattgtcccggtcccggtcccgagatagacatcggcgccaccgcagccgttcccggagccacagccggggacatcgtcgggcttcccgggaccgaagtgcgaaatacaagttctccagagagcgggcatccagagaggagtcctgggagagcgggcggagcgagcgagggcccccggactggaggcttgagagctccaacgggaagatggcttcacggaggtcagaagagaaggaggccggcgagatctgaacccgtctcccgggtgctgtaaatagtctgataaacgttcacacagtctaaaattaccctttatatttgctgaatacaactcatcttttgtagtttaaaatttctattgttttggagctagctgtgagtttctagaagtgtacagagttgctcctgtgttcccgggtcatgttgagtaggaataaataaatctgatgctgcctcctga

SEQ ID NO: 447974 - DNA, 2064 bp, Homo sapiens
gaaagagccgaggtgggctcgaggccgacgcgaccatcgtttgtcgacgccgctgccaccgcctgcctgagagaagtcgtcgcggccgaccccgtcgcctccgccggctaccatgtccgcccaggcgcagatgcgggccctgctggaccagctcatgggcacggctcgggacggagacgaaaccagacagagggtcaagtttacagatgaccgtgtctgcaagagtcaccttctggactgctgcccccatgacatcctggctgggacgcgcatggatttaggagaatgtaccaaaatccacgacttggccctccgagcagattatgagattgcaagtaaagaaagagacctgttttttgaattagatgcaatggatcacttggagtcctttattgctgaatgtgatcggagaactgagctcgccaagaagcggctggcagaaacacaggaggaaatcagtgcggaagtttctgcaaaggcagaaaaagtacatgagttaaatgaagaaataggaaaactccttgctaaagccgaacagctaggggctgaaggtaatgtggatgaatcccagaagattcttatggaagtggaaaaagttcgtgcgaagaaaaaagaagctgaggaagaatacagaaattccatgcctgcatccagttttcagcagcaaaagctgcgtgtctgcgaggtctgttcagcctaccttggtctccatgacaatgaccgtcgcctggcagaccacttcggtggcaagttacacttggggttcattcagatccgagagaagcttgatcagttgaggaaaactgtcgctgaaaagcaggagaagagaaatcaggatcgcttgaggaggagagaggagagggaacgggaggagcgtctgagcaggaggtcgggatcaagaaccagagatcgcaggaggtcacgctcccgggatcggcgtcggaggcggtcaagatctacctcccgagagcgacggaaattgtcccggtcccggtcccgagatagacatcggcgccaccgcagccgttcccggagccacagccggggacatcgtcgggcttcccgggaccgaagtgcgaaatacaagtaactactctgactccttcggtagctgcaaccaggagtgagcccttctctgtgttcccagggtctgctgagggccgtgtctggtggggatggggctgggctcaccctcaggagtagggctggggagtcgtgaacgggactcaggtgtgggaagaggcgagagggctgtggaggagctcgcacggcgccaggtgatgggctgcacaggcactgtcccctgcctgcgtcctggggcctgtgcactgttgcgtccatgctcagagtggctgagacttgtgtcctgaccaggccctgcttacctctgttttggtttttgtttttgatatttttttttccattgtgtttttacgtagtgtcatgttctgtgcatatagtgttgtattctcctttgcactgtttatgttacagtgaaggctctccttattaaaaatcttcgcaaaggtcactttttaatggctatctaacactccatatgtggtgggcaagtctggttggcctccggggggtttccaggtataggggatgtagggccttgcctggcctggtctgcgggtccatcgtcagtgcctgagcggccagcagaaggggggcagcagcctccactgagcctctggttcccatttcccaggttctccagagagcgggcatccagagaggagtcctgggagagcgggcggagcgagcgagggcccccggactggaggcttgagagctccaacgggaagatggcttcacggaggtcagaagagaaggaggccggcgagatctgaacccgtctcccgggtgctgtaaatagtctgataaacgttcacacagtctaaaattaccctttatatttgctgaatacaactcatcttttgtagtttaaaatttctattgttttggagctagctgtgagtttctagaagtgtacagagttgctcctgtgttcccgggtcatgttgagtaggaataaataaatctgatgctgcctcctga

SEQ ID NO: 447975 - DNA, 3854 bp, Homo sapiens
  misc_feature (1993)..(1993): n is a, c, g, or t
gaaagagccgaggtgggctcgaggccgacgcgaccatcgtttgtcgacgccgctgccaccgcctgcctgagagaagtcgtcgcggccgaccccgtcgcctccgccggctaccatgtccgcccaggcgcagatgcgggccctgctggaccagctcatgggcacggctcgggacggtgagtcagagcggccaaccaggcgagggtctggggtgggagtgaggcgaggccgccgggcggcctgaggcgggggccgcgatcgtctgcgcctgcgcctgcgcggggcatcgctcctcctcccccgcgctccgaccgcaggcgccgggcctttgtctaagccggtgcgtctctgaggcggccgtgggtccaggtcgggctcctctctcggagtctgcgccatggatggggcttcagcctccttcctatgtaccgtcctgctacttcctccccggcgggcgccgcggctccgtgcccctccgcgaactgtggagtcggcggagggctggaatcagcgtgggctccaggtcgctggcagccgggtggcagaactcttccgaggctccttgggaagaagctacacccgagggagccggatgggcctcgaaaacctggcccgctctggttctgtaccattgcaaggggaaccgtaaactgagcttttctaacgtgggtttctgccaagtacttttccagctgcccccttccccccagcacacaggagagcctctgtgtagccagcgcttgacagtcgttaggtaggttgtactgtgtagggaggagctcaagatcatgatggttgtcacaggagaaagcggttgcatctttgcaaaactatatacctgctgtggtttgtgttttcttttctgctgagtaatgaagttgtaagttcacactggcacattctcagggctgtgcagattatttgcactttatttcataggtgaataagtgctttttagctttctttgtatattgagttgcttttgaattgcttcccatatttttatttcatacaaactgaacaattgtggcccctctattttatttataaaggttcagtgtatctttgcctgcctacatcaatctgcaagggagttgcagaaagcctcatgttcatcgagccgtgagtcacaaccaatttctaagctgttataacaaaaaagtgtttgctttttttcacaagtaactttaaaagtgtagtttagaaagaaaacattttcaataaaaagacactacattaatcctggatgcttgcaaatcctaaaatatattcctcctctagcgttgcacagctctgtgttgtatacacagactagctttaaaatttgtcacataccactttacctttacttttatgtatcattcccccgacttccttactgcaggtgtgggcaagaaaacttttcctttaacacttttcaacagcgggcataaaattctgcagctgaggtcttgaagaatgcagatgggtacagtatgtgttggagctcacagtgtgtattgactaacctagttccttttttgctttttttggtattgtcttgttaaaagtgactcccaggtagcaactctcttttttaagggtgggaacgaaagggacgtaggaagaatagatctagattatttaacagtcttcgatagagtttgaaagctttcttcttcattcaattttgggcaaaatactgcctctgcatttgttcataacaaaaagattagattaataagtagcttttgttggtggaaattaccagctctataagtcacccttggtggttcatggacctctgattagcttgggttttgcagtctcattgccacatgtatatgtggagccaatggccttttggtgctcagctgtttacgtctgactccttgacttctttggtacagtgatggagtcagatctcattaagtgtgattctccatgatataactagcctcaaaaaaatgtgtattccactccagttgtaaatatctttagatcagcttttcattgnatttgatggggagaacacagaaatgatagtctgcaaatcatccaggtgaattgttatactagttattttttggtggttaatgtgataatattgtcttatttaaaaccacaaatgaatttcaggagacgaaaccagacagagggtcaagtttacagatgaccgtgtctgcaagagtcaccttctggactgctgcccccatgacatcctggctgggacgcgcatggatttaggagaatgtaccaaaatccacgacttggccctccgagcagattatgagattgcaagtaaagaaagagacctgttttttgaattagatgtgaaaggggggaccctaccctcagaacatgagggaataatatttacgtggctcacaaagaccagtgagtacatcatatgcatctctcacaactccccagaagagggcctccagcacgagtctaggctcagccttttctgtccctccgagaactctatgaattgctgccaagtgttttaattttcctcagaatttctttgtaatgttattgagggttggaggtccttttacaaattttggaaataagtaaatcaaatgagaagaccatgcttccaaacaatcattctgtttaacagatccccttgatttaatgcaattatgaatgcgttagtggtagtgtagtttaagatctttcccttgaatgtacaggctttaaagaaacgaacctaggagtgtatttcctatcaagcaaatgggttctaagactttacgctttacacatcattgattatagcgctgtgcttttcccgtgctaggcaatggatcacttggagtcctttattgctgaatgtgatcggagaactgagctcgccaagaagcggctggcagaaacacaggaggaaatcagtgcggaagtttctgcaaaggcagaaaaagtacatgagttaaatgaagaaataggaaaactccttgctaaagccgaacagctaggggctgaaggtaatgtggatgaatcccagaagattcttatggaagtggaaaaagttcgtgcgaagaaaaaagaagctgaggaagaatacagaaattccatgcctgcatccagttttcagcagcaaaagctgcgtgtctgcgaggtctgttcagcctaccttggtctccatgacaatgaccgtcgcctggcagaccacttcggtggcaagttacacttggggttcattcagatccgagagaagcttgatcagttgaggaaaactgtcgctgaaaagcaggagaagagaaatcaggatcgcttgaggaggagagaggagagggaacgggaggagcgtctgagcaggaggtcgggatcaagaaccagagatcgcaggaggtcacgctcccgggatcggcgtcggaggcggtcaagatctacctcccgagagcgacggaaattgtcccggtcccggtcccgagatagacatcggcgccaccgcagccgttcccggagccacagccggggacatcgtcgggcttcccgggaccgaagtgcgaaatacaagttctccagagagcgggcatccagagaggagtcctgggagagcgggcggagcgagcgagggcccccggactggaggcttgagagctccaacgggaagatggcttcacggaggtcagaagagaaggaggccggcgagatctgaacccgtctcccgggtgctgtaaatagtctgataaacgttcacacagtctaaaattaccctttatatttgctgaatacaactcatcttttgtagtttaaaatttctattgttttggagctagctgtgagtttctagaagtgtacagagttgctcctgtgttcccgggtcatgttgagtaggaataaataaatctgatgctgcctcctga

SEQ ID NO: 447976 - DNA, 1313 bp, Homo sapiens
gaccccaagctcaatggggcaaccgggctcgggaccggagtatcgacaaagccaaggagccagaaggggggtcaagtttacagatgaccgtgtctgcaagagtcaccttctggactgctgcccccatgacatcctggctgggacgcgcatggatttaggagaatgtaccaaaatccacgacttggccctccgagcagattatgagattgcaagtaaagaaagagacctgttttttgaattagatgcaatggatcacttggagtcctttattgctgaatgtgatcggagaactgagctcgccaagaagcggctggcagaaacacaggaggaaatcagtgcggaagtttctgcaaaggcagaaaaagtacatgagttaaatgaagaaataggaaaactccttgctaaagccgaacagctaggggctgaaggtaatgtggatgaatcccagaagattcttatggaagtggaaaaagttcgtgcgaagaaaaaagaagctgaggaagaatacagaaattccatgcctgcatccagttttcagcagcaaaagctgcgtgtctgcgaggtctgttcagcctaccttggtctccatgacaatgaccgtcgcctggcagaccacttcggtggcaagttacacttggggttcattcagatccgagagaagcttgatcagttgaggaaaactgtcgctgaaaagcaggagaagagaaatcaggatcgcttgaggaggagagaggagagggaacgggaggagcgtctgagcaggaggtcgggatcaagaaccagagatcgcaggaggtcacgctcccgggatcggcgtcggaggcggtcaagatctacctcccgagagcgacggaaattgtcccggtcccggtcccgagatagacatcggcgccaccgcagccgttcccggagccacagccggggacatcgtcgggcttcccgggaccgaagtgcgaaatacaagttctccagagagcgggcatccagagaggagtcctgggagagcgggcggagcgagcgagggcccccggactggaggcttgagagctccaacgggaagatggcttcacggaggtcagaagagaaggaggccggcgagatctgaacccgtctcccgggtgctgtaaatagtctgataaacgttcacacagtctaaaattaccctttatatttgctgaatacaactcatcttttgtagtttaaaatttctattgttttggagctagctgtgagtttctagaagtgtacagagttgctcctgtgttcccgggtcatgttgagtaggaataaataaatctgatgctgcctcctga

SEQ ID NO: 447977 - DNA, 2469 bp, Homo sapiens
gaaagagccgaggtgggctcgaggccgacgcgaccatcgtttgtcgacgccgctgccaccgcctgcctgagagaagtcgtcgcggccgaccccgtcgcctccgccggctaccatgtccgcccaggcgcagatgcgggccctgctggaccagctcatgggcacggctcgggacggagacgaaaccagacagagggtcaagtttacagatgaccgtgtctgcaagagtcaccttctggactgctgcccccatgacatcctggctgggacgcgcatggatttaggagaatgtaccaaaatccacgacttggccctccgagcagattatgagattgcaagtaaagaaagagacctgttttttgaattagatgcaatggatcacttggagtcctttattgctgaatgtgatcggagaactgagctcgccaagaagcggctggcagaaacacaggaggaaatcagtgcggaagtttctgcaaaggcagaaaaagtacatgagttaaatgaagaaataggaaaactccttgctaaagccgaacagctaggggctgaaggtaatgtggatgaatcccagaagattcttatggaagtggaaaaagttcgtgcgaagaaaaaagaagctgaggaagaatacagaaattccatgcctgcatccagttttcagcagcaaaagctgcgtgtctgcgaggtctgttcagcctaccttggtctccatgacaatgaccgtcgcctggcagaccacttcggtggcaagttacacttggggttcattcagatccgagagaagcttgatcagttgaggaaaactgtcgctgaaaagcaggagaagagaaatcaggatcgcttgaggaggagagaggagagggaacgggaggagcgtctgagcaggaggtcgggatcaagaaccagagatcgcaggaggtaggtttccaggtccattaaaatgttctcaaatttttttttccataagcatttttcttaatatttaatgattatgcctttacaaatgttacctggcaggtagggctggcttgtgaagggcacagggcaagaggttgcttggtgccgtggagggttcccagtgttaatgagagggaaggtcggggcctgcagggtgacaggagtatccaggccacatgttttcaggagacctcattggaaggacctagccattggagatgaactgatggaaatattttaaacctaaatttgtgggagtaaaggagaaaatgtcagtaaagcagcaagcagaatctgctgaggggtggggccctcatagtgttggcacctatagagtctcagccttggagccttctgattgttcaggtcacgctcccgggatcggcgtcggaggcggtcaagatctacctcccgagagcgacggaaattgtcccggtcccggtcccgagatagacatcggcgccaccgcagccgttcccggagccacagccggggacatcgtcgggcttcccgggaccgaagtgcgaaatacaagtaactactctgactccttcggtagctgcaaccaggagtgagcccttctctgtgttcccagggtctgctgagggccgtgtctggtggggatggggctgggctcaccctcaggagtagggctggggagtcgtgaacgggactcaggtgtgggaagaggcgagagggctgtggaggagctcgcacggcgccaggtgatgggctgcacaggcactgtcccctgcctgcgtcctggggcctgtgcactgttgcgtccatgctcagagtggctgagacttgtgtcctgaccaggccctgcttacctctgttttggtttttgtttttgatatttttttttccattgtgtttttacgtagtgtcatgttctgtgcatatagtgttgtattctcctttgcactgtttatgttacagtgaaggctctccttattaaaaatcttcgcaaaggtcactttttaatggctatctaacactccatatgtggtgggcaagtctggttggcctccggggggtttccaggtataggggatgtagggccttgcctggcctggtctgcgggtccatcgtcagtgcctgagcggccagcagaaggggggcagcagcctccactgagcctctggttcccatttcccaggttctccagagagcgggcatccagagaggagtcctgggagagcgggcggagcgagcgagggcccccggactggaggcttgagagctccaacgggaagatggcttcacggaggtcagaagagaaggaggccggcgagatctgaacccgtctcccgggtgctgtaaatagtctgataaacgttcacacagtctaaaattaccctttatatttgctgaatacaactcatcttttgtagtttaaaatttctattgttttggagctagctgtgagtttctagaagtgtacagagttgctcctgtgttcccgggtcatgttgagtaggaataaataaatctgatgctgcctcctga

SEQ ID NO: 447978 - DNA, 1915 bp, Homo sapiens
tttttgtatttttattagagaccatgttggctagactggtcttgaactcctgacctcatgatccgcccaccttggcctcacaaagtgctgggattacaggtgtgagccactgcgtccggtcctgtctctgtttttatctgaaattatgttagcctttgcctagttatggtgaattaaccttagcatatgatagttctcttaatgtttcccaccacccttttcagagtaagcaatttgacgtctacagcttcttttcctttatctctttgggtaaatagcaaccaatttttcctgctactttagatagtaggcaataacaaaatgtattcatagctctcagtaatatttgttctattgttttgtttttgaggtgaaaggggggaccctaccctcagaacatgagggaataatatttacgtggctcacaaagaccagtgagtacatcatatgcatctctcacaactccccagaagagggcctccagcacgagtctaggctcagccttttctgtccctccgagaactctatgaattgctgccaagtgttttaattttcctcagaatttctttgtaatgttattgagggttggaggtccttttacaaattttggaaataagtaaatcaaatgagaagaccatgcttccaaacaatcattctgtttaacagatccccttgatttaatgcaattatgaatgcgttagtggtagtgtagtttaagatctttcccttgaatgtacaggctttaaagaaacgaacctaggagtgtatttcctatcaagcaaatgggttctaagactttacgctttacacatcattgattatagcgctgtgcttttcccgtgctaggcaatggatcacttggagtcctttattgctgaatgtgatcggagaactgagctcgccaagaagcggctggcagaaacacaggaggaaatcagtgcggaagtttctgcaaaggcagaaaaagtacatgagttaaatgaagaaataggaaaactccttgctaaagccgaacagctaggggctgaaggtaatgtggatgaatcccagaagattcttatggaagtggaaaaagttcgtgcgaagaaaaaagaagctgaggaagaatacagaaattccatgcctgcatccagttttcagcagcaaaagctgcgtgtctgcgaggtctgttcagcctaccttggtctccatgacaatgaccgtcgcctggcagaccacttcggtggcaagttacacttggggttcattcagatccgagagaagcttgatcagttgaggaaaactgtcgctgaaaagcaggagaagagaaatcaggatcgcttgaggaggagagaggagagggaacgggaggagcgtctgagcaggaggtcgggatcaagaaccagagatcgcaggaggtcacgctcccgggatcggcgtcggaggcggtcaagatctacctcccgagagcgacggaaattgtcccggtcccggtcccgagatagacatcggcgccaccgcagccgttcccggagccacagccggggacatcgtcgggcttcccgggaccgaagtgcgaaatacaagttctccagagagcgggcatccagagaggagtcctgggagagcgggcggagcgagcgagggcccccggactggaggcttgagagctccaacgggaagatggcttcacggaggtcagaagagaaggaggccggcgagatctgaacccgtctcccgggtgctgtaaatagtctgataaacgttcacacagtctaaaattaccctttatatttgctgaatacaactcatcttttgtagtttaaaatttctattgttttggagctagctgtgagtttctagaagtgtacagagttgctcctgtgttcccgggtcatgttgagtaggaataaataaatctgatgctgcctcctga

SEQ ID NO: 447979 - DNA, 1132 bp, Homo sapiens
ggtaccctttcaacatctcatttctttacttgcatagaaagagacctgttttttgaattagatgcaatggatcacttggagtcctttattgctgaatgtgatcggagaactgagctcgccaagaagcggctggcagaaacacaggaggaaatcagtgcggaagtttctgcaaaggcagaaaaagtacatgagttaaatgaagaaataggaaaactccttgctaaagccgaacagctaggggctgaaggtaatgtggatgaatcccagaagattcttatggaagtggaaaaagttcgtgcgaagaaaaaagaagctgaggaagaatacagaaattccatgcctgcatccagttttcagcagcaaaagctgcgtgtctgcgaggtctgttcagcctaccttggtctccatgacaatgaccgtcgcctggcagaccacttcggtggcaagttacacttggggttcattcagatccgagagaagcttgatcagttgaggaaaactgtcgctgaaaagcaggagaagagaaatcaggatcgcttgaggaggagagaggagagggaacgggaggagcgtctgagcaggaggtcgggatcaagaaccagagatcgcaggaggtcacgctcccgggatcggcgtcggaggcggtcaagatctacctcccgagagcgacggaaattgtcccggtcccggtcccgagatagacatcggcgccaccgcagccgttcccggagccacagccggggacatcgtcgggcttcccgggaccgaagtgcgaaatacaagttctccagagagcgggcatccagagaggagtcctgggagagcgggcggagcgagcgagggcccccggactggaggcttgagagctccaacgggaagatggcttcacggaggtcagaagagaaggaggccggcgagatctgaacccgtctcccgggtgctgtaaatagtctgataaacgttcacacagtctaaaattaccctttatatttgctgaatacaactcatcttttgtagtttaaaatttctattgttttggagctagctgtgagtttctagaagtgtacagagttgctcctgtgttcccgggtcatgttgagtaggaataaataaatctgatgctgcctcctga

SEQ ID NO: 447980 - DNA, 941 bp, Homo sapiens
caaaaattagttgggtgtggtggcatgtgcctgtaatcccagctacttgggaggccgaggcagaagaataggttgaactcgaggtggaagttgcagtgagccgagatcacgccactgcactccagcctggtgacagtgagacaccgtttcaaagagaaaaaaaaaagtattcccatttcctaaaagtgtcccttcaatttttaaattaccaatactgagctcatataaaggtgatttgttaagtagcattcacactctggtttgtgtaacttgctcttcctcattttttgtttcatttatttagaaaactgtcgctgaaaagcaggagaagagaaatcaggatcgcttgaggaggagagaggagagggaacgggaggagcgtctgagcaggaggtcgggatcaagaaccagagatcgcaggaggtcacgctcccgggatcggcgtcggaggcggtcaagatctacctcccgagagcgacggaaattgtcccggtcccggtcccgagatagacatcggcgccaccgcagccgttcccggagccacagccggggacatcgtcgggcttcccgggaccgaagtgcgaaatacaagttctccagagagcgggcatccagagaggagtcctgggagagcgggcggagcgagcgagggcccccggactggaggcttgagagctccaacgggaagatggcttcacggaggtcagaagagaaggaggccggcgagatctgaacccgtctcccgggtgctgtaaatagtctgataaacgttcacacagtctaaaattaccctttatatttgctgaatacaactcatcttttgtagtttaaaatttctattgttttggagctagctgtgagtttctagaagtgtacagagttgctcctgtgttcccgggtcatgttgagtaggaataaataaatctgatgctgcctcctga

SEQ ID NO: 447981 - DNA, 2358 bp, Homo sapiens
  misc_feature (1993)..(1993): n is a, c, g, or t
gaaagagccgaggtgggctcgaggccgacgcgaccatcgtttgtcgacgccgctgccaccgcctgcctgagagaagtcgtcgcggccgaccccgtcgcctccgccggctaccatgtccgcccaggcgcagatgcgggccctgctggaccagctcatgggcacggctcgggacggtgagtcagagcggccaaccaggcgagggtctggggtgggagtgaggcgaggccgccgggcggcctgaggcgggggccgcgatcgtctgcgcctgcgcctgcgcggggcatcgctcctcctcccccgcgctccgaccgcaggcgccgggcctttgtctaagccggtgcgtctctgaggcggccgtgggtccaggtcgggctcctctctcggagtctgcgccatggatggggcttcagcctccttcctatgtaccgtcctgctacttcctccccggcgggcgccgcggctccgtgcccctccgcgaactgtggagtcggcggagggctggaatcagcgtgggctccaggtcgctggcagccgggtggcagaactcttccgaggctccttgggaagaagctacacccgagggagccggatgggcctcgaaaacctggcccgctctggttctgtaccattgcaaggggaaccgtaaactgagcttttctaacgtgggtttctgccaagtacttttccagctgcccccttccccccagcacacaggagagcctctgtgtagccagcgcttgacagtcgttaggtaggttgtactgtgtagggaggagctcaagatcatgatggttgtcacaggagaaagcggttgcatctttgcaaaactatatacctgctgtggtttgtgttttcttttctgctgagtaatgaagttgtaagttcacactggcacattctcagggctgtgcagattatttgcactttatttcataggtgaataagtgctttttagctttctttgtatattgagttgcttttgaattgcttcccatatttttatttcatacaaactgaacaattgtggcccctctattttatttataaaggttcagtgtatctttgcctgcctacatcaatctgcaagggagttgcagaaagcctcatgttcatcgagccgtgagtcacaaccaatttctaagctgttataacaaaaaagtgtttgctttttttcacaagtaactttaaaagtgtagtttagaaagaaaacattttcaataaaaagacactacattaatcctggatgcttgcaaatcctaaaatatattcctcctctagcgttgcacagctctgtgttgtatacacagactagctttaaaatttgtcacataccactttacctttacttttatgtatcattcccccgacttccttactgcaggtgtgggcaagaaaacttttcctttaacacttttcaacagcgggcataaaattctgcagctgaggtcttgaagaatgcagatgggtacagtatgtgttggagctcacagtgtgtattgactaacctagttccttttttgctttttttggtattgtcttgttaaaagtgactcccaggtagcaactctcttttttaagggtgggaacgaaagggacgtaggaagaatagatctagattatttaacagtcttcgatagagtttgaaagctttcttcttcattcaattttgggcaaaatactgcctctgcatttgttcataacaaaaagattagattaataagtagcttttgttggtggaaattaccagctctataagtcacccttggtggttcatggacctctgattagcttgggttttgcagtctcattgccacatgtatatgtggagccaatggccttttggtgctcagctgtttacgtctgactccttgacttctttggtacagtgatggagtcagatctcattaagtgtgattctccatgatataactagcctcaaaaaaatgtgtattccactccagttgtaaatatctttagatcagcttttcattgnatttgatggggagaacacagaaatgatagtctgcaaatcatccaggtgaattgttatactagttattttttggtggttaatgtgataatattgtcttatttaaaaccacaaatgaatttcaggagacgaaaccagacagagggtcaagtttacagatgaccgtgtctgcaagagtcaccttctggactgctgcccccatgacatcctggctgggacgcgcatggatttaggagaatgtaccaaaatccacgacttggccctccgagcagattatgagattgcaagtaaagaaagagacctgttttttgaattagatgtaagttttatttaatgttgatttattcctactgcgaagaacccaatat

SEQ ID NO: 447982 - DNA, 403 bp, Homo sapiens
ttgctaaagccgaacagctaggggctgaaggtaatgtggatgaatcccagaagattcttatggaagtggaaaaagttcgtgcgaagaaaaaagaagctgaggttggtgagataagtgccttagggcaagagaaatcttagtaatttggcagcgttgaccgttggaattaattgagcccatgcttgctcccattttttaaaaaatttatacattttgggcccagcacagtggctcacgcctgtcatcccagcactttggaaggccgaggcgggcggatcacgaggtcaggagataagaccatcctggctaacacagcgaatccccgtctctactaaaaatacaaaaaaattagccgggcatggcgccaggcacctgtagtcccagctgctccggaggctgagga

SEQ ID NO: 447983 - DNA, 1505 bp, Homo sapiens
gaaagagccgaggtgggctcgaggccgacgcgaccatcgtttgtcgacgccgctgccaccgcctgcctgagagaagtcgtcgcggccgaccccgtcgcctccgccggctaccatgtccgcccaggcgcagatgcgggccctgctggaccagctcatgggcacggctcgggacggagacgaaaccagacagagggtcaagtttacagatgaccgtgtctgcaagagtcaccttctggactgctgcccccatgacatcctggctgggacgcgcatggatttaggagaatgtaccaaaatccacgacttggccctccgagcagattatgagattgcaagtaaagaaagagacctgttttttgaattagatgcaatggatcacttggagtcctttattgctgaatgtgatcggagaactgagctcgccaagaagcggctggcagaaacacaggaggaaatcagtgcggaagtttctgcaaaggcagaaaaagtacatgagttaaatgaagaaataggaaaactccttgctaaagccgaacagctaggggctgaaggtaatgtggatgaatcccagaagattcttatggaagtggaaaaagttcgtgcgaagaaaaaagaagctgaggaagaatacagaaattccatgcctgcatccagttttcagcagcaaaagctgcgtgtctgcgaggtctgttcagcctaccttggtctccatgacaatgaccgtcgcctggcagaccacttcggtggcaagttacacttggggttcattcagatccgagagaagcttgatcagttgaggaaaactgtcgctgaaaagcaggagaagagaaatcaggatcgcttgaggaggagagaggagagggaacgggaggagcgtctgagcaggaggtcgggatcaagaaccagagatcgcaggaggtcacgctcccgggatcggcgtcggaggcggtcaagatctacctcccgagagcgacggaaattgtcccggtcccggtcccgagatagacatcggcgccaccgcagccgttcccggagccacagccggggacatcgtcgggcttcccgggaccgaagtgcgaaatacaagtaactactctgactccttcggtagctgcaaccaggagttctccagagagcgggcatccagagaggagtcctgggagagcgggcggagcgagcgagggcccccggactggaggcttgagagctccaacgggaagatggcttcacggaggtcagaagagaaggaggccggcgagatctgaacccgtctcccgggtgctgtaaatagtctgataaacgttcacacagtctaaaattaccctttatatttgctgaatacaactcatcttttgtagtttaaaatttctattgttttggagctagctgtgagtttctagaagtgtacagagttgctcctgtgttcccgggtcatgttgagtaggaataaataaatctgatgctgcctcctgaggctgcggggggtttctgctgtcctctgcgta

SEQ ID NO: 447984 - DNA, 2096 bp, Homo sapiens
gaaagagccgaggtgggctcgaggccgacgcgaccatcgtttgtcgacgccgctgccaccgcctgcctgagagaagtcgtcgcggccgaccccgtcgcctccgccggctaccatgtccgcccaggcgcagatgcgggccctgctggaccagctcatgggcacggctcgggacggagacgaaaccagacagagggtcaagtttacagatgaccgtgtctgcaagagtcaccttctggactgctgcccccatgacatcctggctgggacgcgcatggatttaggagaatgtaccaaaatccacgacttggccctccgagcagattatgagattgcaagtaaagaaagagacctgttttttgaattagatgcaatggatcacttggagtcctttattgctgaatgtgatcggagaactgagctcgccaagaagcggctggcagaaacacaggaggaaatcagtgcggaagtttctgcaaaggcagaaaaagtacatgagttaaatgaagaaataggaaaactccttgctaaagccgaacagctaggggctgaaggtaatgtggatgaatcccagaagattcttatggaagtggaaaaagttcgtgcgaagaaaaaagaagctgaggaagaatacagaaattccatgcctgcatccagttttcagcagcaaaagctgcgtgtctgcgaggtctgttcagcctaccttggtctccatgacaatgaccgtcgcctggcagaccacttcggtggcaagttacacttggggttcattcagatccgagagaagcttgatcagttgaggaaaactgtcgctgaaaagcaggagaagagaaatcaggatcgcttgaggaggagagaggagagggaacgggaggagcgtctgagcaggaggtcgggatcaagaaccagagatcgcaggaggtcacgctcccgggatcggcgtcggaggcggtcaagatctacctcccgagagcgacggaaattgtcccggtcccggtcccgagatagacatcggcgccaccgcagccgttcccggagccacagccggggacatcgtcgggcttcccgggaccgaagtgcgaaatacaagtaactactctgactccttcggtagctgcaaccaggagtgagcccttctctgtgttcccagggtctgctgagggccgtgtctggtggggatggggctgggctcaccctcaggagtagggctggggagtcgtgaacgggactcaggtgtgggaagaggcgagagggctgtggaggagctcgcacggcgccaggtgatgggctgcacaggcactgtcccctgcctgcgtcctggggcctgtgcactgttgcgtccatgctcagagtggctgagacttgtgtcctgaccaggccctgcttacctctgttttggtttttgtttttgatatttttttttccattgtgtttttacgtagtgtcatgttctgtgcatatagtgttgtattctcctttgcactgtttatgttacagtgaaggctctccttattaaaaatcttcgcaaaggtcactttttaatggctatctaacactccatatgtggtgggcaagtctggttggcctccggggggtttccaggtataggggatgtagggccttgcctggcctggtctgcgggtccatcgtcagtgcctgagcggccagcagaaggggggcagcagcctccactgagcctctggttcccatttcccaggttctccagagagcgggcatccagagaggagtcctgggagagcgggcggagcgagcgagggcccccggactggaggcttgagagctccaacgggaagatggcttcacggaggtcagaagagaaggaggccggcgagatctgaacccgtctcccgggtgctgtaaatagtctgataaacgttcacacagtctaaaattaccctttatatttgctgaatacaactcatcttttgtagtttaaaatttctattgttttggagctagctgtgagtttctagaagtgtacagagttgctcctgtgttcccgggtcatgttgagtaggaataaataaatctgatgctgcctcctgaggctgcggggggtttctgctgtcctctgcgta

SEQ ID NO: 447985 - DNA, 1473 bp, Homo sapiens
gaaagagccgaggtgggctcgaggccgacgcgaccatcgtttgtcgacgccgctgccaccgcctgcctgagagaagtcgtcgcggccgaccccgtcgcctccgccggctaccatgtccgcccaggcgcagatgcgggccctgctggaccagctcatgggcacggctcgggacggagacgaaaccagacagagggtcaagtttacagatgaccgtgtctgcaagagtcaccttctggactgctgcccccatgacatcctggctgggacgcgcatggatttaggagaatgtaccaaaatccacgacttggccctccgagcagattatgagattgcaagtaaagaaagagacctgttttttgaattagatgcaatggatcacttggagtcctttattgctgaatgtgatcggagaactgagctcgccaagaagcggctggcagaaacacaggaggaaatcagtgcggaagtttctgcaaaggcagaaaaagtacatgagttaaatgaagaaataggaaaactccttgctaaagccgaacagctaggggctgaaggtaatgtggatgaatcccagaagattcttatggaagtggaaaaagttcgtgcgaagaaaaaagaagctgaggaagaatacagaaattccatgcctgcatccagttttcagcagcaaaagctgcgtgtctgcgaggtctgttcagcctaccttggtctccatgacaatgaccgtcgcctggcagaccacttcggtggcaagttacacttggggttcattcagatccgagagaagcttgatcagttgaggaaaactgtcgctgaaaagcaggagaagagaaatcaggatcgcttgaggaggagagaggagagggaacgggaggagcgtctgagcaggaggtcgggatcaagaaccagagatcgcaggaggtcacgctcccgggatcggcgtcggaggcggtcaagatctacctcccgagagcgacggaaattgtcccggtcccggtcccgagatagacatcggcgccaccgcagccgttcccggagccacagccggggacatcgtcgggcttcccgggaccgaagtgcgaaatacaagtaactactctgactccttcggtagctgcaaccaggagttctccagagagcgggcatccagagaggagtcctgggagagcgggcggagcgagcgagggcccccggactggaggcttgagagctccaacgggaagatggcttcacggaggtcagaagagaaggaggccggcgagatctgaacccgtctcccgggtgctgtaaatagtctgataaacgttcacacagtctaaaattaccctttatatttgctgaatacaactcatcttttgtagtttaaaatttctattgttttggagctagctgtgagtttctagaagtgtacagagttgctcctgtgttcccgggtcatgttgagtaggaataaataaatctgatgctgcctcctga

SEQ ID NO: 447986 - DNA, 3442 bp, Homo sapiens
  misc_feature (1993)..(1993): n is a, c, g, or t
gaaagagccgaggtgggctcgaggccgacgcgaccatcgtttgtcgacgccgctgccaccgcctgcctgagagaagtcgtcgcggccgaccccgtcgcctccgccggctaccatgtccgcccaggcgcagatgcgggccctgctggaccagctcatgggcacggctcgggacggtgagtcagagcggccaaccaggcgagggtctggggtgggagtgaggcgaggccgccgggcggcctgaggcgggggccgcgatcgtctgcgcctgcgcctgcgcggggcatcgctcctcctcccccgcgctccgaccgcaggcgccgggcctttgtctaagccggtgcgtctctgaggcggccgtgggtccaggtcgggctcctctctcggagtctgcgccatggatggggcttcagcctccttcctatgtaccgtcctgctacttcctccccggcgggcgccgcggctccgtgcccctccgcgaactgtggagtcggcggagggctggaatcagcgtgggctccaggtcgctggcagccgggtggcagaactcttccgaggctccttgggaagaagctacacccgagggagccggatgggcctcgaaaacctggcccgctctggttctgtaccattgcaaggggaaccgtaaactgagcttttctaacgtgggtttctgccaagtacttttccagctgcccccttccccccagcacacaggagagcctctgtgtagccagcgcttgacagtcgttaggtaggttgtactgtgtagggaggagctcaagatcatgatggttgtcacaggagaaagcggttgcatctttgcaaaactatatacctgctgtggtttgtgttttcttttctgctgagtaatgaagttgtaagttcacactggcacattctcagggctgtgcagattatttgcactttatttcataggtgaataagtgctttttagctttctttgtatattgagttgcttttgaattgcttcccatatttttatttcatacaaactgaacaattgtggcccctctattttatttataaaggttcagtgtatctttgcctgcctacatcaatctgcaagggagttgcagaaagcctcatgttcatcgagccgtgagtcacaaccaatttctaagctgttataacaaaaaagtgtttgctttttttcacaagtaactttaaaagtgtagtttagaaagaaaacattttcaataaaaagacactacattaatcctggatgcttgcaaatcctaaaatatattcctcctctagcgttgcacagctctgtgttgtatacacagactagctttaaaatttgtcacataccactttacctttacttttatgtatcattcccccgacttccttactgcaggtgtgggcaagaaaacttttcctttaacacttttcaacagcgggcataaaattctgcagctgaggtcttgaagaatgcagatgggtacagtatgtgttggagctcacagtgtgtattgactaacctagttccttttttgctttttttggtattgtcttgttaaaagtgactcccaggtagcaactctcttttttaagggtgggaacgaaagggacgtaggaagaatagatctagattatttaacagtcttcgatagagtttgaaagctttcttcttcattcaattttgggcaaaatactgcctctgcatttgttcataacaaaaagattagattaataagtagcttttgttggtggaaattaccagctctataagtcacccttggtggttcatggacctctgattagcttgggttttgcagtctcattgccacatgtatatgtggagccaatggccttttggtgctcagctgtttacgtctgactccttgacttctttggtacagtgatggagtcagatctcattaagtgtgattctccatgatataactagcctcaaaaaaatgtgtattccactccagttgtaaatatctttagatcagcttttcattgnatttgatggggagaacacagaaatgatagtctgcaaatcatccaggtgaattgttatactagttattttttggtggttaatgtgataatattgtcttatttaaaaccacaaatgaatttcaggagacgaaaccagacagagggtcaagtttacagatgaccgtgtctgcaagagtcaccttctggactgctgcccccatgacatcctggctgggacgcgcatggatttaggagaatgtaccaaaatccacgacttggccctccgagcagattatgagattgcaagtaaagaaagagacctgttttttgaattagatgtgaaaggggggaccctaccctcagaacatgagggaataatatttacgtggctcacaaagaccagcaatggatcacttggagtcctttattgctgaatgtgatcggagaactgagctcgccaagaagcggctggcagaaacacaggaggaaatcagtgcggaagtttctgcaaaggcagaaaaagtacatgagttaaatgaagaaataggaaaactccttgctaaagccgaacagctaggggctgaaggtaatgtggatgaatcccagaagattcttatggaagtggaaaaagttcgtgcgaagaaaaaagaagctgaggaagaatacagaaattccatgcctgcatccagttttcagcagcaaaagctgcgtgtctgcgaggtctgttcagcctaccttggtctccatgacaatgaccgtcgcctggcagaccacttcggtggcaagttacacttggggttcattcagatccgagagaagcttgatcagttgaggaaaactgtcgctgaaaagcaggagaagagaaatcaggatcgcttgaggaggagagaggagagggaacgggaggagcgtctgagcaggaggtcgggatcaagaaccagagatcgcaggaggtcacgctcccgggatcggcgtcggaggcggtcaagatctacctcccgagagcgacggaaattgtcccggtcccggtcccgagatagacatcggcgccaccgcagccgttcccggagccacagccggggacatcgtcgggcttcccgggaccgaagtgcgaaatacaagttctccagagagcgggcatccagagaggagtcctgggagagcgggcggagcgagcgagggcccccggactggaggcttgagagctccaacgggaagatggcttcacggaggtcagaagagaaggaggccggcgagatctgaacccgtctcccgggtgctgtaaatagtctgataaacgttcacacagtctaaaattaccctttatatttgctgaatacaactcatcttttgtagtttaaaatttctattgttttggagctagctgtgagtttctagaagtgtacagagttgctcctgtgttcccgggtcatgttgagtaggaataaataaatctgatgctgcctcctga

SEQ ID NO: 447987 - DNA, 2502 bp, Homo sapiens
  misc_feature (1117)..(1117): n is a, c, g, or t
gaaagagccgaggtgggctcgaggccgacgcgaccatcgtttgtcgacgccgctgccaccgcctgcctgagagaagtcgtcgcggccgaccccgtcgcctccgccggctaccatgtccgcccaggcgcagatgcgggccctgctggaccagctcatgggcacggctcgggacggttcagtgtatctttgcctgcctacatcaatctgcaagggagttgcagaaagcctcatgttcatcgagccgtgagtcacaaccaatttctaagctgttataacaaaaaagtgtttgctttttttcacaagtaactttaaaagtgtagtttagaaagaaaacattttcaataaaaagacactacattaatcctggatgcttgcaaatcctaaaatatattcctcctctagcgttgcacagctctgtgttgtatacacagactagctttaaaatttgtcacataccactttacctttacttttatgtatcattcccccgacttccttactgcaggtgtgggcaagaaaacttttcctttaacacttttcaacagcgggcataaaattctgcagctgaggtcttgaagaatgcagatgggtacagtatgtgttggagctcacagtgtgtattgactaacctagttccttttttgctttttttggtattgtcttgttaaaagtgactcccaggtagcaactctcttttttaagggtgggaacgaaagggacgtaggaagaatagatctagattatttaacagtcttcgatagagtttgaaagctttcttcttcattcaattttgggcaaaatactgcctctgcatttgttcataacaaaaagattagattaataagtagcttttgttggtggaaattaccagctctataagtcacccttggtggttcatggacctctgattagcttgggttttgcagtctcattgccacatgtatatgtggagccaatggccttttggtgctcagctgtttacgtctgactccttgacttctttggtacagtgatggagtcagatctcattaagtgtgattctccatgatataactagcctcaaaaaaatgtgtattccactccagttgtaaatatctttagatcagcttttcattgnatttgatggggagaacacagaaatgatagtctgcaaatcatccaggtgaattgttatactagttattttttggtggttaatgtgataatattgtcttatttaaaaccacaaatgaatttcaggagacgaaaccagacagagggtcaagtttacagatgaccgtgtctgcaagagtcaccttctggactgctgcccccatgacatcctggctgggacgcgcatggatttaggagaatgtaccaaaatccacgacttggccctccgagcagattatgagattgcaagtaaagaaagagacctgttttttgaattagatgcaatggatcacttggagtcctttattgctgaatgtgatcggagaactgagctcgccaagaagcggctggcagaaacacaggaggaaatcagtgcggaagtttctgcaaaggcagaaaaagtacatgagttaaatgaagaaataggaaaactccttgctaaagccgaacagctaggggctgaaggtaatgtggatgaatcccagaagattcttatggaagtggaaaaagttcgtgcgaagaaaaaagaagctgaggaagaatacagaaattccatgcctgcatccagttttcagcagcaaaagctgcgtgtctgcgaggtctgttcagcctaccttggtctccatgacaatgaccgtcgcctggcagaccacttcggtggcaagttacacttggggttcattcagatccgagagaagcttgatcagttgaggaaaactgtcgctgaaaagcaggagaagagaaatcaggatcgcttgaggaggagagaggagagggaacgggaggagcgtctgagcaggaggtcgggatcaagaaccagagatcgcaggaggtcacgctcccgggatcggcgtcggaggcggtcaagatctacctcccgagagcgacggaaattgtcccggtcccggtcccgagatagacatcggcgccaccgcagccgttcccggagccacagccggggacatcgtcgggcttcccgggaccgaagtgcgaaatacaagttctccagagagcgggcatccagagaggagtcctgggagagcgggcggagcgagcgagggcccccggactggaggcttgagagctccaacgggaagatggcttcacggaggtcagaagagaaggaggccggcgagatctgaacccgtctcccgggtgctgtaaatagtctgataaacgttcacacagtctaaaattaccctttatatttgctgaatacaactcatcttttgtagtttaaaatttctattgttttggagctagctgtgagtttctagaagtgtacagagttgctcctgtgttcccgggtcatgttgagtaggaataaataaatctgatgctgcctcctga

SEQ ID NO: 447988 - DNA, 1841 bp, Homo sapiens
gaaagagccgaggtgggctcgaggccgacgcgaccatcgtttgtcgacgccgctgccaccgcctgcctgagagaagtcgtcgcggccgaccccgtcgcctccgccggctaccatgtccgcccaggcgcagatgcgggccctgctggaccagctcatgggcacggctcgggacggagacgaaaccagacagagggtcaagtttacagatgaccgtgtctgcaagagtcaccttctggactgctgcccccatgacatcctggctgggacgcgcatggatttaggagaatgtaccaaaatccacgacttggccctccgagcagattatgagattgcaagtaaagaaagagacctgttttttgaattagatgcaatggatcacttggagtcctttattgctgaatgtgatcggagaactgagctcgccaagaagcggctggcagaaacacaggaggaaatcagtgcggaagtttctgcaaaggcagaaaaagtacatgagttaaatgaagaaataggaaaactccttgctaaagccgaacagctaggggctgaaggtaatgtggatgaatcccagaagattcttatggaagtggaaaaagttcgtgcgaagaaaaaagaagctgaggaagaatacagaaattccatgcctgcatccagttttcagcagcaaaagctgcgtgtctgcgaggtctgttcagcctaccttggtctccatgacaatgaccgtcgcctggcagaccacttcggtggcaagttacacttggggttcattcagatccgagagaagcttgatcagttgaggaaaactgtcgctgaaaagcaggagaagagaaatcaggatcgcttgaggaggagagaggagagggaacgggaggagcgtctgagcaggaggtcgggatcaagaaccagagatcgcaggaggtaggtttccaggtccattaaaatgttctcaaatttttttttccataagcatttttcttaatatttaatgattatgcctttacaaatgttacctggcaggtagggctggcttgtgaagggcacagggcaagaggttgcttggtgccgtggagggttcccagtgttaatgagagggaaggtcggggcctgcagggtgacaggagtatccaggccacatgttttcaggagacctcattggaaggacctagccattggagatgaactgatggaaatattttaaacctaaatttgtgggagtaaaggagaaaatgtcagtaaagcagcaagcagaatctgctgaggggtggggccctcatagtgttggcacctatagagtctcagccttggagccttctgattgttcaggtcacgctcccgggatcggcgtcggaggcggtcaagatctacctcccgagagcgacggaaattgtcccggtcccggtcccgagatagacatcggcgccaccgcagccgttcccggagccacagccggggacatcgtcgggcttcccgggaccgaagtgcgaaatacaagttctccagagagcgggcatccagagaggagtcctgggagagcgggcggagcgagcgagggcccccggactggaggcttgagagctccaacgggaagatggcttcacggaggtcagaagagaaggaggccggcgagatctgaacccgtctcccgggtgctgtaaatagtctgataaacgttcacacagtctaaaattaccctttatatttgctgaatacaactcatcttttgtagtttaaaatttctattgttttggagctagctgtgagtttctagaagtgtacagagttgctcctgtgttcccgggtcatgttgagtaggaataaataaatctgatgctgcctcctga

SEQ ID NO: 447989 - DNA, 1279 bp, Homo sapiens
gaaagagccgaggtgggctcgaggccgacgcgaccatcgtttgtcgacgccgctgccaccgcctgcctgagagaagtcgtcgcggccgaccccgtcgcctccgccggctaccatgtccgcccaggcgcagatgcgggccctgctggaccagctcatgggcacggctcgggacggagacgaaaccagacagagggtcaagtttacagatgaccgtgtctgcaagagtcaccttctggactgctgcccccatgacatcctggctgggacgcgcatggatttaggagaatgtaccaaaatccacgacttggccctccgagcagattatgagattgcaagtaaagaaagagacctgttttttgaattagatgcaatggatcacttggagtcctttattgctgaatgtgatcggagaactgagctcgccaagaagcggctggcagaaacacaggaggaaatcagtgcggaagtttctgcaaaggcagaaaaagtacatgagttaaatgaagaaataggaaaactccttgctaaagccgaacagctaggggctgaaggtaatgtggatgaatcccagaagattcttatggaagtggaaaaagttcgtgcgaagaaaaaagaagctgaggaagaatacagaaattccatgcctgcatccagttttcagcagcaaaagctgcgtgtctgcgaggtctgttcagcctaccttggtctccatgacaatgaccgtcgcctggcagaccacttcggtggcaagttacacttggggttcattcagatccgagagaagcttgatcagttgaggaaaactgtcgctgaaaagcaggagaagagaaatcaggatcgcttgaggaggagagaggagagggaacgggaggagcgtctgagcaggaggtcgggatcaagaaccagagatcgcaggaggtcacgctcccgggatcggcgtcggaggcggtcaagatctacctcccgagaagcgggcggagcgagcgagggcccccggactggaggcttgagagctccaacgggaagatggcttcacggaggtcagaagagaaggaggccggcgagatctgaacccgtctcccgggtgctgtaaatagtctgataaacgttcacacagtctaaaattaccctttatatttgctgaatacaactcatcttttgtagtttaaaatttctattgttttggagctagctgtgagtttctagaagtgtacagagttgctcctgtgttcccgggtcatgttgagtaggaataaataaatctgatgctgcctcctga

SEQ ID NO: 447990 - DNA, 1503 bp, Homo sapiens
tttttgtatttttattagagaccatgttggctagactggtcttgaactcctgacctcatgatccgcccaccttggcctcacaaagtgctgggattacaggtgtgagccactgcgtccggtcctgtctctgtttttatctgaaattatgttagcctttgcctagttatggtgaattaaccttagcatatgatagttctcttaatgtttcccaccacccttttcagagtaagcaatttgacgtctacagcttcttttcctttatctctttgggtaaatagcaaccaatttttcctgctactttagatagtaggcaataacaaaatgtattcatagctctcagtaatatttgttctattgttttgtttttgaggtgaaaggggggaccctaccctcagaacatgagggaataatatttacgtggctcacaaagaccagcaatggatcacttggagtcctttattgctgaatgtgatcggagaactgagctcgccaagaagcggctggcagaaacacaggaggaaatcagtgcggaagtttctgcaaaggcagaaaaagtacatgagttaaatgaagaaataggaaaactccttgctaaagccgaacagctaggggctgaaggtaatgtggatgaatcccagaagattcttatggaagtggaaaaagttcgtgcgaagaaaaaagaagctgaggaagaatacagaaattccatgcctgcatccagttttcagcagcaaaagctgcgtgtctgcgaggtctgttcagcctaccttggtctccatgacaatgaccgtcgcctggcagaccacttcggtggcaagttacacttggggttcattcagatccgagagaagcttgatcagttgaggaaaactgtcgctgaaaagcaggagaagagaaatcaggatcgcttgaggaggagagaggagagggaacgggaggagcgtctgagcaggaggtcgggatcaagaaccagagatcgcaggaggtcacgctcccgggatcggcgtcggaggcggtcaagatctacctcccgagagcgacggaaattgtcccggtcccggtcccgagatagacatcggcgccaccgcagccgttcccggagccacagccggggacatcgtcgggcttcccgggaccgaagtgcgaaatacaagttctccagagagcgggcatccagagaggagtcctgggagagcgggcggagcgagcgagggcccccggactggaggcttgagagctccaacgggaagatggcttcacggaggtcagaagagaaggaggccggcgagatctgaacccgtctcccgggtgctgtaaatagtctgataaacgttcacacagtctaaaattaccctttatatttgctgaatacaactcatcttttgtagtttaaaatttctattgttttggagctagctgtgagtttctagaagtgtacagagttgctcctgtgttcccgggtcatgttgagtaggaataaataaatctgatgctgcctcctga

SEQ ID NO: 447991 - DNA, 590 bp, Homo sapiens
atttacaaagcttgctgtatttcaggcttctaatatgttgctacaattatttagatgcctgactaaaaggaggtcacgctcccgggatcggcgtcggaggcggtcaagatctacctcccgagagcgacggaaattgtcccggtcccggtcccgagatagacatcggcgccaccgcagccgttcccggagccacagccggggacatcgtcgggcttcccgggaccgaagtgcgaaatacaagttctccagagagcgggcatccagagaggagtcctgggagagcgggcggagcgagcgagggcccccggactggaggcttgagagctccaacgggaagatggcttcacggaggtcagaagagaaggaggccggcgagatctgaacccgtctcccgggtgctgtaaatagtctgataaacgttcacacagtctaaaattaccctttatatttgctgaatacaactcatcttttgtagtttaaaatttctattgttttggagctagctgtgagtttctagaagtgtacagagttgctcctgtgttcccgggtcatgttgagtaggaataaataaatctgatgctgcctcctga

SEQ ID NO: 447992 - DNA, 3190 bp, Homo sapiens
  misc_feature (1)..(1): n is a, c, g, or t
ncatctgtgggtcctgtcccatccatcctgacctgttccatctcagccccaggactcagtactgcggttgccaacactgctgccaggcatgatggatgggccacgttccgatgtgggccgttggggtggcaaccccttgcagccccctaccacgccatctccagagccagagccagagccagacggacgctctcgcagaggaggaggccgttccttctgggctcgctgctgtggctgctgttcatgccgaaatgcggcagatgacgactggggacctgaaccctctgactccaggggtcgagggtccagctctggcactcgaagacctggctcccggggctcagactcccgccggcctgtatcccggggcagcggtgtcaatgcagctggagatggcaccatccgagagggcatgctagtagtgaacggtgtggacttgctgagctcgcgctcggaccagaaccgccgagagcaccacacagacgagtatgagtacgacgagctgatagtgcgccgcgggcagcctttccatatgctcctcctcctgtcccggacctatgaatcctctgatcgcatcacccttgagttactcatcggaaacaaccccgaggtgggcaagggcacgcacgtgatcatcccagtgggcaaggggggcagtggaggctggaaagcccaggtggtcaaggccagtgggcagaatctgaacctgcgggtccacacttcccccaacgccatcatcggcaagtttcagttcacagtccgcacacaatcagacgctggggagttccagttgccctttgacccccgcaatgagatctacatcctcttcaacccctggtgcccagaggacattgtgtacgtggaccatgaggattggcggcaggagtatgttcttaatgagtctgggagaatttactacgggaccgaagcacagattggtgagcggacctggaactacggccagtttgaccacggggtgctggatgcctgcttatacatcctggaccggcgggggatgccatatggaggccgtggagacccagtcaatgtctcccgggtcatctctgccatggtgaactccctggatgacaatggagtcctgattgggaactggtctggtgattactcccgaggcaccaacccatcagcgtgggtgggcagcgtggagatcctgcttagctacctacgcacgggatattccgtcccctatggccagtgctgggtctttgctggcgtgaccaccacagtgctgcgctgcctgggtctggccacccgtactgtcaccaacttcaactccgcccacgacacagacacatcccttaccatggacatctacttcgacgagaacatgaagcccctggagcacctgaaccatgattctgtctggaacttccatgtgtggaacgactgctggatgaagaggccggatctgccctcgggctttgatgggtggcaggtggtggatgccacaccccaagagactagcagtggcatcttctgctgcggcccctgctctgtggagtccatcaagaatggcctggtctacatgaagtacgacacgcctttcatttttgctgaggtgaatagtgacaaggtgtactggcagcggcaggatgatggcagcttcaagattgtttatgtggaggagaaggccatcggcacactcattgtcacaaaggccatcagctccaacatgcgggaggacatcacctacctctataagcacccagaaggctcagacgcagagcggaaggcagtagagacagcagcagcccacggcagcaaacccaatgtgtatgccaaccggggctcagcggaggatgtggccatgcaggtggaggcacaggacgcggtgatggggcaggatctgatggtctctgtgatgctgatcaatcacagcagcagccgccgcacagtgaaactgcacctctacctctcagtcactttctatactggtgtcagtggtaccatcttcaaggagaccaagaaggaagtggagctggcaccaggggcctcggaccgtgtgaccatgccagtggcctacaaggaataccggccccatcttgtggaccagggggccatgctgctcaatgtctcaggccacgtcaaggagagcgggcaggtgctggccaagcagcacaccttccgtctgcgcaccccagacctctccctcacgttactgggagcagcagtggttggccaggagtgtgaagtacagattgtcttcaagaacccccttcccgtcaccctcaccaatgtcgtcttccggctcgaaggctctgggttacagaggcccaagatcctcaacgttggggacattggaggcaatgaaacagtgacactgcgccagtcgtttgtgcctgtgcgaccaggcccccgccagctcattgccagcttggacagcccacagctctcccaggtgcacggtgtcatccaggtggatgtggccccagcccctggggatgggggcttcttctcagacgctggaggtgacagtcacttaggagagaccatccctatggcatctcgaggtggagcttagccctgtgccaggagcaatgggactggagtcagatgagcaaggacattgccccaagataggggcacactacagagcagctccccaggagctcaggtggggagtccagggctcccggagagggagtcagtcttcacttgcactgggggaacagatgctaataaactgttttttaatgaaaaaagcaccaccacacagacaaaccaacaaagaaaacaaacaaagaaacacaaaacaacacaaaaaaaggggggggcacgccaagaaatgaccacccagggggcgccccgaagataggagcaaaccaaacaccaagagaacaaagggaggcacaaaaaggagagagagcagacaaaaaagcagaggaaacaaccacgaaaacgaaaacacgcacgcagtcgggagacacaagcggagcacaggcggaaacacacagtggaaggaagacaccaccacacgacaggaggacgagaagacaacaaatagagggcgaacaacgcgcccccacgcacgagactaaagcacccccaaggcagagagaacaacaacaacgtagaacgaggacaaaggaggtcaaaaaaaaaaacgagaaagaacgcgcggcgacagaaacgtatgccaacacagagagaaaacaaggcgaaacaaatc

SEQ ID NO: 447993 - DNA, 520 bp, Homo sapiens
gcatcttctgctgcggcccctgctctgtggagtccatcaagaatggcctggtctacatgaagtacgacacgcctttcatttttgctgaggtgagggctgggctccaggtgccttcttgggcttcagtcatgggttctctggtcccaacttcaccgctgactgaccagctctgcgacccggggcaagtcactcattatacaagtcagtttcctcacctgtaaaaggggataatcaaggctgccttgcttcctatactcgggatcagaagagataacgggtatgaaactgcttcactagtcgtaaagtcagccattgagtgtgagggattactgatattgccaaagtgctctgccaggagcctcccagaccagcttcttccctgcactctggcctcgtctggctcgtcttggaaagtctccccttgggctctgccaggaagctcccacccttgggaccaagccctgtcccatagctcctgggatcaggggaaggaggccgggagtcaggccaccctcagacc

SEQ ID NO: 447994 - DNA, 2345 bp, Homo sapiens
  misc_feature (1)..(1): n is a, c, g, or t
ncatctgtgggtcctgtcccatccatcctgacctgttccatctcagccccaggactcagtactgcggttgccaacactgctgccaggcatgatggatgggccacgttccgatgtgggccgttggggtggcaaccccttgcagccccctaccacgccatctccagagccagagccagagccagacggacgctctcgcagaggaggaggccgttccttctgggctcgctgctgtggctgctgttcatgccgaaatgcggcagatgacgactggggacctgaaccctctgactccaggggtcgagggtccagctctggcactcgaagacctggctcccggggctcagactcccgccggcctgtatcccggggcagcggtgtcaatgcagctggagatggcaccatccgagagggcatgctagtagtgaacggtgtggacttgctgagctcgcgctcggaccagaaccgccgagagcaccacacagacgagtatgagtacgacgagctgatagtgcgccgcgggcagcctttccatatgctcctcctcctgtcccggacctatgaatcctctgatcgcatcacccttgagttactcatcggaaacaaccccgaggtgggcaagggcacgcacgtgatcatcccagtgggcaaggggggcagtggaggctggaaagcccaggtggtcaaggccagtgggcagaatctgaacctgcgggtccacacttcccccaacgccatcatcggcaagtttcagttcacagtccgcacacaatcagacgctggggagttccagttgccctttgacccccgcaatgagatctacatcctcttcaacccctggtgcccagaggacattgtgtacgtggaccatgaggattggcggcaggagtatgttcttaatgagtctgggagaatttactacgggaccgaagcacagattggtgagcggacctggaactacggccagtttgaccacggggtgctggatgcctgcttatacatcctggaccggcgggggatgccatatggaggccgtggagacccagtcaatgtctcccgggtcatctctgccatggtgaactccctggatgacaatggagtcctgattgggaactggtctggtgattactcccgaggcaccaacccatcagcgtgggtgggcagcgtggagatcctgcttagctacctacgcacgggatattccgtcccctatggccagtgctgggtctttgctggcgtgaccaccacagtgctgcgctgcctgggtctggccacccgtactgtcaccaacttcaactccgcccacgacacagacacatcccttaccatggacatctacttcgacgagaacatgaagcccctggagcacctgaaccatgattctgtctggaacttccatgtgtggaacgactgctggatgaagaggccggatctgccctcgggctttgatgggtggcaggtggtggatgccacaccccaagagactagcagtggcatcttctgctgcggcccctgctctgtggagtccatcaagaatggcctggtctacatgaagtacgacacgcctttcatttttgctgaggtgaatagtgacaaggtgtactggcagcggcaggatgatggcagcttcaagattgtttatgtggaggagaaggccatcggcacactcattgtcacaaaggccatcagctccaacatgcgggaggacatcacctacctctataagcacccagaaggctcagacgcagagcggaaggcagtagagacagcagcagcccacggcagcaaacccaatgtgtatgccaaccggggctcagcggaggatgtggccatgcaggtggaggcacaggacgcggtgatggggcaggatctgatggtctctgtgatgctgatcaatcacagcagcagccgccgcacagtgaaactgcacctctacctctcagtcactttctatactggtgtcagtggtaccatcttcaaggagaccaagaaggaagtggagctggcaccaggggcctcggaccgtgtgaccatgccagtggcctacaaggaataccggccccatcttgtggaccagggggccatgctgctcaatgtctcaggccacgtcaaggagagcgggcaggtgctggccaagcagcacaccttccgtctgcgcaccccagacctctccctcacgttactgggagcagcagtggttggccaggagtgtgaagtacagattgtcttcaagaacccccttcccgtcaccctcaccaatgtcgtcttccggctcgaaggctctgggttacagaggcccaagatcctcaacgttgggtgagtctggcctctccccctacccctgcttc

SEQ ID NO: 447995 - DNA, 433 bp, Homo sapiens
aagaaaaaaaaaaaaaaaaaaaaaagaatgcggccgcgatgcgctccatggcatctggaggtggtgttcccactgatgaagagcaggcgactgggttggagagggagatcatgctggctgcaaagaagggactggacccatacaatgtactggccccaaagggagcttcaggcaccagggaagaccctaatttagtcccctccatctccaacaagagaatagtaggctgcatctgtgaagaggacaataccagcgtcgtctggttttggctgcacaaaggcgaggcccagcgatgcccccgctgtggagcccattacaagctggtgccccagcagctggcacactgagcacctgcactaaattactcaaaatgtgctgtaaagtttcttctttccagtaaagactagccattgcattggctccttctcccata

SEQ ID NO: 447996 - DNA, 681 bp, Homo sapiens
  misc_feature (641)..(641): n is a, c, g, or t
  misc_feature (673)..(673): n is a, c, g, or t
ccccccaaccccctctcttttacacttaaattactcagaaaatgagtttctaaaaacagaaaagagagacagagatctcgtgccaaattcggcacgaacgcggacgcaatggcttcaaggttacttcgcggagctggaacgctggccgcgcaggccctgagggctcgcggccccagtggcgcggccgcgatgcgctccatggcatctggaggtggtgttcccactgatgaagagcaggcgactgggttggagagggagatcatgctggctgcaaagaagggactggacccatacaatgtactggccccaaagggagcttcaggcaccagggaagaccctaatttagtcccctccatctccaacaagagaatagtaggctgcatctgtgaagaggacaataccagcgtcgtctggttttggctgcacaaaggcgaggcccagcgatgcccccgctgtggagcccattacaagctggtgccccagcagctggcacactgagcacctgcactaaattactcaaaatgtgctgtaaagtttcttctttccagtaaagactagccattgcattggctccttctcccataaaaatccctttccaataactccttttcccaaaaacagcacgtttctctaccaagccngtcagtcatcactaaaccccgccgactgggtnatttagat

SEQ ID NO: 447997 - DNA, 364 bp, Homo sapiens
cctcaatttcttcatctgaagaatgggaggagggcttgaactgatctcttaagatatcaaccatagtcttacttgtgtatcagagatgtctgaggaaaagaaattcatgttgaaagtctccctttctaggttggatgaccataaaccaccttttttcccttttaggtgaagaggacaataccagcgtcgtctggttttggctgcacaaaggcgaggcccagcgatgcccccgctgtggagcccattacaagctggtgccccagcagctggcacactgagcacctgcactaaattactcaaaatgtgctgtaaagtttcttctttccagtaaagactagccattgcattggctccttctcccata

SEQ ID NO: 447998 - DNA, 848 bp, Homo sapiens
cggacgcgtgggtccggacgcgtgggtcgacccacgcgtccgagatcatgctggctgcaaagaagggactggacccatacaatgtactggccccaaagggagcttcaggcaccagggaagaccctaatttagtcccctccatctccaacaagagaatagtaggctgcatctgtgaagaggacaataccagcgtcgtctggttttggctgcacaaaggcgaggcccagcgatgcccccgctgtggagcccattacaagctggtgccccagcagctggcacactgagcacctgcactaaattactcaaaatgtgctgtaaagtttcttctttccagtaaagactagccattgcattggctccttctcccataatcccttaaaacaagaagaactacaacagaggcgcgcacgactcctcgaaggtacgtccacctcaaagaggggaccccaaaggcaattaacggcggaataaccccagaggaatacacatttgagtacccaaaaacacgcgcggagcatcaccccggcacaactacggggtgccgagtctccccgagtaactccgaagtaacgaagcgccctacggcgcacaccctttgggaccccggtcttcacgagcatatacagcttaacccaacatacgcgacatccaggagggcggacacccttggcgcggtgcaagcgaaacaagccgtaggccccctaatgcagcactcgttgggcggtaccacaccgtgatagtagaccgcgcaaccaaggtggaaaccccgcccttcagcgccgagtcacacccctgcgggtggcgccacgcccgtcgccaccgcgccctaacacaccctgtcggcggga

SEQ ID NO: 447999 - DNA, 878 bp, Homo sapiens
acgcagtgatctttaggagcccacttctaaattcaaatcatttggggttcagtaagtctcttcacagacggggacctaatagcttccattagcagcctccacgtttgctgaacacgactacggggccagacccacaggaactccaatgtggttcagccgctcaactccagggaccaaaaagactttcccacctcccagcgttattaaaggcaaccccgcccccaagcctcagccactacgcggtgcagaaagaggcagagctgggcatgcgcaatttccgcccccgccacagtcttgggagtgggcgggctcgagggctgggaggaagccgaaagctgaccgagaggagaaagaagcccgcccccggaagtccctcctgtctctgcagcttgttcccggaagttttgctgctagtcgcggacgcaatggcttcaaggttacttcgcggagctggaacgctggccgcgcagtggcgcggccgcgatgcgctccatggcatctggaggtggtgttcccactgatgaagagcaggcgactgggttggagagggagatcatgctggctgcaaagaagggactggacccatacaatgtactggccccaaagggagcttcaggcaccagggaagaccctaatttagtcccctccatctccaacaagagaatagtaggctgcatctgtgaagaggacaataccagcgtcgtctggttttggctgcacaaaggcgaggcccagcgatgcccccgctgtggagcccattacaagctggtgccccagcagctggcacactgagcacctgcactaaattactcaaaatgtgctgtaaagtttcttctttccagtaaagactagccattgcattggctccttctcccata

SEQ ID NO: 448000 - DNA, 1280 bp, Homo sapiens
acgcagtgatctttaggagcccacttctaaattcaaatcatttggggttcagtaagtctcttcacagacggggacctaatagcttccattagcagcctccacgtttgctgaacacgactacggggccagacccacaggaactccaatgtggttcagccgctcaactccagggaccaaaaagactttcccacctcccagcgttattaaaggcaaccccgcccccaagcctcagccactacgcggtgcagaaagaggcagagctgggcatgcgcaatttccgcccccgccacagtcttgggagtgggcgggctcgagggctgggaggaagccgaaagctgaccgagaggagaaagaagcccgcccccggaagtccctcctgtctctgcagcttgttcccggaagttttgctgctagtcgcggacgcaatggcttcaaggttacttcgcggagctggaacgctggccgcgcaggccctgagggctcgcggccccagtggcgcggccgcgatgcgctccatggcatctggaggtggtgttcccactgatgaagagcaggcgactgggttggagagggagatcatgctggctgcaaagaagggactggacccatacaatgtactggccccaaagggagcttcaggcaccagggaagaccctaatttagtcccctccatctccaacaagagaatagtaggctgcatctgtgaagaggacaataccagcgtcgtctggttttggctgcacaaaggcgaggcccagcgatgcccccgctgtggagcccattacaagctggtgccccagcagctggcacactgagcacctgcactaaattactcaaaatgtgctgtaaagtttcttctttccagtaaagactagccattgcattggctccttctcccataaaaaaaaaaaaaaaaaaaaaaaaaaaaaaaaaaaaaaaaaaaaaaaaaaaaaaaaaaaaaaaaaaaaaagacaagaccaaaaggaacagaggaacaccaacacaaacacaacaagaaaaaaaaaaaaatttggggcccttttggcaccccggctttttaactcggcgagtttttttgtgggggcccaattttggggctaatttggccaaatcccccttaaagggggcggttttaacaactctagggggcgcgggtttaaaaagcgtgggcattggaaaaaacccgggggttcccacattataacgcttttgagggaaatacccctttttcgcgggtggggcaaatatacacaaagggcctcaccgcgaggccctttccc

SEQ ID NO: 448001 - DNA, 703 bp, Homo sapiens
cagggaccagagtgttgccctcccagggtggtcccagggcggcaaagcggcgcggctcgtgcagcttctcgaggtcccagtggccgctttacggtccccagtgcctcaggctctgcaggcatctccctgtaattctggaccgctgctcctgccgctccccgaactcactccgctgcgaaaacaaatgtcgacaaatttgcctcggtggttggagaaagaaaagctcataggccgggcgcggtggctcacaactgtaatcccagcactttgggaggccgaggcggacagatcccctgaggtcaggagctcaagaccagcctggccaacatggtggtgttcccactgatgaagagcaggcgactgggttggagagggagatcatgctggctgcaaagaagggactggacccatacaatgtactggccccaaagggagcttcaggcaccagggaagaccctaatttagtcccctccatctccaacaagagaatagtaggctgcatctgtgaagaggacaataccagcgtcgtctggttttggctgcacaaaggcgaggcccagcgatgcccccgctgtggagcccattacaagctggtgccccagcagctggcacactgagcacctgcactaaattactcaaaatgtgctgtaaagtttcttctttccagtaaagactagccattgcattggctccttctcccata

SEQ ID NO: 448002 - DNA, 1040 bp, Homo sapiens
  misc_feature (908)..(908): n is a, c, g, or t
acgcagtgatctttaggagcccacttctaaattcaaatcatttggggttcagtaagtctcttcacagacggggacctaatagcttccattagcagcctccacgtttgctgaacacgactacggggccagacccacaggaactccaatgtggttcagccgctcaactccagggaccaaaaagactttcccacctcccagcgttattaaaggcaaccccgcccccaagcctcagccactacgcggtgcagaaagaggcagagctgggcatgcgcaatttccgcccccgccacagtcttgggagtgggcgggctcgagggctgggaggaagccgaaagctgaccgagaggagaaagaagcccgcccccggaagtccctcctgtctctgcagcttgttcccggaagttttgctgctagtcgcggacgcaatggcttcaaggttacttcgcggagctggaacgctggccgcgcaggccctgagggctcgcggccccagtggcgcggccgcgatgcgctccatggcatctggaggtggtgttcccactgatgaagagcaggcgactgggttggagagggagatcatgctggctgcaaagaagggactggacccatacaatgtactggccccaaagggagcttcaggcaccagggaagaccctaatttagtcccctccatctccaacaagagaatagtaggctgcatctgtgaagaggacaataccagcgtcgtctggttttggctgcacaaaggcgaggcccagcgatgcccccgctgtggagcccattacaagctggtgccccagcagctggcacactgagcacctgcactaaattactcaaaatgtgctgtaaagtttcttctttccagtaaagactagccattgcattggctccttctcccataaacattngggttctgatatctgaggccagtaactataaaatatctctcggggggggccccgggaccgagtttcccctatagggagcctaattacaaatccttggccgaagatttacaacggcaagactggaaaaaccct

SEQ ID NO: 448003 - DNA, 1367 bp, Homo sapiens
  misc_feature (1235)..(1235): n is a, c, g, or t
cagggaccagagtgttgccctcccagggtggtcccagggcggcaaagcggcgcggctcgtgcagcttctcgaggtcccagtggccgctttacggtccccagtgcctcaggctctgcaggcatctccctgtaattctggaccgctgctcctgccgctccccgaactcactccgctgcgaaagtatcctaaacggaggtgccgggtgaccttgggagggaccggggctgccaccgggatggggaggggtccggcctcccttcaaacctgcgcccacctcaagcagagtgggttctacatgcttttagacaaatgtcgacaaatttgcctcggtggttggagaaagaaaagctcataggccgggcgcggtggctcacaactgtaatcccagcactttgggaggccgaggcggacagatcccctgaggtcaggagctcaagaccagcctggccaacatggtaaaaccccgtttctactaaaaatacaaaaattagccgggcgtggtggcgcgcgcctgtagtcccagctactcgggaggctgaggcaggagaatcgcttaaacccgggaggcggaggttcccgtgagccaacatcgcgccattgcactccagcctgggcaacaagagcaaaactccgtctcaaaaaagaaaaaaaaagctcccccgagtgctgccgcttgtgtggatgggtacttggtggttcttaggggaccatggatatgagtagcctttaggagcttgtgagcccgctaaaacttatacagaagtttcggggcaccattttccttgatcatttctgtttgtagtttttctatcagtcatttcagtcagcgtcataattcacgttatcttcctttaggtggtgttcccactgatgaagagcaggcgactgggttggagagggagatcatgctggctgcaaagaagggactggacccatacaatgtactggccccaaagggagcttcaggcaccagggaagaccctaatttagtcccctccatctccaacaagagaatagtaggctgcatctgtgaagaggacaataccagcgtcgtctggttttggctgcacaaaggcgaggcccagcgatgcccccgctgtggagcccattacaagctggtgccccagcagctggcacactgagcacctgcactaaattactcaaaatgtgctgtaaagtttcttctttccagtaaagactagccattgcattggctccttctcccataaacattngggttctgatatctgaggccagtaactataaaatatctctcggggggggccccgggaccgagtttcccctatagggagcctaattacaaatccttggccgaagatttacaacggcaagactggaaaaaccct

SEQ ID NO: 448004 - DNA, 1020 bp, Homo sapiens
acgcagtgatctttaggagcccacttctaaattcaaatcatttggggttcagtaagtctcttcacagacggggacctaatagcttccattagcagcctccacgtttgctgaacacgactacggggccagacccacaggaactccaatgtggttcagccgctcaactccagggaccaaaaagactttcccacctcccagcgttattaaaggcaaccccgcccccaagcctcagccactacgcggtgcagaaagaggcagagctgggcatgcgcaatttccgcccccgccacagtcttgggagtgggcgggctcgagggctgggaggaagccgaaagctgaccgagaggagaaagaagcccgcccccggaagtccctcctgtctctgcagcttgttcccggaagttttgctgctagtcgcggacgcaatggcttcaaggttacttcgcggagctggaacgctggccgcgcaggccctgagggctcgcggccccagtggcgcggccgcgatgcgctccatggcatctggaggtggtgttcccactgatgaagagcaggcgactgggttggagagggagatcatgctggctgcaaagaagggactggacccatacaatgtactggccccaaagggagcttcaggcaccagggaagaccctaatttagtcccctccatctccaacaagagaatagtaggctgcatctgtaagtacctcacctctattttttatccacttgcttaatatatcctacaatagtgtgtaagctgcctcaaatcttcagtgtgtgagtgcatgttggtaagtttgtctaagggtcttgacactctcaagcctcattatgcctgatagttcatccttactgggaagaagcgcagcacagcggtaagactggctcactgggagtgcggcatgaaggagtacccacccagcaaatatttattgttatactgcttctatgccaggcatcattttagacactagggatacataccagaacggaccctgctttgcgttctacata

SEQ ID NO: 448005 - DNA, 901 bp, Homo sapiens
acgcagtgatctttaggagcccacttctaaattcaaatcatttggggttcagtaagtctcttcacagacggggacctaatagcttccattagcagcctccacgtttgctgaacacgactacggggccagacccacaggaactccaatgtggttcagccgctcaactccagggaccaaaaagactttcccacctcccagcgttattaaaggcaaccccgcccccaagcctcagccactacgcggtgcagaaagaggcagagctgggcatgcgcaatttccgcccccgccacagtcttgggagtgggcgggctcgagggctgggaggaagccgaaagctgaccgagaggagaaagaagcccgcccccggaagtccctcctgtctctgcagcttgttcccggaagttttgctgctagtcgcggacgcaatggcttcaaggttacttcgcggagctggaacgctggccgcgcaggccctgagggctcgcggccccagtggcgcggccgcgatgcgctccatggcatctggaggtggtgttcccactgatgaagagcaggcgactgggttggagagggagatcatgctggctgcaaagaagggactggacccatacaatgtactggccccaaagggagcttcaggcaccagggaagaccctaatttagtcccctccatctccaacaagagaatagtaggctgcatctgtgaagaggacaataccagcgtcgtctggttttggctgcacaaaggcgaggcccagcgatgcccccgctgtggagcccattacaagctggtgccccagcagctggcacactgagcacctgcactaaattactcaaaatgtgctgtaaagtttcttctttccagtaaagactagccattgcattggctccttctcccata

SEQ ID NO: 448006 - DNA, 553 bp, Homo sapiens
  misc_feature (4)..(4): n is a, c, g, or t
  misc_feature (7)..(7): n is a, c, g, or t
  misc_feature (23)..(23): n is a, c, g, or t
  misc_feature (40)..(40): n is a, c, g, or t
ttanagncctttatgctaatatngccagcgcctactactntatgcgatgcccgacagaatgaaaggccgcggacgcaatggcttcaaggttacttcgcggagctggaacgctggccgcgcaggccctgagggctcgcggccccagtggcgcggccgcgatgcgctccatggcatctggaggtggtgttcccactgatgaagagcaggcgactgggttggagagggagatcatgctggctgcaaagaagggactggacccatacaatgtactggccccaaagggagcttcaggcaccagggaagaccctaatttagtcccctccatctccaacaagagaatagtaggctgcatctgtgaagaggacaataccagcgtcgtctggttttggctgcacaaaggcgaggcccagcgatgcccccgctgtggagcccattacaagctggtgccccagcagctggcacactgagcacctgcactaaattactcaaaatgtgctgtaaagtttcttctttccagtaaagactagccattgcattggctccttctcccata

SEQ ID NO: 448007 - DNA, 1136 bp, Homo sapiens
  misc_feature (970)..(970): n is a, c, g, or t
acgcagtgatctttaggagcccacttctaaattcaaatcatttggggttcagtaagtctcttcacagacggggacctaatagcttccattagcagcctccacgtttgctgaacacgactacggggccagacccacaggaactccaatgtggttcagccgctcaactccagggaccaaaaagactttcccacctcccagcgttattaaaggcaaccccgcccccaagcctcagccactacgcggtgcagaaagaggcagagctgggcatgcgcaatttccgcccccgccacagtcttgggagtgggcgggctcgagggctgggaggaagccgaaagctgaccgagaggagaaagaagcccgcccccggaagtccctcctgtctctgcagcttgttcccggaagttttgctgctagtcgcggacgcaatggcttcaaggttacttcgcggagctggaacgctggccgcgcaggccctgagggctcgcggccccagtggcgcggccgcgatgcgctccatggcatctggaggtggtgttcccactgatgaagagcaggcgactgggttggagagggagatcatgctggctgcaaagaagggactggacccatacaatgtactggccccaaagggagcttcaggcaccagggaagaccctaatttagtcccctccatctccaacaagagaatagtaggctgcatctgtgaagaggacaataccagcgtcgtctggttttggctgcacaaaggcgaggcccagcgatgcccccgctgtggagcccattacaagctggtgccccagcagctggcacactgagcacctgcactaaattactcaaaatgtgctgtaaagtttcttctttccagtaaagactagccattgcattggctccttctcccataaaaaaaaaaaaaaaaaaaaaaaaaaaaaaaaaaaaaaaaaaaaaaaaaaaaaaaaaaaaaaaaaaaacnggggggcgttattatttgggggggggaaacaagagggttattataaagggccactatgttacataggtggtttctgaggacccagttttttttgcaacacggggggaatagtcgggggcgccccataggagggggtatatattggagacggcggggttaccgggat

SEQ ID NO: 448008 - DNA, 1228 bp, Homo sapiens
cagggaccagagtgttgccctcccagggtggtcccagggcggcaaagcggcgcggctcgtgcagcttctcgaggtcccagtggccgctttacggtccccagtgcctcaggctctgcaggcatctccctgtaattctggaccgctgctcctgccgctccccgaactcactccgctgcgaaagtatcctaaacggaggtgccgggtgaccttgggagggaccggggctgccaccgggatggggaggggtccggcctcccttcaaacctgcgcccacctcaagcagagtgggttctacatgcttttagacaaatgtcgacaaatttgcctcggtggttggagaaagaaaagctcataggccgggcgcggtggctcacaactgtaatcccagcactttgggaggccgaggcggacagatcccctgaggtcaggagctcaagaccagcctggccaacatggtaaaaccccgtttctactaaaaatacaaaaattagccgggcgtggtggcgcgcgcctgtagtcccagctactcgggaggctgaggcaggagaatcgcttaaacccgggaggcggaggttcccgtgagccaacatcgcgccattgcactccagcctgggcaacaagagcaaaactccgtctcaaaaaagaaaaaaaaagctcccccgagtgctgccgcttgtgtggatgggtacttggtggttcttaggggaccatggatatgagtagcctttaggagcttgtgagcccgctaaaacttatacagaagtttcggggcaccattttccttgatcatttctgtttgtagtttttctatcagtcatttcagtcagcgtcataattcacgttatcttcctttaggtggtgttcccactgatgaagagcaggcgactgggttggagagggagatcatgctggctgcaaagaagggactggacccatacaatgtactggccccaaagggagcttcaggcaccagggaagaccctaatttagtcccctccatctccaacaagagaatagtaggctgcatctgtgaagaggacaataccagcgtcgtctggttttggctgcacaaaggcgaggcccagcgatgcccccgctgtggagcccattacaagctggtgccccagcagctggcacactgagcacctgcactaaattactcaaaatgtgctgtaaagtttcttctttccagtaaagactagccattgcattggctccttctcccata

SEQ ID NO: 448009 - DNA, 1114 bp, Homo sapiens
  misc_feature (948)..(948): n is a, c, g, or t
acgcagtgatctttaggagcccacttctaaattcaaatcatttggggttcagtaagtctcttcacagacggggacctaatagcttccattagcagcctccacgtttgctgaacacgactacggggccagacccacaggaactccaatgtggttcagccgctcaactccagggaccaaaaagactttcccacctcccagcgttattaaaggcaaccccgcccccaagcctcagccactacgcggtgcagaaagaggcagagctgggcatgcgcaatttccgcccccgccacagtcttgggagtgggcgggctcgagggctgggaggaagccgaaagctgaccgagaggagaaagaagcccgcccccggaagtccctcctgtctctgcagcttgttcccggaagttttgctgctagtcgcggacgcaatggcttcaaggttacttcgcggagctggaacgctggccgcgcaggccctgagggctcgcggccccagtggcgcggccgcgatgcgctccatggcatctggaggtggtgttcccactgatgaagagcaggcgactgggttggagagggagatcatgctggctgcaaagaagggactggacccatacaatgtactggccccaaagggagcttcaggcaccagggaagaccctaatttagtcccctccatctccaacaagagaatagtaggctgcatctgtgaagaggacaataccagcgtcgtctggttttggctgcacaaaggcgaggcccagcgatgcccccgctgtggagcccattacaagctggtgccccagcagctggcacactgagcacctgcactaaattactcaaaatgtgctgtaaagtttcttctttccagtaaagactagccattgcattggctccttctcccataaaaaaaaaaaaaaaaaaaaaaaaaaaaaaaaaaaaaaaaaaaaaacnggggggcgttattatttgggggggggaaacaagagggttattataaagggccactatgttacataggtggtttctgaggacccagttttttttgcaacacggggggaatagtcgggggcgccccataggagggggtatatattggagacggcggggttaccgggat

SEQ ID NO: 448010 - DNA, 447 bp, Homo sapiens
attagagatcggcgagtgatggtcagtattcgggagtgacgtgcggaggctatggtcggccagtggcgcgatggtcatggattgaggtgtgtccactgataagagcagggactggttgagaggagatcatgtggctgaaagaagggctgacccatacaatgtactggccccaaagggagcttcaggcaccagggaagaccctaatttagtcccctccatctccaacaagagaatagtaggctgcatctgtgaagaggacaataccagcgtcgtctggttttggctgcacaaaggcgaggcccagcgatgcccccgctgtggagcccattacaagctggtgccccagcagctggcacactgagcacctgcactaaattactcaaaatgtgctgtaaagtttcttctttccagtaaagactagccattgcattggctccttctcccata

SEQ ID NO: 448011 - DNA, 1347 bp, Homo sapiens
cagggaccagagtgttgccctcccagggtggtcccagggcggcaaagcggcgcggctcgtgcagcttctcgaggtcccagtggccgctttacggtccccagtgcctcaggctctgcaggcatctccctgtaattctggaccgctgctcctgccgctccccgaactcactccgctgcgaaagtatcctaaacggaggtgccgggtgaccttgggagggaccggggctgccaccgggatggggaggggtccggcctcccttcaaacctgcgcccacctcaagcagagtgggttctacatgcttttagacaaatgtcgacaaatttgcctcggtggttggagaaagaaaagctcataggccgggcgcggtggctcacaactgtaatcccagcactttgggaggccgaggcggacagatcccctgaggtcaggagctcaagaccagcctggccaacatggtaaaaccccgtttctactaaaaatacaaaaattagccgggcgtggtggcgcgcgcctgtagtcccagctactcgggaggctgaggcaggagaatcgcttaaacccgggaggcggaggttcccgtgagccaacatcgcgccattgcactccagcctgggcaacaagagcaaaactccgtctcaaaaaagaaaaaaaaagctcccccgagtgctgccgcttgtgtggatgggtacttggtggttcttaggggaccatggatatgagtagcctttaggagcttgtgagcccgctaaaacttatacagaagtttcggggcaccattttccttgatcatttctgtttgtagtttttctatcagtcatttcagtcagcgtcataattcacgttatcttcctttaggtggtgttcccactgatgaagagcaggcgactgggttggagagggagatcatgctggctgcaaagaagggactggacccatacaatgtactggccccaaagggagcttcaggcaccagggaagaccctaatttagtcccctccatctccaacaagagaatagtaggctgcatctgtaagtacctcacctctattttttatccacttgcttaatatatcctacaatagtgtgtaagctgcctcaaatcttcagtgtgtgagtgcatgttggtaagtttgtctaagggtcttgacactctcaagcctcattatgcctgatagttcatccttactgggaagaagcgcagcacagcggtaagactggctcactgggagtgcggcatgaaggagtacccacccagcaaatatttattgttatactgcttctatgccaggcatcattttagacactagggatacataccagaacggaccctgctttgcgttctacata

SEQ ID NO: 448012 - DNA, 3872 bp, Homo sapiens
atctaagctgaaagtgtttggggagatcagacattgctgtctggtgctcctctctcagtggccatcatgtctttgacatctgcttaccagcataaattagcagagaagctcactatcctgaatgatcgcggtcagggggttctcatccgtatgtataacatcaagaagacttgttcagaccccaaatctaagccacctttcttactggaaaagtccatggaaccatctctcaagtatatcaacaagaaatttcccaacatagatgtccgaaacagcacgcaacatttaggaccagtacatcgtgaaaaagccgagataattagattcctcaccaactactaccagtcatttgtggatgtcatggaatttcgggatcatgtatatgaacttctcaacaccattgatgcctgccagtgccattttgatatcaatctcaactttgatttcactcggagttacctggacttgattgtaacttacacctcagtcattttacttctgtcacggattgaagatcggcggatactcattggcatgtacaattgtgcccatgagatgctgcatgggcatggtgaccccagttttgcccgtctgggtcagatggtcttggagtatgaccaccctctgaagaagctgacagaagagtttgggcctcacacaaaggctgtgagtggagccctcctctctttgcatttcctctttgtccgaagaaaccagggggctgagcagtggcgcagtgcccaacttctaagcctcatcagcaaccccccagccatgattaaccctgctaattcagatacaatggcctgtgagtatctgtctgtggaagtaatggagcgctggattatcattgggtttcttctttgtcatgggtgcctcaactccaatagccagtgccagaagctgtggaagctgtgtctgcagggctccctctacatcacccttatccgtgaggatgtgctgcaggtgcacaaagtcaccgaggacctgtttagcagtttgaaagggtatggcaagagagtggcagacataaaggagagcaaggaacatgtaattgcaaacagtggccagtttcattgtcaacggcggcaatttctgcggatggcagtgaaggagctggagactgtgttggctgatgaaccgggactactgggtcctaaggctctttttgctttcatggccctgtccttcattcgtgatgaggtcacctggctggttcgccacacagagaatgtcaccaagacaaagacacctgaggactatgctgactcgagcattgcagagctacttttcttgttggaggggattaggtctctggtccgaagacacatcaaagtgatacagcaataccaccttcagtacttggcaagatttgatgctcttgtgctcagtgacatcattcagaacttgtctgtgtgtccagaggaggagtccatcatcatgtcctcattcgtcagtatcctctcctctctgaatctcaaacaagttgataatggagaaaaatttgaattctcaggattgaggctggactggttccgcctacaggcatacactagcgtggctaaggcccctctgcacctgcatgagaaccctgacttagccaaggtgatgaacctcattgtcttccactcccgaatgctggactccgtagaaaaattgctggtggaaacttctgatctgtctactttctgctttcatcttcgtatctttgagaagatgtttgccatgaccttggaggaatctgccatgttgcgttatgccattgctttccccctgatttgtgctcactttgtccactgcactcatgagatgtgcccagaggagtacccccacctcaagaaccatggtcttcaccactgcaactccttcctggaagagttggccaagcagaccagcaattgcgtcctggagatctgtgctgagcagcgaaacctgagcgagcagcttctacctaagcactgtgccactacaatcagcaaagccaagaacaagaaaaccaggaagcagaggcagactcccagaaaaggagagcccgagagggacaagccaggagctgagagtcaccggaagaaccgcagcattgtcaccaacatggacaagctacacctaaacttgacagaactggcactgacaatgaatcatgtatacagtttctccgtgtttgaacatactatcttcccttctgagtacctcagcagccacctggaggccagactcaacagagccattgtgtggctggctggctacaatgccacgacccaggagatcgtacggccttctgagctgttggcaggagtcaaagcatacattggtttcatacagtcactggcccagtttttgggtgcagatgcttccagagtcatccgcaacgccctcctgcagcagacacaaccactggattcctgtggggaacagacaatcaccacactctacacaaactggtacctggaaagtctgcttagacaggcaagcagtgggaccatcatcctctccccagccatgcaggccttcgtcagcctgcccagagaaggggagcagaacttcagtgcagaggagttctctgacatctctgagatgcgggccttggcagaactcctgggcccctatggcatgaagttcctgagtgaaaacctgatgtggcatgtgacctctcagattgtggagctgaagaagctggtggtggaaaacatggacatacttgttcagatcagatccaactttagcaagccggacttgatggcttccctgctgccccagctgacaggggctgaaaatgtgctaaagcgcatgaccatcattggggttatcctcagtttcagggccatggcccaagagggacttcgggaggttttctcctcccactgcccatttcttatgggtcccattgagtgcttgaaggagtttgtcactccagacacagacatcaaggtgaccttgagtatctttgagctggcatctgctgcaggtgtgggctgtgacattgacccagccttggtggctgccattgctaatctgaaagctgatacttcatctcctgaggaggaatataaggtggcctgcctgctcttgatctttctggcagtttccctcccactccttgccactgacccttcttccttttatagcattgagaaggatggttacaacaacaatattcattgcttgaccaaagccatcatccaggtgtctgctgccctcttcacgctctacaacaagaacattgaaactcacctcaaggaatttctggtggtggcctctgtcagcctcttgcagctgggccaggagactgacaagcttaaaaccagaaatcgagaatccatttctctgctcatgcgcttggtggtggaggagtcatccttcctgaccctggacatgctggagtcctgtttcccttatgtcctgcttcgaaatgcctatcgggaggtgtctcgggccttccacctaaactgaatgcctgccagtacccactgaagagccctttggaccttcctaaacccttgccatagtggaagctgtggtcactttcgcagggggtgggaatggggtggggtcactaaggagagagggtcaggagccagagttgatgagcagatctgtggaagaacaatccagggctgagaaatcgtagagcagtgaggcaggctgggagcatggaggacagcttatggaaaaagttagggcgtggggccacatgtgtgaattttacaatgaaaaaaggagtaacgtacaagtatattttctatcttctggtgacttgagcttgagctctgacaggcatgggcctctccgaccttcatcactattcttaggataatgctggcgggcagagatgatcaatcatcatattaaatcataatgagcttataatcctc

SEQ ID NO: 448013 - DNA, 1555 bp, Homo sapiens
gcggccgcctactactactactactgctcgaattcaagcttctaacgatgtacggggaccctgtagtcccactactcaggaggctgaggcagcagaataacttgatcccgggaggcggaggttgcagtaagctaagatcctgccacagcattccaggctgagtgacagagcgagactctgtctcaaaaaataaataataatttaaaaaaagatacagaacagttccatcaccacaaggatccctcgcattgctcttttatagcaattttatagcaattttctcctcccacaacccccttccccatctctagctcctggtaacacagatatattctctatttctaaaattttgtcatttgatatatctttttgtaaacatataattatacacacatatttctctaccacttatactttttcaaagtgctttcacatccttatagcaattctgcaaggtagccagggaaggctttcctatttcaggtcagaaaacagatttagaaatattaaatgacttaatgaaggtcacatgtttagcagtagaactagaactgggacccaagtctgatgttcagtcctagaccttttctacttgcccggtctgcctcttcacaagggaagacttgggttttagaatccagagaccttagaaggagcaaattggagaaggtgaggacatgatggcctttactaccggaagcaaaaagtgaatgtccagaggtgaagggacagagaagtaacaggacccatcagcatttcaggcaatttgcttcctttaccaggagggtctctgtcctcttacaacctgggaaaaaataagttgtgtcccaggttgtaagtttgctttacttaggcccaaaggaactaaagaatggatatcagaaatctcaccccaattgttttgtcttacaggcacagaataggttctagcctcagcattttcattaatgtagtgtttttattaacatctccattaacttgcttgcagcaatgagatggaattatgcctcccacaaggcctggggcaagatacttgcataggtgcccccttttgtttggacagtagaaacactgcctcccctgccatggtgttcaatccagttggcaggtgggccagcttcaaagtgcagaaggaactgggtgtggtggctcacccctgtaatcccagcactttgggaggcaggcggatcgcttgaactcaggagtttgagaccactctgggcaacacagtgaaaccctgtctctccaaaaatacaaaaaattagctgggcatggtggctgttgtctgtaatcccaacactttgggaggctgaggccagtggatctcttgagctaaggaggttaagaccagcctggtcaacatggcgaactccgtctctacaaaaaaatacgaaaattagctgggcgtagtagttcctgcctgtagtcctagctacttggaaggctgaggtggggaggatcgcttgagtccgggaggcagaggttgcagtgagcgaagatgatgccattgcactccagtctgggtgacagagcaagatcctgtctcacaaaaaaa

SEQ ID NO: 448014 - DNA, 795 bp, Homo sapiens
acccgaggaagcaggcaacatatacggctaggtacgaggcctgggtggttgctgtggaagtaatggagcgctggattatcattgggtttcttctttgtcatgggtgcctcaactccaatagccagtgccagaagctgtggaagctgtgtctgcagggctccctctacatcacccttatccgtgaggatgtgctgcaggtgcacaaagtcaccgaggacctgtttagcagtttgaaagggtatggcaagagagtggcagacataaaggagagcaaggaacatgtaattgcaaacagtggccagtttcattgtcaacggcggcaatttctgcggatggcagtgaaggagctggagactgtgttggctgatgaaccgggactactgggtcctaaggctctttttgctttcatggccctgtccttcattcgtgatgaggtcacctggctggttcgccacacagagaatgtcaccaagacaaagacacctgaggactatgctgactcgagcattgcagagctacttttcttgttggaggggattaggtctctggtccgaagacacatcaaagtgatacagcaataccaccttcagtacttggcaagatttgatgctcttgtgctcagtgacatcattcagaacttgtctgtgtgtccagaggaggagtccatcatcatgtcctcattcgtcagtatcctctcctctctgaatctcaaacaagtgatcatgggaaaatttgaattctccggattggcgggggctggtccgcctacggctacctacggggtaggccctcggc

SEQ ID NO: 448015 - DNA, 441 bp, Homo sapiens
tcatatttctagtcttattcatctctgttctcatcctaaactttataggagcattgcagagctacttttcttgttggaggggattaggtctctggtccgaagacacatcaaagtgatacagcaataccaccttcagtacttggcaagatttgatgctcttgtgctcagtgacatcattcaggtatgatatttaattgattatactttggaaatttcaggatgatccctagtgattttcctattgaaaccgcgcctggccttttgtgttcttataaaatcttttcttgccaactacagtggtgtgttcctgttacccaacttgcttgggagactgaggcaggaggatcacttgaggccagaagttccaggctgtagtagactatgatcacacctgtgaatagacactgcattctagcctgggcaacatagcaagactctatc

SEQ ID NO: 448016 - DNA, 6715 bp, Homo sapiens
atctaagctgaaagtgtttggggagatcagacattgctgtctggtgctcctctctcagtggccatcatgtctttgacatctgcttaccagcataaattagcagagaagctcactatcctgaatgatcgcggtcagggggttctcatccgtatgtataacatcaagaagacttgttcagaccccaaatctaagccacctttcttactggaaaagtccatggaaccatctctcaagtatatcaacaagaaatttcccaacatagatgtccgaaacagcacgcaacatttaggaccagtacatcgtgaaaaagccgagataattagattcctcaccaactactaccagtcatttgtggatgtcatggaatttcgggatcatgtatatgaacttctcaacaccattgatgcctgccagtgccattttgatatcaatctcaactttgatttcactcggagttacctggacttgattgtaacttacacctcagtcattttacttctgtcacggattgaagatcggcggatactcattggcatgtacaattgtgcccatgagatgctgcatgggcatggtgaccccagttttgcccgtctgggtcagatggtcttggagtatgaccaccctctgaagaagctgacagaagagtttgggcctcacacaaaggctgtgagtggagccctcctctctttgcatttcctctttgtccgaagaaaccagggggctgagcagtggcgcagtgcccaacttctaagcctcatcagcaaccccccagccatgattaaccctgctaattcagatacaatggcctgtgagtatctgtctgtggaagtaatggagcgctggattatcattgggtttcttctttgtcatgggtgcctcaactccaatagccagtgccagaagctgtggaagctgtgtctgcagggctccctctacatcacccttatccgtgaggatgtgctgcaggtgcacaaagtcaccgaggacctgtttagcagtttgaaagggtatggcaagagagtggcagacataaaggagagcaaggaacatgtaattgcaaacagtggccagtttcattgtcaacggcggcaatttctgcggatggcagtgaaggagctggagactgtgttggctgatgaaccgggactactgggtcctaaggctctttttgctttcatggccctgtccttcattcgtgatgaggtcacctggctggttcgccacacagagaatgtcaccaagacaaagacacctgaggactatgctgactcgagcattgcagagctacttttcttgttggaggggattaggtctctggtccgaagacacatcaaagtgatacagcaataccaccttcagtacttggcaagatttgatgctcttgtgctcagtgacatcattcagaacttgtctgtgtgtccagaggaggagtccatcatcatgtcctcattcgtcagtatcctctcctctctgaatctcaaacaagttgataatggagaaaaatttgaattctcaggattgaggctggactggttccgcctacaggcatacactagcgtggctaaggcccctctgcacctgcatgagaaccctgacttagccaaggtgatgaacctcattgtcttccactcccgaatgctggactccgtagaaaaattgctggtggaaacttctgatctgtctactttctgctttcatcttcgtatctttgagaagatgtttgccatgaccttggaggaatctgccatgttgcgttatgccattgctttccccctgatttgtgctcactttgtccactgcactcatgagatgtgcccagaggagtacccccacctcaagaaccatggtcttcaccactgcaactccttcctggaagagttggccaagcagaccagcaattgcgtcctggagatctgtgctgagcagcgaaacctgagcgagcagcttctacctaagcactgtgccactacaatcagcaaagccaagaacaagaaaaccaggaagcagaggcagactcccagaaaaggagagcccgagagggacaagccaggagctgagagtcaccggaagaaccgcagcattgtcaccaacatggacaagctacacctaaacttgacagaactggcactgacaatgaatcatgtatacagtttctccgtgtttgaacatactatcttcccttctgagtacctcagcagccacctggaggccagactcaacagagccattgtgtggctggctggctacaatgccacgacccaggagatcgtacggccttctgagctgttggcaggagtcaaagcatacattggtttcatacagtcactggcccagtttttgggtgcagatgcttccagagtcatccgcaacgccctcctgcagcagacacaaccactggattcctgtggggaacagacaatcaccacactctacacaaactggtacctggaaagtctgcttagacaggcaagcagtgggaccatcatcctctccccagccatgcaggccttcgtcagcctgcccagagaaggggagcagaacttcagtgcagaggagttctctgacatctctgagatgcgggccttggcagaactcctgggcccctatggcatgaagttcctgagtgaaaacctgatgtggcatgtgacctctcagattgtggagctgaagaagctggtggtggaaaacatggacatacttgttcagatcagatccaactttagcaagccggacttgatggcttccctgctgccccagctgacaggggctgaaaatgtgctaaagcgcatgaccatcattggggttatcctcagtttcagggccatggcccaagagggacttcgggaggttttctcctcccactgcccatttcttatgggtcccattgagtgcttgaaggagtttgtcactccagacacagacatcaaggtgaccttgagtatctttgagctggcatctgctgcaggtgtgggctgtgacattgacccagccttggtggctgccattgctaatctgaaagctgatacttcatctcctgaggaggaatataaggtggcctgcctgctcttgatctttctggcagtttccctcccactccttgccactgacccttcttccttttatagcattgagaaggatggttacaacaacaatattcattgcttgaccaaagccatcatccaggtgtctgctgccctcttcacgctctacaacaagaacattgaaactcacctcaaggaatttctggtggtggcctctgtcagcctcttgcagctgggccaggagactgacaagcttaaaaccagaaatcgagaatccatttctctgctcatgcgcttggtggtggaggagtcatccttcctgaccctggacatgctggagtcctgtttcccttatgtcctgcttcgaaatgcctatcgggaggtgtctcgggccttccacctaaactgaatgcctgccagtacccactgaagagccctttggaccttcctaaacccttgccatagtggaagctgtggtcactttcgcagggggtgggaatggggtggggtcactaaggagagagggtcaggagccagagttgatgagcagatctgtggaagaacaatccagggctgagaaatcgtagagcagtgaggcaggctgggagcatggaggacagcttatggaaaaagttagggcgtggggccacatgtgtgaattttacaatgaaaaaaggagtaacgtacaagtatattttctatcttctggtgacttgagcttgagctctgacaggcatgggcctctccgaccttcatcactattcttaggataatgctggcgggcagagatgatcaatcatcatattaaatcataatgagcttataatcctcacactggagctgctattgtctcctgcacattcattaggaccattatcttctctcttcctttttcaaatgtgttcagcaaacattcaacctgctcctactgcagagtagcagcaaaggagcccctcttttcctttgtggggctcttcgaggggtcattgggtctcttcctttgcccccagcttgactgcgtttcctactggggcaaggaggaagtgcccttcagagatgttcactgcccacctactctactacattgtttgttacaagttctctcttgctttaacccctcctgctttgatatctccacaacccagagcagagggtcagttagtctccgtcaattctaggttacatgacaactgattggcccagacttaggtgggttttccctcctgtaccatttgggggtactctgccttttattgggagggactaatttaaccccaaatccttttgtcagcctatttgatagctgttttggggttttgtacaggtgtttgctttttatttcttgagacccaggcttagtcaatactttcttaacttggcacccataatcaacatacagatttttcttagcaacagttgtctgctctttagggtggaagcgatagagaatcctgcttcgtgcatcagcaaatcctccttccttgctatgggaagggcttatgttctaaagggtgattcagtgtcaggcttatgagactgagagtaaagttgatgaggaagaggaggctcagaagtatctgaacaactactctatatgtttatatttttctgcttgaggggatagagatccctcctccatctgcatctgcatatagaactgcttaagaggacagcaagacaagttgctgcagggggatggagggtagacagaatgcctttttttaaaactgaaaattttattgagatacttaatccacctgcacttgtaagaaatcatacagagaaattctattttcctttacacagtttccctgaatgctaacatctagcaaaactgtagtacactgccacaaccaggataactgacattgatataatctactgatcttgttcagatttccttccccagttttgcttatgttcatttctctctgtgtgtgcacgtgtgtgtgttatctatttctatacagctttatcatgtgtaggtttgtgtatctgccactgcagtcaacatacagaacaggccgggcgcagtggctcacgcctgtaatcccagcactttgggaggccaaggcaggtggatcacctgaggtcaggggtttgagagcagcctggccaatatagtgaaacaccgtctctactaaaaataccaaaactagccgggcgtggtggtgcatgcctgtagtcccactactcaggaggctgaggcagcagaataacttgatcccgggaggcggaggttgcagtaagctaagatcctgccacagcattccaggctgagtgacagagcgagactctgtctcaaaaaataaataataatttaaaaaaagatacagaacagttccatcaccacaaggatccctcgcattgctcttttatagcaattttatagcaattttctcctcccacaacccccttccccatctctagctcctggtaacacagatatattctctatttctaaaattttgtcatttgatatatctttttgtaaacatataattatacacacatatttctctaccacttatactttttcaaagtgctttcacatccttatagcaattctgcaaggtagccagggaaggctttcctatttcaggtcagaaaacagatttagaaatattaaatgacttaatgaaggtcacatgtttagcagtagaactagaactgggacccaagtctgatgttcagtcctagaccttttctacttgcccggtctgcctcttcacaagggaagacttgggttttagaatccagagaccttagaaggagcaaattggagaaggtgaggacatgatggcctttactaccggaagcaaaaagtgaatgtccagaggtgaagggacagagaagtaacaggacccatcagcatttcaggcaatttgcttcctttaccaggagggtctctgtcctcttacaacctgggaaaaaataagttgtgtcccaggttgtaagtttgctttacttaggcccaaaggaactaaagaatggatatcagaaatctcaccccaattgttttgtcttacaggcacagaataggttctagcctcagcattttcattaatgtagtgtttttattaacatctccattaacttgcttgcagcaatgagatggaattatgcctcccacaaggcctggggcaagatacttgcataggtgcccccttttgtttggacagtagaaacactgcctcccctgccatggtgttcaatccagttggcaggtgggccagcttcaaagtgcagaaggaactgggtgtggtggctcacccctgtaatcccagcactttgggaggcaggcggatcgcttgaactcaggagtttgagaccactctgggcaacacagtgaaaccctgtctctccaaaaatacaaaaaattagctgggcatggtggctgttgtctgtaatcccaacactttgggaggctgaggccagtggatctcttgagctaaggaggttaagaccagcctggtcaacatggcgaactccgtctctacaaaaaaatacgaaaattagctgggcgtagtagttcctgcctgtagtcctagctacttggaaggctgaggtggggaggatcgcttgagtccgggaggcagaggttgcagtgagcgaagatgatgccattgcactccagtctgggtgacagagcaagatcctgtctcacaaaaaaa

SEQ ID NO: 448017 - DNA, 6096 bp, Homo sapiens
atctaagctgaaagtgtttggggagatcagacattgctgtctggtgctcctctctcagtggccatcatgtctttgacatctgcttaccagcataaattagcagagaagctcactatcctgaatgatcgcggtcagggggttctcatccgtatgtataacatcaagaagacttgttcagaccccaaatctaagccacctttcttactggaaaagtccatggaaccatctctcaagtatatcaacaagaaatttcccaacatagatgtccgaaacagcacgcaacatttaggaccagtacatcgtgaaaaagccgagataattagattcctcaccaactactaccagtcatttgtggatgtcatggaatttcgggatcatgtatatgaacttctcaacaccattgatgcctgccagtgccattttgatatcaatctcaactttgatttcactcggagttacctggacttgattgtaacttacacctcagtcattttacttctgtcacggattgaagatcggcggatactcattggcatgtacaattgtgcccatgagatgctgcatgggcatggtgaccccagttttgcccgtctgggtcagatggtcttggagtatgaccaccctctgaagaagctgacagaagagtttgggcctcacacaaaggctgtgagtggagccctcctctctttgcatttcctctttgtccgaagaaaccagggggctgagcagtggcgcagtgcccaacttctaagcctcatcagcaaccccccagccatgattaaccctgctaattcagatacaatggcctgtgagtatctgtctgtggaagtaatggagcgctggattatcattgggtttcttctttgtcatgggtgcctcaactccaatagccagtgccagaagctgtggaagctgtgtctgcagggctccctctacatcacccttatccgtgaggatgtgctgcaggtgcacaaagtcaccgaggacctgtttagcagtttgaaagggtatggcaagagagtggcagacataaaggagagcaaggaacatgtaattgcaaacagtggccagtttcattgtcaacggcggcaatttctgcggatggcagtgaaggagctggagactgtgttggctgatgaaccgggactactgggtcctaaggctctttttgctttcatggccctgtccttcattcgtgatgaggtcacctggctggttcgccacacagagaatgtcaccaagacaaagacacctgaggactatgctgactcgagcattgcagagctacttttcttgttggaggggattaggtctctggtccgaagacacatcaaagtgatacagcaataccaccttcagtacttggcaagatttgatgctcttgtgctcagtgacatcattcagaacttgtctgtgtgtccagaggaggagtccatcatcatgtcctcattcgtcagtatcctctcctctctgaatctcaaacaagttgataatggagaaaaatttgaattctcaggattgaggctggactggttccgcctacaggcatacactagcgtggctaaggcccctctgcacctgcatgagaaccctgacttagccaaggtgatgaacctcattgtcttccactcccgaatgctggactccgtagaaaaattgctggtggaaacttctgatctgtctactttctgctttcatcttcgtatctttgagaagatgtttgccatgaccttggaggaatctgccatgttgcgttatgccattgctttccccctgatttgtgctcactttgtccactgcactcatgagatgtgcccagaggagtacccccacctcaagaaccatggtcttcaccactgcaactccttcctggaagagttggccaagcagaccagcaattgcgtcctggagatctgtgctgagcagcgaaacctgagcgagcagcttctacctaagcactgtgccactacaatcagcaaagccaagaacaagaaaaccaggaagcagaggcagactcccagaaaaggagagcccgagagggacaagccaggagctgagagtcaccggaagaaccgcagcattgtcaccaacatggacaagctacacctaaacttgacagaactggcactgacaatgaatcatgtatacagtttctccgtgtttgaacatactatcttcccttctgagtacctcagcagccacctggaggccagactcaacagagccattgtgtggctggctggctacaatgccacgacccaggagatcgtacggccttctgagctgttggcaggagtcaaagcatacattggtttcatacagtcactggcccagtttttgggtgcagatgcttccagagtcatccgcaacgccctcctgcagcagacacaaccactggattcctgtggggaacagacaatcaccacactctacacaaactggtacctggaaagtctgcttagacaggcaagcagtgggaccatcatcctctccccagccatgcaggccttcgtcagcctgcccagagaaggggagcagaacttcagtgcagaggagttctctgacatctctgagatgcgggccttggcagaactcctgggcccctatggcatgaagttcctgagtgaaaacctgatgtggcatgtgacctctcagattgtggagctgaagaagctggtggtggaaaacatggacatacttgttcagatcagatccaactttagcaagccggacttgatggcttccctgctgccccagctgacaggggctgaaaatgtgctaaagcgcatgaccatcattggggttatcctcagtttcagggccatggcccaagagggacttcgggaggttttctcctcccactgcccatttcttatgggtcccattgagtgcttgaaggagtttgtcactccagacacagacatcaaggtgaccttgagtatctttgagctggcatctgctgcaggtgtgggctgtgacattgacccagccttggtggctgccattgctaatctgaaagctggctgggagcatggaggacagcttatggaaaaagttagggcgtggggccacatgtgtgaattttacaatgaaaaaaggagtaacgtacaagtatattttctatcttctggtgacttgagcttgagctctgacaggcatgggcctctccgaccttcatcactattcttaggataatgctggcgggcagagatgatcaatcatcatattaaatcataatgagcttataatcctcacactggagctgctattgtctcctgcacattcattaggaccattatcttctctcttcctttttcaaatgtgttcagcaaacattcaacctgctcctactgcagagtagcagcaaaggagcccctcttttcctttgtggggctcttcgaggggtcattgggtctcttcctttgcccccagcttgactgcgtttcctactggggcaaggaggaagtgcccttcagagatgttcactgcccacctactctactacattgtttgttacaagttctctcttgctttaacccctcctgctttgatatctccacaacccagagcagagggtcagttagtctccgtcaattctaggttacatgacaactgattggcccagacttaggtgggttttccctcctgtaccatttgggggtactctgccttttattgggagggactaatttaaccccaaatccttttgtcagcctatttgatagctgttttggggttttgtacaggtgtttgctttttatttcttgagacccaggcttagtcaatactttcttaacttggcacccataatcaacatacagatttttcttagcaacagttgtctgctctttagggtggaagcgatagagaatcctgcttcgtgcatcagcaaatcctccttccttgctatgggaagggcttatgttctaaagggtgattcagtgtcaggcttatgagactgagagtaaagttgatgaggaagaggaggctcagaagtatctgaacaactactctatatgtttatatttttctgcttgaggggatagagatccctcctccatctgcatctgcatatagaactgcttaagaggacagcaagacaagttgctgcagggggatggagggtagacagaatgcctttttttaaaactgaaaattttattgagatacttaatccacctgcacttgtaagaaatcatacagagaaattctattttcctttacacagtttccctgaatgctaacatctagcaaaactgtagtacactgccacaaccaggataactgacattgatataatctactgatcttgttcagatttccttccccagttttgcttatgttcatttctctctgtgtgtgcacgtgtgtgtgttatctatttctatacagctttatcatgtgtaggtttgtgtatctgccactgcagtcaacatacagaacaggccgggcgcagtggctcacgcctgtaatcccagcactttgggaggccaaggcaggtggatcacctgaggtcaggggtttgagagcagcctggccaatatagtgaaacaccgtctctactaaaaataccaaaactagccgggcgtggtggtgcatgcctgtagtcccactactcaggaggctgaggcagcagaataacttgatcccgggaggcggaggttgcagtaagctaagatcctgccacagcattccaggctgagtgacagagcgagactctgtctcaaaaaataaataataatttaaaaaaagatacagaacagttccatcaccacaaggatccctcgcattgctcttttatagcaattttatagcaattttctcctcccacaacccccttccccatctctagctcctggtaacacagatatattctctatttctaaaattttgtcatttgatatatctttttgtaaacatataattatacacacatatttctctaccacttatactttttcaaagtgctttcacatccttatagcaattctgcaaggtagccagggaaggctttcctatttcaggtcagaaaacagatttagaaatattaaatgacttaatgaaggtcacatgtttagcagtagaactagaactgggacccaagtctgatgttcagtcctagaccttttctacttgcccggtctgcctcttcacaagggaagacttgggttttagaatccagagaccttagaaggagcaaattggagaaggtgaggacatgatggcctttactaccggaagcaaaaagtgaatgtccagaggtgaagggacagagaagtaacaggacccatcagcatttcaggcaatttgcttcctttaccaggagggtctctgtcctcttacaacctgggaaaaaataagttgtgtcccaggttgtaagtttgctttacttaggcccaaaggaactaaagaatggatatcagaaatctcaccccaattgttttgtcttacaggcacagaataggttctagcctcagcattttcattaatgtagtgtttttattaacatctccattaacttgcttgcagcaatgagatggaattatgcctcccacaaggcctggggcaagatacttgcataggtgcccccttttgtttggacagtagaaacactgcctcccctgccatggtgttcaatccagttggcaggtgggccagcttcaaagtgcagaaggaactgggtgtggtggctcacccctgtaatcccagcactttgggaggcaggcggatcgcttgaactcaggagtttgagaccactctgggcaacacagtgaaaccctgtctctccaaaaatacaaaaaattagctgggcatggtggctgttgtctgtaatcccaacactttgggaggctgaggccagtggatctcttgagctaaggaggttaagaccagcctggtcaacatggcgaactccgtctctacaaaaaaatacgaaaattagctgggcgtagtagttcctgcctgtagtcctagctacttggaaggctgaggtggggaggatcgcttgagtccgggaggcagaggttgcagtgagcgaagatgatgccattgcactccagtctgggtgacagagcaagatcctgtctcacaaaaaaa

SEQ ID NO: 448018 - DNA, 5059 bp, Homo sapiens
atctaagctgaaagtgtttggggagatcagacattgctgtctggtgctcctctctcagtggccatcatgtctttgacatctgcttaccagcataaattagcagagaagctcactatcctgatttgtgctcactttgtccactgcactcatgagatgtgcccagaggagtacccccacctcaagaaccatggtcttcaccactgcaactccttcctggaagagttggccaagcagaccagcaattgcgtcctggagatctgtgctgagcagcgaaacctgagcgagcagcttctacctaagcactgtgccactacaatcagcaaagccaagaacaagaaaaccaggaagcagaggcagactcccagaaaaggagagcccgagagggacaagccaggagctgagagtcaccggaagaaccgcagcattgtcaccaacatggacaagctacacctaaacttgacagaactggcactgacaatgaatcatgtatacagtttctccgtgtttgaacatactatcttcccttctgagtacctcagcagccacctggaggccagactcaacagagccattgtgtggctggctggctacaatgccacgacccaggagatcgtacggccttctgagctgttggcaggagtcaaagcatacattggtttcatacagtcactggcccagtttttgggtgcagatgcttccagagtcatccgcaacgccctcctgcagcagacacaaccactggattcctgtggggaacagacaatcaccacactctacacaaactggtacctggaaagtctgcttagacaggcaagcagtgggaccatcatcctctccccagccatgcaggccttcgtcagcctgcccagagaaggggagcagaacttcagtgcagaggagttctctgacatctctgagatgcgggccttggcagaactcctgggcccctatggcatgaagttcctgagtgaaaacctgatgtggcatgtgacctctcagattgtggagctgaagaagctggtggtggaaaacatggacatacttgttcagatcagatccaactttagcaagccggacttgatggcttccctgctgccccagctgacaggggctgaaaatgtgctaaagcgcatgaccatcattggggttatcctcagtttcagggccatggcccaagagggacttcgggaggttttctcctcccactgcccatttcttatgggtcccattgagtgcttgaaggagtttgtcactccagacacagacatcaaggtgaccttgagtatctttgagctggcatctgctgcaggtgtgggctgtgacattgacccagccttggtggctgccattgctaatctgaaagctgatacttcatctcctgaggaggaatataaggtggcctgcctgctcttgatctttctggcagtttccctcccactccttgccactgacccttcttccttttatagcattgagaaggatggttacaacaacaatattcattgcttgaccaaagccatcatccaggtgtctgctgccctcttcacgctctacaacaagaacattgaaactcacctcaaggaatttctggtggtggcctctgtcagcctcttgcagctgggccaggagactgacaagcttaaaaccagaaatcgagaatccatttctctgctcatgcgcttggtggtggaggagtcatccttcctgaccctggacatgctggagtcctgtttcccttatgtcctgcttcgaaatgcctatcgggaggtgtctcgggccttccacctaaactgaatgcctgccagtacccactgaagagccctttggaccttcctaaacccttgccatagtggaagctgtggtcactttcgcagggggtgggaatggggtggggtcactaaggagagagggtcaggagccagagttgatgagcagatctgtggaagaacaatccagggctgagaaatcgtagagcagtgaggcaggctgggagcatggaggacagcttatggaaaaagttagggcgtggggccacatgtgtgaattttacaatgaaaaaaggagtaacgtacaagtatattttctatcttctggtgacttgagcttgagctctgacaggcatgggcctctccgaccttcatcactattcttaggataatgctggcgggcagagatgatcaatcatcatattaaatcataatgagcttataatcctcacactggagctgctattgtctcctgcacattcattaggaccattatcttctctcttcctttttcaaatgtgttcagcaaacattcaacctgctcctactgcagagtagcagcaaaggagcccctcttttcctttgtggggctcttcgaggggtcattgggtctcttcctttgcccccagcttgactgcgtttcctactggggcaaggaggaagtgcccttcagagatgttcactgcccacctactctactacattgtttgttacaagttctctcttgctttaacccctcctgctttgatatctccacaacccagagcagagggtcagttagtctccgtcaattctaggttacatgacaactgattggcccagacttaggtgggttttccctcctgtaccatttgggggtactctgccttttattgggagggactaatttaaccccaaatccttttgtcagcctatttgatagctgttttggggttttgtacaggtgtttgctttttatttcttgagacccaggcttagtcaatactttcttaacttggcacccataatcaacatacagatttttcttagcaacagttgtctgctctttagggtggaagcgatagagaatcctgcttcgtgcatcagcaaatcctccttccttgctatgggaagggcttatgttctaaagggtgattcagtgtcaggcttatgagactgagagtaaagttgatgaggaagaggaggctcagaagtatctgaacaactactctatatgtttatatttttctgcttgaggggatagagatccctcctccatctgcatctgcatatagaactgcttaagaggacagcaagacaagttgctgcagggggatggagggtagacagaatgcctttttttaaaactgaaaattttattgagatacttaatccacctgcacttgtaagaaatcatacagagaaattctattttcctttacacagtttccctgaatgctaacatctagcaaaactgtagtacactgccacaaccaggataactgacattgatataatctactgatcttgttcagatttccttccccagttttgcttatgttcatttctctctgtgtgtgcacgtgtgtgtgttatctatttctatacagctttatcatgtgtaggtttgtgtatctgccactgcagtcaacatacagaacaggccgggcgcagtggctcacgcctgtaatcccagcactttgggaggccaaggcaggtggatcacctgaggtcaggggtttgagagcagcctggccaatatagtgaaacaccgtctctactaaaaataccaaaactagccgggcgtggtggtgcatgcctgtagtcccactactcaggaggctgaggcagcagaataacttgatcccgggaggcggaggttgcagtaagctaagatcctgccacagcattccaggctgagtgacagagcgagactctgtctcaaaaaataaataataatttaaaaaaagatacagaacagttccatcaccacaaggatccctcgcattgctcttttatagcaattttatagcaattttctcctcccacaacccccttccccatctctagctcctggtaacacagatatattctctatttctaaaattttgtcatttgatatatctttttgtaaacatataattatacacacatatttctctaccacttatactttttcaaagtgctttcacatccttatagcaattctgcaaggtagccagggaaggctttcctatttcaggtcagaaaacagatttagaaatattaaatgacttaatgaaggtcacatgtttagcagtagaactagaactgggacccaagtctgatgttcagtcctagaccttttctacttgcccggtctgcctcttcacaagggaagacttgggttttagaatccagagaccttagaaggagcaaattggagaaggtgaggacatgatggcctttactaccggaagcaaaaagtgaatgtccagaggtgaagggacagagaagtaacaggacccatcagcatttcaggcaatttgcttcctttaccaggagggtctctgtcctcttacaacctgggaaaaaataagttgtgtcccaggttgtaagtttgctttacttaggcccaaaggaactaaagaatggatatcagaaatctcaccccaattgttttgtcttacaggcacagaataggttctagcctcagcattttcattaatgtagtgtttttattaacatctccattaacttgcttgcagcaatgagatggaattatgcctcccacaaggcctggggcaagatacttgcataggtgcccccttttgtttggacagtagaaacactgcctcccctgccatggtgttcaatccagttggcaggtgggccagcttcaaagtgcagaaggaactgggtgtggtggctcacccctgtaatcccagcactttgggaggcaggcggatcgcttgaactcaggagtttgagaccactctgggcaacacagtgaaaccctgtctctccaaaaatacaaaaaattagctgggcatggtggctgttgtctgtaatcccaacactttgggaggctgaggccagtggatctcttgagctaaggaggttaagaccagcctggtcaacatggcgaactccgtctctacaaaaaaatacgaaaattagctgggcgtagtagttcctgcctgtagtcctagctacttggaaggctgaggtggggaggatcgcttgagtccgggaggcagaggttgcagtgagcgaagatgatgccattgcactccagtctgggtgacagagcaagatcctgtctcacaaaaaaa

SEQ ID NO: 448019 - DNA, 4304 bp, Homo sapiens
gcaaatgccagttggggccaggcaggaaaggtacctggaaagtctgcttagacaggcaagcagtgggaccatcatcctctccccagccatgcaggccttcgtcagcctgcccagagaaggggagcagaacttcagtgcagaggagttctctgacatctctgagatgcgggccttggcagaactcctgggcccctatggcatgaagttcctgagtgaaaacctgatgtggcatgtgacctctcagattgtggagctgaagaagctggtggtggaaaacatggacatacttgttcagatcagatccaactttagcaagccggacttgatggcttccctgctgccccagctgacaggggctgaaaatgtgctaaagcgcatgaccatcattggggttatcctcagtttcagggccatggcccaagagggacttcgggaggttttctcctcccactgcccatttcttatgggtcccattgagtgcttgaaggagtttgtcactccagacacagacatcaaggtgaccttgagtatctttgagctggcatctgctgcaggtgtgggctgtgacattgacccagccttggtggctgccattgctaatctgaaagctgatacttcatctcctgaggaggaatataaggtggcctgcctgctcttgatctttctggcagtttccctcccactccttgccactgacccttcttccttttatagcattgagaaggatggttacaacaacaatattcattgcttgaccaaagccatcatccaggtgtctgctgccctcttcacgctctacaacaagaacattgaaactcacctcaaggaatttctggtggtggcctctgtcagcctcttgcagctgggccaggagactgacaagcttaaaaccagaaatcgagaatccatttctctgctcatgcgcttggtggtggaggagtcatccttcctgaccctggacatgctggagtcctgtttcccttatgtcctgcttcgaaatgcctatcgggaggtgtctcgggccttccacctaaactgaatgcctgccagtacccactgaagagccctttggaccttcctaaacccttgccatagtggaagctgtggtcactttcgcagggggtgggaatggggtggggtcactaaggagagagggtcaggagccagagttgatgagcagatctgtggaagaacaatccagggctgagaaatcgtagagcagtgaggcaggctgggagcatggaggacagcttatggaaaaagttagggcgtggggccacatgtgtgaattttacaatgaaaaaaggagtaacgtacaagtatattttctatcttctggtgacttgagcttgagctctgacaggcatgggcctctccgaccttcatcactattcttaggataatgctggcgggcagagatgatcaatcatcatattaaatcataatgagcttataatcctcacactggagctgctattgtctcctgcacattcattaggaccattatcttctctcttcctttttcaaatgtgttcagcaaacattcaacctgctcctactgcagagtagcagcaaaggagcccctcttttcctttgtggggctcttcgaggggtcattgggtctcttcctttgcccccagcttgactgcgtttcctactggggcaaggaggaagtgcccttcagagatgttcactgcccacctactctactacattgtttgttacaagttctctcttgctttaacccctcctgctttgatatctccacaacccagagcagagggtcagttagtctccgtcaattctaggttacatgacaactgattggcccagacttaggtgggttttccctcctgtaccatttgggggtactctgccttttattgggagggactaatttaaccccaaatccttttgtcagcctatttgatagctgttttggggttttgtacaggtgtttgctttttatttcttgagacccaggcttagtcaatactttcttaacttggcacccataatcaacatacagatttttcttagcaacagttgtctgctctttagggtggaagcgatagagaatcctgcttcgtgcatcagcaaatcctccttccttgctatgggaagggcttatgttctaaagggtgattcagtgtcaggcttatgagactgagagtaaagttgatgaggaagaggaggctcagaagtatctgaacaactactctatatgtttatatttttctgcttgaggggatagagatccctcctccatctgcatctgcatatagaactgcttaagaggacagcaagacaagttgctgcagggggatggagggtagacagaatgcctttttttaaaactgaaaattttattgagatacttaatccacctgcacttgtaagaaatcatacagagaaattctattttcctttacacagtttccctgaatgctaacatctagcaaaactgtagtacactgccacaaccaggataactgacattgatataatctactgatcttgttcagatttccttccccagttttgcttatgttcatttctctctgtgtgtgcacgtgtgtgtgttatctatttctatacagctttatcatgtgtaggtttgtgtatctgccactgcagtcaacatacagaacaggccgggcgcagtggctcacgcctgtaatcccagcactttgggaggccaaggcaggtggatcacctgaggtcaggggtttgagagcagcctggccaatatagtgaaacaccgtctctactaaaaataccaaaactagccgggcgtggtggtgcatgcctgtagtcccactactcaggaggctgaggcagcagaataacttgatcccgggaggcggaggttgcagtaagctaagatcctgccacagcattccaggctgagtgacagagcgagactctgtctcaaaaaataaataataatttaaaaaaagatacagaacagttccatcaccacaaggatccctcgcattgctcttttatagcaattttatagcaattttctcctcccacaacccccttccccatctctagctcctggtaacacagatatattctctatttctaaaattttgtcatttgatatatctttttgtaaacatataattatacacacatatttctctaccacttatactttttcaaagtgctttcacatccttatagcaattctgcaaggtagccagggaaggctttcctatttcaggtcagaaaacagatttagaaatattaaatgacttaatgaaggtcacatgtttagcagtagaactagaactgggacccaagtctgatgttcagtcctagaccttttctacttgcccggtctgcctcttcacaagggaagacttgggttttagaatccagagaccttagaaggagcaaattggagaaggtgaggacatgatggcctttactaccggaagcaaaaagtgaatgtccagaggtgaagggacagagaagtaacaggacccatcagcatttcaggcaatttgcttcctttaccaggagggtctctgtcctcttacaacctgggaaaaaataagttgtgtcccaggttgtaagtttgctttacttaggcccaaaggaactaaagaatggatatcagaaatctcaccccaattgttttgtcttacaggcacagaataggttctagcctcagcattttcattaatgtagtgtttttattaacatctccattaacttgcttgcagcaatgagatggaattatgcctcccacaaggcctggggcaagatacttgcataggtgcccccttttgtttggacagtagaaacactgcctcccctgccatggtgttcaatccagttggcaggtgggccagcttcaaagtgcagaaggaactgggtgtggtggctcacccctgtaatcccagcactttgggaggcaggcggatcgcttgaactcaggagtttgagaccactctgggcaacacagtgaaaccctgtctctccaaaaatacaaaaaattagctgggcatggtggctgttgtctgtaatcccaacactttgggaggctgaggccagtggatctcttgagctaaggaggttaagaccagcctggtcaacatggcgaactccgtctctacaaaaaaatacgaaaattagctgggcgtagtagttcctgcctgtagtcctagctacttggaaggctgaggtggggaggatcgcttgagtccgggaggcagaggttgcagtgagcgaagatgatgccattgcactccagtctgggtgacagagcaagatcctgtctcacaaaaaaa

SEQ ID NO: 448020 - DNA, 3744 bp, Homo sapiens
atctaagctgaaagtgtttggggagatcagacattgctgtctggtgctcctctctcagtggccatcatgtctttgacatctgcttaccagcataaattagcagagaagctcactatcctgaatgatcgcggtcagggggttctcatccgtatgtataacatcaagaagacttgttcagaccccaaatctaagccacctttcttactggaaaagtccatggaaccatctctcaagtatatcaacaagaaatttcccaacatagatgtccgaaacagcacgcaacatttaggaccagtacatcgtgaaaaagccgagataattagattcctcaccaactactaccagtcatttgtggatgtcatggaatttcgggatcatgtatatgaacttctcaacaccattgatgcctgccagtgccattttgatatcaatctcaactttgatttcactcggagttacctggacttgattgtaacttacacctcagtcattttacttctgtcacggattgaagatcggcggatactcattggcatgtacaattgtgcccatgagatgctgcatgggcatggtgaccccagttttgcccgtctgggtcagatggtcttggagtatgaccaccctctgaagaagctgacagaagagtttgggcctcacacaaaggctgtgagtggagccctcctctctttgcatttcctctttgtccgaagaaaccagggggctgagcagtggcgcagtgcccaacttctaagcctcatcagcaaccccccagccatgattaaccctgctaattcagatacaatggcctgtgagtatctgtctgtggaagtaatggagcgctggattatcattgggtttcttctttgtcatgggtgcctcaactccaatagccagtgccagaagctgtggaagctgtgtctgcagggctccctctacatcacccttatccgtgaggatgtgctgcaggtgcacaaagtcaccgaggacctgtttagcagtttgaaagggtatggcaagagagtggcagacataaaggagagcaaggaacatgtaattgcaaacagtggccagtttcattgtcaacggcggcaatttctgcggatggcagtgaaggagctggagactgtgttggctgatgaaccgggactactgggtcctaaggctctttttgctttcatggccctgtccttcattcgtgatgaggtcacctggctggttcgccacacagagaatgtcaccaagacaaagacacctgaggactatgctgactcgagcattgcagagctacttttcttgttggaggggattaggtctctggtccgaagacacatcaaagtgatacagcaataccaccttcagtacttggcaagatttgatgctcttgtgctcagtgacatcattcagaacttgtctgtgtgtccagaggaggagtccatcatcatgtcctcattcgtcagtatcctctcctctctgaatctcaaacaagttgataatggagaaaaatttgaattctcaggattgaggctggactggttccgcctacaggcatacactagcgtggctaaggcccctctgcacctgcatgagaaccctgacttagccaaggtgatgaacctcattgtcttccactcccgaatgctggactccgtagaaaaattgctggtggaaacttctgatctgtctactttctgctttcatcttcgtatctttgagaagatgtttgccatgaccttggaggaatctgccatgttgcgttatgccattgctttccccctgatttgtgctcactttgtccactgcactcatgagatgtgcccagaggagtacccccacctcaagaaccatggtcttcaccactgcaactccttcctggaagagttggccaagcagaccagcaattgcgtcctggagatctgtgctgagcagcgaaacctgagcgagcagcttctacctaagcactgtgccactacaatcagcaaagccaagaacaagaaaaccaggaagcagaggcagactcccagaaaaggagagcccgagagggacaagccaggagctgagagtcaccggaagaaccgcagcattgtcaccaacatggacaagctacacctaaacttgacagaactggcactgacaatgaatcatgtatacagtttctccgtgtttgaacatactatcttcccttctgagtacctcagcagccacctggaggccagactcaacagagccattgtgtggctggctggctacaatgccacgacccaggagatcgtacggccttctgagctgttggcaggagtcaaagcatacattggtttcatacagtcactggcccagtttttgggtgcagatgcttccagagtcatccgcaacgccctcctgcagcagacacaaccactggattcctgtggggaacagacaatcaccacactctacacaaactggtacctggaaagtctgcttagacaggcaagcagtgggaccatcatcctctccccagccatgcaggccttcgtcagcctgcccagagaaggggagcagaacttcagtgcagaggagttctctgacatctctgagatgcgggccttggcagaactcctgggcccctatggcatgaagttcctgagtgaaaacctgatgtggcatgtgacctctcagattgtggagctgaagaagctggtggtggaaaacatggacatacttgttcagatcagatccaactttagcaagccggacttgatggcttccctgctgccccagctgacaggggctgaaaatgtgctaaagcgcatgaccatcattggggttatcctcagtttcagggccatggcccaagagggacttcgggaggttttctcctcccactgcccatttcttatgggtcccattgagtgcttgaaggagtttgtcactccagacacagacatcaaggtgaccttgagtatctttgagctggcatctgctgcaggtgtgggctgtgacattgacccagccttggtggctgccattgctaatctgaaagctgatacttcatctcctgaggaggaatataaggtggcctgcctgctcttgatctttctggcagtttccctcccactccttgccactgacccttcttccttttatagcattgagaaggatggttacaacaacaatattcattgcttgaccaaagccatcatccaggtgtctgctgccctcttcacgctctacaacaagaacattgaaactcacctcaaggaatttctggtggtggcctctgtcagcctcttgcagctgggccaggagactgacaagcttaaaaccagaaatcgagaatccatttctctgctcatgcgcttggtggtggaggagtcatccttcctgaccctggacatgctggagtcctgtttcccttatgtcctgcttcgaaatgcctatcgggaggtgtctcgggccttccacctaaactgaatgcctgccagtacccactgaagaaacaatccagggctgagaaatcgtagagcagtgaggcaggctgggagcatggaggacagcttatggaaaaagttagggcgtggggccacatgtgtgaattttacaatgaaaaaaggagtaacgtacaagtatattttctatcttctggtgacttgagcttgagctctgacaggcatgggcctctccgaccttcatcactattcttaggataatgctggcgggcagagatgatcaatcatcatattaaatcataatgagcttataatcctc

SEQ ID NO: 448021 - DNA, 2581 bp, Homo sapiens
atctaagctgaaagtgtttggggagatcagacattgctgtctggtgctcctctctcagtggccatcatgtctttgacatctgcttaccagcataaattagcagagaagctcactatcctgaatgatcgcggtcagggggttctcatccgtatgtataacatcaagaagacttgttcagaccccaaatctaagccacctttcttactggaaaagtccatggaaccatctctcaagtatatcaacaagaaatttcccaacatagatgtccgaaacagcacgcaacatttaggaccagtacatcgtgaaaaagccgagataattagattcctcaccaactactaccagtcatttgtggatgtcatggaatttcgggatcatgtatatgaacttctcaacaccattgatgcctgccagtgccattttgatatcaatctcaactttgatttcactcggagttacctggacttgattgtaacttacacctcagtcattttacttctgtcacggattgaagatcggcggatactcattggcatgtacaattgtgcccatgagatgctgcatgggcatggtgaccccagttttgcccgtctgggtcagatggtcttggagtatgaccaccctctgaagaagctgacagaagagtttgggcctcacacaaaggctgtgagtggagccctcctctctttgcatttcctctttgtccgaagaaaccagggggctgagcagtggcgcagtgcccaacttctaagcctcatcagcaaccccccagccatgattaaccctgctaattcagatacaatggcctgtgagtatctgtctgtggaagtaatggagcgctggattatcattgggtttcttctttgtcatgggtgcctcaactccaatagccagtgccagaagctgtggaagctgtgtctgcagggctccctctacatcacccttatccgtgaggatgtgctgcaggtgcacaaagtcaccgaggacctgtttagcagtttgaaagggtatggcaagagagtggcagacataaaggagagcaaggaacatgtaattgcaaacagtggccagtttcattgtcaacggcggcaatttctgcggatggcagtgaaggagctggagactgtgttggctgatgaaccgggactactgggtcctaaggctctttttgctttcatggccctgtccttcattcgtgatgaggtcacctggctggttcgccacacagagaatgtcaccaagacaaagacacctgaggactatgctgactcgagcattgcagagctacttttcttgttggaggggattaggtctctggtccgaagacacatcaaagtgatacagcaataccaccttcagtacttggcaagatttgatgctcttgtgctcagtgacatcattcagaacttgtctgtgtgtccagaggaggagtccatcatcatgtcctcattcgtcagtatcctctcctctctgaatctcaaacaagttgataatggagaaaaatttgaattctcaggattgaggctggactggttccgcctacaggcatacactagcgtggctaaggcccctctgcacctgcatgagaaccctgacttagccaaggtgatgaacctcattgtcttccactcccgaatgctggactccgtagaaaaattgctggtggaaacttctgatctgtctactttctgctttcatcttcgtatctttgagaagatgtttgccatgaccttggaggaatctgccatgttgcgttatgccattgctttccccctgatttgtgctcactttgtccactgcactcatgagatgtgcccagaggagtacccccacctcaagaaccatggtcttcaccactgcaactccttcctggaagagttggccaagcagaccagcaattgcgtcctggagatctgtgctgagcagcgaaacctgagcgagcagcttctacctaagcactgtgccactacaatcagcaaagccaagaacaagaaaaccaggaagcagaggcagactcccagaaaaggagagcccgagagggacaagccaggagctgagagtcaccggaagaaccgcagcattgtcaccaacatggacaagctacacctaaacttgacagaactggcactgacaatgaatcatgtatacagtttctccgtgtttgaacatactatcttcccttctgagtacctcagcagccacctggaggccagactcaacagagccattgtgtggctggctggctacaatgccacgacccaggagatcgtacggccttctgagctgttggcaggagtcaaagcatacattggtttcatacagtcactggcccagtttttgggtgcagatgcttccagagtcatccgcaacgccctcctgcagcagacacaaccactggattcctgtggggaacagacaatcaccacactctacacaaactggtcagtgttgcttaggcttttccactgccttactttgtgttggcactttttcctttacacggtaggacctcagggcccgagcattttagctcccagggtcatagactccaaaatggagggttgcttctccttgaggaatg

SEQ ID NO: 448022 - DNA, 2015 bp, Homo sapiens
tgtgctagaggttgagtctgagggagtgagtaagggtggagacagactaaatacatagtttctaagaaatgaaaattttattgagatacttaatccacctgcacttgtaagaaatcatacagagaaattctattttcctttacacagtttccctgaatgctaacatctagcaaaactgtagtacactgccacaaccaggataactgacattgatataatctactgatcttgttcagatttccttccccagttttgcttatgttcatttctctctgtgtgtgcacgtgtgtgtgttatctatttctatacagctttatcatgtgtaggtttgtgtatctgccactgcagtcaacatacagaacaggccgggcgcagtggctcacgcctgtaatcccagcactttgggaggccaaggcaggtggatcacctgaggtcaggggtttgagagcagcctggccaatatagtgaaacaccgtctctactaaaaataccaaaactagccgggcgtggtggtgcatgcctgtagtcccactactcaggaggctgaggcagcagaataacttgatcccgggaggcggaggttgcagtaagctaagatcctgccacagcattccaggctgagtgacagagcgagactctgtctcaaaaaataaataataatttaaaaaaagatacagaacagttccatcaccacaaggatccctcgcattgctcttttatagcaattttatagcaattttctcctcccacaacccccttccccatctctagctcctggtaacacagatatattctctatttctaaaattttgtcatttgatatatctttttgtaaacatataattatacacacatatttctctaccacttatactttttcaaagtgctttcacatccttatagcaattctgcaaggtagccagggaaggctttcctatttcaggtcagaaaacagatttagaaatattaaatgacttaatgaaggtcacatgtttagcagtagaactagaactgggacccaagtctgatgttcagtcctagaccttttctacttgcccggtctgcctcttcacaagggaagacttgggttttagaatccagagaccttagaaggagcaaattggagaaggtgaggacatgatggcctttactaccggaagcaaaaagtgaatgtccagaggtgaagggacagagaagtaacaggacccatcagcatttcaggcaatttgcttcctttaccaggagggtctctgtcctcttacaacctgggaaaaaataagttgtgtcccaggttgtaagtttgctttacttaggcccaaaggaactaaagaatggatatcagaaatctcaccccaattgttttgtcttacaggcacagaataggttctagcctcagcattttcattaatgtagtgtttttattaacatctccattaacttgcttgcagcaatgagatggaattatgcctcccacaaggcctggggcaagatacttgcataggtgcccccttttgtttggacagtagaaacactgcctcccctgccatggtgttcaatccagttggcaggtgggccagcttcaaagtgcagaaggaactgggtgtggtggctcacccctgtaatcccagcactttgggaggcaggcggatcgcttgaactcaggagtttgagaccactctgggcaacacagtgaaaccctgtctctccaaaaatacaaaaaattagctgggcatggtggctgttgtctgtaatcccaacactttgggaggctgaggccagtggatctcttgagctaaggaggttaagaccagcctggtcaacatggcgaactccgtctctacaaaaaaatacgaaaattagctgggcgtagtagttcctgcctgtagtcctagctacttggaaggctgaggtggggaggatcgcttgagtccgggaggcagaggttgcagtgagcgaagatgatgccattgcactccagtctgggtgacagagcaagatcctgtctcacaaaaaaa

SEQ ID NO: 448023 - DNA, 678 bp, Homo sapiens
atctaagctgaaagtgtttggggagatcagacattgctgtctggtgctcctctctcagtggccatcatgtctttgacatctgcttaccagcataaattagcagagaagctcactatcctgaatgatcgcggtcagggggttctcatccgtatgtataacatcaagaagacttgttcagaccccaaatctaagccacctttcttactggaaaagtccatggaaccatctctcaagtatatcaacaagaaatttcccaacatagatgtccgaaacagcacgcaacatttaggaccagtacatcgtgaaaaagccgagataattagattcctcaccaactactaccagtcatttgtggatgtcatggaatttcgggtgagctctcttgagccgtttccaatgtaggcaaggtctttcagaggctattctttctttagatgttcatgtatttgcttaaaacaagttcttgaaaaaatgagagagatgtactaatatggaaggatatctaagttgtattgttaaatgaaagcaaatttcaaaatagtatatgatacatcacatttctattttaaaagagtatgtatgtatatgtatttagtaaatatctaggaaagatctggactattttacattaaactgttaaaaataactacctttggggactgattatgactggcttca

SEQ ID NO: 448024 - DNA, 428 bp, Homo sapiens
gtaagtttagtgggattagatgggagtggatgaagcagtatgttatatgaagaacaagttctaaaagtcttcctctgcactgttttcccacctacagttgggtttcttctttgtcatgggtgcctcaactccaatagccagtgccagaagctgtggaagctgtgtctgcagggctccctctacatcacccttatccgtgaggatgtgctgcaggtgcacaaagtcaccgaggacctgtttagcagtttgaaagggtgagagacacgagagccaaactgatcttccttgaatagtttttagcccctccaatatcctttttcagtctccacaagtgttcccagatataggtggtaacgattaattctaactattgaagaaatatacattaaatacctactattagctaagtgcttcactgggttttaggg

SEQ ID NO: 448025 - DNA, 350 bp, Homo sapiens
gggaggcaggacatatgtgaggatgaacatcttttatccggaaatattgatctttgagccaggaagtaggacaagatgtttttgaagaggatctaccattctatgtagttggatattggtgtgctgtttattgtttccttttatacttccgtttttcttgcagttgataatggagaaaaatttgaattctcaggattgaggctggactggttccgcctacaggtaatgatctgttcctgttaaagattctcatcctcagattcttcctcccccacaatcccttctctttttatctcctaaatttgctttatggagtgagtcaactttgaaaactgctaattggacaagac

SEQ ID NO: 448026 - DNA, 3734 bp, Homo sapiens
atctaagctgaaagtgtttggggagatcagacattgctgtctggtgctcctctctcagtggccatcatgtctttgacatctgcttaccagcataaattagcagagaagctcactatcctgaatgatcgcggtcagggggttctcatccgtatgtataacatcaagaagacttgttcagaccccaaatctaagccacctttcttactggaaaagtccatggaaccatctctcaagtatatcaacaagaaatttcccaacatagatgtccgaaacagcacgcaacatttaggaccagtacatcgtgaaaaagccgagataattagattcctcaccaactactaccagtcatttgtggatgtcatggaatttcgggatcatgtatatgaacttctcaacaccattgatgcctgccagtgccattttgatatcaatctcaactttgatttcactcggagttacctggacttgattgtaacttacacctcagtcattttacttctgtcacggattgaagatcggcggatactcattggcatgtacaattgtgcccatgagatgctgcatgggcatggtgaccccagttttgcccgtctgggtcagatggtcttggagtatgaccaccctctgaagaagctgacagaagagtttgggcctcacacaaaggctgtgagtggagccctcctctctttgcatttcctctttgtccgaagaaaccagggggctgagcagtggcgcagtgcccaacttctaagcctcatcagcaaccccccagccatgattaaccctgctaattcagatacaatggcctgtgagtatctgtctgtggaagtaatggagcgctggattatcattgggtttcttctttgtcatgggtgcctcaactccaatagccagtgccagaagctgtggaagctgtgtctgcagggctccctctacatcacccttatccgtgaggatgtgctgcaggtgcacaaagtcaccgaggacctgtttagcagtttgaaagggtatggcaagagagtggcagacataaaggagagcaaggaacatgtaattgcaaacagtggccagtttcattgtcaacggcggcaatttctgcggatggcagtgaaggagctggagactgtgttggctgatgaaccgggactactgggtcctaaggctctttttgctttcatggccctgtccttcattcgtgatgaggtcacctggctggttcgccacacagagaatgtcaccaagacaaagacacctgaggactatgctgactcgagcattgcagagctacttttcttgttggaggggattaggtctctggtccgaagacacatcaaagtgatacagcaataccaccttcagtacttggcaagatttgatgctcttgtgctcagtgacatcattcagaacttgtctgtgtgtccagaggaggagtccatcatcatgtcctcattcgtcagtatcctctcctctctgaatctcaaacaagttgataatggagaaaaatttgaattctcaggattgaggctggactggttccgcctacaggcatacactagcgtggctaaggcccctctgcacctgcatgagaaccctgacttagccaaggtgatgaacctcattgtcttccactcccgaatgctggactccgtagaaaaattgctggtggaaacttctgatctgtctactttctgctttcatcttcgtatctttgagaagatgtttgccatgaccttggaggaatctgccatgttgcgttatgccattgctttccccctgatttgtgctcactttgtccactgcactcatgagatgtgcccagaggagtacccccacctcaagaaccatggtcttcaccactgcaactccttcctggaagagttggccaagcagaccagcaattgcgtcctggagatctgtgctgagcagcgaaacctgagcgagcagcttctacctaagcactgtgccactacaatcagcaaagccaagaacaagaaaaccaggaagcagaggcagactcccagaaaaggagagcccgagagggacaagccaggagctgagagtcaccggaagaaccgcagcattgtcaccaacatggacaagctacacctaaacttgacagaactggcactgacaatgaatcatgtatacagtttctccgtgtttgaacatactatcttcccttctgagtacctcagcagccacctggaggccagactcaacagagccattgtgtggctggctggctacaatgccacgacccaggagatcgtacggccttctgagctgttggcaggagtcaaagcatacattggtttcatacagtcactggcccagtttttgggtgcagatgcttccagagtcatccgcaacgccctcctgcagcagacacaaccactggattcctgtggggaacagacaatcaccacactctacacaaactggtacctggaaagtctgcttagacaggcaagcagtgggaccatcatcctctccccagccatgcaggccttcgtcagcctgcccagagaaggggagcagaacttcagtgcagaggagttctctgacatctctgagatgcgggccttggcagaactcctgggcccctatggcatgaagttcctgagtgaaaacctgatgtggcatgtgacctctcagattgtggagctgaagaagctggtggtggaaaacatggacatacttgttcagatcagatccaactttagcaagccggacttgatggcttccctgctgccccagctgacaggggctgaaaatgtgctaaagcgcatgaccatcattggggttatcctcagtttcagggccatggcccaagagggacttcgggaggttttctcctcccactgcccatttcttatgggtcccattgagtgcttgaaggagtttgtcactccagacacagacatcaaggtgaccttgagtatctttgagctggcatctgctgcaggtgtgggctgtgacattgacccagccttggtggctgccattgctaatctgaaagctgatacttcatctcctgaggaggaatataaggtggcctgcctgctcttgatctttctggcagtttccctcccactccttgccactgacccttcttccttttatagcattgagaaggatggttacaacaacaatattcattgcttgaccaaagccatcatccaggtgtctgctgccctcttcacgctctacaacaagaacattgaaactcacctcaaggaatttctggtggtggcctctgtcagcctcttgcagctgggccaggagactgacaagcttaaaaccagaaatcgagaatccatttctctgctcatgcgcttggtggtggaggagtcatccttcctgaccctggacatgctggagtcctgtttcccttatgtcctgcttcgaaatgcctatcgggaggtgtctcgggccttccacctaaactgaatgcctgccagtacccactgaagagccctttggaccttcctaaacccttgccatagtggaagctgtggtcactttcgcagggggtgggaatggggtggggtcactaaggagagagggtcaggagccagagttgatgagcagatctgtggaagaacaatccagggctgagaaatcgtagagcagtgaggcaggctgggagcatggaggacagcttatggaaaaagttagggcgtggggccacatgtgtgaattttacaatgaaaaaaggagtaacgtacaagtat

SEQ ID NO: 448027 - DNA, 5946 bp, Homo sapiens
acccgaggaagcaggcaacatatacggctaggtacgaggcctgggtggttgctgtggaagtaatggagcgctggattatcattgggtttcttctttgtcatgggtgcctcaactccaatagccagtgccagaagctgtggaagctgtgtctgcagggctccctctacatcacccttatccgtgaggatgtgctgcaggtgcacaaagtcaccgaggacctgtttagcagtttgaaagggtatggcaagagagtggcagacataaaggagagcaaggaacatgtaattgcaaacagtggccagtttcattgtcaacggcggcaatttctgcggatggcagtgaaggagctggagactgtgttggctgatgaaccgggactactgggtcctaaggctctttttgctttcatggccctgtccttcattcgtgatgaggtcacctggctggttcgccacacagagaatgtcaccaagacaaagacacctgaggactatgctgactcgagcattgcagagctacttttcttgttggaggggattaggtctctggtccgaagacacatcaaagtgatacagcaataccaccttcagtacttggcaagatttgatgctcttgtgctcagtgacatcattcagaacttgtctgtgtgtccagaggaggagtccatcatcatgtcctcattcgtcagtatcctctcctctctgaatctcaaacaagttgataatggagaaaaatttgaattctcaggattgaggctggactggttccgcctacaggcatacactagcgtggctaaggcccctctgcacctgcatgagaaccctgacttagccaaggtgatgaacctcattgtcttccactcccgaatgctggactccgtagaaaaattgctggtggaaacttctgatctgtctactttctgctttcatcttcgtatctttgagaagatgtttgccatgaccttggaggaatctgccatgttgcgttatgccattgctttccccctgatttgtgctcactttgtccactgcactcatgagatgtgcccagaggagtacccccacctcaagaaccatggtcttcaccactgcaactccttcctggaagagttggccaagcagaccagcaattgcgtcctggagatctgtgctgagcagcgaaacctgagcgagcagcttctacctaagcactgtgccactacaatcagcaaagccaagaacaagaaaaccaggaagcagaggcagactcccagaaaaggagagcccgagagggacaagccaggagctgagagtcaccggaagaaccgcagcattgtcaccaacatggacaagctacacctaaacttgacagaactggcactgacaatgaatcatgtatacagtttctccgtgtttgaacatactatcttcccttctgagtacctcagcagccacctggaggccagactcaacagagccattgtgtggctggctggctacaatgccacgacccaggagatcgtacggccttctgagctgttggcaggagtcaaagcatacattggtttcatacagtcactggcccagtttttgggtgcagatgcttccagagtcatccgcaacgccctcctgcagcagacacaaccactggattcctgtggggaacagacaatcaccacactctacacaaactggtacctggaaagtctgcttagacaggcaagcagtgggaccatcatcctctccccagccatgcaggccttcgtcagcctgcccagagaaggggagcagaacttcagtgcagaggagttctctgacatctctgagatgcgggccttggcagaactcctgggcccctatggcatgaagttcctgagtgaaaacctgatgtggcatgtgacctctcagattgtggagctgaagaagctggtggtggaaaacatggacatacttgttcagatcagatccaactttagcaagccggacttgatggcttccctgctgccccagctgacaggggctgaaaatgtgctaaagcgcatgaccatcattggggttatcctcagtttcagggccatggcccaagagggacttcgggaggttttctcctcccactgcccatttcttatgggtcccattgagtgcttgaaggagtttgtcactccagacacagacatcaaggtgaccttgagtatctttgagctggcatctgctgcaggtgtgggctgtgacattgacccagccttggtggctgccattgctaatctgaaagctgatacttcatctcctgaggaggaatataaggtggcctgcctgctcttgatctttctggcagtttccctcccactccttgccactgacccttcttccttttatagcattgagaaggatggttacaacaacaatattcattgcttgaccaaagccatcatccaggtgtctgctgccctcttcacgctctacaacaagaacattgaaactcacctcaaggaatttctggtggtggcctctgtcagcctcttgcagctgggccaggagactgacaagcttaaaaccagaaatcgagaatccatttctctgctcatgcgcttggtggtggaggagtcatccttcctgaccctggacatgctggagtcctgtttcccttatgtcctgcttcgaaatgcctatcgggaggtgtctcgggccttccacctaaactgaatgcctgccagtacccactgaagagccctttggaccttcctaaacccttgccatagtggaagctgtggtcactttcgcagggggtgggaatggggtggggtcactaaggagagagggtcaggagccagagttgatgagcagatctgtggaagaacaatccagggctgagaaatcgtagagcagtgaggcaggctgggagcatggaggacagcttatggaaaaagttagggcgtggggccacatgtgtgaattttacaatgaaaaaaggagtaacgtacaagtatattttctatcttctggtgacttgagcttgagctctgacaggcatgggcctctccgaccttcatcactattcttaggataatgctggcgggcagagatgatcaatcatcatattaaatcataatgagcttataatcctcacactggagctgctattgtctcctgcacattcattaggaccattatcttctctcttcctttttcaaatgtgttcagcaaacattcaacctgctcctactgcagagtagcagcaaaggagcccctcttttcctttgtggggctcttcgaggggtcattgggtctcttcctttgcccccagcttgactgcgtttcctactggggcaaggaggaagtgcccttcagagatgttcactgcccacctactctactacattgtttgttacaagttctctcttgctttaacccctcctgctttgatatctccacaacccagagcagagggtcagttagtctccgtcaattctaggttacatgacaactgattggcccagacttaggtgggttttccctcctgtaccatttgggggtactctgccttttattgggagggactaatttaaccccaaatccttttgtcagcctatttgatagctgttttggggttttgtacaggtgtttgctttttatttcttgagacccaggcttagtcaatactttcttaacttggcacccataatcaacatacagatttttcttagcaacagttgtctgctctttagggtggaagcgatagagaatcctgcttcgtgcatcagcaaatcctccttccttgctatgggaagggcttatgttctaaagggtgattcagtgtcaggcttatgagactgagagtaaagttgatgaggaagaggaggctcagaagtatctgaacaactactctatatgtttatatttttctgcttgaggggatagagatccctcctccatctgcatctgcatatagaactgcttaagaggacagcaagacaagttgctgcagggggatggagggtagacagaatgcctttttttaaaactgaaaattttattgagatacttaatccacctgcacttgtaagaaatcatacagagaaattctattttcctttacacagtttccctgaatgctaacatctagcaaaactgtagtacactgccacaaccaggataactgacattgatataatctactgatcttgttcagatttccttccccagttttgcttatgttcatttctctctgtgtgtgcacgtgtgtgtgttatctatttctatacagctttatcatgtgtaggtttgtgtatctgccactgcagtcaacatacagaacaggccgggcgcagtggctcacgcctgtaatcccagcactttgggaggccaaggcaggtggatcacctgaggtcaggggtttgagagcagcctggccaatatagtgaaacaccgtctctactaaaaataccaaaactagccgggcgtggtggtgcatgcctgtagtcccactactcaggaggctgaggcagcagaataacttgatcccgggaggcggaggttgcagtaagctaagatcctgccacagcattccaggctgagtgacagagcgagactctgtctcaaaaaataaataataatttaaaaaaagatacagaacagttccatcaccacaaggatccctcgcattgctcttttatagcaattttatagcaattttctcctcccacaacccccttccccatctctagctcctggtaacacagatatattctctatttctaaaattttgtcatttgatatatctttttgtaaacatataattatacacacatatttctctaccacttatactttttcaaagtgctttcacatccttatagcaattctgcaaggtagccagggaaggctttcctatttcaggtcagaaaacagatttagaaatattaaatgacttaatgaaggtcacatgtttagcagtagaactagaactgggacccaagtctgatgttcagtcctagaccttttctacttgcccggtctgcctcttcacaagggaagacttgggttttagaatccagagaccttagaaggagcaaattggagaaggtgaggacatgatggcctttactaccggaagcaaaaagtgaatgtccagaggtgaagggacagagaagtaacaggacccatcagcatttcaggcaatttgcttcctttaccaggagggtctctgtcctcttacaacctgggaaaaaataagttgtgtcccaggttgtaagtttgctttacttaggcccaaaggaactaaagaatggatatcagaaatctcaccccaattgttttgtcttacaggcacagaataggttctagcctcagcattttcattaatgtagtgtttttattaacatctccattaacttgcttgcagcaatgagatggaattatgcctcccacaaggcctggggcaagatacttgcataggtgcccccttttgtttggacagtagaaacactgcctcccctgccatggtgttcaatccagttggcaggtgggccagcttcaaagtgcagaaggaactgggtgtggtggctcacccctgtaatcccagcactttgggaggcaggcggatcgcttgaactcaggagtttgagaccactctgggcaacacagtgaaaccctgtctctccaaaaatacaaaaaattagctgggcatggtggctgttgtctgtaatcccaacactttgggaggctgaggccagtggatctcttgagctaaggaggttaagaccagcctggtcaacatggcgaactccgtctctacaaaaaaatacgaaaattagctgggcgtagtagttcctgcctgtagtcctagctacttggaaggctgaggtggggaggatcgcttgagtccgggaggcagaggttgcagtgagcgaagatgatgccattgcactccagtctgggtgacagagcaagatcctgtctcacaaaaaaa

SEQ ID NO: 448028 - DNA, 4707 bp, Homo sapiens
atctaagctgaaagtgtttggggagatcagacattgctgtctggtgctcctctctcagtggccatcatgtctttgacatctgcttaccagcataaattagcagagaagctcactatcctgaatgatcgcggtcagggggttctcatccgtatgtataacatcaagaagacttgttcagaccccaaatctaagccacctttcttactggaaaagtccatggaaccatctctcaagtatatcaacaagaaatttcccaacatagatgtccgaaacagcacgcaacatttaggaccagtacatcgtgaaaaagccgagataattagattcctcaccaactactaccagtcatttgtggatgtcatggaatttcgggatcatgtatatgaacttctcaacaccattgatgcctgccagtgccattttgatatcaatctcaactttgatttcactcggagttacctggacttgattgtaacttacacctcagtcattttacttctgtcacggattgaagatcggcggatactcattggcatgtacaattgtgcccatgagatgctgcatgggcatggtgaccccagttttgcccgtctgggtcagatggtcttggagtatgaccaccctctgaagaagctgacagaagagtttgggcctcacacaaaggctgtgagtggagccctcctctctttgcatttcctctttgtccgaagaaaccagggggctgagcagtggcgcagtgcccaacttctaagcctcatcagcaaccccccagccatgattaaccctgctaattcagatacaatggcctgtgagtatctgtctgtggaagtaatggagcgctggattatcattgggtttcttctttgtcatgggtgcctcaactccaatagccagtgccagaagctgtggaagctgtgtctgcagggctccctctacatcacccttatccgtgaggatgtgctgcaggtgcacaaagtcaccgaggacctgtttagcagtttgaaagggtatggcaagagagtggcagacataaaggagagcaaggaacatgtaattgcaaacagtggccagtttcattgtcaacggcggcaatttctgcggatggcagtgaaggagctggagactgtgttggctgatgaaccgggactactgggtcctaaggctctttttgctttcatggccctgtccttcattcgtgatgaggtcacctggctggttcgccacacagagaatgtcaccaagacaaagacacctgaggactatgctgactcgagcattgcagagctacttttcttgttggaggggattaggtctctggtccgaagacacatcaaagtgatacagcaataccaccttcagtacttggcaagatttgatgctcttgtgctcagtgacatcattcagaacttgtctgtgtgtccagaggaggagtccatcatcatgtcctcattcgtcagtatcctctcctctctgaatctcaaacaagttgataatggagaaaaatttgaattctcaggattgaggctggactggttccgcctacaggcatacactagcgtggctaaggcccctctgcacctgcatgagaaccctgacttagccaaggtgatgaacctcattgtcttccactcccgaatgctggactccgtagaaaaattgctggtggaaacttctgatctgtctactttctgctttcatcttcgtatctttgagaagatgtttgccatgaccttggaggaatctgccatgttgcgttatgccattgctttccccctgatttgtgctcactttgtccactgcactcatgagatgtgcccagaggagtacccccacctcaagaaccatggtcttcaccactgcaactccttcctggaagagttggccaagcagaccagcaattgcgtcctggagatctgtgctgagcagcgaaacctgagcgagcagcttctacctaagcactgtgccactacaatcagcaaagccaagaacaagaaaaccaggaagcagaggcagactcccagaaaaggagagcccgagagggacaagccaggagctgagagtcaccggaagaaccgcagcattgtcaccaacatggacaagctacacctaaacttgacagaactggcactgacaatgaatcatgtatacagtttctccgtgtttgaacatactatcttcccttctgagtacctcagcagccacctggaggccagactcaacagagccattgtgtggctggctggctacaatgccacgacccaggagatcgtacggccttctgagctgttggcaggagtcaaagcatacattggtttcatacagtcactggcccagtttttgggtgcagatgcttccagagtcatccgcaacgccctcctgcagcagacacaaccactggattcctgtggggaacagacaatcaccacactctacacaaactggtacctggaaagtctgcttagacaggcaagcagtgggaccatcatcctctccccagccatgcaggccttcgtcagcctgcccagagaaggggagcagaacttcagtgcagaggagttctctgacatctctgagatgcgggccttggcagaactcctgggcccctatggcatgaagttcctgagtgaaaacctgatgtggcatgtgacctctcagattgtggagctgaagaagctggtggtggaaaacatggacatacttgttcagatcagatccaactttagcaagccggacttgatggcttccctgctgccccagctgacaggggctgaaaatgtgctaaagcgcatgaccatcattggggttatcctcagtttcagggccatggcccaagagggacttcgggaggttttctcctcccactgcccatttcttatgggtcccattgagtgcttgaaggagtttgtcactccagacacagacatcaaggtgaccttgagtatctttgagctggcatctgctgcaggtgtgggctgtgacattgacccagccttggtggctgccattgctaatctgaaagctgatacttcatctcctgaggaggaatataaggtggcctgcctgctcttgatctttctggcagtttccctcccactccttgccactgacccttcttccttttatagcattgagaaggatggttacaacaacaatattcattgcttgaccaaagccatcatccaggtgtctgctgccctcttcacgctctacaacaagaacattgaaactcacctcaaggaatttctggtggtggcctctgtcagcctcttgcagctgggccaggagactgacaagcttaaaaccagaaatcgagaatccatttctctgctcatgcgcttggtggtggaggagtcatccttcctgaccctggacatgctggagtcctgtttcccttatgtcctgcttcgaaatgcctatcgggaggtgtctcgggccttccacctaaactgaatgcctgccagtacccactgaagagccctttggaccttcctaaacccttgccatagtggaagctgtggtcactttcgcagggggtgggaatggggtggggtcactaaggagagagggtcaggagccagagttgatgagcagatctgtggaagaacaatccagggctgagaaatcgtagagcagtgaggcaggctgggagcatggaggacagcttatggaaaaagttagggcgtggggccacatgtgtgaattttacaatgaaaaaaggagtaacgtacaagtatattttctatcttctggtgacttgagcttgagctctgacaggcatgggcctctccgaccttcatcactattcttaggataatgctggcgggcagagatgatcaatcatcatattaaatcataatgagcttataatcctcacactggagctgctattgtctcctgcacattcattaggaccattatcttctctcttcctttttcaaatgtgttcagcaaacattcaacctgctcctactgcagagtagcagcaaaggagcccctcttttcctttgtggggctcttcgaggggtcattgggtctcttcctttgcccccagcttgactgcgtttcctactggggcaaggaggaagtgcccttcagagatgttcactgcccacctactctactacattgtttgttacaagttctctcttgctttaacccctcctgctttgatatctccacaacccagagcagagggtcagttagtctccgtcaattctaggttacatgacaactgattggcccagacttaggtgggttttccctcctgtaccatttgggggtactctgccttttattgggagggactaatttaaccccaaatccttttgtcagcctgggtatagctgttgctccaggaagggatttctcttctggatcttaaatttcacagacctcattaggttgtatggccctgagagtgggtatccttgagggagtacaagctgtttcaacttagcccttttctgcgctaattagaatttcaagcgtcacagagcctgggggctttcaagatagcactaaactaggtttacttaactccttggcaggaaatagtggcccccatgcatcacttctgtgaatccactgccagggagaagtggagaaacagatcatatatgtcacaggtctagagtggttggaattgacaaatataattagctagttggttaattagggtcatgtccatactttcatgatgaaagggaa

SEQ ID NO: 448029 - DNA, 3525 bp, Homo sapiens
atctaagctgaaagtgtttggggagatcagacattgctgtctggtgctcctctctcagtggccatcatgtctttgacatctgcttaccagcataaattagcagagaagctcactatcctgaatgatcgcggtcagggggttctcatccgtatgtataacatcaagaagacttgttcagaccccaaatctaagccacctttcttactggaaaagtccatggaaccatctctcaagtatatcaacaagaaatttcccaacatagatgtccgaaacagcacgcaacatttaggaccagtacatcgtgaaaaagccgagataattagattcctcaccaactactaccagtcatttgtggatgtcatggaatttcgggatcatgtatatgaacttctcaacaccattgatgcctgccagtgccattttgatatcaatctcaactttgatttcactcggagttacctggacttgattgtaacttacacctcagtcattttacttctgtcacggattgaagatcggcggatactcattggcatgtacaattgtgcccatgagatgctgcatgggcatggtgaccccagttttgcccgtctgggtcagatggtcttggagtatgaccaccctctgaagaagctgacagaagagtttgggcctcacacaaaggctgtgagtggagccctcctctctttgcatttcctctttgtccgaagaaaccagggggctgagcagtggcgcagtgcccaacttctaagcctcatcagcaaccccccagccatgattaaccctgctaattcagatacaatggcctgtgagtatctgtctgtggaagtaatggagcgctggattatcattgggtttcttctttgtcatgggtgcctcaactccaatagccagtgccagaagctgtggaagctgtgtctgcagggctccctctacatcacccttatccgtgaggatgtgctgcaggtgcacaaagtcaccgaggacctgtttagcagtttgaaagggtatggcaagagagtggcagacataaaggagagcaaggaacatgtaattgcaaacagtggccagtttcattgtcaacggcggcaatttctgcggatggcagtgaaggagctggagactgtgttggctgatgaaccgggactactgggtcctaaggctctttttgctttcatggccctgtccttcattcgtgatgaggtcacctggctggttcgccacacagagaatgtcaccaagacaaagacacctgaggactatgctgactcgagcattgcagagctacttttcttgttggaggggattaggtctctggtccgaagacacatcaaagtgatacagcaataccaccttcagtacttggcaagatttgatgctcttgtgctcagtgacatcattcagaacttgtctgtgtgtccagaggaggagtccatcatcatgtcctcattcgtcagtatcctctcctctctgaatctcaaacaagttgataatggagaaaaatttgaattctcaggattgaggctggactggttccgcctacaggcatacactagcgtggctaaggcccctctgcacctgcatgagaaccctgacttagccaaggtgatgaacctcattgtcttccactcccgaatgctggactccgtagaaaaattgctggtggaaacttctgatctgtctactttctgctttcatcttcgtatctttgagaagatgtttgccatgaccttggaggaatctgccatgttgcgttatgccattgctttccccctgatttgtgctcactttgtccactgcactcatgagatgtgcccagaggagtacccccacctcaagaaccatggtcttcaccactgcaactccttcctggaagagttggccaagcagaccagcaattgcgtcctggagatctgtgctgagcagcgaaacctgagcgagcagcttctacctaagcactgtgccactacaatcagcaaagccaagaacaagaaaaccaggaagcagaggcagactcccagaaaaggagagcccgagagggacaagccaggagctgagagtcaccggaagaaccgcagcattgtcaccaacatggacaagctacacctaaacttgacagaactggcactgacaatgaatcatgtatacagtttctccgtgtttgaacatactatcttcccttctgagtacctcagcagccacctggaggccagactcaacagagccattgtgtggctggctggctacaatgccacgacccaggagatcgtacggccttctgagctgttggcaggagtcaaagcatacattggtttcatacagtcactggcccagtttttgggtgcagatgcttccagagtcatccgcaacgccctcctgcagcagacacaaccactggattcctgtggggaacagacaatcaccacactctacacaaactggtacctggaaagtctgcttagacaggcaagcagtgggaccatcatcctctccccagccatgcaggccttcgtcagcctgcccagagaaggggagcagaacttcagtgcagaggagttctctgacatctctgagatgcgggccttggcagaactcctgggcccctatggcatgaagttcctgagtgaaaacctgatgtggcatgtgacctctcagattgtggagctgaagaagctggtggtggaaaacatggacatacttgttcagatcagatccaactttagcaagccggacttgatggcttccctgctgccccagctgacaggggctgaaaatgtgctaaagcgcatgaccatcattggggttatcctcagtttcagggccatggcccaagagggacttcgggaggttttctcctcccactgcccatttcttatgggtcccattgagtgcttgaaggagtttgtcactccagacacagacatcaaggtgaccttgagtatctttgagctggcatctgctgcaggtgtgggctgtgacattgacccagccttggtggctgccattgctaatctgaaagctgatacttcatctcctgaggaggaatataaggtggcctgcctgctcttgatctttctggcagtttccctcccactccttgccactgacccttcttccttttatagcattgagaaggatggtaagtaaggggtaggtttgagacaccagtgctattcaagttagtgtcctggggtagagagaggagacagagatactggaaaatatagacttctgacttgggtgtaaagttctgtttcaaaaagcacttgaaggctggacaccgtggctcatgcctgtaatcctagcactttgggaggccaaggtgaggtgggtagatcacttgagcccatgagttccagaccagcctaggcaacgtggtgaaaccctgtttctacaaaaataaataaactagctgggcagggtggcctgtagtcccagctacctgggaggctgaggtaggaggatggcttgagcccaaggggtcaaggttgtagtgagccatgattgcgccactgcactccagca

SEQ ID NO: 448030 - DNA, 3278 bp, Homo sapiens
atctaagctgaaagtgtttggggagatcagacattgctgtctggtgctcctctctcagtggccatcatgtctttgacatctgcttaccagcataaattagcagagaagctcactatcctgaatgatcgcggtcagggggttctcatccgtatgtataacatcaagaagacttgttcagaccccaaatctaagccacctttcttactggaaaagtccatggaaccatctctcaagtatatcaacaagaaatttcccaacatagatgtccgaaacagcacgcaacatttaggaccagtacatcgtgaaaaagccgagataattagattcctcaccaactactaccagtcatttgtggatgtcatggaatttcgggatcatgtatatgaacttctcaacaccattgatgcctgccagtgccattttgatatcaatctcaactttgatttcactcggagttacctggacttgattgtaacttacacctcagtcattttacttctgtcacggattgaagatcggcggatactcattggcatgtacaattgtgcccatgagatgctgcatgggcatggtgaccccagttttgcccgtctgggtcagatggtcttggagtatgaccaccctctgaagaagctgacagaagagtttgggcctcacacaaaggctgtgagtggagccctcctctctttgcatttcctctttgtccgaagaaaccagggggctgagcagtggcgcagtgcccaacttctaagcctcatcagcaaccccccagccatgattaaccctgctaattcagatacaatggcctgtgagtatctgtctgtggaagtaatggagcgctggattatcattgggtttcttctttgtcatgggtgcctcaactccaatagccagtgccagaagctgtggaagctgtgtctgcagggctccctctacatcacccttatccgtgaggatgtgctgcaggtgcacaaagtcaccgaggacctgtttagcagtttgaaagggtatggcaagagagtggcagacataaaggagagcaaggaacatgtaattgcaaacagtggccagtttcattgtcaacggcggcaatttctgcggatggcagtgaaggagctggagactgtgttggctgatgaaccgggactactgggtcctaaggctctttttgctttcatggccctgtccttcattcgtgatgaggtcacctggctggttcgccacacagagaatgtcaccaagacaaagacacctgaggactatgctgactcgagcattgcagagctacttttcttgttggaggggattaggtctctggtccgaagacacatcaaagtgatacagcaataccaccttcagtacttggcaagatttgatgctcttgtgctcagtgacatcattcagaacttgtctgtgtgtccagaggaggagtccatcatcatgtcctcattcgtcagtatcctctcctctctgaatctcaaacaagttgataatggagaaaaatttgaattctcaggattgaggctggactggttccgcctacaggcatacactagcgtggctaaggcccctctgcacctgcatgagaaccctgacttagccaaggtgatgaacctcattgtcttccactcccgaatgctggactccgtagaaaaattgctggtggaaacttctgatctgtctactttctgctttcatcttcgtatctttgagaagatgtttgccatgaccttggaggaatctgccatgttgcgttatgccattgctttccccctgatttgtgctcactttgtccactgcactcatgagatgtgcccagaggagtacccccacctcaagaaccatggtcttcaccactgcaactccttcctggaagagttggccaagcagaccagcaattgcgtcctggagatctgtgctgagcagcgaaacctgagcgagcagcttctacctaagcactgtgccactacaatcagcaaagccaagaacaagaaaaccaggaagcagaggcagactcccagaaaaggagagcccgagagggacaagccaggagctgagagtcaccggaagaaccgcagcattgtcaccaacatggacaagctacacctaaacttgacagaactggcactgacaatgaatcatgtatacagtttctccgtgtttgaacatactatcttcccttctgagtacctcagcagccacctggaggccagactcaacagagccattgtgtggctggctggctacaatgccacgacccaggagatcgtacggccttctgagctgttggcaggagtcaaagcatacattggtttcatacagtcactggcccagtttttgggtgcagatgcttccagagtcatccgcaacgccctcctgcagcagacacaaccactggattcctgtggggaacagacaatcaccacactctacacaaactggtacctggaaagtctgcttagacaggcaagcagtgggaccatcatcctctccccagccatgcaggccttcgtcagcctgcccagagaaggggagcagaacttcagtgcagaggagttctctgacatctctgagatgcgggccttggcagaactcctgggcccctatggcatgaagttcctgagtgaaaacctgatgtggcatgtgacctctcagattgtggagctgaagaagctggtggtggaaaacatggacatacttgttcagatcagatccaactttagcaagccggacttgatggcttccctgctgccccagctgacaggggctgaaaatgtgctaaagcgcatgaccatcattggggttatcctcagtttcagggccatggcccaagagggacttcgggaggttttctcctcccactgcccatttcttatgggtcccattgagtgcttgaaggagtttgtcactccagacacagacatcaaggtgaccttgagtatctttgagctggcatctgctgcaggtgtgggctgtgacattgacccagccttggtggctgccattgctaatctgaaagctgatacttcatctcctgaggaggaatataaggtggcctgcctgctcttgatctttctggcagtttccctcccactccttgccactgacccttcttccttttatagcattgagaaggatggttacaacaacaatatttcagtcaaagctgtgcccctgggtctgacccgagatctaatctctgtgctctgtgtattggcgacgagcagggtgagaataagtgcgtgcccacagcaacgagagatataggctacacccgg

SEQ ID NO: 448031 - DNA, 1458 bp, Homo sapiens
atctaagctgaaagtgtttggggagatcagacattgctgtctggtgctcctctctcagtggccatcatgtctttgacatctgcttaccagcataaattagcagagaagctcactatcctgaatgatcgcggtcagggggttctcatccgtatgtataacatcaagaagacttgttcagaccccaaatctaagccacctttcttactggaaaagtccatggaaccatctctcaagtatatcaacaagaaatttcccaacatagatgtccgaaacagcacgcaacatttaggaccagtacatcgtgaaaaagccgagataattagattcctcaccaactactaccagtcatttgtggatgtcatggaatttcgggatcatgtatatgaacttctcaacaccattgatgcctgccagtgccattttgatatcaatctcaactttgatttcactcggagttacctggacttgattgtaacttacacctcagtcattttacttctgtcacggattgaagatcggcggatactcattggcatgtacaattgtgcccatgagatgctgcatgggcatggtgaccccagttttgcccgtctgggtcagatggtcttggagtatgaccaccctctgaagaagctgacagaagagtttgggcctcacacaaaggctgtgagtggagccctcctctctttgcatttcctctttgtccgaagaaaccagggggctgagcagtggcgcagtgcccaacttctaagcctcatcagcaaccccccagccatgattaaccctgctaattcagatacaatggcctgtgagtatctgtctgtggaagtaatggagcgctggattatcattgggtttcttctttgtcatgggtgcctcaactccaatagccagtgccagaagctgtggaagctgtgtctgcagggctccctctacatcacccttatccgtgaggatgtgctgcaggtgcacaaagtcaccgaggacctgtttagcagtttgaaagggtgagagacacgagagccaaactgatcttccttgaatagtttttagcccctccaatatcctttttcagtctccacaagtgttcccagatataggtggtaacgattaattctaactattgaagaaatatacattaaatacctactattagctaagtgcttcactgggttttagggacacaataatgaataagacaacatggaggttaagagcacagactctgaaactagattgcttgggtttgaattcaggctctaccactagttgtgtggccttgggcaagttgctcaaatttcccatgccattacctcaatttcctcatctataaaatgtggataatagtagtacctccctatggcctacctcatagggttgttgtgaagaataaaagtgttattatttgtaaagcaggtagaaaagttcctggtacattgtaagtgctatgtgcttgtt

SEQ ID NO: 448032 - DNA, 1079 bp, Homo sapiens
  misc_feature (887)..(887): n is a, c, g, or t
  misc_feature (889)..(891): n is a, c, g, or t
  misc_feature (893)..(893): n is a, c, g, or t
  misc_feature (897)..(897): n is a, c, g, or t
  misc_feature (907)..(907): n is a, c, g, or t
  misc_feature (917)..(917): n is a, c, g, or t
  misc_feature (921)..(921): n is a, c, g, or t
cggacgcgtgggtcgacccacgcgtcgcaaagtcgccgacatcggcctggctgcctggggacgcaaggccctggacattgctgagaacgagatgccgggcctgatgcgtatgcgggagcggtactcggcctccaagccactgaagggcgcccgcatcgctggctgcctgcacatgaccgtggagacggccgtcctcattgagaccctcgtcaccctgggtgctgaggtgcagtggtccagctgcaacatcttctccacccaggaccatgcggcggctgccattgccaaggctggcattccggtgtatgcctggaagggcgaaacggacgaggagtacctgtggtgcattgagcagaccctgtacttcaaggacgggcccctcaacatgattctggacgacgggggcgacctcaccaacctcatccacaccaagtacccgcagcttctgccaggcatccgaggcatctctgaggagaccacgactggggtccacaacctctacaagatgatggccaatgggatcctcaaggtgcctgccatcaatgtcaatgactccgtcaccaagagcaagtttgacaacctctatggctgccgggagtccctcatagatggcatcaagcgggccacagatgtgatgattgccggcaaggtagcggtggtagcaggctatggtgatgtgggcaagggctgtgcccaggccctgcggggtttcggagcccgcgtcatcatcaccgagattgaccccatcaacgcactgcaggctgccatggagggctatgaggtgaccaccatggatgaggcctgtcaggagggcaacatctttgtcaccaccacaggctgtattgacatcatccttggccgcctttgagcgttgagttgtgccttgngnnncntggnccttgccggngatcgggcantggncacgggacgcgggggagggactccagcccgggacgcctcggtgaaggggccgctccgtggcgggcgggcccggggcggcccctggggactccccacgtggcgcggtgccccacccgggttccacgtgggggccggtggtcaacctggccccccgcgct

SEQ ID NO: 448033 - DNA, 660 bp, Homo sapiens
tcttcgcgactctgaggatcccccaggtccttaagccggatcactaccgctactgagagccaggtctgcgtttcaccctccagctgctgtccttgcccaggccccacctctcctccctaagagctaatggcaccaactttgtgattggtttgtcagtgtcccccatcgactctctggggctgatcacttagtttttggcctctgctgcagccgtcatactgttccaaatgtggcagcgggaacagagtaccctcttcaagccccggtcatgatggaggtcccagccacagggaaccatgagctcagtggtcttggaacagctcactaagtcagtccttccttagcctggaagtcagtagtggagtcacaaagcccatgtgttttgccatctaggccttcacctggtctgtggacttatacctgtgtgcttggtttacaggtccagtggttcttcagcccatgacagatgagaaggggctatattgaagggcaaagaggaactgttgtttgaattttcctgagagcctggcttagtgctgggccttctcttaaacctcattacaatgaggttagtacttttagtccctgttttacaggggttagaatagactgttacccttggggctaaggcccttggggcttataggacctgtcttaagg

SEQ ID NO: 448034 - DNA, 1160 bp, Homo sapiens
gtggcgggggctgcagggccgactcggggctctctggaccccctggaatcgcagcctcggcgcgtttctggccgcgcgaagccagctggaagttggagttctcgcgcggccatgagcgggccgttccgggtggccgtggactacaagtcccagcatgccccgcgacgccggggccgccgcgcggtctgcgagccgcaaactggcggcgtgctccgcgggagagcacacctggccacggcctgggacggctggcacctgccggaccctgctcggggggcctgcgcccggcctcctaggcctggaccggaccctgtccagctgggcggccccgacgagcgtccacccctctctgggcctcctacagggacggcgagggcaccccggagggtgtatgaggagaggcctggaaagcgagccccaggccggctccgatcctcctctcccctgggactttgggccagttacccaacctgtggggtcccccacccctccagcaggggcagccttgcagaaatctcgaagaaaatttggagtggtttgaaaaatcctgctgtcccaccgattgaagtgtaatacagggatagttaacgtttacttagtgtttcctgtgggatcggcactgccttctagctttattctagtctcatggctctgtagggaaactgttctcattttatgatgagaatcctgaggcagaggtaacttgccctcagtcttacagctggtggtgatggagcaagattggaacgcaggccatctagatctctgagcgcaccctttcaccactgtgtgcaagcgaatacacgcggaacaatcctagtgaattttcagcaaaaaccagttcagtttggctggtagcttttcaagtaactttgacactattggaccgggtgtggtggctcacccctctcaaagtgctgggattacaggctgtgagccactgcgcccagcctgagaagtgacagtttagatgaaggtggtgagatgcagttggattgcttatatatttcacttgttgagccaaaaacgtgctgattgaggtgaaagaggaaaagaggaatcaaatcttaagtttttgggcagagtagctggttgaatggtggtttcatttcctaaaatgggaagattgggagagtaaccggttctgggggcacacagga

SEQ ID NO: 448035 - DNA, 2266 bp, Homo sapiens
agatatttaaaggcgtcggcgccacgcgcatatccctgctcggcgctgcccgcccagttcctgttcccagactgaggcccagcccccttcgcccgtttccatcacgagtgccgccagcatgtctgacaaactgccctacaaagtcgccgacatcggcctggctgcctggggacgcaaggccctggacattgctgagaacgagatgccgggcctgatgcgtatgcgggagcggtactcggcctccaagccactgaagggcgcccgcatcgctggctgcctgcacatgaccgtggagacggccgtcctcattgagaccctcgtcaccctgggtgctgaggtgcagtggtccagctgcaacatcttctccacccaggaccatgcggcggctgccattgccaaggctggcattccggtgtatgcctggaagggcgaaacggacgaggagtacctgtggtgcattgagcagaccctgtacttcaaggacgggcccctcaacatgattctggacgacgggggcgacctcaccaacctcatccacaccaagtacccgcagcttctgccaggcatccgaggcatctctgaggagaccacgactggggtccacaacctctacaagatgatggccaatgggatcctcaaggtgcctgccatcaatgtcaatgactccgtcaccaagagcaagtttgacaacctctatggctgccgggagtccctcatagatggcatcaagcgggccacagatgtgatgattgccggcaaggtagcggtggtagcaggctatggtgatgtgggcaagggctgtgcccaggccctgcggggtttcggagcccgcgtcatcatcaccgagattgaccccatcaacgcactgcaggctgccatggagggctatgaggtgaccaccatggatgaggcctgtcaggagggcaacatctttgtcaccaccacaggctgtattgacatcatccttggccggcactttgagcagatgaaggatgatgccattgtgtgtaacattggacactttgacgtggagatcgatgtcaagtggctcaacgagaacgccgtggagaaggtgaacatcaagccgcaggtggaccggtatcggttgaagaatgggcgccgcatcatcctgctggccgagggtcggctggtcaacctgggttgtgccatgggccaccccagcttcgtgatgagtaactccttcaccaaccaggtgatggcgcagatcgagctgtggacccatccagacaagtaccccgttggggttcatttcctgcccaagaagctggatgaggcagtggctgaagcccacctgggcaagctgaatgtgaagttgaccaagctaactgagaagcaagcccagtacctgggcatgtcctgtgatggccccttcaagccggatcactaccgctactgagagccaggtctgcgtttcaccctccagctgctgtccttgcccaggccccacctctcctccctaagagctaatggcaccaactttgtgattggtttgtcagtgtcccccatcgactctctggggctgatcacttagtttttggcctctgctgcagccgtcatactgttccaaatgtggcagcgggaacagagtaccctcttcaagccccggtcatgatggaggtcccagccacagggaaccatgagctcagtggtcttggaacagctcactaagtcagtccttccttagcctggaagtcagtagtggagtcacaaagcccatgtgttttgccatctaggccttcacctggtctgtggacttatacctgtgtgcttggtttacaggtccagtggttcttcagcccatgacagatgagaaggggctatattgaagggcaaagaggaactgttgtttgaattttcctgagagcctggcttagtgctgggccttctcttaaacctcattacaatgaggttagtacttttagtccctgttttacaggggttagaatagactgttaaggggcaactgagaaagaacagagaagtgacagctaggggttgagaggggccagaaaaacatgaatgcaggcagatttcgtgaaatctgccaccactttataaccagatggttcctttcacaaccctgggtcaaaaagagaataatttggcctataatgttaaaagaaagcaggaaggtgggtaaataaaaatcttggtgcctggaaaaaaaaaaaacaaaacaaccaaaagggggcgggcgaaaaaatcccgggggcccacatccgacccctttttgcaaggcccccaa

SEQ ID NO: 448036 - DNA, 2574 bp, Homo sapiens
agatatttaaaggcgtcggcgccacgcgcatatccctgctcggcgctgcccgcccagttcctgttcccagactgaggcccagcccccttcgcccgtttccatcacgagtgccgccagcatgtctgacaaactgccctacaaagtcgccgacatcggcctggctgcctggggacgcaaggccctggacattgctgagaacgagatgccgggcctgatgcgtatgcgggagcggtactcggcctccaagccactgaagggcgcccgcatcgctggctgcctgcacatgaccgtggagacggccgtcctcattgagaccctcgtcaccctgggtgctgaggtgcagtggtccagctgcaacatcttctccacccaggaccatgcggcggctgccattgccaaggctggcattccggtgtatgcctggaagggcgaaacggacgaggagtacctgtggtgcattgagcagaccctgtacttcaaggacgggcccctcaacatgattctggacgacgggggcgacctcaccaacctcatccacaccaagtacccgcagcttctgccaggcatccgaggcatctctgaggagaccacgactggggtccacaacctctacaagatgatggccaatgggatcctcaaggtgcctgccatcaatgtcaatgactccgtcaccaagagcaagtttgacaacctctatggctgccgggagtccctcatagatggcatcaagcgggccacagatgtgatgattgccggcaaggtagcggtggtagcaggctatggtgatgtgggcaagggctgtgcccaggccctgcggggtttcggagcccgcgtcatcatcaccgagattgaccccatcaacgcactgcaggctgccatggagggctatgaggtgaccaccatggatgaggcctgtcaggagggcaacatctttgtcaccaccacaggctgtattgacatcatccttggccggcactttgagcagatgaaggatgatgccattgtgtgtaacattggacactttgacgtggagatcgatgtcaagtggctcaacgagaacgccgtggagaaggtgaacatcaagccgcaggtggaccggtatcggttgaagaatgggcgccgcatcatcctgctggccgagggtcggctggtcaacctgggttgtgccatgggccaccccagcttcgtgatgagtaactccttcaccaaccaggtgatggcgcagatcgagctgtggacccatccagacaagtaccccgttggggttcatttcctgcccaagaagctggatgaggcagtggctgaagcccacctgggcaagctgaatgtgaagttgaccaagctaactgagaagcaagcccagtacctgggcatgtcctgtgatggccccttcaagccggatcactaccgctactgagagccaggtctgcgtttcaccctccagctgctgtccttgcccaggccccacctctcctccctaagagctaatggcaccaactttgtgattggtttgtcagtgtcccccatcgactctctggggctgatcacttagtttttggcctctgctgcagccgtcatactgttccaaatgtggcagcgggaacagagtaccctcttcaagccccggtcatgatggaggtcccagccacagggaaccatgagctcagtggtcttggaacagctcactaagtcagtccttccttagcctggaagtcagtagtggagtcacaaagcccatgtgttttgccatctaggccttcacctggtctgtggacttatacctgtgtgcttggtttacaggtccagtggttcttcagcccatgacagatgagaaggggctatattgaagggcaaagaggaactgttgtttgaattttcctgagagcctggcttagtgctgggccttctcttaaacctcattacaatgaggttagtacttttagtccctgttttacaggggttagaatagactgttaaggggcaactgagaaagaacagagaagtgacagctaggggttgagaggggccagaaaaacatgaatgcaggcagatttcgtgaaatctgccaccactttataaccagatggttcctttcacaaccctgggtcaaaaagagaataatttggcctataatgttaaaagaaagcaggaaggtgggtaaataaaaatcttggtgcctggaaaaaaaaaaaaaaaaaaaaaaaaaaaaaaagggggggggggcaaaaagtttcccaggggggcccaagtataacaggttacccaaggttttcgtgtaacaagggggtgccccctattaggggaggccgaataaaaagagtaggagaccgtggccgggcgttttaaccaacgccggggacctggggaaccaacgtggctacctgtgggaaacctttggagaagaaacccttttccttggggcgggggcaccatagttgggccaaatacaccctacagacgagtttaagcgcctcagggaacattattacacttgcaaaggtttcacgtgtttaccaacgtgtatatgtctggccgatagaaatttggcaccggatatgtttctgcaacttttcg

SEQ ID NO: 448037 - DNA, 2281 bp, Homo sapiens
agatatttaaaggcgtcggcgccacgcgcatatccctgctcggcgctgcccgcccagttcctgttcccagactgaggcccagcccccttcgcccgtttccatcacgagtgccgccagcatgtctgacaaactgccctacaaagtcgccgacatcggcctggctgcctggggacgcaaggccctggacattgctgagaacgagatgccgggcctgatgcgtatgcgggagcggtactcggcctccaagccactgaagggcgcccgcatcgctggctgcctgcacatgaccgtggagacggccgtcctcattgagaccctcgtcaccctgggtgctgaggtgcagtggtccagctgcaacatcttctccacccaggaccatgcggcggctgccattgccaaggctggcattccggtgtatgcctggaagggcgaaacggacgaggagtacctgtggtgcattgagcagaccctgtacttcaaggacgggcccctcaacatgattctggacgacgggggcgacctcaccaacctcatccacaccaagtacccgcagcttctgccaggcatccgaggcatctctgaggagaccacgactggggtccacaacctctacaagatgatggccaatgggatcctcaaggtgcctgccatcaatgtcaatgactccgtcaccaagagcaagtttgacaacctctatggctgccgggagtccctcatagatggcatcaagcgggccacagatgtgatgattgccggcaaggtagcggtggtagcaggctatggtgatgtgggcaagggctgtgcccaggccctgcggggtttcggagcccgcgtcatcatcaccgagattgaccccatcaacgcactgcaggctgccatggagggctatgaggtgaccaccatggatgaggcctgtcaggagggcaacatctttgtcaccaccacaggctgtattgacatcatccttggccggtaggtgccagatggggggtcccggggagtgagggaggagggcagagttgggacagctttctgtccctgacaatctcccacggtcttgggctgcctgagcactttgagcagatgaaggatgatgccattgtgtgtaacattggacactttgacgtggagatcgatgtcaagtggctcaacgagaacgccgtggagaaggtgaacatcaagccgcaggtggaccggtatcggttgaagaatgggcgccgcatcatcctgctggccgagggtcggctggtcaacctgggttgtgccatgggccaccccagcttcgtgatgagtaactccttcaccaaccaggtgatggcgcagatcgagctgtggacccatccagacaagtaccccgttggggttcatttcctgcccaagaagctggatgaggcagtggctgaagcccacctgggcaagctgaatgtgaagttgaccaagctaactgagaagcaagcccagtacctgggcatgtcctgtgatggccccttcaagccggatcactaccgctactgagagccaggtctgcgtttcaccctccagctgctgtccttgcccaggccccacctctcctccctaagagctaatggcaccaactttgtgattggtttgtcagtgtcccccatcgactctctggggctgatcacttagtttttggcctctgctgcagccgtcatactgttccaaatgtggcagcgggaacagagtaccctcttcaagccccggtcatgatggaggtcccagccacagggaaccatgagctcagtggtcttggaacagctcactaagtcagtccttccttagcctggaagtcagtagtggagtcacaaagcccatgtgttttgccatctaggccttcacctggtctgtggacttatacctgtgtgcttggtttacaggtccagtggttcttcagcccatgacagatgagaaggggctatattgaagggcaaagaggaactgttgtttgaattttcctgagagcctggcttagtgctgggccttctcttaaacctcattacaatgaggttagtacttttagtccctgttttacaggggttagaatagactgttaaggggcaactgagaaagaacagagaagtgacagctaggggttgagaggggccagaaaaacatgaatgcaggcagatttcgtgaaatctgccaccactttataaccagatggttcctttcacaaccctgggtcaaaaagagaataatttggcctataatgttaaaagaaagcaggaaggtgggtaaataaaaatcttggtgcctggaa

SEQ ID NO: 448038 - DNA, 2021 bp, Homo sapiens
agatatttaaaggcgtcggcgccacgcgcatatccctgctcggcgctgcccgcccagttcctgttcccagactgaggcccagcccccttcgcccgtttccatcacgagtgccgccagcatgtctgacaaactgccctacaaagtcgccgacatcggcctggctgcctggggacgcaaggccctggacattgctgagaacgagatgccgggcctgatgcgtatgcgggagcggtactcggcctccaagccactgaagggcgcccgcatcgctggctgcctgcacatgaccgtggagacggccgtcctcattgagaccctcgtcaccctgggtgctgaggtgcagtggtccagctgcaacatcttctccacccaggaccatgcggcggctgccattgccaaggctggcattccggtgtatgcctggaagggcgaaacggacgaggagtacctgtggtgcattgagcagaccctgtacttcaaggacgggcccctcaacatgattctggacgacgggggcgacctcaccaacctcatccacaccaagtacccgcagcttctgccaggcatccgaggcatctctgaggagaccacgactggggtccacaacctctacaagatgatggccaatgggatcctcaaggtgcctgccatcaatgtcaatgactccgtcaccaagagcaagtttgacaacctctatggctgccgggagtccctcatagatggcatcaagcgggccacagatgtgatgattgccggcaaggtagcggtggtagcaggctatggtgatgtgggcaagggctgtgcccaggccctgcggggtttcggagcccgcgtcatcatcaccgagattgaccccatcaacgcactgcaggctgccatggagggctatgaggtgaccaccatggatgaggcctgtcaggagggcaacatctttgtcaccaccacaggctgtattgacatcatccttggccggcactttgagcagatgaaggatgatgccattgtgtgtaacattggacactttgacgtggagatcgatgtcaagtggctcaacgagaacgccgtggagaaggtgaacatcaagccgcaggtggaccggtatcggttgaagaatgggcgccgcatcatcctgctggccgagggtcggctggtcaacctgggttgtgccatgggccaccccagcttcgtgatgagtaactccttcaccaaccaggtgatggcgcagatcgagctgtggacccatccagacaagtaccccgttggggttcatttcctgcccaagaagctggatgaggcagtggctgaagcccacctgggcaagctgaatgtgaagttgaccaagctaactgagaagcaagcccagtacctgggcatgtcctgtgatggccccttcaagccggatcactaccgctactgagagccaggtctgcgtttcaccctccagctgctgtccttgcccaggccccacctctcctccctaagagctaatggcaccaactttgtgattggtttgtcagtgtcccccatcgactctctggggctgatcacttagtttttggcctctgctgcagccgtcatactgttccaaatgtggcagcgggaacagagtaccctcttcaagccccggtcatgatggaggtcccagccacagggaaccatgagctcagtggtcttggaacagctcactaagtcagtccttccttagcctggaagtcagtagtggagtcacaaagcccatgtgttttgccatctaggccttcacctggtctgtggacttatacctgtgtgcttggtttacaggtccagtggttcttcagcccatgacagatgagaaggggctatattgaagggcaaagaggaactgttgtttgaattttcctgagagcctggcttagtgctgggccttctcttaaacctcattacaatgaggttagtacttttagtccctgttttacaggggttagaatagactgttacccttggggctaaggcccttggggcttataggacctgtcttaagg

SEQ ID NO: 448039 - DNA, 2072 bp, Homo sapiens
cggacgcgtgggtcgacccacgcgtcgcaaagtcgccgacatcggcctggctgcctggggacgcaaggccctggacattgctgagaacgagatgccgggcctgatgcgtatgcgggagcggtactcggcctccaagccactgaagggcgcccgcatcgctggctgcctgcacatgaccgtggagacggccgtcctcattgagaccctcgtcaccctgggtgctgaggtgcagtggtccagctgcaacatcttctccacccaggaccatgcggcggctgccattgccaaggctggcattccggtgtatgcctggaagggcgaaacggacgaggagtacctgtggtgcattgagcagaccctgtacttcaaggacgggcccctcaacatgattctggacgacgggggcgacctcaccaacctcatccacaccaagtacccgcagcttctgccaggcatccgaggcatctctgaggagaccacgactggggtccacaacctctacaagatgatggccaatgggatcctcaaggtgcctgccatcaatgtcaatgactccgtcaccaagagcaagtttgacaacctctatggctgccgggagtccctcatagatggcatcaagcgggccacagatgtgatgattgccggcaaggtagcggtggtagcaggctatggtgatgtgggcaagggctgtgcccaggccctgcggggtttcggagcccgcgtcatcatcaccgagattgaccccatcaacgcactgcaggctgccatggagggctatgaggtgaccaccatggatgaggcctgtcaggagggcaacatctttgtcaccaccacaggctgtattgacatcatccttggccggcactttgagcagatgaaggatgatgccattgtgtgtaacattggacactttgacgtggagatcgatgtcaagtggctcaacgagaacgccgtggagaaggtgaacatcaagccgcaggtggaccggtatcggttgaagaatgggcgccgcatcatcctgctggccgagggtcggctggtcaacctgggttgtgccatgggccaccccagcttcgtgatgagtaactccttcaccaaccaggtgatggcgcagatcgagctgtggacccatccagacaagtaccccgttggggttcatttcctgcccaagaagctggatgaggcagtggctgaagcccacctgggcaagctgaatgtgaagttgaccaagctaactgagaagcaagcccagtacctgggcatgtcctgtgatggccccttcaagccggatcactaccgctactgagagccaggtctgcgtttcaccctccagctgctgtccttgcccaggccccacctctcctccctaagagctaatggcaccaactttgtgattggtttgtcagtgtcccccatcgactctctggggctgatcacttagtttttggcctctgctgcagccgtcatactgttccaaatgtggcagcgggaacagagtaccctcttcaagccccggtcatgatggaggtcccagccacagggaaccatgagctcagtggtcttggaacagctcactaagtcagtccttccttagcctggaagtcagtagtggagtcacaaagcccatgtgttttgccatctaggccttcacctggtctgtggacttatacctgtgtgcttggtttacaggtccagtggttcttcagcccatgacagatgagaaggggctatattgaagggcaaagaggaactgttgtttgaattttcctgagagcctggcttagtgctgggccttctcttaaacctcattacaatgaggttagtacttttagtccctgttttacaggggttagaatagactgttaaggggcaactgagaaagaacagagaagtgacagctaggggttgagaggggccagaaaaacatgaatgcaggcagatttcgtgaaatctgccaccactttataaccagatggttcctttcacaaccctgggtcaaaaagagaataatttggcctataatgttaaaagaaagcaggaaggtgggtaaataaaaatcttggtgcctggaa

SEQ ID NO: 448040 - DNA, 2070 bp, Homo sapiens
agatatttaaaggcgtcggcgccacgcgcatatccctgctcggcgctgcccgcccagttcctgttcccagactgaggcccagcccccttcgcccgtttccatcacgagtgccgccagcatgtctgacaaactgccctacaaagtcgccgacatcggcctggctgcctggggacgcaaggccctggacattgctgagaacgagatgccgggcctgatgcgtatgcgggagcggtactcggcctccaagccactgaagggcgcccgcatcgctggctgcctgcacatgaccgtggagacggccgtcctcattgagaccctcgtcaccctgggtgctgaggtgcagtggtccagctgcaacatcttctccacccaggaccatgcggcggctgccattgccaaggctggcattccggtgtatgcctggaagggcgaaacggacgaggagtacctgtggtgcattgagcagaccctgtacttcaaggacgggcccctcaacatgattctggacgacgggggcgacctcaccaacctcatccacaccaagtacccgcagcttctgccaggcatccgaggcatctctgaggagaccacgactggggtccacaacctctacaagatgatggccaatgggatcctcaaggtgcctgccatcaatgtcaatgactccgtcaccaagagcaagtttgacaacctctatggctgccgggagtccctcatagatggcatcaagcgggccacagatgtgatgattgccggcaaggtagcggtggtagcaggctatggtgatgtgggcaagggctgtgcccaggccctgcggggtttcggagcccgcgtcatcatcaccgagattgaccccatcgcactttgagcagatgaaggatgatgccattgtgtgtaacattggacactttgacgtggagatcgatgtcaagtggctcaacgagaacgccgtggagaaggtgaacatcaagccgcaggtggaccggtatcggttgaagaatgggcgccgcatcatcctgctggccgagggtcggctggtcaacctgggttgtgccatgggccaccccagcttcgtgatgagtaactccttcaccaaccaggtgatggcgcagatcgagctgtggacccatccagacaagtaccccgttggggttcatttcctgcccaagaagctggatgaggcagtggctgaagcccacctgggcaagctgaatgtgaagttgaccaagctaactgagaagcaagcccagtacctgggcatgtcctgtgatggccccttcaagccggatcactaccgctactgagagccaggtctgcgtttcaccctccagctgctgtccttgcccaggccccacctctcctccctaagagctaatggcaccaactttgtgattggtttgtcagtgtcccccatcgactctctggggctgatcacttagtttttggcctctgctgcagccgtcatactgttccaaatgtggcagcgggaacagagtaccctcttcaagccccggtcatgatggaggtcccagccacagggaaccatgagctcagtggtcttggaacagctcactaagtcagtccttccttagcctggaagtcagtagtggagtcacaaagcccatgtgttttgccatctaggccttcacctggtctgtggacttatacctgtgtgcttggtttacaggtccagtggttcttcagcccatgacagatgagaaggggctatattgaagggcaaagaggaactgttgtttgaattttcctgagagcctggcttagtgctgggccttctcttaaacctcattacaatgaggttagtacttttagtccctgttttacaggggttagaatagactgttaaggggcaactgagaaagaacagagaagtgacagctaggggttgagaggggccagaaaaacatgaatgcaggcagatttcgtgaaatctgccaccactttataaccagatggttcctttcacaaccctgggtcaaaaagagaataatttggcctataatgttaaaagaaagcaggaaggtgggtaaataaaaatcttggtgcctggaa

SEQ ID NO: 448041 - DNA, 1646 bp, Homo sapiens
ccacaaccgaattagctaggtacgaggcatccgaggcatctctgaggagaccacgactggggtccacaacctctacaagatgatggccaatgggatcctcaaggtgcctgccatcaatgtcaatgactccgtcaccaagagcaagtttgacaacctctatggctgccgggagtccctcatagatggcatcaagcgggccacagatgtgatgattgccggcaaggtagcggtggtagcaggctatggtgatgtgggcaagggctgtgcccaggccctgcggggtttcggagcccgcgtcatcatcaccgagattgaccccatcaacgcactgcaggctgccatggagggctatgaggtgaccaccatggatgaggcctgtcaggagggcaacatctttgtcaccaccacaggctgtattgacatcatccttggccggcactttgagcagatgaaggatgatgccattgtgtgtaacattggacactttgacgtggagatcgatgtcaagtggctcaacgagaacgccgtggagaaggtgaacatcaagccgcaggtggaccggtatcggttgaagaatgggcgccgcatcatcctgctggccgagggtcggctggtcaacctgggttgtgccatgggccaccccagcttcgtgatgagtaactccttcaccaaccaggtgatggcgcagatcgagctgtggacccatccagacaagtaccccgttggggttcatttcctgcccaagaagctggatgaggcagtggctgaagcccacctgggcaagctgaatgtgaagttgaccaagctaactgagaagcaagcccagtacctgggcatgtcctgtgatggccccttcaagccggatcactaccgctactgagagccaggtctgcgtttcaccctccagctgctgtccttgcccaggccccacctctcctccctaagagctaatggcaccaactttgtgattggtttgtcagtgtcccccatcgactctctggggctgatcacttagtttttggcctctgctgcagccgtcatactgttccaaatgtggcagcgggaacagagtaccctcttcaagccccggtcatgatggaggtcccagccacagggaaccatgagctcagtggtcttggaacagctcactaagtcagtccttccttagcctggaagtcagtagtggagtcacaaagcccatgtgttttgccatctaggccttcacctggtctgtggacttatacctgtgtgcttggtttacaggtccagtggttcttcagcccatgacagatgagaaggggctatattgaagggcaaagaggaactgttgtttgaattttcctgagagcctggcttagtgctgggccttctcttaaacctcattacaatgaggttagtacttttagtccctgttttacaggggttagaatagactgttaaggggcaactgagaaagaacagagaagtgacagctaggggttgagaggggccagaaaaacatgaatgcaggcagatttcgtgaaatctgccaccactttataaccagatggttcctttcacaaccctgggtcaaaaagagaataatttggcctataatgttaaaagaaagcaggaaggtgggtaaataaaaatcttggtgcctggaa

SEQ ID NO: 448042 - DNA, 1811 bp, Homo sapiens
agatatttaaaggcgtcggcgccacgcgcatatccctgctcggcgctgcccgcccagttcctgttcccagactgaggcccagcccccttcgcccgtttccatcacgagtgccgccagcatgtctgacaaactgccctacaaagtcgccgacatcggcctggctgcctggggacgcaaggccctggacattgctgagaacgagatgccgggcctgatgcgtatgcgggagcggtactcggcctccaagccactgaagggcgcccgcatcgctggctgcctgcacatgaccgtggagacggccgtcctcattgagaccctcgtcaccctgggtgctgaggtgcagtggtccagctgcaacatcttctccacccaggaccatgcggcggctgccattgccaaggctggcattccggtgtatgcctggaagggcgaaacggacgaggagtacctgtggtgcattgagcagaccctgtacttcaaggacgggcccctcaacatgattctggacgacgggggcgacctcaccaacctcatccacaccaagtacccgcagcttctgccaggcatccgaggcatctctgaggagaccacgactggggtccacaacctctacaagatgatggccaatgggatcctcaaggtgcctgccatcaatgtcaatgactccgtcaccaagagcaagtttgacaacctctatggctgccgggagtccctcatagatggcatcaagcgggccacagatgtgatgattgccggcaaggtagcggtggtagcaggctatggtgatgtgggcaagggctgtgcccaggccctgcggggtttcggagcccgcgtcatcatcaccgagattgaccccatcaacgcactgcaggctgccatggagggctatgaggtgaccaccatggatgaggcctgtcaggagggcaacatctttgtcaccaccacaggctgtattgacatcatccttggccggcactttgagcagatgaaggatgatgccattgtgtgtaacattggacactttgacgtggagatcgatgtcaagtggctcaacgagaacgccgtggagaaggtgaacatcaagccgcaggtggaccggtatcggttgaagaatgggcgccgcatcatcctgctggccgagggtcggctggtcaacctgggttgtgccatgggccaccccagcttcgtgatgagtaactccttcaccaaccaggtgatggcgcagatcgagctgtggacccatccagacaagtaccccgttggggttcatttcctgcccaagaagctggatgaggcagtggctgaagcccacctgggcaagctgaatgtgaagttgaccaagctaactgagaagcaagcccagtacctgggcatgtcctgtgatggccccttcaagccggatcactaccgctactgagagccagacaggtccagtggttcttcagcccatgacagatgagaaggggctatattgaagggcaaagaggaactgttgtttgaattttcctgagagcctggcttagtgctgggccttctcttaaacctcattacaatgaggttagtacttttagtccctgttttacaggggttagaatagactgttaaggggcaactgagaaagaacagagaagtgacagctaggggttgagaggggccagaaaaacatgaatgcaggcagatttcgtgaaatctgccaccactttataaccagatggttcctttcacaaccctgggtcaaaaagagaataatttggcctataatgttaaaagaaagcaggaaggtgggtaaataaaaatcttggtgcctggaa

SEQ ID NO: 448043 - DNA, 1891 bp, Homo sapiens
agatatttaaaggcgtcggcgccacgcgcatatccctgctcggcgctgcccgcccagttcctgttcccagactgaggcccagcccccttcgcccgtttccatcacgagtgccgccagcatgtctgacaaactgccctacaaagtcgccgacatcggcctggctgcctggggacgcaaggccctggacattgctgagaacgagatgccgggcctgatgcgtatgcgggagcggtactcggcctccaagccactgaagggcgcccgcatcgctggctgcctgcacatgaccgtggagacggccgtcctcattgagaccctcgtcaccctgggtgctgaggtgcagtggtccagctgcaacatcttctccacccaggaccatgcggcggctgccattgccaaggctggcattccggtgtatgcctggaagggcgaaacggacgaggagtacctgtggtgcattgagcagaccctgtacttcaaggacgggcccctcaacatgattctggacgacgggggcgacctcaccaacctcatccacaccaagtacccgcagcttctgccaggcatccgaggcatctctgaggagaccacgactggggtccacaacctctacaagatgatggccaatgggatcctcaaggtgcctgccatcaatgtcaatgactccgtcaccaagagcaagtttgacaacctctatggctgccgggagtccctcatagatggcatcaagcgggccacagatgtgatgattgccggcaaggtagcggtggtagcaggctatggtgatgtgggcaagggctgtgcccaggccctgcggggtttcggagcccgcgtcatcatcaccgagattgaccccatcaacgcactgcaggctgccatggagggctatgaggtgaccaccatggatgaggcctgtcaggagggcaacatctttgtcaccaccacaggctgtattgacatcatccttggccggcactttgagcagatgaaggatgatgccattgtgtgtaacattggacactttgacgtggagatcgatgtcaagtggctcaacgagaacgccgtggagaaggtgaacatcaagccgcaggtggaccggtatcggttgaagaatgggcgccgcatcatcctgctggccgagggtcggctggtcaacctgggttgtgccatgggccaccccagcttcgtgatgagtaactccttcaccaaccaggtgatggcgcagatcgagctgtggacccatccagacaagtaccccgttggggttcatttcctgcccaagaagctggatgaggcagtggctgaagcccacctgggcaagctgaatgtgaagttgaccaagctaactgagaagcaagcccagtacctgggcatgtcctgtgatggccccttcaagccggatcactaccgctactgagagccagaaggcggagccaggtgtacggggtggaacatgaaagcggaccaggagcgtgaccgctgaagcacagcatcacagggagatggtcaggcctctggaggctgcgggtgggcctgactgatgtcaggccttccacaagaggtggtggagcagagtcttctctaactcccccggggaaagggagactccctttctcggtctgctaagtaaccggtgccttcccgagcactgatgctaccactagaccaaggtccactaggtaatgggtgccttcccaggtgctggcattactgctagaccaggaagccctctagtggccctgtccgggcgtaacagagggctcacactcttgtcttctggtcacttgctcaccgtgtcccttcagctcctatctctgtatggcctggtttttcctaggttataattgtagaacaaagattattataatattggaataaagagtaatgctac

SEQ ID NO: 448044 - DNA, 2081 bp, Homo sapiens
agatatttaaaggcgtcggcgccacgcgcatatccctgctcggcgctgcccgcccagttcctgttcccagactgaggcccagcccccttcgcccgtttccatcacgagtgccgccagcatgtctgacaaactgccctacaaagtcgccgacatcggcctggctgcctggggacgcaaggccctggacattgctgagaacgagatgccgggcctgatgcgtatgcgggagcggtactcggcctccaagccactgaagggcgcccgcatcgctggctgcctgcacatgaccgtggagacggccgtcctcattgagaccctcgtcaccctgggtgctgaggtgcagtggtccagctgcaacatcttctccacccaggaccatgcggcggctgccattgccaaggctggcattccggtgtatgcctggaagggcgaaacggacgaggagtacctgtggtgcattgagcagaccctgtacttcaaggacgggcccctcaacatgattctggacgacgggggcgacctcaccaacctcatccacaccaagtacccgcagcttctgccaggcatccgaggcatctctgaggagaccacgactggggtccacaacctctacaagatgatggccaatgggatcctcaaggtgcctgccatcaatgtcaatgactccgtcaccaagagcaagtttgacaacctctatggctgccgggagtccctcatagatggcatcaagcgggccacagatgtgatgattgccggcaaggtagcggtggtagcaggctatggtgatgtgggcaagggctgtgcccaggccctgcggggtttcggagcccgcgtcatcatcaccgagattgaccccatcaacgcactgcaggctgccatggagggctatgaggtgaccaccatggatgaggcctgtcaggagggcaacatctttgtcaccaccacaggctgtattgacatcatccttggccggcactttgagcagatgaaggatgatgccattgtgtgtaacattggacactttgacgtggagatcgatgtcaagtggctcaacgagaacgccgtggagaaggtgaacatcaagccgcaggtggaccggtatcggttgaagaatgggcgccgcatcatcctgctggccgagggtcggctggtcaacctgggttgtgccatgggccaccccagcttcgtgatgagtaactccttcaccaaccaggtgatggcgcagatcgagctgtggacccatccagacaagtaccccgttggggttcatttcctgcccaagaagctggatgaggcagtggctgaagcccacctgggcaagctgaatgtgaagttgaccaagctaactgagaagcaagcccagtacctgggcatgtcctgtgatggccccttcaagccggatcactaccgctactgagagccagccctgccaagcaccaatggccagagacctgggggttcttggtaaagctcatccctgtgaaggacagtgaacacagatcaagaagtatcagctggaccccagcatggaggagcaactgcagacttcagcagactcattcaggtcaatcacttgatgtggcctcttactggcaacattagccatggattttgtacccttaggagctatgatgaaaaaaacaacacaagattaaatcaaatgcgagagaaaataatgtgcaaacaagagatgcggtaaacatgaaatatatgaggatactgtgggtataacatgacatactgttttacagtaaactgtttgttgttgtttttgttgttgtttttctgagtctcgctctgtcacccaggctggagtacagtggcgcaatctcggctcactgcaacctctgcctcctgggttcaaatgattctcctggctcagcctcagcctcagcctcccgagtagctgggattataggcgcctgccaccacgcccggcgaatttttgtatttttagtagagatggggtttcgccatgttggtcaggctggtttataggaccactgtcatatatgcagtccgtcatatacacttgggcaacagagtgaggaagaaagaaaggaaagaaaggaaggaaggaa

SEQ ID NO: 448045 - DNA, 1190 bp, Homo sapiens
  misc_feature (998)..(998): n is a, c, g, or t
  misc_feature (1000)..(1002): n is a, c, g, or t
  misc_feature (1004)..(1004): n is a, c, g, or t
  misc_feature (1008)..(1008): n is a, c, g, or t
  misc_feature (1018)..(1018): n is a, c, g, or t
  misc_feature (1028)..(1028): n is a, c, g, or t
  misc_feature (1032)..(1032): n is a, c, g, or t
agatatttaaaggcgtcggcgccacgcgcatatccctgctcggcgctgcccgcccagttcctgttcccagactgaggcccagcccccttcgcccgtttccatcacgagtgccgccagcatgtctgacaaactgccctacaaagtcgccgacatcggcctggctgcctggggacgcaaggccctggacattgctgagaacgagatgccgggcctgatgcgtatgcgggagcggtactcggcctccaagccactgaagggcgcccgcatcgctggctgcctgcacatgaccgtggagacggccgtcctcattgagaccctcgtcaccctgggtgctgaggtgcagtggtccagctgcaacatcttctccacccaggaccatgcggcggctgccattgccaaggctggcattccggtgtatgcctggaagggcgaaacggacgaggagtacctgtggtgcattgagcagaccctgtacttcaaggacgggcccctcaacatgattctggacgacgggggcgacctcaccaacctcatccacaccaagtacccgcagcttctgccaggcatccgaggcatctctgaggagaccacgactggggtccacaacctctacaagatgatggccaatgggatcctcaaggtgcctgccatcaatgtcaatgactccgtcaccaagagcaagtttgacaacctctatggctgccgggagtccctcatagatggcatcaagcgggccacagatgtgatgattgccggcaaggtagcggtggtagcaggctatggtgatgtgggcaagggctgtgcccaggccctgcggggtttcggagcccgcgtcatcatcaccgagattgaccccatcaacgcactgcaggctgccatggagggctatgaggtgaccaccatggatgaggcctgtcaggagggcaacatctttgtcaccaccacaggctgtattgacatcatccttggccgcctttgagcgttgagttgtgccttgngnnncntggnccttgccggngatcgggcantggncacgggacgcgggggagggactccagcccgggacgcctcggtgaaggggccgctccgtggcgggcgggcccggggcggcccctggggactccccacgtggcgcggtgccccacccgggttccacgtgggggccggtggtcaacctggccccccgcgct

SEQ ID NO: 448046 - DNA, 1336 bp, Homo sapiens
agatatttaaaggcgtcggcgccacgcgcatatccctgctcggcgctgcccgcccagttcctgttcccagactgaggcccagcccccttcgcccgtttccatcacgagtgccgccagcatgtctgacaaactgccctacaaagtcgccgacatcggcctggctgcctggggacgcaaggccctggacattgctgagaacgagatgccgggcctgatgcgtatgcgggagcggtactcggcctccaagccactgaagggcgcccgcatcgctggctgcctgcacatgaccgtggagacggccgtcctcattgagaccctcgtcaccctgggtgctgaggtgcagtggtccagctgcaacatcttctccacccaggaccatgcggcggctgccattgccaaggctggcattccggtgtatgcctggaagggcgaaacggacgaggagtacctgtggtgcattgagcagaccctgtacttcaaggacgggcccctcaacatgattctggacgacgggggcgacctcaccaacctcatccacaccaagtacccgcagcttctgccaggcatccgaggcatctctgaggagaccacgactggggtccacaacctctacaagatgatggccaatgggatcctcaaggtgcctgccatcaatgtcaatgactccgtcaccaagagcaagtttgacaacctctatggctgccgggagtccctcatagatggcatcaagcgggccacagatgtgatgattgccggcaaggtagcggtggtagcaggctatggtgatgtgggcaagggctgtgcccaggccctgcggggtttcggagcccgcgtcatcatcaccgagattgaccccatcaacgcactgcaggctgccatggagggctatgaggtgaccaccatggatgaggcctgtcaggagggcaacatctttgtcaccaccacaggctgtattgacatcatccttggccggtaggtgccagatggggggtcccggggagtgagggaggagggcagagttgggacagctttctgtccctgacaatctcccacggtcttgggctgcctgagcactttgagcagatgaaggatgatgccattgtgtgtaacattggacactttgacgtggagatcgatgtcaagtggctcaacgagaacgccgtggagaaggtgaacatcaagccgcaggtgagaagctcccgccttgccagtgggctgggcagatgggagtgcagaggagtgctggctgccagggaggagagctgaggagatggtggcaacctgtgcagggggatggggagaagagggcctagcatcagagccagccagacgtggc

SEQ ID NO: 448047 - DNA, 824 bp, Homo sapiens
  misc_feature (34)..(34): n is a, c, g, or t
gcgcggaccccaagaccttaagcccaagggtccntagccggatcactaccgctactgagagccaggtctgcgtttcaccctccagctgctgtccttgcccaggccccacctctcctccctaagagctaatggcaccaactttgtgattggtttgtcagtgtcccccatcgactctctggggctgatcacttagtttttggcctctgctgcagccgtcatactgttccaaatgtggcagcgggaacagagtaccctcttcaagccccggtcatgatggaggtcccagccacagggaaccatgagctcagtggtcttggaacagctcactaagtcagtccttccttagcctggaagtcagtagtggagtcacaaagcccatgtgttttgccatctaggccttcacctggtctgtggacttatacctgtgtgcttggtttacaggtccagtggttcttcagcccatgacagatgagaaggggctatattgaagggcaaagaggaactgttgtttgaattttcctgagagcctggcttagtgctgggccttctcttaaacctcattacaatgaggttagtacttttagtccctgttttacaggggttagaatagactgttaaggggcaactgagaaagaacagagaagtgacagctaggggttgagaggggccagaaaaacatgaatgcaggcagatttcgtgaaatctgccaccactttataaccagatggttcctttcacaaccctgggtcaaaaagagaataatttggcctataatgttaaaagaaagcaggaaggtgggtaaataaaaatcttggtgcctggaa

SEQ ID NO: 448048 - DNA, 822 bp, Homo sapiens
tcttcgcgactctgaggatcccccaggtccttaagccggatcactaccgctactgagagccaggtctgcgtttcaccctccagctgctgtccttgcccaggccccacctctcctccctaagagctaatggcaccaactttgtgattggtttgtcagtgtcccccatcgactctctggggctgatcacttagtttttggcctctgctgcagccgtcatactgttccaaatgtggcagcgggaacagagtaccctcttcaagccccggtcatgatggaggtcccagccacagggaaccatgagctcagtggtcttggaacagctcactaagtcagtccttccttagcctggaagtcagtagtggagtcacaaagcccatgtgttttgccatctaggccttcacctggtctgtggacttatacctgtgtgcttggtttacaggtccagtggttcttcagcccatgacagatgagaaggggctatattgaagggcaaagaggaactgttgtttgaattttcctgagagcctggcttagtgctgggccttctcttaaacctcattacaatgaggttagtacttttagtccctgttttacaggggttagaatagactgttaaggggcaactgagaaagaacagagaagtgacagctaggggttgagaggggccagaaaaacatgaatgcaggcagatttcgtgaaatctgccaccactttataaccagatggttcctttcacaaccctgggtcaaaaagagaataatttggcctataatgttaaaagaaagcaggaaggtgggtaaataaaaatcttggtgcctggaa

SEQ ID NO: 448049 - DNA, 654 bp, Homo sapiens
  misc_feature (34)..(34): n is a, c, g, or t
atcgagctcggctaccatccccactgtgtgctcngtttacaggtccagtggtttcagcccatgacagatgagaaggggctatattgaagggcaaagaggaactgtggaggtcccagccacagggaaccatgagctcagtggtcttggaacagctcactaagtcagtccttccttagcctggaagtcagtagtggagtcacaaagcccatgtgttttgccatctaggccttcacctggtctgtggacttatacctgtgtgcttggtttacaggtccagtggttcttcagcccatgacagatgagaaggggctatattgaagggcaaagaggaactgttgtttgaattttcctgagagcctggcttagtgctgggccttctcttaaacctcattacaatgaggttagtacttttagtccctgttttacaggggttagaatagactgttaaggggcaactgagaaagaacagagaagtgacagctaggggttgagaggggccagaaaaacatgaatgcaggcagatttcgtgaaatctgccaccactttataaccagatggttcctttcacaaccctgggtcaaaaagagaataatttggcctataatgttaaaagaaagcaggaaggtgggtaaataaaaatcttggtgcctggaa

SEQ ID NO: 448050 - DNA, 588 bp, Homo sapiens
catcttcagttcttagaactgggacttaatggcaagctgggtcaaatgttctaggatggacccacgtgatgccgtgcagagtgatttggtcaacagtccaaagttaatgatccacaagtcagtagtggagtcacaaagcccatgtgttttgccatctaggccttcacctggtctgtggacttatacctgtgtgcttggtttacaggtccagtggttcttcagcccatgacagatgagaaggggctatattgaagggcaaagaggaactgttgtttgaattttcctgagagcctggcttagtgctgggccttctcttaaacctcattacaatgaggttagtacttttagtccctgttttacaggggttagaatagactgttaaggggcaactgagaaagaacagagaagtgacagctaggggttgagaggggccagaaaaacatgaatgcaggcagatttcgtgaaatctgccaccactttataaccagatggttcctttcacaaccctgggtcaaaaagagaataatttggcctataatgttaaaagaaagcaggaaggtgggtaaataaaaatcttggtgcctggaa

SEQ ID NO: 448051 - DNA, 455 bp, Homo sapiens
tcagctcgaccacatatgctccaccgctccggcgactgattgatattctaaccctgttctctttagtcacaggtccagtggttcttcagcccatgacagatgagaaggggctatattgaagggcaaagaggaactgttgtttgaattttcctgagagcctggcttagtgctgggccttctcttaaacctcattacaatgaggttagtacttttagtccctgttttacaggggttagaatagactgttaaggggcaactgagaaagaacagagaagtgacagctaggggttgagaggggccagaaaaacatgaatgcaggcagatttcgtgaaatctgccaccactttataaccagatggttcctttcacaaccctgggtcaaaaagagaataatttggcctataatgttaaaagaaagcaggaaggtgggtaaataaaaatcttggtgcctggaa

SEQ ID NO: 448052 - DNA, 633 bp, Homo sapiens
agatatttaaaggcgtcggcgccacgcgcatatccctgctcggcgctgcccgcccagttcctgttcccagactgaggcccagcccccttcgcccgtttccatcacgagtgccgccagcatgtctgacaaactgccctacaaagtcgccgacatcggcctggctgcctggggacgcaaggccctggacattgctgagaacgagatgccgggcctgatgcgtatgcgggagcggtactcggcctccaagccactgaagggcgcccgcatcgctggctgcctgcacatgaccgtggagacggccgtcctcattgagaccctcgtcaccctgggtgctgaggtgcagtggtccagctgcaacatcttctccacccaggaccatgcggcggctgccattgccaaggctggcattccggtgtatgcctggaagggcgaaacggacgaggagtacctgtggtgcattgagcagaccctgtacttcaaggacgggcccctcaacatgattctggacgacgggggcgacctcaccaacctcatccgtttcgcccttccaggcatacaccggaatgccagccttggcaatggcagccgccgcatggtcctgggtggagaagatgttgcacagtcaccctgcac

SEQ ID NO: 448053 - DNA, 2183 bp, Homo sapiens
agatatttaaaggcgtcggcgccacgcgcatatccctgctcggcgctgcccgcccagttcctgttcccagactgaggcccagcccccttcgcccgtttccatcacgagtgccgccagcatgtctgacaaactgccctacaaagtcgccgacatcggcctggctgcctggggacgcaaggccctggacattgctgagaacgagatgccgggcctgatgcgtatgcgggagcggtactcggcctccaagccactgaagggcgcccgcatcgctggctgcctgcacatgaccgtggagacggccgtcctcattgagaccctcgtcaccctgggtgctgaggtgcagtggtccagctgcaacatcttctccacccaggaccatgcggcggctgccattgccaaggctggcattccggtgtatgcctggaagggcgaaacggacgaggagtacctgtggtgcattgagcagaccctgtacttcaaggacgggcccctcaacatgattctggacgacgggggcgacctcaccaacctcatccacaccaagtacccgcagcttctgccaggcatccgaggcatctctgaggagaccacgactggggtccacaacctctacaagatgatggccaatgggatcctcaaggtgcctgccatcaatgtcaatgactccgtcaccaagagcaagtttgacaacctctatggctgccgggagtccctcatagatggcatcaagcgggccacagatgtgatgattgccggcaaggtagcggtggtagcaggctatggtgatgtgggcaagggctgtgcccaggccctgcggggtttcggagcccgcgtcatcatcaccgagattgaccccatcaacgcactgcaggctgccatggagggctatgaggtgaccaccatggatgaggcctgtcaggagggcaacatctttgtcaccaccacaggctgtattgacatcatccttggccggcactttgagcagatgaaggatgatgccattgtgtgtaacattggacactttgacgtggagatcgatgtcaagtggctcaacgagaacgccgtggagaaggtgaacatcaagccgcaggtggaccggtatcggttgaagaatgggcgccgcatcatcctgctggccgagggtcggctggtcaacctgggttgtgccatgggccaccccagcttcgtgatgagtaactccttcaccaaccaggtgatggcgcagatcgagctgtggacccatccagacaagtaccccgttggggttcatttcctgcccaagaagctggatgaggcagtggctgaagcccacctgggcaagctgaatgtgaagttgaccaagctaactgagaagcaagcccagtacctgggcatgtcctgtgatggccccttcaagccggatcactaccgctactgagagccaggtctgcgtttcaccctccagctgctgtccttgcccaggccccacctctcctccctaagagctaatggcaccaactttgtgattggtttgtcagtgtcccccatcgactctctggggctgatcacttagtttttggcctctgctgcagccgtcatactgttccaaatgtggcagcgggaacagagtaccctcttcaagccccggtcatgatggaggtcccagccacagggaaccatgagctcagtggtcttggaacagctcactaagtcagtccttccttagcctggaagtcagtagtggagtcacaaagcccatgtgttttgccatctaggccttcacctggtctgtggacttatacctgtgtgcttggtttacaggtccagtggttcttcagcccatgacagatgagaaggggctatattgaagggcaaagaggaactgttgtttgaattttcctgagagcctggcttagtgctgggccttctcttaaacctcattacaatgaggttagtacttttagtccctgttttacaggggttagaatagactgttaaggggcaactgagaaagaacagagaagtgacagctaggggttgagaggggccagaaaaacatgaatgcaggcagatttcgtgaaatctgccaccactttataaccagatggttcctttcacaaccctgggtcaaaaagagaataatttggcctataatgttaaaagaaagcaggaaggtgggtaaataaaaatcttggtgcctggaa

SEQ ID NO: 448054 - DNA, 2161 bp, Homo sapiens
cggacgcgtgggtcgacccacgcgtcgcaaagtcgttcctgttcccagactgaggcccagcccccttcgcccgtttccatcacgagtgccgccagcatgtctgacaaactgccctacaaagtcgccgacatcggcctggctgcctggggacgcaaggccctggacattgctgagaacgagatgccgggcctgatgcgtatgcgggagcggtactcggcctccaagccactgaagggcgcccgcatcgctggctgcctgcacatgaccgtggagacggccgtcctcattgagaccctcgtcaccctgggtgctgaggtgcagtggtccagctgcaacatcttctccacccaggaccatgcggcggctgccattgccaaggctggcattccggtgtatgcctggaagggcgaaacggacgaggagtacctgtggtgcattgagcagaccctgtacttcaaggacgggcccctcaacatgattctggacgacgggggcgacctcaccaacctcatccacaccaagtacccgcagcttctgccaggcatccgaggcatctctgaggagaccacgactggggtccacaacctctacaagatgatggccaatgggatcctcaaggtgcctgccatcaatgtcaatgactccgtcaccaagagcaagtttgacaacctctatggctgccgggagtccctcatagatggcatcaagcgggccacagatgtgatgattgccggcaaggtagcggtggtagcaggctatggtgatgtgggcaagggctgtgcccaggccctgcggggtttcggagcccgcgtcatcatcaccgagattgaccccatcaacgcactgcaggctgccatggagggctatgaggtgaccaccatggatgaggcctgtcaggagggcaacatctttgtcaccaccacaggctgtattgacatcatccttggccggcactttgagcagatgaaggatgatgccattgtgtgtaacattggacactttgacgtggagatcgatgtcaagtggctcaacgagaacgccgtggagaaggtgaacatcaagccgcaggtggaccggtatcggttgaagaatgggcgccgcatcatcctgctggccgagggtcggctggtcaacctgggttgtgccatgggccaccccagcttcgtgatgagtaactccttcaccaaccaggtgatggcgcagatcgagctgtggacccatccagacaagtaccccgttggggttcatttcctgcccaagaagctggatgaggcagtggctgaagcccacctgggcaagctgaatgtgaagttgaccaagctaactgagaagcaagcccagtacctgggcatgtcctgtgatggccccttcaagccggatcactaccgctactgagagccaggtctgcgtttcaccctccagctgctgtccttgcccaggccccacctctcctccctaagagctaatggcaccaactttgtgattggtttgtcagtgtcccccatcgactctctggggctgatcacttagtttttggcctctgctgcagccgtcatactgttccaaatgtggcagcgggaacagagtaccctcttcaagccccggtcatgatggaggtcccagccacagggaaccatgagctcagtggtcttggaacagctcactaagtcagtccttccttagcctggaagtcagtagtggagtcacaaagcccatgtgttttgccatctaggccttcacctggtctgtggacttatacctgtgtgcttggtttacaggtccagtggttcttcagcccatgacagatgagaaggggctatattgaagggcaaagaggaactgttgtttgaattttcctgagagcctggcttagtgctgggccttctcttaaacctcattacaatgaggttagtacttttagtccctgttttacaggggttagaatagactgttaaggggcaactgagaaagaacagagaagtgacagctaggggttgagaggggccagaaaaacatgaatgcaggcagatttcgtgaaatctgccaccactttataaccagatggttcctttcacaaccctgggtcaaaaagagaataatttggcctataatgttaaaagaaagcaggaaggtgggtaaataaaaatcttggtgcctggaa

SEQ ID NO: 448055 - DNA, 2267 bp, Homo sapiens
agatatttaaaggcgtcggcgccacgcgcatatccctgctcggcgctgcccgcccagttcctgttcccagactgaggcccagcccccttcgcccgtttccatcacgagtgccgccagcatgtctgacaaactgccctacaaagtcgccgacatcggcctggctgcctggggacgcaaggccctggacattgctgagaacgagatgccgggcctgatgcgtatgcgggagcggtactcggcctccaagccactgaagggcgcccgcatcgctggctgcctgcacatgaccgtggagacggccgtcctcattgagaccctcgtcaccctgggtgctgaggtgcagtggtccagctgcaacatcttctccacccaggaccatgcggcggctgccattgccaaggctggcattccggtgtatgcctggaagggcgaaacggacgaggagtacctgtggtgcattgagcagaccctgtacttcaaggacgggcccctcaacatgattctggacgacgggggcgacctcaccaacctcatccacaccaagtacccgcagcttctgccaggcatccgaggcatctctgaggagaccacgactggggtccacaacctctacaagatgatggccaatgggatcctcaaggtgcctgccatcaatgtcaatgactccgtcaccaagagcaagtttgacaacctctatggctgccgggagtccctcatagatggcatcaagcgggccacagatgtgatgattgccggcaaggtagcggtggtagcaggctatggtgatgtgggcaagggctgtgcccaggccctgcggggtttcggagcccgcgtcatcatcaccgagattgaccccatcaacgcactgcaggctgccatggagggctatgaggtgaccaccatggatgaggcctgtcaggagggcaacatctttgtcaccaccacaggctgtattgacatcatccttggccggcactttgagcagatgaaggatgatgccattgtgtgtaacattggacactttgacgtggagatcgatgtcaagtggctcaacgagaacgccgtggagaaggtgaacatcaagccgcaggtggaccggtatcggttgaagaatgggcgccgcatcatcctgctggccgagggtcggctggtcaacctgggttgtgccatgggccaccccagcttcgtgatgagtaactccttcaccaaccaggtgatggcgcagatcgagctgtggacccatccagacaagtaccccgttggggttcatttcctgcccaagaagctggatgaggcagtggctgaagcccacctgggcaagctgaatgtgaagttgaccaagctaactgagaagcaagcccagtacctgggcatgtcctgtgatggccccttcaagccggatcactaccgctactgagagccaggtctgcgtttcaccctccagctgctgtccttgcccaggccccacctctcctccctaagagctaatggcaccaactttgtgattggtttgtcagtgtcccccatcgactctctggggctgatcacttagtttttggcctctgctgcagccgtcatactgttccaaatgtggcagcgggaacagagtaccctcttcaagccccggtcatgatggaggtcccagccacagggaaccatgagctcagtggtcttggaacagctcactaagtcagtccttccttagcctggaagtcagtagtggagtcacaaagcccatgtgttttgccatctaggccttcacctggtctgtggacttatacctgtgtgcttggtttacaggtccagtggttcttcagcccatgacagatgagaaggggctatattgaagggcaaagaggaactgttgtttgaattttcctgagagcctggcttagtgctgggccttctcttaaacctcattacaatgaggttagtacttttagtccctgttttacaggggttagaatagactgttaaggggcaactgagaaagaacagagaagtgacagctaggggttgagaggggccagaaaaacatgaatgcaggcagatttcgtgaaatctgccaccactttataaccagatggttcctttcacaaccctgggtcaaaaagagaataatttggcctataatgttaaaagaaagcaggaaggtgggtaaataaaaatcttggtgcctggaaaaacaaaaaaaaaaaaaaaaaaaaaaaaaaaaaaaaaaaaaaaaaaaaaaaaaaaaaaaaaaagggggggcgcgcgccgccgaa

SEQ ID NO: 448056 - DNA, 2365 bp, Homo sapiens
agatatttaaaggcgtcggcgccacgcgcatatccctgctcggcgctgcccgcccagttcctgttcccagactgaggcccagcccccttcgcccgtttccatcacgagtgccgccagcatgtctgacaaactgccctacaaagtcgccgacatcggcctggctgcctggggacgcaaggccctggacattgctgagaacgagatgccgggcctgatgcgtatgcgggagcggtactcggcctccaagccactgaagggcgcccgcatcgctggctgcctgcacatgaccgtggagacggccgtcctcattgagaccctcgtcaccctgggtgctgaggtgcagtggtccagctgcaacatcttctccacccaggaccatgcggcggctgccattgccaaggctggcattccggtgtatgcctggaagggcgaaacggacgaggagtacctgtggtgcattgagcagaccctgtacttcaaggacgggcccctcaacatgattctggacgacgggggcgacctcaccaacctcatccacaccaagtacccgcagcttctgccaggcatccgaggcatctctgaggagaccacgactggggtccacaacctctacaagatgatggccaatgggatcctcaaggtgcctgccatcaatgtcaatgactccgtcaccaagagcaagtttgacaacctctatggctgccgggagtccctcatagatggcatcaagcgggccacagatgtgatgattgccggcaaggtagcggtggtagcaggctatggtgatgtgggcaagggctgtgcccaggccctgcggggtttcggagcccgcgtcatcatcaccgagattgaccccatcaacgcactgcaggctgccatggagggctatgaggtgaccaccatggatgaggcctgtcaggagggcaacatctttgtcaccaccacaggctgtattgacatcatccttggccggcactttgagcagatgaaggatgatgccattgtgtgtaacattggacactttgacgtggagatcgatgtcaagtggctcaacgagaacgccgtggagaaggtgaacatcaagccgcaggtggaccggtatcggttgaagaatgggcgccgcatcatcctgctggccgagggtcggctggtcaacctgggttgtgccatgggccaccccagcttcgtgatgagtaactccttcaccaaccaggtgatggcgcagatcgagctgtggacccatccagacaagtaccccgttggggttcatttcctgcccaagaagctggatgaggcagtggctgaagcccacctgggcaagctgaatgtgaagttgaccaagctaactgagaagcaagcccagtacctgggcatgtcctgtgatggccccttcaagccggatcactaccgctactgagagccaggtctgcgtttcaccctccagctgctgtccttgcccaggccccacctctcctccctaagagctaatggcaccaactttgtgattggtttgtcagtgtcccccatcgactctctggggctgatcacttagtttttggcctctgctgcagccgtcatactgttccaaatgtggcagcgggaacagagtaccctcttcaagccccggtcatgatggaggtcccagccacagggaaccatgagctcagtggtcttggaacagctcactaagtcagtccttccttagcctggaagtcagtagtggagtcacaaagcccatgtgttttgccatctaggccttcacctggtctgtggacttatacctgtgtgcttggtttacaggtccagtggttcttcagcccatgacagatgagaaggggctatattgaagggcaaagaggaactgttgtttgaattttcctgagagcctggcttagtgctgggccttctcttaaacctcattacaatgaggttagtacttttagtccctgttttacaggggttagaatagactgttaaggggcaactgagaaagaacagagaagtgacagctaggggttgagaggggtcacccacaaaccccctccattcccacaagcacctcaaatccactgctcacaactggactcatgtttttcaccggattctgacctcctactagctgccaaatcttggtaagtagtgcttgtatccaccaggtactctaaccagaaacagagtcatcctggatacctccctttccctctgcttctctgtcttgctggcgtcttaataagtgctgcttccacattccttgcggtttctcttcatctgctttattgcatcatggcttagtggtcctgctgtagtttcctaacagtcctttggttgacactgttgataccaacaggcattcgccattcacagc

SEQ ID NO: 448057 - DNA, 2281 bp, Homo sapiens
aaaaaaagacactattaagtctggagaatgccatccacatttatggaaacacttgctgtatatctggtgatttacgtgtgtttacacaataatcttcatagagatggacgtaatcccgttatatagagcatgaaactgaggcccttgggaggtgacttgcaaagattctgttgaagtagttcatcaagttgctaccagagtagactgtctccattgtgtggatgctgaaactgaacccagaaagccgacatcggcctggctgcctggggacgcaaggccctggacattgctgagaacgagatgccgggcctgatgcgtatgcgggagcggtactcggcctccaagccactgaagggcgcccgcatcgctggctgcctgcacatgaccgtggagacggccgtcctcattgagaccctcgtcaccctgggtgctgaggtgcagtggtccagctgcaacatcttctccacccaggaccatgcggcggctgccattgccaaggctggcattccggtgtatgcctggaagggcgaaacggacgaggagtacctgtggtgcattgagcagaccctgtacttcaaggacgggcccctcaacatgattctggacgacgggggcgacctcaccaacctcatccacaccaagtacccgcagcttctgccaggcatccgaggcatctctgaggagaccacgactggggtccacaacctctacaagatgatggccaatgggatcctcaaggtgcctgccatcaatgtcaatgactccgtcaccaagagcaagtttgacaacctctatggctgccgggagtccctcatagatggcatcaagcgggccacagatgtgatgattgccggcaaggtagcggtggtagcaggctatggtgatgtgggcaagggctgtgcccaggccctgcggggtttcggagcccgcgtcatcatcaccgagattgaccccatcaacgcactgcaggctgccatggagggctatgaggtgaccaccatggatgaggcctgtcaggagggcaacatctttgtcaccaccacaggctgtattgacatcatccttggccggcactttgagcagatgaaggatgatgccattgtgtgtaacattggacactttgacgtggagatcgatgtcaagtggctcaacgagaacgccgtggagaaggtgaacatcaagccgcaggtggaccggtatcggttgaagaatgggcgccgcatcatcctgctggccgagggtcggctggtcaacctgggttgtgccatgggccaccccagcttcgtgatgagtaactccttcaccaaccaggtgatggcgcagatcgagctgtggacccatccagacaagtaccccgttggggttcatttcctgcccaagaagctggatgaggcagtggctgaagcccacctgggcaagctgaatgtgaagttgaccaagctaactgagaagcaagcccagtacctgggcatgtcctgtgatggccccttcaagccggatcactaccgctactgagagccaggtctgcgtttcaccctccagctgctgtccttgcccaggccccacctctcctccctaagagctaatggcaccaactttgtgattggtttgtcagtgtcccccatcgactctctggggctgatcacttagtttttggcctctgctgcagccgtcatactgttccaaatgtggcagcgggaacagagtaccctcttcaagccccggtcatgatggaggtcccagccacagggaaccatgagctcagtggtcttggaacagctcactaagtcagtccttccttagcctggaagtcagtagtggagtcacaaagcccatgtgttttgccatctaggccttcacctggtctgtggacttatacctgtgtgcttggtttacaggtccagtggttcttcagcccatgacagatgagaaggggctatattgaagggcaaagaggaactgttgtttgaattttcctgagagcctggcttagtgctgggccttctcttaaacctcattacaatgaggttagtacttttagtccctgttttacaggggttagaatagactgttaaggggcaactgagaaagaacagagaagtgacagctaggggttgagaggggccagaaaaacatgaatgcaggcagatttcgtgaaatctgccaccactttataaccagatggttcctttcacaaccctgggtcaaaaagagaataatttggcctataatgttaaaagaaagcaggaaggtgggtaaataaaaatcttggtgcctggaa

SEQ ID NO: 448058 - DNA, 2877 bp, Homo sapiens
gtggcgggggctgcagggccgactcggggctctctggaccccctggaatcgcagcctcggcgcgtttctggccgcgcgaagccagctggaagttggagttctcgcgcggccatgagcgggccgttccgggtggccgtggactacaagtcccagcatgccccgcgacgccggggccgccgcgcggtctgcgagccgcaaactggcggcgtgctccgcgggagagcacacctggccacggcctgggacggctggcacctgccggaccctgctcggggggcctgcgcccggcctcctaggcctggaccggaccctgtccagctgggcggccccgacgagcgtccacccctctctgggcctcctacagggacggcgagggcaccccggagggtgtatgaggagaggcctggaaagcgagccccaggccggctccgatcctcctctcccctgggactttgggccagttacccaacctgtggggtcccccacccctccagcaggggcagccttgcagaaatctcgaagaaaatttggagtggtttgaaaaatcctgctgtcccaccgattgaagtgtaatacagggatagttaacgtttacttagtgtttcctgtgggatcggcactgccttctagctttattctagtctcatggctctgtagggaaactgttctcattttatgatgagaatcctgaggcagaggtaacttgccctcagtcttacagctggtggtgatggagcaagattggaacgcaggccatctagatctctgagcgcaccctttcaccactgtgtgcaagcgaatacacgcggaacaatcctagtgaattttcagcaaaaaccaccgacatcggcctggctgcctggggacgcaaggccctggacattgctgagaacgagatgccgggcctgatgcgtatgcgggagcggtactcggcctccaagccactgaagggcgcccgcatcgctggctgcctgcacatgaccgtggagacggccgtcctcattgagaccctcgtcaccctgggtgctgaggtgcagtggtccagctgcaacatcttctccacccaggaccatgcggcggctgccattgccaaggctggcattccggtgtatgcctggaagggcgaaacggacgaggagtacctgtggtgcattgagcagaccctgtacttcaaggacgggcccctcaacatgattctggacgacgggggcgacctcaccaacctcatccacaccaagtacccgcagcttctgccaggcatccgaggcatctctgaggagaccacgactggggtccacaacctctacaagatgatggccaatgggatcctcaaggtgcctgccatcaatgtcaatgactccgtcaccaagagcaagtttgacaacctctatggctgccgggagtccctcatagatggcatcaagcgggccacagatgtgatgattgccggcaaggtagcggtggtagcaggctatggtgatgtgggcaagggctgtgcccaggccctgcggggtttcggagcccgcgtcatcatcaccgagattgaccccatcaacgcactgcaggctgccatggagggctatgaggtgaccaccatggatgaggcctgtcaggagggcaacatctttgtcaccaccacaggctgtattgacatcatccttggccggcactttgagcagatgaaggatgatgccattgtgtgtaacattggacactttgacgtggagatcgatgtcaagtggctcaacgagaacgccgtggagaaggtgaacatcaagccgcaggtggaccggtatcggttgaagaatgggcgccgcatcatcctgctggccgagggtcggctggtcaacctgggttgtgccatgggccaccccagcttcgtgatgagtaactccttcaccaaccaggtgatggcgcagatcgagctgtggacccatccagacaagtaccccgttggggttcatttcctgcccaagaagctggatgaggcagtggctgaagcccacctgggcaagctgaatgtgaagttgaccaagctaactgagaagcaagcccagtacctgggcatgtcctgtgatggccccttcaagccggatcactaccgctactgagagccaggtctgcgtttcaccctccagctgctgtccttgcccaggccccacctctcctccctaagagctaatggcaccaactttgtgattggtttgtcagtgtcccccatcgactctctggggctgatcacttagtttttggcctctgctgcagccgtcatactgttccaaatgtggcagcgggaacagagtaccctcttcaagccccggtcatgatggaggtcccagccacagggaaccatgagctcagtggtcttggaacagctcactaagtcagtccttccttagcctggaagtcagtagtggagtcacaaagcccatgtgttttgccatctaggccttcacctggtctgtggacttatacctgtgtgcttggtttacaggtccagtggttcttcagcccatgacagatgagaaggggctatattgaagggcaaagaggaactgttgtttgaattttcctgagagcctggcttagtgctgggccttctcttaaacctcattacaatgaggttagtacttttagtccctgttttacaggggttagaatagactgttaaggggcaactgagaaagaacagagaagtgacagctaggggttgagaggggccagaaaaacatgaatgcaggcagatttcgtgaaatctgccaccactttataaccagatggttcctttcacaaccctgggtcaaaaagagaataatttggcctataatgttaaaagaaagcaggaaggtgggtaaataaaaatcttggtgcctggaa

SEQ ID NO: 448059 - DNA, 2033 bp, Homo sapiens
agatatttaaaggcgtcggcgccacgcgcatatccctgctcggcgctgcccgcccagttcctgttcccagactgaggcccagcccccttcgcccgtttccatcacgagtgccgccagcatgtctgacaaactgccctacaaagtcgccgacatcggcctggctgcctggggacgcaaggccctggacattgctgagaacgagatgccgggcctgatgcgtatgcgggagcggtactcggcctccaagccactgaagggcgcccgcatcgctggctgcctgcacatgaccgtggagacggccgtcctcattgagaccctcgtcaccctgggtgctgaggtgcagtggtccagctgcaacatcttctccacccaggaccatgcggcggctgccattgccaaggctggcattccggtgtatgcctggaagggcgaaacggacgaggagtacctgtggtgcattgagcagaccctgtacttcaaggacgggcccctcaacatgattctggacgacgggggcgacctcaccaacctcatccacaccaagtacccgcagcttctgccaggcatccgaggcatctctgaggagaccacgactggggtccacaacctctacaagatgatggccaatgggatcctcaaggtgcctgccatcaatgtcaatgactccgtcaccaagagcaagtttgacaacctctatggctgccgggagtccctcatagatggcatcaagcgggccacagatgtgatgattgccggcaaggtagcggtggtagcaggctatggtgatgtgggcaagggctgtgcccaggccctgcggggtttcggagcccgcgtcatcatcaccgagattgaccccatcaacgcactgcaggctgccatggagggctatgaggtgaccaccatggatgaggcctgtcaggagggcaacatctttgtcaccaccacaggctgtattgacatcatccttggccggcactttgagcagatgaaggatgatgccattgtgtgtaacattggacactttgacgtggagatcgatgtcaagtggctcaacgagaacgccgtggagaaggtgaacatcaagccgcaggtgatggcgcagatcgagctgtggacccatccagacaagtaccccgttggggttcatttcctgcccaagaagctgggcaagctgaatgtgaagttgaccaagctaactgagaagcaagcccagtacctgggcatgtcctgtgatggccccttcaagccggatcactaccgctactgagagccaggtctgcgtttcaccctccagctgctgtccttgcccaggccccacctctcctccctaagagctaatggcaccaactttgtgattggtttgtcagtgtcccccatcgactctctggggctgatcacttagtttttggcctctgctgcagccgtcatactgttccaaatgtggcagcgggaacagagtaccctcttcaagccccggtcatgatggaggtcccagccacagggaaccatgagctcagtggtcttggaacagctcactaagtcagtccttccttagcctggaagtcagtagtggagtcacaaagcccatgtgttttgccatctaggccttcacctggtctgtggacttatacctgtgtgcttggtttacaggtccagtggttcttcagcccatgacagatgagaaggggctatattgaagggcaaagaggaactgttgtttgaattttcctgagagcctggcttagtgctgggccttctcttaaacctcattacaatgaggttagtacttttagtccctgttttacaggggttagaatagactgttaaggggcaactgagaaagaacagagaagtgacagctaggggttgagaggggccagaaaaacatgaatgcaggcagatttcgtgaaatctgccaccactttataaccagatggttcctttcacaaccctgggtcaaaaagagaataatttggcctataatgttaaaagaaagcaggaaggtgggtaaataaaaatcttggtgcctggaa

SEQ ID NO: 448060 - DNA, 1690 bp, Homo sapiens
cccatcaatgtcaatgacttgctcttggtgacggagtcattgacattgatggcaggcaccttgaggatcccattggacatcatcttgtagaggttgtggaccccagtcgtggtctcctcagagatgcctcggatgcctggcagaagctgcgggtactatggtgtggctgactccgtcaccaagagcaagtttgacaacctctatggctgccgggagtccctcatagatggcatcaagcgggccacagatgtgatgattgccggcaaggtagcggtggtagcaggctatggtgatgtgggcaagggctgtgcccaggccctgcggggtttcggagcccgcgtcatcatcaccgagattgaccccatcaacgcactgcaggctgccatggagggctatgaggtgaccaccatggatgaggcctgtcaggagggcaacatctttgtcaccaccacaggctgtattgacatcatccttggccggcactttgagcagatgaaggatgatgccattgtgtgtaacattggacactttgacgtggagatcgatgtcaagtggctcaacgagaacgccgtggagaaggtgaacatcaagccgcaggtggaccggtatcggttgaagaatgggcgccgcatcatcctgctggccgagggtcggctggtcaacctgggttgtgccatgggccaccccagcttcgtgatgagtaactccttcaccaaccaggtgatggcgcagatcgagctgtggacccatccagacaagtaccccgttggggttcatttcctgcccaagaagctggatgaggcagtggctgaagcccacctgggcaagctgaatgtgaagttgaccaagctaactgagaagcaagcccagtacctgggcatgtcctgtgatggccccttcaagccggatcactaccgctactgagagccaggtctgcgtttcaccctccagctgctgtccttgcccaggccccacctctcctccctaagagctaatggcaccaactttgtgattggtttgtcagtgtcccccatcgactctctggggctgatcacttagtttttggcctctgctgcagccgtcatactgttccaaatgtggcagcgggaacagagtaccctcttcaagccccggtcatgatggaggtcccagccacagggaaccatgagctcagtggtcttggaacagctcactaagtcagtccttccttagcctggaagtcagtagtggagtcacaaagcccatgtgttttgccatctaggccttcacctggtctgtggacttatacctgtgtgcttggtttacaggtccagtggttcttcagcccatgacagatgagaaggggctatattgaagggcaaagaggaactgttgtttgaattttcctgagagcctggcttagtgctgggccttctcttaaacctcattacaatgaggttagtacttttagtccctgttttacaggggttagaatagactgttaaggggcaactgagaaagaacagagaagtgacagctaggggttgagaggggccagaaaaacatgaatgcaggcagatttcgtgaaatctgccaccactttataaccagatggttcctttcacaaccctgggtcaaaaagagaataatttggcctataatgttaaaagaaagcaggaaggtgggtaaataaaaatcttggtgcctggaa

SEQ ID NO: 448061 - DNA, 1941 bp, Homo sapiens
agatatttaaaggcgtcggcgccacgcgcatatccctgctcggcgctgcccgcccagttcctgttcccagactgaggcccagcccccttcgcccgtttccatcacgagtgccgccagcatgtctgacaaactgccctacaaagtcgccgacatcggcctggctgcctggggacgcaaggccctggacattgctgagaacgagatgccgggcctgatgcgtatgcgggagcggtactcggcctccaagccactgaagggcgcccgcatcgctggctgcctgcacatgaccgtggagacggccgtcctcattgagaccctcgtcaccctgggtgctgaggtgcagtggtccagctgcaacatcttctccacccaggaccatgcggcggctgccattgccaaggctggcattccggtgtatgcctggaagggcgaaacggacgaggagtacctgtggtgcattgagcagaccctgtacttcaaggacgggcccctcaacatgattctggacgacgggggcgacctcaccaacctcatccacaccaagtacccgcagcttctgccaggcatccgaggcatctctgaggagaccacgactggggtccacaacctctacaagatgatggccaatgggatcctcaaggtgcctgccatcaatgtcaatgactccgtcaccaagagcaagtttgacaacctctatggctgccgggagtccctcatagatggcatcaagcgggccacagatgtgatgattgccggcaaggtagcggtggtagcaggctatggtgatgtgggcaagggctgtgcccaggccctgcggggtttcggagcccgcgtcatcatcaccgagattgaccccatcaacgcactgcaggctgccatggagggctatgaggtgaccaccatggatgaggcctgtcaggagggcaacatctttgtcaccaccacaggctgtattgacatcatccttggccggcactttgagcagatgaaggatgatgccattgtgtgtaacattggacactttgacgtggagatcgatgtcaagtggctcaacgagaacgccgtggagaaggtgaacatcaagccgcaggtggaccggtatcggttgaagaatgggcgccgcatcatcctgctggccgagggtcggctggtcaacctgggttgtgccatgggccaccccagcttcgtgatgagtaactccttcaccaaccaggtgatggcgcagatcgagctgtggacccatccagacaagtaccccgttggggttcatttcctgcccaagaagctggatgaggcagtggctgaagcccacctgggcaagctgaatgtgaagttgaccaagctaactgagaagcaagcccagtacctgggcatgtcctgtgatggccccttcaagccggatcactaccgctactgagagccaggtcaatcacttgatgtggcctcttactggcaacattagccatggattttgtacccttaggagctatgatgaaaaaaacaacacaagattaaatcaaatgcgagagaaaataatgtgcaaacaagagatgcggtaaacatgaaatatatgaggatactgtgggtataacatgacatactgttttacagtaaactgtttgttgttgtttttgttgttgtttttctgagtctcgctctgtcacccaggctggagtacagtggcgcaatctcggctcactgcaacctctgcctcctgggttcaaatgattctcctggctcagcctcagcctcagcctcccgagtagctgggattataggcgcctgccaccacgcccggcgaatttttgtatttttagtagagatggggtttcgccatgttggtcaggctggtttataggaccactgtcatatatgcagtccgtcatatacacttgggcaacagagtgaggaagaaagaaaggaaagaaaggaaggaaggaa

SEQ ID NO: 448062 - DNA, 1268 bp, Homo sapiens
atttcttaataaatattggctgttatttttgtgctaagccatgtgctggaggttgttttggagcagttcggactcctcatgggcactgttggaggcagagaggcctgccagatcagagggtgggctgtgggagcggggccctgcctgccttcactgttgccctgcctgcgtgtaggtggaccggtatcggttgaagaatgggcgccgcatcatcctgctggccgagggtcggctggtcaacctgggttgtgccatgggccaccccagcttcgtgatgagtaactccttcaccaaccaggtgatggcgcagatcgagctgtggacccatccagacaagtaccccgttggggttcatttcctgcccaagaagctggatgaggcagtggctgaagcccacctgggcaagctgaatgtgaagttgaccaagctaactgagaagcaagcccagtacctgggcatgtcctgtgatggccccttcaagccggatcactaccgctactgagagccaggtctgcgtttcaccctccagctgctgtccttgcccaggccccacctctcctccctaagagctaatggcaccaactttgtgattggtttgtcagtgtcccccatcgactctctggggctgatcacttagtttttggcctctgctgcagccgtcatactgttccaaatgtggcagcgggaacagagtaccctcttcaagccccggtcatgatggaggtcccagccacagggaaccatgagctcagtggtcttggaacagctcactaagtcagtccttccttagcctggaagtcagtagtggagtcacaaagcccatgtgttttgccatctaggccttcacctggtctgtggacttatacctgtgtgcttggtttacaggtccagtggttcttcagcccatgacagatgagaaggggctatattgaagggcaaagaggaactgttgtttgaattttcctgagagcctggcttagtgctgggccttctcttaaacctcattacaatgaggttagtacttttagtccctgttttacaggggttagaatagactgttaaggggcaactgagaaagaacagagaagtgacagctaggggttgagaggggccagaaaaacatgaatgcaggcagatttcgtgaaatctgccaccactttataaccagatggttcctttcacaaccctgggtcaaaaagagaataatttggcctataatgttaaaagaaagcaggaaggtgggtaaataaaaatcttggtgcctggaa

SEQ ID NO: 448063 - DNA, 1390 bp, Homo sapiens
agatatttaaaggcgtcggcgccacgcgcatatccctgctcggcgctgcccgcccagttcctgttcccagactgaggcccagcccccttcgcccgtttccatcacgagtgccgccagcatgtctgacaaactgccctacaaagtcgccgacatcggcctggctgcctggggacgcaaggccctggacattgctgagaacgagatgccgggcctgatgcgtatgcgggagcggtactcggcctccaagccactgaagggcgcccgcatcgctggctgcctgcacatgaccgtggagacggccgtcctcattgagaccctcgtcaccctgggtgctgaggtgcagtggtccagctgcaacatcttctccacccaggaccatgcggcggctgccattgccaaggctggcattccggtgtatgcctggaagggcgaaacggacgaggagtacctgtggtgcattgagcagaccctgtacttcaaggacgggcccctcaacatgattctggacgacgggggcgacctcaccaacctcatccacaccaagtacccgcagcttctgccaggcatccgaggcatctctgaggagaccacgactggggtccacaacctctacaagatgatggccaatgggatcctcaaggtgcctgccatcaatgtcaatgactccgtcaccaagagcaagtttgacaacctctatggctgccgggagtccctcatagatggcatcaagcgggccacagatgtgatgattgccggcaaggtagcggtggtagcaggctatggtgatgtgggcaagggctgtgcccaggccctgcggggtttcggagcccgcgtcatcatcaccgagattgaccccatcaacgcactgcaggctgccatggagggctatgaggtgaccaccatggatgaggcctgtcaggagggcaacatctttgtcaccaccacagcggtttgcactttaccctgggcaggacattgaccccaatgaactgagtgacgacccggtgtggtcgcaggtggaaccatggacagcgggcgacacacgcgcacaggcgcagccaaaaacagcgggggaaaggcgggagctaactaccacgacgcgggacagacggaatgctcggagataagagatggcggcaacaaactgactcaagcacggagccggcagcgagaccacaacagaagaccgatgacgaccaccgaaggaggacaggagacagcaaccagagcagaggacttgaagagtgatgatagaacgaaacacggaggcagacacgcagcagaaagacgcagcgacgaccagaggaacggagacacgaggagagaagaaagatgaagagcgagccgcctgcctgctccttgcctgctctcagcggagggtcgatgcaga

SEQ ID NO: 448064 - DNA, 1242 bp, Homo sapiens
ggactgctcttccagaggcaagaccaaccaagatgagtgccctgggagctgtcattgccctcctgctctggggacagctttttgcagtggactcaggcaatgatgtcacggatatcgcagatgacggctgcccgaagccccccgagattgcacatggctatgtggagcactcggttcgctaccagtgtaagaactactacaaactgcgcacagaaggagatggagtgtacaccttaaacaatgagaagcagtggataaataaggctgttggagataaacttcctgaatgtgaagcagtatgtgggaagcccaagaatccggcaaacccagtgcagcggatcctgggtggacacctggatgccaaaggcagctttccctggcaggctaagatggtttcccaccataatctcaccacaggtgccacgctgatcaatgaacaatggctgctgaccacggctaaaaatctcttcctgaaccattcagaaaatgcaacagcgaaagacattgcccctactttaacactctatgtggggaaaaagcagcttgtagagattgagaaggttgttctacaccctaactactcccaggtagatattgggctcatcaaactcaaacagaaggtgtctgttaatgagagagtgatgcccatctgcctaccttcaaaggattatgcagaagtagggcgtgtgggttatgtttctggctgggggcgaaatgccaattttaaatttactgaccatctgaagtatgtcatgctgcctgtggctgaccaagaccaatgcataaggcattatgaaggcagcacagtccccgaaaagaagacaccgaagagccctgtaggggtgcagccccatactgaatgaacacaccttctgtgctggcatgtctaagtaccaagaagacacctgctatggcgatgcgggcagtgcctttgccgttcacgacctggaggaggacacctggtatgcgactgggatcttaagctttgataagagctgtgctgtggctgagtatggtgtgtatgtgaaggtgacttccatccaggactgggttcagaagaccatagctgagaactaatgcaaggctggccggaagcccttgcctgaaagcaagatttcagcctggaagagggcaaagtggacgggagtggacaggagtggatgcgataagatgtggtttgaagctgatgggtgccagccctgcattgctgagtcaatcaataaagagctttcttttgaccca

SEQ ID NO: 448065 - DNA, 1423 bp, Homo sapiens
ggactgctcttccagaggcaagaccaaccaagatgagtgccctgggagctgtcattgccctcctgctctggggacagctttttgcagtggactcaggcaatgatgtcacggatatcgcagatgacggctgcccgaagccccccgagattgcacatggctatgtggagcactcggttcgctaccagtgtaagaactactacaaactgcgcacagaaggagatggagtgtacaccttaaacaatgagaagcagtggataaataaggctgttggagataaacttcctgaatgtgaagcagtatgtgggaagcccaagaatccggcaaacccagtgcagcggatcctgggtggacacctggatgccaaaggcagctttccctggcaggctaagatggtttcccaccataatctcaccacaggtgccacgctgatcaatgaacaatggctgctgaccacggctaaaaatctcttcctgaaccattcagaaaatgcaacagcgaaagacattgcccctactttaacactctatgtggggaaaaagcagcttgtagagattgagaaggttgttctacaccctaactactcccaggtagatattgggctcatcaaactcaaacagaaggtgtctgttaatgagagagtgatgcccatctgcctaccttcaaaggattatgcagaagtagggcgtgtgggttatgtttctggctgggggcgaaatgccaattttaaatttactgaccatctgaagtatgtcatgctgcctgtggctgaccaagaccaatgcataaggcattatgaaggcagcacagtccccgaaaagaagacaccgaagagccctgtaggggtgcagccccatactgaatgaacacaccttctgtgctggcatgtctaagtaccaagaagacacctgctatggcgatgcgggcagtgcctttgccgttcacgacctggaggaggacacctggtatgcgactgggatcttaagctttgataagagctgtgctgtggctgagtatggtgtgtatgtgaaggtgacttccatccaggactgggttcagaagaccatagctgagaactaatgcaaggctggccggaagcccttgcctgaaagcaagatttcagcctggaagagggcaaagtggacgggagtggacaggagtggatgcgataagatgtggtttgaagctgatgggtgccagccctgcattgctgagtcaatcaataaagagctttcttttgacccaaaaaaaaaacagactctcacgtcacacaaaccttggttggggcgcccctgggcccctgggaaaggttttttaaacccctctccgtgggggcgccgggcccctgtgggttatgggaaaccgtggccacagggcgtgtccccaaaggaaactccggggcacgaactagggggtgggtttcccc

SEQ ID NO: 448066 - DNA, 681 bp, Homo sapiens
ggactgctcttccagaggcaagaccaaccaagatgagtgccctgggagctgtcattgccctcctgctctggggacagctttttgcagtggactcaggcaatgatgtcacggatatcgcagatgacggctgcccgaagccccccgagattgcacatggctatgtggagcactcggttcgctaccagtgtaagaactactacaaactgcgcacagaaggagatggagtgtacaccttaaacaatgagaagcagtggataaataaggctgttggagataaacttcctgaatgtgaagcagaatgaacacaccttctgtgctggcatgtctaagtaccaagaagacacctgctatggcgatgcgggcagtgcctttgccgttcacgacctggaggaggacacctggtatgcgactgggatcttaagctttgataagagctgtgctgtggctgagtatggtgtgtatgtgaaggtgacttccatccaggactgggttcagaagaccatagctgagaactaatgcaaggctggccggaagcccttgcctgaaagcaagatttcagcctggaagagggcaaagtggacgggagtggacaggagtggatgcgataagatgtggtttgaagctgatgggtgccagccctgcattgctgagtcaatcaataaagagctttcttttgaccca

SEQ ID NO: 448067 - DNA, 635 bp, Homo sapiens
ggactgctcttccagaggcaagaccaaccaagatgagtgccctgggagctgtcattgccctcctgctctggggacagctttttgcagtggactcaggcaatgatgtcacggatatcgcagatgacggctgcccgaagccccccgagattgcacatggctatgtggagcactcggttcgctaccagtgtaagaactactacaaactgcgcacagaaggagatggagtgtacaccttaaacaatgagaagcagtggataaataaggctgttggagataaacttcctgaatgtgaagcagtatgtgggaagcccaagaatccggcaaacccagtgcagcggatcctgggtggaccctggtatgcgactgggatcttaagctttgataagagctgtgctgtggctgagtatggtgtgtatgtgaaggtgacttccatccaggactgggttcagaagaccatagctgagaactaatgcaaggctggccggaagcccttgcctgaaagcaagatttcagcctggaagagggcaaagtggacgggagtggacaggagtggatgcgataagatgtggtttgaagctgatgggtgccagccctgcattgctgagtcaatcaataaagagctttcttttgaccca

SEQ ID NO: 448068 - DNA, 617 bp, Homo sapiens
ggactgctcttccagaggcaagaccaaccaagatgagtgccctgggagctgtcattgccctcctgctctggggacagctttttgcagtggactcaggcaatgatgtcacggatatcgcagatgacggctgcccgaagccccccgagattgcacatggctatgtggagcactcggttcgctaccagtgtaagaactactacaaactgcgcacagaaggagatgagacacctgctatggcgatgcgggcagtgcctttgccgttcacgacctggaggaggacacctggtatgcgactgggatcttaagctttgataagagctgtgctgtggctgagtatggtgtgtatgtgaaggtgacttccatccaggactgggttcagaagaccatagctgagaactaatgcaaggctggccggaagcccttgcctgaaagcaagatttcagcctggaagagggcaaagtggacgggagtggacaggagtggatgcgataagatgtggtttgaagctgatgggtgccagccctgcattgctgagtcaatcaataaagagctttcttttgacccaaaaaaaaaaaaaaaaaaaaaaaaaaaaaaaaaaaaaaaaaaatttggggcgc

SEQ ID NO: 448069 - DNA, 765 bp, Homo sapiens
ggactgctcttccagaggcaagaccaaccaagatgagtgccctgggagctgtcattgccctcctgctctggggacagctttttgcagtggactcaggcaatgatgtcacggatatcgcagatgacggctgcccgaagccccccgagattgcacatggctatgtggagcactcggttcgctaccagtgtaagaactactacaaactgcgcacagaaggagatggagtatacaccttaaatgataagaagcagtggataaataaggctgttggagataaacttcctgaatgtgaagcagtgacttccatccaggactgggttcagaagaccatagctgagaactaatgcaaggctggccggaagcccttgcctgaaagcaagatttcagcctggaagagggcaaagtggacgggagtggacaggagtggatgcgataagatgtggtttgaagctgatgggtgccagccctgcattgctgagtcaatcaataaagagctttcttttgacccaacaaaaagacccatataaacaaacatggaaagcgcatgttgccgggcggccctcgaggaccttgacgaaaaatattttttaaaggaacgacaataccgtttagtggagcggcgcgcccccttattgactgtggagaacaggtgtcctaaagacgtatctgcctgaaggaaatccggggtggaaaacacagggcgtgaacattccccctgtttaaaaaacgcggggggaacagccaagacttcttgaaccattccaa

SEQ ID NO: 448070 - DNA, 516 bp, Homo sapiens
ggactgctcttccagaggcaagaccaaccaagatgagtgccctgggagctgtcattgccctcctgctctggggacagctttttgcagtggactcaggcaatgatgtcacggatatcgcagatgacggctgcccgaagccccccgagattgcacatggctatgtggagcactcggttcgctaccagtgtaagaactactacaaactgcgcacagaaggagatgagtatacacctttaagattgcccggaggaagcaaactcttcgtataaaaaaagcaggccatctgcttaacccttggctccaccataaggcactgggactcggatttctctatctgatagaggtattttctgtggccctgggagctgtctgtctttcccctacccccaaggatgccaggaagacgtccaccattagccatgtggcaacctttacttctatgcctcacaagtgcctttcagagagccccaattctgctttcccacaaaataaacctaatgccatcaggcaaaacat

SEQ ID NO: 448071 - DNA, 600 bp, Homo sapiens
cttttttttttgtgagacagagtctcactctgtcaccaggatggagtgagtggcgcgatctcagctcatcgcaacctccccctccccggttcaagcaattctcctgcctcagcctcccaagtagctaggactacaggcgtgtgccaccacgcccagctaatttttgtatttttagtagcgatgtggttcaccatgttggcccggatgatctcgatctcttgacctcgtgatccacctgtctcggcctcccaaagtctgctatggcgatgcgggcagtgcctttgccgttcacgacctggaggaggacacctggtacgcggctgggatcctaagctttgataagagctgtgctgtggctgagtatggtgtgtatgtgaaggtgacttccatccagcactgggttcagaagaccatagctgagaactaatgcaaggctggccggaagcccttgcctgaaagcaagatttcagcctggaagagggcaaagtggacgggagtggacaggagtggatgcgataagatgtggtttgaagctgatgggtgccagccctgcattgctgagtcaatcaataaagagctttcttttgacccatttctgtg

SEQ ID NO: 448072 - DNA, 1529 bp, Homo sapiens
acacagagcccgggccacaggcagctccttgccagctctcctcctcgcacagccgctcgaaccgcctgctgagccccatggcccgcgccacgctctccgccgcccccagcaatccccggctcctgcgggtggcgctgctgctcctgctcctggtggccgccagccggcgcgcagcaggtgggtcccggcgccctggggtccccgggccggacgcggctggggtgggcgccccgcgccgacagccccgctcaatcagcgagtctcttcttccctaggagcgcccctggccactgaactgcgctgccagtgcttgcagaccctgcagggaattcacctcaagaacatccaaagtgtgaaggtgaagtcccccggaccccactgcgcccaaaccgaagtcatgtaagtctcgcccatcgctgccgctgccactgctggggtccccgactctcccgctgccccaaaccctgtcctcagcccgacctcctgtctcacgagattcccttctctctgcagagccacactcaagaatgggcagaaagcttgtctcaaccccgcatcgcccatggttaagaaaatcatcgaaaagatgctgaaaaagtaagttataatttccatgtacacaggcgactggagctgttggtcagaaatactggcgtctgccccctaaaaagtaaatcaggaaaacccagggttagctgcaggactgaaaaaattattattttcacaaagttgccattaaggttattaatctgttctggtgccagaggatattcccagtgcccagggtcaccacccaggttcttccctcctgccagtgaatgtaggtaaaactgctttcatgtaaggtctcattggagtttgccagttgtgctgaagtgttttccacctgttaaaaaacacaagcttcatttcccctagttcctactgactttcagacctgaaaagcagaccccctggttttttgtaaaagtttagggttgaagtgcagagatttcacaataatattgcactgggtatataactggttgccaccacctattagccatgtcactcagagacaatattatttagtttatctgagactcagcaaaacagggaaaataatggtagctacatcatgaggttgccctgaggctcaagtgaggcccagtatgacaaagagcaataggctctggctgttttagccagtaaaacagtgtagactgccactcctccaccccacgtcacccccattcctaaaagagcatcccaagcctagaggttgctttgaggctcaagtgaggcccagtgtggctgagtatggtgtgtatgtgaaggtgacttccatccaggactgggttcagaagaccatagctgagaactaatgcaaggctggccggaagcccttgcctgaaagcaagatttcagcctggaagagggcaaagtggacgggagtggacaggagtggatgcgataagatgtggtttgaagctgatgggtgccagccctgcattgctgagtcaatcaataaagagctttcttttgaccca

SEQ ID NO: 448073 - DNA, 364 bp, Homo sapiens
gatcccagtcgcataccaggtgtcctcctccaggtcgtgaacggcaaaggcactgcccgcatcgccatagcaggtgtcttcttggtacttagacatgccagcacagaaggtgtgttcattcagtatgggctgcacccctacagggctcttcgtgacttccatccaggactgggttcagaagaccatagctgagaactaatgcaaggctggccggaagcccttgcctgaaagcaagatttcagcctggaagagggcaaagtggacgggagtggacaggagtggatgcgataagatgtggtttgaagctgatgggtgccagccctgcattgctgagtcaatcaataaagagctttcttttgaccca

SEQ ID NO: 448074 - DNA, 631 bp, Homo sapiens
  misc_feature (19)..(19): n is a, c, g, or t
  misc_feature (58)..(58): n is a, c, g, or t
  misc_feature (91)..(91): n is a, c, g, or t
  misc_feature (100)..(100): n is a, c, g, or t
ttacagagctgttagtganccgcagatcgctacgatacgcaagctcgaattaccctcntaaaggaccaaagctgagctcacgcgggtgcgncgctctagnccggcggatccccgggctgcagtgaccatctgaagtatgtcatgctgcctgtggctgaccaagaccaatgcataaggcattatgaaggcagcacagtccccgaaaagaagacaccgaagagccctgtaggggtgcagccccatactgaatgaacacaccttctgtgctggcatgtctaagtaccaagaagacacctgctatggcgatgcgggcagtgcctttgccgttcacgacctggaggaggacacctggtatgcgactgggatcttaagctttgataagagctgtgctgtggctgagtatggtgtgtatgtgaaggtgacttccatccaggactgggttcagaagaccatagctgagaactaatgcaaggctggccggaagcccttgcctgaaagcaagatttcagcctggaagagggcaaagtggacgggagtggacaggagtggatgcgataagatgtggtttgaagctgatgggtgccagccctgcattgctgagtcaatcaataaagagctttcttttgaccca

SEQ ID NO: 448075 - DNA, 1469 bp, Homo sapiens
gaattcttcagagatgtaagaataggatactatcagagaacaagatagaccttggaatttaaaaacaaaaatgggaaaacaaattcaataaatggatgataaagtcaaggaaatctttcaaaaagcgagtgtgtgtgtatgcatgtgtgtgtgtgcgtgtgtgtgtgtgtgtacatgcctgtgtgtgtggatgcatgcatgtgctgtgaagcagggagaccagctttccgctccttcttgttttctctctgcagtgacctgggagctgtcatttccctcctgctctggggacgacagctttttgcactgtactcaggcaatgatgtcacggatatttcagatgaccgcttcccgaagccccctgagattgcaaatggctatgtggagcacttgtttcgctaccagtgtaagaactactacagactgcgcacagaaggagatggagtatacaccttaaatgataagaagcagtggataaataaggctgttggagataaacttcctgaatgtgaagcagtatgtgggaagcccaagaatccggcaaacccagtgcagcggatcctgggtggacacctggatgccaaaggcagctttccctggcaggctaagatggtttcccaccataatctcaccacaggtgccacgctgatcaatgaacaatggctgctgaccacggctaaaaatctcttcctgaaccattcagaaaatgcaacagcgaaagacattgcccctactttaacactctatgtggggaaaaagcagcttgtagagattgagaaggtggttctacaccctaactaccaccaggtagatattgggctcatcaaactcaaacagaaggtgcttgttaatgagagagtgatgcccatctgcctaccttcaaagaattatgcagaagtagggcgtgtgggttacgtgtctggctggggacaaagtgacaactttaaacttactgaccatctgaagtatgtcatgctgcctgtggctgaccaatacgattgcataacgcattatgaaggcagcacatgccccaaatggaaggcaccgaagagccctgtaggggtgcagcccatactgaacgaacacaccttctgtgtcggcatgtctaagtaccaggaagacacctgctatggcgatgcgggcagtgcctttgccgttcacgacctggaggaggacacctggtacgcggctgggatcctaagctttgataagagctgtgctgtggctgagtatggtgtgtatgtgaaggtgacttccatccagcactgggttcagaagaccatagctgagaactaatgcaaggctggccggaagcccttgcctgaaagcaagatttcagcctggaagagggcaaagtggacgggagtggacaggagtggatgcgataagatgtggtttgaagctgatgggtgccagccctgcattgctgagtcaatcaataaagagctttcttttgacccatttctgtg

SEQ ID NO: 448076 - DNA, 427 bp, Homo sapiens
ggactgctcttccagaggcaagaccaaccaagatgagtgccctgggagctgtcattgccctcctgctctggggacagctttttgcagtggactcaggcaatgatgtcacggatatcgcagatgacggctgcccgaagccccccgagattcccttctttactaaacaaatcccatggattctgatttctgggtcttaggattttaaaagtgaagggatatttttcttatatttgtgagttcagttccgatggtgcccgtggtcaaaagcgaaaaacatggacaattcctattcattcttagcactttgacatgtcttggggaaaagcttacattttaatttaaaagaaagatcaattatatccatgcttaacaggatcagcaggagctttataaatgactttacagagactaataagggatttgatct

SEQ ID NO: 448077 - DNA, 1294 bp, Homo sapiens
ggactgctcttccagaggcaagaccaaccaagatgagtgccctgggagctgtcattgccctcctgctctggggacagctttttgcagtggactcaggcaatgatgtcacggatatcgcagatgacggctgcccgaagccccccgagattgcacatggctatgtggagcactcggttcgctaccagtgtaagaactactacaaactgcgcacagaaggagatggagtgtacaccttaaacaatgagaagcagtggataaataaggctgttggagataaacttcctgaatgtgaagcagtatgtgggaagcccaagaatccggcaaacccagtgcagcggatcctgggtggacacctggatgccaaaggcagctttccctggcaggctaagatggtttcccaccataatctcaccacaggtgccacgctgatcaatgaacaatggctgctgaccacggctaaaaatctcttcctgaaccattcagaaaatgcaacagcgaaagacattgcccctactttaacactctatgtggggaaaaagcagcttgtagagattgagaaggttgttctacaccctaactactcccaggtagatattgggctcatcaaactcaaacagaaggtgtctgttaatgagagagtgatgcccatctgcctaccttcaaaggattatgcagaagtagggcgtgtgggttatgtttctggctgggggcgaaatgccaattttaaatttactgaccatctgaagtatgtcatgctgcctgtggctgaccaagaccaatgcataaggcattatgaaggcagcacagtccccgaaaagaagacaccgaagagccctgtaggggtgcagccccatactgaatgaacacaccttctgtgctggcatgtctaagtaccaagaagacacctgctatggcgatgcgggcagtgcctttgccgttcacgacctggaggaggacacctggtatgcgactgggatcttaagctttgataagagctgtgctgtggctgagtatggtgtgtatgtgaaggtgacttccatccaggactgggttcagaagaccatagctgagaactaatgcaaggctggccggaagcccttgcctgaaagcaagatttcagcctggaagagggcaaagtggacgggagtggacaggagtggatgcgataagatgtggtttgaagctgatgggtgccagccctgcattgctgagtcaatcaataaagagctttcttttgacccaaaaaaaaaaaaaaaaaaaaaaaaaaaaaaaaaaaaaaaaaaatttggggcgc

SEQ ID NO: 448078 - DNA, 1513 bp, Homo sapiens
  misc_feature (1244)..(1245): n is a, c, g, or t
ggactgctcttccagaggcaagaccaaccaagatgagtgccctgggagctgtcattgccctcctgctctggggacagctttttgcagtggactcaggcaatgatgtcacggatatcgcagatgacggctgcccgaagccccccgagattgcacatggctatgtggagcactcggttcgctaccagtgtaagaactactacaaactgcgcacagaaggagatggagtgtacaccttaaacaatgagaagcagtggataaataaggctgttggagataaacttcctgaatgtgaagcagtatgtgggaagcccaagaatccggcaaacccagtgcagcggatcctgggtggacacctggatgccaaaggcagctttccctggcaggctaagatggtttcccaccataatctcaccacaggtgccacgctgatcaatgaacaatggctgctgaccacggctaaaaatctcttcctgaaccattcagaaaatgcaacagcgaaagacattgcccctactttaacactctatgtggggaaaaagcagcttgtagagattgagaaggttgttctacaccctaactactcccaggtagatattgggctcatcaaactcaaacagaaggtgtctgttaatgagagagtgatgcccatctgcctaccttcaaaggattatgcagaagtagggcgtgtgggttatgtttctggctgggggcgaaatgccaattttaaatttactgaccatctgaagtatgtcatgctgcctgtggctgaccaagaccaatgcataaggcattatgaaggcagcacagtccccgaaaagaagacaccgaagagccctgtaggggtgcagccccatactgaatgaacacaccttctgtgctggcatgtctaagtaccaagaagacacctgctatggcgatgcgggcagtgcctttgccgttcacgacctggaggaggacacctggtatgcgactgggatcttaagctttgataagagctgtgctgtggctgagtatggtgtgtatgtgaaggtgacttccatccaggactgggttcagaagaccatagctgagaactaatgcaaggctggccggaagcccttgcctgaaagcaagatttcagcctggaagagggcaaagtggacgggagtggacaggagtggatgcgataagatgtggtttgaagctgatgggtgccagccctgcattgctgagtcaatcaataaagagctttcttttgacccatnnaaaaaaaaccacaacaaaaacttttggcccccttgggccccggaaaagtttcaaaacattcgttggggcggggcgcaaggggaacgggaaccgggcaaagcggtccaaggaaacccgtgcgccagagaaaagagcggagagatttcccaccatgtaaaaaaagcccggggggaacaccggcgcgttctggaacacactccgagagggccctcagaggcacaaaacgggacgcatccagagggtgccagaggaaaccgcaataaaaccg

SEQ ID NO: 448079 - DNA, 1207 bp, Homo sapiens
ggactgctcttccagaggcaagaccaaccaagatgagtgccctgggagctgtcattgccctcctgctctggggacagctttttgcagtggactcaggcaatgatgtcacggatatcgcagggctatgtggagcactcggttcgctaccagtgtaagaactactacaaactgcgcacagaaggagatggagtgtacaccttaaacaatgagaagcagtggataaataaggctgttggagataaacttcctgaatgtgaagcagtatgtgggaagcccaagaatccggcaaacccagtgcagcggatcctgggtggacacctggatgccaaaggcagctttccctggcaggctaagatggtttcccaccataatctcaccacaggtgccacgctgatcaatgaacaatggctgctgaccacggctaaaaatctcttcctgaaccattcagaaaatgcaacagcgaaagacattgcccctactttaacactctatgtggggaaaaagcagcttgtagagattgagaaggttgttctacaccctaactactcccaggtagatattgggctcatcaaactcaaacagaaggtgtctgttaatgagagagtgatgcccatctgcctaccttcaaaggattatgcagaagtagggcgtgtgggttatgtttctggctgggggcgaaatgccaattttaaatttactgaccatctgaagtatgtcatgctgcctgtggctgaccaagaccaatgcataaggcattatgaaggcagcacagtccccgaaaagaagacaccgaagagccctgtaggggtgcagccccatactgaatgaacacaccttctgtgctggcatgtctaagtaccaagaagacacctgctatggcgatgcgggcagtgcctttgccgttcacgacctggaggaggacacctggtatgcgactgggatcttaagctttgataagagctgtgctgtggctgagtatggtgtgtatgtgaaggtgacttccatccaggactgggttcagaagaccatagctgagaactaatgcaaggctggccggaagcccttgcctgaaagcaagatttcagcctggaagagggcaaagtggacgggagtggacaggagtggatgcgataagatgtggtttgaagctgatgggtgccagccctgcattgctgagtcaatcaataaagagctttcttttgaccca

SEQ ID NO: 448080 - DNA, 1167 bp, Homo sapiens
ggactgctcttccagaggcaagaccaaccaagatgagtgccctgggagctgtcattgccctcctgctctggggacagctttttgcagtggactcaggcaatgatgtcacggatatcgcagatgacggctgcccgaagccccccgagattgcacatggctatgtggagcactcggttcgctaccagtgtaagaactactacaaactgcgcacagaaggagatgtatgtgggaagcccaagaatccggcaaacccagtgcagcggatcctgggtggacacctggatgccaaaggcagctttccctggcaggctaagatggtttcccaccataatctcaccacaggtgccacgctgatcaatgaacaatggctgctgaccacggctaaaaatctcttcctgaaccattcagaaaatgcaacagcgaaagacattgcccctactttaacactctatgtggggaaaaagcagcttgtagagattgagaaggttgttctacaccctaactactcccaggtagatattgggctcatcaaactcaaacagaaggtgtctgttaatgagagagtgatgcccatctgcctaccttcaaaggattatgcagaagtagggcgtgtgggttatgtttctggctgggggcgaaatgccaattttaaatttactgaccatctgaagtatgtcatgctgcctgtggctgaccaagaccaatgcataaggcattatgaaggcagcacagtccccgaaaagaagacaccgaagagccctgtaggggtgcagccccatactgaatgaacacaccttctgtgctggcatgtctaagtaccaagaagacacctgctatggcgatgcgggcagtgcctttgccgttcacgacctggaggaggacacctggtatgcgactgggatcttaagctttgataagagctgtgctgtggctgagtatggtgtgtatgtgaaggtgacttccatccaggactgggttcagaagaccatagctgagaactaatgcaaggctggccggaagcccttgcctgaaagcaagatttcagcctggaagagggcaaagtggacgggagtggacaggagtggatgcgataagatgtggtttgaagctgatgggtgccagccctgcattgctgagtcaatcaataaagagctttcttttgaccca

SEQ ID NO: 448081 - DNA, 1113 bp, Homo sapiens
ggactgctcttccagaggcaagaccaaccaagatgagtgccctgggagctgtcattgccctcctgctctggggacagctttttgcagtggactcaggcaatgatgtcacggatatcgcagatgacggctgcccgaagccccccgagattgcacatggctatgtggagcactcggttcgctaccagtgtaagaactactacaaactgcgcacagaaggagatgacctggatgccaaaggcagctttccctggcaggctaagatggtttcccaccataatctcaccacaggtgccacgctgatcaatgaacaatggctgctgaccacggctaaaaatctcttcctgaaccattcagaaaatgcaacagcgaaagacattgcccctactttaacactctatgtggggaaaaagcagcttgtagagattgagaaggttgttctacaccctaactactcccaggtagatattgggctcatcaaactcaaacagaaggtgtctgttaatgagagagtgatgcccatctgcctaccttcaaaggattatgcagaagtagggcgtgtgggttatgtttctggctgggggcgaaatgccaattttaaatttactgaccatctgaagtatgtcatgctgcctgtggctgaccaagaccaatgcataaggcattatgaaggcagcacagtccccgaaaagaagacaccgaagagccctgtaggggtgcagccccatactgaatgaacacaccttctgtgctggcatgtctaagtaccaagaagacacctgctatggcgatgcgggcagtgcctttgccgttcacgacctggaggaggacacctggtatgcgactgggatcttaagctttgataagagctgtgctgtggctgagtatggtgtgtatgtgaaggtgacttccatccaggactgggttcagaagaccatagctgagaactaatgcaaggctggccggaagcccttgcctgaaagcaagatttcagcctggaagagggcaaagtggacgggagtggacaggagtggatgcgataagatgtggtttgaagctgatgggtgccagccctgcattgctgagtcaatcaataaagagctttcttttgaccca

SEQ ID NO: 448082 - DNA, 1177 bp, Homo sapiens
ggactgctcttccagaggcaagaccaaccaagatgagtgccctgggagctgtcattgccctcctgctctggggacagctttttgcagtggactcaggcaatgatgtcacggatatcgcagatgacggctgcccgaagccccccgagattgcacatggctatgtggagcactcggttcgctaccagtgtaagaactactacaaactgcgcacagaaggagatggagtgtacaccttaaacaatgagaagcagtggataaataaggctgttggagataaacttcctgaatgtgaagcagtatgtgggaagcccaagaatccggcaaacccagtgcagcggatcctgggtggacacctggatgccaaaggcagctttccctggcaggctaagatggtttcccaccataatctcaccacaggtgccacgctgatcaatgaacaatggctgctgaccacggctaaaaatctcttcctgaaccattcagaaaatgcaacagcgaaagacattgcccctactttaacacgtagatattgggctcatcaaactcaaacagaaggtgtctgttaatgagagagtgatgcccatctgcctaccttcaaaggattatgcagaagtagggcgtgtgggttatgtttctggctgggggcgaaatgccaattttaaatttactgaccatctgaagtatgtcatgctgcctgtggctgaccaagaccaatgcataaggcattatgaaggcagcacagtccccgaaaagaagacaccgaagagccctgtaggggtgcagccccatactgaatgaacacaccttctgtgctggcatgtctaagtaccaagaagacacctgctatggcgatgcgggcagtgcctttgccgttcacgacctggaggaggacacctggtatgcgactgggatcttaagctttgataagagctgtgctgtggctgagtatggtgtgtatgtgaaggtgacttccatccaggactgggttcagaagaccatagctgagaactaatgcaaggctggccggaagcccttgcctgaaagcaagatttcagcctggaagagggcaaagtggacgggagtggacaggagtggatgcgataagatgtggtttgaagctgatgggtgccagccctgcattgctgagtcaatcaataaagagctttcttttgaccca

SEQ ID NO: 448083 - DNA, 1137 bp, Homo sapiens
ggactgctcttccagaggcaagaccaaccaagatgagtgccctgggagctgtcattgccctcctgctctggggacagctttttgcagtggactcaggcaatgatgtcacggatatcgcagatgacggctgcccgaagccccccgagattgcacatggctatgtggagcactcggttcgctaccagtgtaagaactactacaaactgcgcacagaaggagatggagtgtacaccttaaacaatgagaagcagtggataaataaggctgttggagataaacttcctgaatgtgaagcagataatctcaccacaggtgccacgctgatcaatgaacaatggctgctgaccacggctaaaaatctcttcctgaaccattcagaaaatgcaacagcgaaagacattgcccctactttaacactctatgtggggaaaaagcagcttgtagagattgagaaggttgttctacaccctaactactcccaggtagatattgggctcatcaaactcaaacagaaggtgtctgttaatgagagagtgatgcccatctgcctaccttcaaaggattatgcagaagtagggcgtgtgggttatgtttctggctgggggcgaaatgccaattttaaatttactgaccatctgaagtatgtcatgctgcctgtggctgaccaagaccaatgcataaggcattatgaaggcagcacagtccccgaaaagaagacaccgaagagccctgtaggggtgcagccccatactgaatgaacacaccttctgtgctggcatgtctaagtaccaagaagacacctgctatggcgatgcgggcagtgcctttgccgttcacgacctggaggaggacacctggtatgcgactgggatcttaagctttgataagagctgtgctgtggctgagtatggtgtgtatgtgaaggtgacttccatccaggactgggttcagaagaccatagctgagaactaatgcaaggctggccggaagcccttgcctgaaagcaagatttcagcctggaagagggcaaagtggacgggagtggacaggagtggatgcgataagatgtggtttgaagctgatgggtgccagccctgcattgctgagtcaatcaataaagagctttcttttgaccca

SEQ ID NO: 448084 - DNA, 1171 bp, Homo sapiens
ggactgctcttccagaggcaagaccaaccaagatgagtgccctgggagctgtcattgccctcctgctctggggacagctttttgcagtggactcaggcaatgatgtcacggatatcgcagatgacggctgcccgaagccccccgagattgcacatggctatgtggagcactcggttcgctaccagtgtaagaactactacaaactgcgcacagaaggagatggagtgtacaccttaaacaatgagaagcagtggataaataaggctgttggagataaacttcctgaatgtgaagcagtatgtgggaagcccaagaatccggcaaacccagtgcagcggatcctgggtggacacctggatgccaaaggcagctttccctggcaggctaagatggtttcccaccataatctcaccacaggtgccacgctgatcaatgaacaatggctgctgaccacggctaaaaatctcttcctgaaccattcagaaaatgcaacagcgaaagacattgcccctactttaacactctatgtggggaaaaagcagcttgtagagattgagaaggttgttctacaccctaactactcccaggtagatattgggctcatcaaactcaaatgtgggttatgtttctggctgggggcgaaatgccaattttaaatttactgaccatctgaagtatgtcatgctgcctgtggctgaccaagaccaatgcataaggcattatgaaggcagcacagtccccgaaaagaagacaccgaagagccctgtaggggtgcagccccatactgaatgaacacaccttctgtgctggcatgtctaagtaccaagaagacacctgctatggcgatgcgggcagtgcctttgccgttcacgacctggaggaggacacctggtatgcgactgggatcttaagctttgataagagctgtgctgtggctgagtatggtgtgtatgtgaaggtgacttccatccaggactgggttcagaagaccatagctgagaactaatgcaaggctggccggaagcccttgcctgaaagcaagatttcagcctggaagagggcaaagtggacgggagtggacaggagtggatgcgataagatgtggtttgaagctgatgggtgccagccctgcattgctgagtcaatcaataaagagctttcttttgaccca

SEQ ID NO: 448085 - DNA, 942 bp, Homo sapiens
ggactgctcttccagaggcaagaccaaccaagatgagtgccctgggagctgtcattgccctcctgctctggggacagctttttgcagtggactcaggcaatgatgtcacggatatcgcagatgacggctgcccgaagccccccgagattgcacatggctatgtggagcactcggttcgctaccagtgtaagaactactacaaactgcgcacagaaggagatgtctatgtggggaaaaagcagcttgtagagattgagaaggttgttctacaccctaactactcccaggtagatattgggctcatcaaactcaaacagaaggtgtctgttaatgagagagtgatgcccatctgcctaccttcaaaggattatgcagaagtagggcgtgtgggttatgtttctggctgggggcgaaatgccaattttaaatttactgaccatctgaagtatgtcatgctgcctgtggctgaccaagaccaatgcataaggcattatgaaggcagcacagtccccgaaaagaagacaccgaagagccctgtaggggtgcagccccatactgaatgaacacaccttctgtgctggcatgtctaagtaccaagaagacacctgctatggcgatgcgggcagtgcctttgccgttcacgacctggaggaggacacctggtatgcgactgggatcttaagctttgataagagctgtgctgtggctgagtatggtgtgtatgtgaaggtgacttccatccaggactgggttcagaagaccatagctgagaactaatgcaaggctggccggaagcccttgcctgaaagcaagatttcagcctggaagagggcaaagtggacgggagtggacaggagtggatgcgataagatgtggtttgaagctgatgggtgccagccctgcattgctgagtcaatcaataaagagctttcttttgaccca

SEQ ID NO: 448086 - DNA, 956 bp, Homo sapiens
ggactgctcttccagaggcaagaccaaccaagatgagtgccctgggagctgtcattgccctcctgctctggggacagctttttgcagtggactcaggcaatgatgtcacggatatcgcagatgacggctgcccgaagccccccgagattgcacatggctatgtggagcactcggttcgctaccagtgtaagaactactacaaactgcgcacagaaggagatggagtgtacaccttaaacaatgagaagcagtggataaataaggctgttggagataaacttcctgaatgtgaagcagtatgtgggaagcccaagaatccggcaaacccagtgcagcggatcctgggtggacacctggatgccaaaggcagctttccctggcaggctaagatggtttcccaccataatctcaccacaggtgccacgctgatcaatgaacaatggctgctgaccacggctaaaaatctcttcctgaaccattcagaaaatgcaacagcgaaagacattgcccctactttaacacccccgaaaagaagacaccgaagagccctgtaggggtgcagccccatactgaatgaacacaccttctgtgctggcatgtctaagtaccaagaagacacctgctatggcgatgcgggcagtgcctttgccgttcacgacctggaggaggacacctggtatgcgactgggatcttaagctttgataagagctgtgctgtggctgagtatggtgtgtatgtgaaggtgacttccatccaggactgggttcagaagaccatagctgagaactaatgcaaggctggccggaagcccttgcctgaaagcaagatttcagcctggaagagggcaaagtggacgggagtggacaggagtggatgcgataagatgtggtttgaagctgatgggtgccagccctgcattgctgagtcaatcaataaagagctttcttttgaccca

SEQ ID NO: 448087 - DNA, 860 bp, Homo sapiens
ggactgctcttccagaggcaagaccaaccaagatgagtgccctgggagctgtcattgccctcctgctctggggacagctttttgcagtggactcaggcaatgatgtcacggatatcgcagatgacggctgcccgaagccccccgagattgcacatggctatgtggagcactcggttcgctaccagtgtaagaactactacaaactgcgcacagaaggagatggagtgtacaccttaaacaatgagaagcagtggataaataaggctgttggagataaacttcctgaatgtgaagcagtatgtgggaagcccaagaatccggcaaacccagtgcagcggatcctgggtggacacctggatgccaaaggcagctttccctggcaggctaagatggtttcccaccataatctcaccacaggtgccacgctgatcaatgaacaatggctgctgaccacggctaaaaatctcttcctgaacaatgaacacaccttctgtgctggcatgtctaagtaccaagaagacacctgctatggcgatgcgggcagtgcctttgccgttcacgacctggaggaggacacctggtatgcgactgggatcttaagctttgataagagctgtgctgtggctgagtatggtgtgtatgtgaaggtgacttccatccaggactgggttcagaagaccatagctgagaactaatgcaaggctggccggaagcccttgcctgaaagcaagatttcagcctggaagagggcaaagtggacgggagtggacaggagtggatgcgataagatgtggtttgaagctgatgggtgccagccctgcattgctgagtcaatcaataaagagctttcttttgaccca

SEQ ID NO: 448088 - DNA, 656 bp, Homo sapiens
ggactgctcttccagaggcaagaccaaccaagatgagtgccctgggagctgtcattgccctcctgctctggggacagctttttgcagtggactcaggcaatgatgtcacggatatcgcagatgacggctgcccgaagccccccgagattgcacatggctatgtggagcactcggttcgctaccagtgtaagaactactacaaactgcgcacagaaggagatgccccgaaaagaagacaccgaagagccctgtaggggtgcagccccatactgaatgaacacaccttctgtgctggcatgtctaagtaccaagaagacacctgctatggcgatgcgggcagtgcctttgccgttcacgacctggaggaggacacctggtatgcgactgggatcttaagctttgataagagctgtgctgtggctgagtatggtgtgtatgtgaaggtgacttccatccaggactgggttcagaagaccatagctgagaactaatgcaaggctggccggaagcccttgcctgaaagcaagatttcagcctggaagagggcaaagtggacgggagtggacaggagtggatgcgataagatgtggtttgaagctgatgggtgccagccctgcattgctgagtcaatcaataaagagctttcttttgaccca

SEQ ID NO: 448089 - DNA, 1012 bp, Homo sapiens
ggactgctcttccagaggcaagaccaaccaagatgagtgccctgggagctgtcattgccctcctgctctggggacagctttttgcagtggactcaggcaatgatgtcacggatatcgcagatgacggctgcccgaagccccccgagattgcacatggctatgtggagcactcggttcgctaccagtgtaagaactactacaaactgcgcacagaaggagatggagtgtacaccttaaacaatgagaagcagtggataaataaggctgttggagataaacttcctgaatgtgaagcagataatctcaccacaggtgccacgctgatcaatgaacaatggctgctgaccacggctaaaaatctcttcctgaaccattcagaaaatgcaacagcgaaagacattgcccctactttaacactctatgtggggaaaaagcagcttgtagagattgagaaggttgttctacaccctaactactcccaggtagatattgggctcatcaaactcaaacagaaggtgtctgttaatgagagagtgatgcccatctgcctaccttcaaaggattatgcagaagtagggcgtgtgggttatgtttctggctgggggcgaaatgccaattttaaatttacaatgaacacaccttctgtgctggcatgtctaagtaccaagaagacacctgctatggcgatgcgggcagtgcctttgccgttcacgacctggaggaggacacctggtatgcgactgggatcttaagctttgataagagctgtgctgtggctgagtatggtgtgtatgtgaaggtgacttccatccaggactgggttcagaagaccatagctgagaactaatgcaaggctggccggaagcccttgcctgaaagcaagatttcagcctggaagagggcaaagtggacgggagtggacaggagtggatgcgataagatgtggtttgaagctgatgggtgccagccctgcattgctgagtcaatcaataaagagctttcttttgaccca

SEQ ID NO: 448090 - DNA, 1005 bp, Homo sapiens
ggactgctcttccagaggcaagaccaaccaagatgagtgccctgggagctgtcattgccctcctgctctggggacagctttttgcagtggactcaggcaatgatgtcacggatatcgcagatgacggctgcccgaagccccccgagattgcacatggctatgtggagcactcggttcgctaccagtgtaagaactactacaaactgcgcacagaaggagatggagtatacaccttaaatgataagaagcagtggataaataaggctgttggagataaacttcctgaatgtgaagcagatgacggctgcccgaagccccccgagattgcacatggctatgtggagcactcggttcgctaccagtgtaagaactactacaaactgcgcacagaaggagatggtaagatgtggacaactgtctccatgccctacatacaacccccttctctgacatttccatgatgggtggtgctgaggtgattcgccagaaagttcgttgctctccttggagccaggagatttagattctaataagcgttttgtcgccagtagccatggccctttgggcagactaacttttgtcagcctcaagttttctgttttgttaaggggaggcgatgccatgcagcctacctcatgtaaatctcagagtcagatttacatctccagcagatgtgggaaaagaaggaatgctgatgatgatgtcaccctcacctagtgagtcttgctgtcctggcactgctctaagggctttatacttatttgctcacttagtcctcacagtatccctctgaacagagtttattgttttcactttgctgataaggaaactgaggcacagacaggttgagtatcttgcccaaattcaggcagcctgtaagaggcagagtcaggatttgaaccctgagccctccctgtactgcttggctgtgaccgccatgaccacagtgtgttctgctgggcttaactggcatccaggcacttggcttccagcacagcactcttt

SEQ ID NO: 448091 - DNA, 966 bp, Homo sapiens
  misc_feature (966)..(966): n is a, c, g, or t
ggactgctcttccagaggcaagaccaaccaagatgagtgccctgggagctgtcattgccctcctgctctggggacagctttttgcagtggactcaggcaatgatgtcacggatatcgcagatgacggctgcccgaagccccccgagattgcacatggctatgtggagcactcggttcgctaccagtgtaagaactactacaaactgcgcacagaaggagatggagtgtacaccttaaacaatgagaagcagtggataaataaggctgttggagatatcaaagctctgtttgtgtctgaggaggagacaaagctgactcggccaggaggtctacatcaagaatggggatacagaaaggcaagctgtgcagagagatgctcaagcatgccccaggctatgacaaagtccaggacatctcagtaggtggtcacccatcggatcctcatgtacggcaggagtgagtcccctatgcagaccccaaacaacttgccagaggtgatctggcggccctgacagtctccacacagagaacgtcgacccatacaagcacggtgcaacccagcacgaggcacacagcaggagccagcacacaacccagcacagcggcaccaagccggtacctgccacaggcccgacactgcaaacattcaacccccttaagctgcaggccgcatgaacgagacaccccaagcagcgcatagagtcatcaagacggggctaccgtgcggaactcgaggctaggcatcgatcaaacgtggaaaacaaaaacaacaaccacaacgacaacacaacctgcacaaaacaaccacaacaaatggcgagccaagagcatcacaatactcggcgagaccgagaacgcaaaacgtaccagacatcacactccatagtcgagcaaggcacacggacaatgacaagaaacacaagatacacagacacaacacggcgatccaggcggatccacagtcgn

SEQ ID NO: 448092 - DNA, 615 bp, Homo sapiens
ggactgctcttccagaggcaagaccaaccaagatgagtgccctgggagctgtcattgccctcctgctctggggacagctttttgcagtggactcaggcaatgatgtcacggatatcgcagatgacggctgcccgaagccccccgagattgcacatggctatgtggagcactcggttcgctaccagtgtaagaactactacaaactgcgcacagaaggagatgaatgaacacaccttctgtgctggcatgtctaagtaccaagaagacacctgctatggcgatgcgggcagtgcctttgccgttcacgacctggaggaggacatgtggctgagtatggtgtgtatgtgaaggtgacttccatccaggactgggttcagaagaccatagctgagaactaatgcaaggctggccggaagcccttgcctgaaagcaagatttcagcctggaagagggcaaagtggacgggagtggacaggagtggatgcgataagatgtggtttgaagctgatgggtgccagccctgcattgctgagtcaatcaataaagagctttcttttgacccaaaaaaaaaaaaaaaaaaaaaaaaaaaaaaaaaaaaaaaaaaatttggggcgc

SEQ ID NO: 448093 - DNA, 448 bp, Homo sapiens
ggactgctcttccagaggcaagaccaaccaagatgagtgccctgggagctgtcattgccctcctgctctggggacagctttttgcagtggactcaggcaatgatgtcacggatatcgcagatgacggctgcccgaagccccccgagattgcacattgtggctgagtatggtgtgtatgtgaaggtgacttccatccaggactgggttcagaagaccatagctgagaactaatgcaaggctggccggaagcccttgcctgaaagcaagatttcagcctggaagagggcaaagtggacgggagtggacaggagtggatgcgataagatgtggtttgaagctgatgggtgccagccctgcattgctgagtcaatcaataaagagctttcttttgacccaaaaaaaaaaaaaaaaaaaaaaaaaaaaaaaaaaaaaaaaaaatttggggcgc

SEQ ID NO: 448094 - DNA, 269 bp, Homo sapiens
ctctctgcagtgacctgggagctgtcatttccctcctgctctggggacgacagctttttgcactgtactcaggcaatgatgtcacggatatttcaggtcagtctttgagttgggtaggagcatgcatccctggcactgccacatcccactctgactctctcgggtctgcattctttctttgagaacacacagttccccattcttatcctgacctctgggctttcaggactgccaagaacattggggatcctgccagaaatgaggggagc

SEQ ID NO: 448095 - DNA, 515 bp, Homo sapiens
gaaactgaggcacagacaggttgagtatcttgcccaaattcaggcagcctgtaagaggcagagtcaggatttgaaccctgagccctccctgtactgcttggctgtgaccgccatgaccacagtgtgttctgctgggcttaactggcatccaggcacttggcttccagcacagcactctttcccttcctccttctcatatactctctccttttccccttcctttttgtccccttttcctcttccttttagttcttctctttaaatgccttctcactctgcacggggtctagacttgacttctcctttggctcacttcttgccttttgtttcaggagtgtacaccttaaacaatgagaagcagtggataaataaggctgttggagataaacttcctgaatgtgaagcaggtgggtgctgagcacttaagagagcaggcaggcgtccagcggggaacgtcctagaggcacagccttccagtgcggcttcctctgagcacacaagagccaggaggaggg

SEQ ID NO: 448096 - DNA, 386 bp, Homo sapiens
gggtgcagccccatactgaatgaacacaccttctgtgctggcatgtctaagtaccaagaagacacctgctatggcgatgcgggcagtgcctttgccgttcacgacctggaggaggacacctggtatgcgactgggatcttaagctttgataagagctgtgctgtggctgagtatggtgtgtatgtgaaggtgacttccatccaggactgggttcagaagaccatagctgagaactaatgcaaggctggccggaagcccttgcctgaaagcaagatttcagcctggaagagggcaaagtggacgggagtggacaggagtggatgcgataagatgtggtttgaagctgatgggtgccagccctgcattgctgagtcaatcaataaaga

SEQ ID NO: 448097 - DNA, 1419 bp, Homo sapiens
ggactgctcttccagaggcaagaccaaccaagatgagtgccctgggagctgtcattgccctcctgctctggggacagctttttgcagtggactcaggcaatgatgtcacggatatcgcagatgacggctgcccgaagccccccgagattgcacatggctatgtggagcactcggttcgctaccagtgtaagaactactacaaactgcgcacagaaggagatggagtatacaccttaaatgataagaagcagtggataaataaggctgttggagataaacttcctgaatgtgaagcagatgacggctgcccgaagccccccgagattgcacatggctatgtggagcactcggttcgctaccagtgtaagaactactacaaactgcgcacagaaggagatggagtgtacaccttaaacaatgagaagcagtggataaataaggctgttggagataaacttcctgaatgtgaagcagtatgtgggaagcccaagaatccggcaaacccagtgcagcggatcctgggtggacacctggatgccaaaggcagctttccctggcaggctaagatggtttcccaccataatctcaccacaggtgccacgctgatcaatgaacaatggctgctgaccacggctaaaaatctcttcctgaaccattcagaaaatgcaacagcgaaagacattgcccctactttaacactctatgtggggaaaaagcagcttgtagagattgagaaggttgttctacaccctaactactcccaggtagatattgggctcatcaaactcaaacagaaggtgtctgttaatgagagagtgatgcccatctgcctaccttcaaaggattatgcagaagtagggcgtgtgggttatgtttctggctgggggcgaaatgccaattttaaatttactgaccatctgaagtatgtcatgctgcctgtggctgaccaagaccaatgcataaggcattatgaaggcagcacagtccccgaaaagaagacaccgaagagccctgtaggggtgcagccccatactgaatgaacacaccttctgtgctggcatgtctaagtaccaagaagacacctgctatggcgatgcgggcagtgcctttgccgttcacgacctggaggaggacacctggtatgcgactgggatcttaagctttgataagagctgtgctgtggctgagtatggtgtgtatgtgaaggtgacttccatccaggactgggttcagaagaccatagctgagaactaatgcaaggctggccggaagcccttgcctgaaagcaagatttcagcctggaagagggcaaagtggacgggagtggacaggagtggatgcgataagatgtggtttgaagctgatgggtgccagccctgcattgctgagtcaatcaataaagagctttcttttgaccca

SEQ ID NO: 448098 - DNA, 718 bp, Homo sapiens
ggactgctcttccagaggcaagaccaaccaagatgagtgccctgggagctgtcattgccctcctgctctggggacagctttttgcagtggactcaggcaatgatgtcacggatatcgcagatgacggctgcccgaagccccccgagattgcacatggctatgtggagcactcggttcgctaccagtgtaagaactactacaaactgcgcacagaaggagatggagtgtacaccttaaacaatgagaagcagtggataaataaggctgttggagataaacttcctgaatgtgaagcagtatgtgggaagcccaagaatccggcaaacccagtgcagcggatcctgggtggacacctggatgccaaaggcagctttccctggcaggctaagatggtttcccacctgcctttgccgttcacgacctggaggaggacacctggtatgcgactgggatcttaagctttgataagagctgtgctgtggctgagtatggtgtgtatgtgaaggtgacttccatccaggactgggttcagaagaccatagctgagaactaatgcaaggctggccggaagcccttgcctgaaagcaagatttcagcctggaagagggcaaagtggacgggagtggacaggagtggatgcgataagatgtggtttgaagctgatgggtgccagccctgcattgctgagtcaatcaataaagagctttcttttgaccca

SEQ ID NO: 448099 - DNA, 565 bp, Homo sapiens
ggactgctcttccagaggcaagaccaaccaagatgagtgccctgggagctgtcattgccctcctgctctggggacagctttttgcagtggactcaggcaatgatgtcacggatatcgcagatgacggctgcccgaagccccccgagattgcacatggctatgtggagcactcggttcgctaccagtgtaagaactactacaaactgcgcacagaaggagatgagacacctgctatggcgatgcgggcagtgcctttgccgttcacgacctggaggaggacacctggtatgcgactgggatcttaagctttgataagagctgtgctgtggctgagtatggtgtgtatgtgaaggtgacttccatccaggactgggttcagaagaccatagctgagaactaatgcaaggctggccggaagcccttgcctgaaagcaagatttcagcctggaagagggcaaagtggacgggagtggacaggagtggatgcgataagatgtggtttgaagctgatgggtgccagccctgcattgctgagtcaatcaataaagagctttcttttgaccca

SEQ ID NO: 448100 - DNA, 624 bp, Homo sapiens
ggactgctcttccagaggcaagaccaaccaagatgagtgccctgggagctgtcattgccctcctgctctggggacagctttttgcagtggactcaggcaatgatgtcacggatatcgcagatgacggctgcccgaagccccccgagattgcacatggctatgtggagcactcggttcgctaccagtgtaagaactactacaaactgcgcacagaaggagatgcttctagtaggagggctgaaagggagcaacttttcctccaatcctggaaattcgacacaattagatttgaactgctggaaatacaacacatgttaaatcttaagtacaagggggaaaaaataaatcagttattgaaacataaaaatgaataccaaggacctgatcaaatttcacacagcagtttccttgcaacactttcagctccccatgctccagaatacccacccaagaaaataataggctttaaaacaatatcggctcctcatccaaagaacaactgctgattgaaacacctcattagctgagtgtagagaagtgcatcttatgaaacagtcttagcagtggtaggttgggaaggagatagctgcaaccaaaaaagaaataaatattctataaaccttc

SEQ ID NO: 448101 - DNA, 809 bp, Homo sapiens
  misc_feature (540)..(541): n is a, c, g, or t
ggactgctcttccagaggcaagaccaaccaagatgagtgccctgggagctgtcattgccctcctgctctggggacagctttttgcagtggactcaggcaatgatgtcacggatatcgcagatgacggctgcccgaagccccccgagattgcacatggctatgtggagcactcggttcgctaccagtgtaagaactactacaaactgcgcacagaaggagatgtgcctttgccgttcacgacctggaggaggacacctggtatgcgactgggatcttaagctttgataagagctgtgctgtggctgagtatggtgtgtatgtgaaggtgacttccatccaggactgggttcagaagaccatagctgagaactaatgcaaggctggccggaagcccttgcctgaaagcaagatttcagcctggaagagggcaaagtggacgggagtggacaggagtggatgcgataagatgtggtttgaagctgatgggtgccagccctgcattgctgagtcaatcaataaagagctttcttttgacccatnnaaaaaaaaccacaacaaaaacttttggcccccttgggccccggaaaagtttcaaaacattcgttggggcggggcgcaaggggaacgggaaccgggcaaagcggtccaaggaaacccgtgcgccagagaaaagagcggagagatttcccaccatgtaaaaaaagcccggggggaacaccggcgcgttctggaacacactccgagagggccctcagaggcacaaaacgggacgcatccagagggtgccagaggaaaccgcaataaaaccg

SEQ ID NO: 448102 - DNA, 399 bp, Homo sapiens
ggactgctcttccagaggcaagaccaaccaagatgagtgccctgggagctgtcattgccctcctgctctggggacagctttttgcagtggactcaggcaatgatgtcacggatatcgcagatgacggctgcccgaagccccccgagattgcacatggctatgtggagcactcggttcgctaccagtgtaagaactactacaaactgcgcacagaaggagatgtgtggctgagtatggtgtgtatgtgaaggtgacttccatccaggactgggttcagcctggaagagggcaaagtggacgggagtggacaggagtggatgcgataagatgtggtttgaagctgatgggtgccagccctgcattgctgagtcaatcaataaagagctttcttttgaccca

SEQ ID NO: 448103 - DNA, 828 bp, Homo sapiens
ggactgctcttccagaggcaagaccaaccaagatgagtgccctgggagctgtcattgccctcctgctctggggacagctttttgcagtggactcaggcaatgatgtcacggatatcgcagatgacggctgcccgaagccccccgagattgcacatggctatgtggagcactcggttcgctaccagtgtaagaactactacaaactgcgcacagaaggagatggtaagatgtggacaactgtctccatgccctacatacaacccccttctctgacatttccatgatgggtggtgctgaggtgattcgccagaaagttcgttgctctccttggagccaggagatttagattctaataagcgttttgtcgccagtagccatggccctttgggcagactaacttttgtcagcctcaagttttctgttttgttaaggggaggcgatgccatgcagcctacctcatgtaaatctcagagtcagatttacatctccagcagatgtgggaaaagaaggaatgctgatgatgatgtcaccctcacctagtgagtcttgctgtcctggcactgctctaagggctttatacttatttgctcacttagtcctcacagtatccctctgaacagagtttattgttttcactttgctgataaggaaactgaggcacagacaggttgagtatcttgcccaaattcaggcagcctgtaagaggcagagtcaggatttgaaccctgagccctccctgtactgcttggctgtgaccgccatgaccacagtgtgttctgctgggcttaactggcatccaggcacttggcttccagcacagcactcttt

SEQ ID NO: 448104 - DNA, 1443 bp, Homo sapiens
  misc_feature (1443)..(1443): n is a, c, g, or t
ggactgctcttccagaggcaagaccaaccaagatgagtgccctgggagctgtcattgccctcctgctctggggacagctttttgcagtggactcaggcaatgatgtcacggatatcgcagatgacggctgcccgaagccccccgagattgcacatggctatgtggagcactcggttcgctaccagtgtaagaactactacaaactgcgcacagaaggagatggagtgtacaccttaaacaatgagaagcagtggataaataaggctgttggagataaacttcctgaatgtgaagcagtatgtgggaagcccaagaatccggcaaacccagtgcagcggatcctgggtggacacctggatgccaaaggcagctttccctggcaggctaagatggtttcccaccataatctcaccacaggtgccacgctgatcaatgaacaatggctgctgaccacggctaaaaatctcttcctgaaccattcagaaaatgcaacagcgaaagacattgcccctactttaacactctatgtggggaaaaagcagcttgtagagattgagaaggttgttctacaccctaactactcccaggtagatattgggctcatcaaactcaaacagaaggtgtctgttaatgagagagtgatgcccatctgcctaccttcaaaggattatgcagaagtagggcgtgtgggttatgtttctggctgggggcgaaatgccaattttaaatttactgaccatctgaagtatgtcatgctgcctgtggctgaccaagaccaatgcataaggcattatgaaggcagcacagtccccgaaaagaagacaccgaagagccctgtaggggtgcagccccatactgaatgaacacaccttctgtgctggcatgtctaagtaccaagaagacacctgctatggcgatgcgggcagtgcctttgccgttcacgacctggaggaggacacctggtatgcgactgggatcttaagctttgataagagctgtgctgtggctgagtatggtgtgtatgtgaaggtgacttccatccaggactgggttcagaagaccatagctgagaactaatgcaaggctggccggaagcccttgcctgaaagcaagatttcagcctggaagagggcaaagtggacgggagtggacaggagtggatgcgataagatgtggtttgaagctgatgggtgccagccctgcattgctgagtcaatcaataaagagctttcttttgacccaaaaaaaaaaaaaaaaaaaaaaaaaaaaaaattgtggtggggggattgggcccttgaaaagggttttgaaaacattctgggtgggagcccgggggccaagatgggataggtggaccatgggacaaaaggggttcccaaggaaaaccggggaccaagaaacaaagggcgagggatttctccacaagttaaaaaaggcccggan

SEQ ID NO: 448105 - DNA, 1264 bp, Homo sapiens
ggactgctcttccagaggcaagaccaaccaagatgagtgccctgggagctgtcattgccctcctgctctggggacagctttttgcagtggactcaggcaatgatgtcacggatatcgcagatgacggctgcccgaagccccccgagattgcacatggctatgtggagcactcggttcgctaccagtgtaagaactactacaaactgcgcacagaaggagatggagtgtacaccttaaacaatgagaagcagtggataaataaggctgttggagataaacttcctgaatgtgaagcagtatgtgggaagcccaagaatccggcaaacccagtgcagcggatcctgggtggacacctggatgccaaaggcagctttccctggcaggctaagatggtttcccaccataatctcaccacaggtgccacgctgatcaatgaacaatggctgctgaccacggctaaaaatctcttcctgaaccattcagaaaatgcaacagcgaaagacattgcccctactttaacactctatgtggggaaaaagcagcttgtagagattgagaaggttgttctacaccctaactactcccaggtagatattgggctcatcaaactcaaacagaaggtgtctgttaatgagagagtgatgcccatctgcctaccttcaaaggattatgcagaagtagggcgtgtgggttatgtttctggctgggggcgaaatgccaattttaaatttactgaccatctgaagtatgtcatgctgcctgtggctgaccaagaccaatgcataaggcattatgaaggcagcacagtccccgaaaagaagacaccgaagagccctgtaggggtgcagccccatactgaatgaacacaccttctgtgctggcatgtctaagtaccaagaagacacctgctatggcgatgcgggcagtgcctttgccgttcacgacctggaggaggacacctggtatgcgactgggatcttaagctttgataagagctgtgctgtggctgagtatggtgtgtatgtgaaggtgacttccatccaggactgggttcagaagaccatagctgagaactaatgcaaggctggccggaagcccttgcctgaaagcaagatttcagcctggaagagggcaaagtggacgggagtggacaggagtggatgcgataagatgtggtttgaagctgatgggtgccagccctgcattgctgagtcaatcaataaagagctttcttttgacccaaaaaaaaaaaaatttggggcgc

SEQ ID NO: 448106 - DNA, 1192 bp, Homo sapiens
ggactgctcttccagaggcaagaccaaccaagatgagtgccctgggagctgtcattgccctcctgctctggggacagctttttgcagtggactcaggcaatgatgtcacggatatcgcagatgacggctgcccgaagccccccgagattgcacatggctatgtggagcactcggttcgctaccagtgtaagaactactacaaactgcgcacagaaggagatggagtgtacaccttaaacaatgagaagcagtggataaataaggctgttggagataaacttcctgaatgtgaagcagtatgtgggaagcccaagaatccggcaaacccagtgcagcggatcctgggtggacacctggatgccaaaggcagctttccctggcaggctaagatggtttcccaccataatctcaccacaggtgccacgctgatcaatgaacaatggctgctgaccacggctaaaaatctcttcctgaaccattcagaaaatgcaacagcgaaagacattgcccctactttaacactctatgtggggaaaaagcagcttgtagagattgagaaggttgttctacaccctaactactcccaggtagatattgggctcatcaaactcaaacagaaggtgtctgttaatgagagagtgatgcccatctgcctaccttcaaaggattatgcagaagtagggcgtgtgggttatgtttctggctgggggcgaaatgccaattttaaatttactgaccatctgaagtatgtcatgctgcctgtggctgaccaagaccaatgcataaggcattatgaaggcagcacagtaatgaacacaccttctgtgctggcatgtctaagtaccaagaagacacctgctatggcgatgcgggcagtgcctttgccgttcacgacctggaggaggacacctggtatgcgactgggatcttaagctttgataagagctgtgctgtggctgagtatggtgtgtatgtgaaggtgacttccatccaggactgggttcagaagaccatagctgagaactaatgcaaggctggccggaagcccttgcctgaaagcaagatttcagcctggaagagggcaaagtggacgggagtggacaggagtggatgcgataagatgtggtttgaagctgatgggtgccagccctgcattgctgagtcaatcaataaagagctttcttttgaccca

SEQ ID NO: 448107 - DNA, 1191 bp, Homo sapiens
ggactgctcttccagaggcaagaccaaccaagatgagtgccctgggagctgtcattgccctcctgctctggggacagctttttgcagtggactcaggcaatgatgtcacggatatcgcagatgacggctgcccgaagccccccgagattgcacatggctatgtggagcactcggttcgctaccagtgtaagaactactacaaactgcgcacagaaggagatggagtgtacaccttaaacaatgagaagcagtggataaataaggctgttggagataaacttcctgaatgtgaagcagtatgtgggaagcccaagaatccggcaaacccagtgcagcggatcctgggtggacataatctcaccacaggtgccacgctgatcaatgaacaatggctgctgaccacggctaaaaatctcttcctgaaccattcagaaaatgcaacagcgaaagacattgcccctactttaacactctatgtggggaaaaagcagcttgtagagattgagaaggttgttctacaccctaactactcccaggtagatattgggctcatcaaactcaaacagaaggtgtctgttaatgagagagtgatgcccatctgcctaccttcaaaggattatgcagaagtagggcgtgtgggttatgtttctggctgggggcgaaatgccaattttaaatttactgaccatctgaagtatgtcatgctgcctgtggctgaccaagaccaatgcataaggcattatgaaggcagcacagtccccgaaaagaagacaccgaagagccctgtaggggtgcagccccatactgaatgaacacaccttctgtgctggcatgtctaagtaccaagaagacacctgctatggcgatgcgggcagtgcctttgccgttcacgacctggaggaggacacctggtatgcgactgggatcttaagctttgataagagctgtgctgtggctgagtatggtgtgtatgtgaaggtgacttccatccaggactgggttcagaagaccatagctgagaactaatgcaaggctggccggaagcccttgcctgaaagcaagatttcagcctggaagagggcaaagtggacgggagtggacaggagtggatgcgataagatgtggtttgaagctgatgggtgccagccctgcattgctgagtcaatcaataaagagctttcttttgaccca

SEQ ID NO: 448108 - DNA, 1062 bp, Homo sapiens
ggactgctcttccagaggcaagaccaaccaagatgagtgccctgggagctgtcattgccctcctgctctggggacagctttttgcagtggactcaggcaatgatgtcacggatatcgcagatgacggctgcccgaagccccccgagattgcacatggctatgtggagcactcggttcgctaccagtgtaagaactactacaaactgcgcacagaaggagatgataatctcaccacaggtgccacgctgatcaatgaacaatggctgctgaccacggctaaaaatctcttcctgaaccattcagaaaatgcaacagcgaaagacattgcccctactttaacactctatgtggggaaaaagcagcttgtagagattgagaaggttgttctacaccctaactactcccaggtagatattgggctcatcaaactcaaacagaaggtgtctgttaatgagagagtgatgcccatctgcctaccttcaaaggattatgcagaagtagggcgtgtgggttatgtttctggctgggggcgaaatgccaattttaaatttactgaccatctgaagtatgtcatgctgcctgtggctgaccaagaccaatgcataaggcattatgaaggcagcacagtccccgaaaagaagacaccgaagagccctgtaggggtgcagccccatactgaatgaacacaccttctgtgctggcatgtctaagtaccaagaagacacctgctatggcgatgcgggcagtgcctttgccgttcacgacctggaggaggacacctggtatgcgactgggatcttaagctttgataagagctgtgctgtggctgagtatggtgtgtatgtgaaggtgacttccatccaggactgggttcagaagaccatagctgagaactaatgcaaggctggccggaagcccttgcctgaaagcaagatttcagcctggaagagggcaaagtggacgggagtggacaggagtggatgcgataagatgtggtttgaagctgatgggtgccagccctgcattgctgagtcaatcaataaagagctttcttttgaccca

SEQ ID NO: 448109 - DNA, 1612 bp, Homo sapiens
ggactgctcttccagaggcaagaccaaccaagatgagtgccctgggagctgtcattgccctcctgctctggggacagctttttgcagtggactcaggcaatgatgtcacggatatcgcagatgacggctgcccgaagccccccgagattgcacatggctatgtggagcactcggttcgctaccagtgtaagaactactacaaactgcgcacagaaggagatggagtgtacaccttaaacaatgagaagcagtggataaataaggctgttggagataaacttcctgaatgtgaagcagtatgtgggaagcccaagaatccggcaaacccagtgcagcggatcctgggtggacacctggatgccaaaggcagctttccctggcaggctaagatggtttcccaccataatctcaccacaggtgccacgctgatcaatgaacaatggctgctgaccacggctaaaaatctcttcctgaaccattcagaaaatgcaacagcgaaagacattgcccctactttaacactctatgtggggaaaaagcagcttgtagagattgagaaggttgttctacaccctaactactcccaggtagatattgggctcatcaaactcaaacagaaggtgtctgttaatgagagagtgatgcccatctgcctaccttcaaaggattatgcagaagtagggcgtgtgggttatgtttctggctgggggcgaaatgccaattttaaatttacctttccctggcaggctaagatggtttcccaccataatctcaccacaggtgccacgctgatcaatgaacaatggctgctgaccacggctaaaaatctcttcctgaaccattcagaaaatgcaacagcgaaagacattgcccctactttaacactctatgtggggaaaaagcagcttgtagagattgagaaggtggttctacaccctaactaccaccaggtagatattgggctcatcaaactcaaacagaaggtgcttgttaatgagagagtgatgcccatctgcctaccttcaaagaattatgcagaagtagggcgtgtgggttacgtgtctggctggggacaaagtgacaactttaaacttactgaccatctgaagtatgtcatgctgcctgtggctgaccaatacgattgcataacgcattatgaaggcagcacatgccccaaatggaaggcaccgaagagccctgtaggggtgcagcccatactgaacgaacacaccttctgtgtcggcatgtctaagtaccaggaagacacctgctatggcgatgcgggcagtgcctttgccgttcacgacctggaggaggacacctggtacgcggctgggatcctaagctttgataagagctgtgctgtggctgagtatggtgtgtatgtgaaggtgacttccatccagcactgggttcagaagaccatagctgagaactaatgcaaggctggccggaagcccttgcctgaaagcaagatttcagcctggaagagggcaaagtggacgggagtggacaggagtggatgcgataagatgtggtttgaagctgatgggtgccagccctgcattgctgagtcaatcaataaagagctttcttttgacccatttctgtg

SEQ ID NO: 448110 - DNA, 811 bp, Homo sapiens
ggactgctcttccagaggcaagaccaaccaagatgagtgccctgggagctgtcattgccctcctgctctggggacagctttttgcagtggactcaggcaatgatgtcacggatatcgcagatgacggctgcccgaagccccccgagattgcacatggctatgtggagcactcggttcgctaccagtgtaagaactactacaaactgcgcacagaaggagatgctaccttcaaaggattatgcagaagtagggcgtgtgggttatgtttctggctgggggcgaaatgccaattttaaatttactgaccatctgaagtatgtcatgctgcctgtggctgaccaagaccaatgcataaggcattatgaaggcagcacagtccccgaaaagaagacaccgaagagccctgtaggggtgcagccccatactgaatgaacacaccttctgtgctggcatgtctaagtaccaagaagacacctgctatggcgatgcgggcagtgcctttgccgttcacgacctggaggaggacacctggtatgcgactgggatcttaagctttgataagagctgtgctgtggctgagtatggtgtgtatgtgaaggtgacttccatccaggactgggttcagaagaccatagctgagaactaatgcaaggctggccggaagcccttgcctgaaagcaagatttcagcctggaagagggcaaagtggacgggagtggacaggagtggatgcgataagatgtggtttgaagctgatgggtgccagccctgcattgctgagtcaatcaataaagagctttcttttgaccca

SEQ ID NO: 448111 - DNA, 906 bp, Homo sapiens
ggactgctcttccagaggcaagaccaaccaagatgagtgccctgggagctgtcattgccctcctgctctggggacagctttttgcagtggactcaggcaatgatgtcacggatatcgcagatgacggctgcccgaagccccccgagattgcacatggctatgtggagcactcggttcgctaccagtgtaagaactactacaaactgcgcacagaaggagatggagtgtacaccttaaacaatgagaagcagtggataaataaggctgttggagataaacttcctgaatgtgaagcagtatgtgggaagcccaagaatccggcaaacccagtgcagcggatcctgggtggacacctggatgccaaaggcagctttccctggcaggctaagatggtttcccaccataatctcaccacaggtgccacgctgatcaatgaacaatggctgctgaccacggctaaaaatctcttcctgaaccattcagaaaatgcaacagcgaaagacattgcccctactttaacacaatgaacacaccttctgtgctggcatgtctaagtaccaagaagacacctgctatggcgatgcgggcagtgcctttgccgttcacgacctggaggaggacacctggtatgcgactgggatcttaagctttgataagagctgtgctgtggctgagtatggtgtgtatgtgaaggtgacttccatccaggactgggttcagaagaccatagctgagaactaatgcaaggctggccggaagcccttgcctgaaagcaagatttcagcctggaagagggcaaagtggacgggagtggacaggagtggatgcgataagatgtggtttgaagctgatgggtgccagccctgcattgctgagtcaatcaataaagagctttcttttgaccca

SEQ ID NO: 448112 - DNA, 799 bp, Homo sapiens
  misc_feature (621)..(621): n is a, c, g, or t
  misc_feature (666)..(666): n is a, c, g, or t
  misc_feature (702)..(702): n is a, c, g, or t
  misc_feature (780)..(780): n is a, c, g, or t
ggactgctcttccagaggcaagaccaaccaagatgagtgccctgggagctgtcattgccctcctgctctggggacagctttttgcagtggactcaggcaatgatgtcacggatatcgcagatgacggctgcccgaagccccccgagattgcacatggctatgtggagcactcggttcgctaccagtgtaagaactactacaaactgcgcacagaaggagatggagtgtacaccttaaacaatgagaagcagtggataaataaggctgttggagataaacttcctgaatgtgaagcagtatgtgggaagcccaagaatccggcaaacccagtgcagcggatcctgggtggacacctggatgccaaaggcagctttccctggcaggctaagatggtttcccaccataatctcaccacaggtgccacgctgatcaatgaacaatggctgctgaccacggctaaaaatctcttcctgaaccattcagaaaatgcaacagcgaaagacattgcccctactttaacacgtagatattgggctcatcaaactcaaacagaaggtgtctgttaatgagagagtgatgcccatctgcctaccttcaaaggattatgcagaagtagggcgngtgtgggtttatgttctgggctggggcgaaatgccaatatgatanggcatatgaggcagacagtcccgaaagagacacganagcctgtaggtgcagcatctgatgaccactctggctgatgttagtccagagcactgtatgcatcgcatgcctgcgtcnactgagagcactgatgcaa

SEQ ID NO: 448113 - DNA, 864 bp, Homo sapiens
ggactgctcttccagaggcaagaccaaccaagatgagtgccctgggagctgtcattgccctcctgctctggggacagctttttgcagtggactcaggcaatgatgtcacggatatcgcagatgacggctgcccgaagccccccgagattgcacatggctatgtggagcactcggttcgctaccagtgtaagaactactacaaactgcgcacagaaggagatggagtatacaccttaaatgataagaagcagtggataaataaggctgttggagataaacttcctgaatgtgaagcagataatctcaccacaggtgccacgctgatcaatgaacaatggctgctgaccacggctaaaaatctcttcctgaaccattcagaaaatgcaacagcgaaagacattgcccctactttaacactctatgtggggaaaaagcagcttgtagagattgagaaggttgttctacaccctaactactcccaggtagatattgggctcatcaaactcaaacagaaggtgtctgttaatgagagagtgatgcccatctgcctaccttcaaaggattatgcagaagtagggcgcctggtatgcgactgggatcttaagctttgataagagctgtgctgtggctgagtatggtgtgtatgtgaaggtgacttccatccaggactgggttcagaagaccatagctgagaactaatgcaaggctggccggaagcccttgcctgaaagcaagatttcagcctggaagagggcaaagtggacgggagtggacaggagtggatgcgataagatgtggtttgaagctgatgggtgccagccctgcattgctgagtcaatcaataaagagctttcttttgaccca

SEQ ID NO: 448114 - DNA, 351 bp, Homo sapiens
  misc_feature (348)..(348): n is a, c, g, or t
ggactgctcttccagaggcaagaccaaccaagatgagtgccctgggagctgtcattgccctcctgctctggggacagctttttgcagtggactcaggcaatgatgtcacggatatcgcagatgacggctgcccgaagccccccgagattgcacatggctatgtggagcactcggttcgctaccagtgtaagaactactacaaactgcgcacagaaggagatggagtatacaccttaaatgataagaagcagtggataaataaggctgttggagataaacttcctgaatgtgaagcagacaatccggggaagcctaagtattccctacctcgtggggctagccatcgangcc

SEQ ID NO: 448115 - DNA, 3474 bp, Homo sapiens
aggttgggagagcggcggagaagcgagtgaggagggcgagcgcgaagccgggaagaggggcgcgcgtggagggggtgccgggcgccgcgagggcctgctccgggcacctgcgaacgcgcggcgctctcaaggagcgcctggctctcgcccgccagcctccggccgcgacgcgcccagggcgcggagagggggtggggacggattgggattctgccatcgccctcaccggctgggccctggagccgctcccaggataactccacgttggggagggcgcccgccgagcctccccggcctgtgcagacggcgcgcgcggcgggagggcgcggaccagcgtccccagcccggccccgggcggaaggcgagcggagcgcggccgcgcgggcagcagacggcagacggtgcccggcgcccacgggggctgcccctgatggggcctggcaatgactgagcaggcccagccccagaggacaaggaagagaaggcatattgaggagggcaagaagtgacgcccggtgtagaatgactgccctgggagggtggttccttgggccctggcagggttgctgacccttaccctgcaaaacacaaagagcaggactccagactcttcttgtgaatggtcccctgccctgcagctccaccatgaggcttctcgtggccccactcttgctagcttgggtggctggtgccactgccgctgtgcccgtggtaccctggcatgttccctgcccccctcagtgtgcctgccagatccggccctggtatacgccccgctcgtcctaccgcgaggctaccactgtggactgcaatgacctattcctgacggcagtccccccggcactccccgcaggcacacagaccctgctcctgcagagcaacagcattgtccgtgtggaccagagtgagctgggctacctggccaatctcacagagctggacctgtcccagaacagcttttcggatgcccgagactgtgatttccatgccctgccccagctgctgagcctgcacctagaggagaaccagctgacccggctggaggaccacagctttgcagggctggccagcctacaggaactctatctcaaccacaaccagctctaccgcatcgcccccagggccttttctggcctcagcaacttgctgcggctgcacctcaactccaacctcctgagggccattgacagccgctggtttgaaatgctgcccaacttggagatactcatgattggcggcaacaaggtagatgccatcctggacatgaacttccggcccctggccaacctgcgtagcctggtgctagcaggcatgaacctgcgggagatctccgactatgccctggaggggctgcaaagcctggagagcctctccttctatgacaaccagctggcccgggtgcccaggcgggcactggaacaggtgcccgggctcaagttcctagacctcaacaagaacccgctccagcgggtagggccgggggactttgccaacatgctgcaccttaaggagctgggactgaacaacatggaggagctggtctccatcgacaagtttgccctggtgaacctccccgagctgaccaagctggacatcaccaataacccacggctgtccttcatccacccccgcgccttccaccacctgccccagatggagaccctcatgctcaacaacaacgctctcagtgccttgcaccagcagacggtggagtccctgcccaacctgcaggaggtaggtctccacggcaaccccatccgctgtgactgtgtcatccgctgggccaatgccacgggcacccgtgtccgcttcatcgagccgcaatccaccctgtgtgcggagcctccggacctccagcgcctcccggtccgtgaggtgcccttccgggagatgacggaccactgtttgcccctcatctccccacgaagcttccccccaagcctccaggtagccagtggagagagcatggtgctgcattgccgggcactggccgaacccgaacccgagatctactgggtcactccagctgggcttcgactgacacctgcccatgcaggcaggaggtaccgggtgtaccccgaggggaccctggagctgcggagggtgacagcagaagaggcagggctatacacctgtgtggcccagaacctggtgggggctgacactaagacggttagtgtggttgtgggccgtgctctcctccagccaggcagggacgaaggacaggggctggagctccgggtgcaggagacccacccctatcacatcctgctatcttgggtcaccccacccaacacagtgtccaccaacctcacctggtccagtgcctcctccctccggggccagggggccacagctctggcccgcctgcctcggggaacccacagctacaacattacccgcctccttcaggccacggagtactgggcctgcctgcaagtggcctttgctgatgcccacacccagttggcttgtgtatgggccaggaccaaagaggccacttcttgccacagagccttaggggatcgtcctgggctcattgccatcctggctctcgctgtccttctcctggcagctgggctagcggcccaccttggcacaggccaacccaggaagggtgtgggtgggaggcggcctctccctccagcctgggctttctggggctggagtgccccttctgtccgggttgtgtctgctcccctcgtcctgccctggaatccagggaggaagctgcccagatcctcagaaggggagacactgttgccaccattgtctcaaaattcttgaagctcagcctgttctcagcagtagagaaatcactaggactactttttaccaaaagagaagcagtctgggccagatgccctgccaggaaagggacatggacccacgtgcttgaggcctggcagctgggccaagacagatggggctttgtggccctgggggtgcttctgcagccttgaaaaagttgcccttacctcctagggtcacctctgctgccattctgaggaacatctccaaggaacaggagggactttggctagagcctcctgcctccccatcttctctctgcccagaggctcctgggcctggcttggctgtcccctacctgtgtccccgggctgcaccccttcctcttctctttctctgtacagtctcagttgcttgctcttgtgcctcctgggcaagggctgaaggaggccactccatctcacctcggggggctgccctcaatgtgggagtgaccccagccagatctgaaggacatttgggagagggatgcccaggaacgcctcatctcagcagcctgggctcggcattccgaagctgactttctataggcaattttgtacctttgtggagaaatgtgtcacctcccccaacccgattcactcttttctcctgttttgtaaaaaataaaaataaataataacaataatacgggggaaaggaacgaaaggaaaataaaaatct

SEQ ID NO: 448116 - DNA, 3079 bp, Homo sapiens
gtcacggtaacctcaacccaaaagggctgcccctgatggggcctggcaatgactgagcaggcccagccccagaggacaaggaagagaaggcatattgaggagggcaagaagtgacgcccggtgtagaatgactgccctgggagggtggttccttgggccctggcagggttgctgacccttaccctgcaaaacacaaagagcaggactccagactcttcttgtgaatggtcccctgccctgcagctccaccatgaggcttctcgtggccccactcttgctagcttgggtggctggtgccactgccgctgtgcccgtggtaccctggcatgttccctgcccccctcagtgtgcctgccagatccggccctggtatacgccccgctcgtcctaccgcgaggctaccactgtggactgcaatgacctattcctgacggcagtccccccggcactccccgcaggcacacagaccctgctcctgcagagcaacagcattgtccgtgtggaccagagtgagctgggctacctggccaatctcacagagctggacctgtcccagaacagcttttcggatgcccgagactgtgatttccatgccctgccccagctgctgagcctgcacctagaggagaaccagctgacccggctggaggaccacagctttgcagggctggccagcctacaggaactctatctcaaccacaaccagctctaccgcatcgcccccagggccttttctggcctcagcaacttgctgcggctgcacctcaactccaacctcctgagggccattgacagccgctggtttgaaatgctgcccaacttggagatactcatgattggcggcaacaaggtagatgccatcctggacatgaacttccggcccctggccaacctgcgtagcctggtgctagcaggcatgaacctgcgggagatctccgactatgccctggaggggctgcaaagcctggagagcctctccttctatgacaaccagctggcccgggtgcccaggcgggcactggaacaggtgcccgggctcaagttcctagacctcaacaagaacccgctccagcgggtagggccgggggactttgccaacatgctgcaccttaaggagctgggactgaacaacatggaggagctggtctccatcgacaagtttgccctggtgaacctccccgagctgaccaagctggacatcaccaataacccacggctgtccttcatccacccccgcgccttccaccacctgccccagatggagaccctcatgctcaacaacaacgctctcagtgccttgcaccagcagacggtggagtccctgcccaacctgcaggaggtaggtctccacggcaaccccatccgctgtgactgtgtcatccgctgggccaatgccacgggcacccgtgtccgcttcatcgagccgcaatccaccctgtgtgcggagcctccggacctccagcgcctcccggtccgtgaggtgcccttccgggagatgacggaccactgtttgcccctcatctccccacgaagcttccccccaagcctccaggtagccagtggagagagcatggtgctgcattgccgggcactggccgaacccgaacccgagatctactgggtcactccagctgggcttcgactgacacctgcccatgcaggcaggaggtaccgggtgtaccccgaggggaccctggagctgcggagggtgacagcagaagaggcagggctatacacctgtgtggcccagaacctggtgggggctgacactaagacggttagtgtggttgtgggccgtgctctcctccagccaggcagggacgaaggacaggggctggagctccgggtgcaggagacccacccctatcacatcctgctatcttgggtcaccccacccaacacagtgtccaccaacctcacctggtccagtgcctcctccctccggggccagggggccacagctctggcccgcctgcctcggggaacccacagctacaacattacccgcctccttcaggccacggagtactgggcctgcctgcaagtggcctttgctgatgcccacacccagttggcttgtgtatgggccaggaccaaagaggccacttcttgccacagagccttaggggatcgtcctgggctcattgccatcctggctctcgctgtccttctcctggcagctgggctagcggcccaccttggcacaggccaacccaggaagggtgtgggtgggaggcggcctctccctccagcctgggctttctggggctggagtgccccttctgtccgggttgtgtctgctcccctcgtcctgccctggaatccagggaggaagctgcccagatcctcagaaggggagacactgttgccaccattgtctcaaaattcttgaagctcagcctgttctcagcagtagagaaatcactaggactactttttaccaaaagagaagcagtctgggccagatgccctgccaggaaagggacatggacccacgtgcttgaggcctggcagctgggccaagacagatggggctttgtggccctgggggtgcttctgcagccttgaaaaagttgcccttacctcctagggtcacctctgctgccattctgaggaacatctccaaggaacaggagggactttggctagagcctcctgcctccccatcttctctctgcccagaggctcctgggcctggcttggctgtcccctacctgtgtccccgggctgcaccccttcctcttctctttctctgtacagtctcagttgcttgctcttgtgcctcctgggcaagggctgaaggaggccactccatctcacctcggggggctgccctcaatgtgggagtgaccccagccagatctgaaggacatttgggagagggatgcccaggaacgcctcatctcagcagcctgggctcggcattccgaagctgactttctataggcaattttgtacctttgtggagaaatgtgtcacctcccccaacccgattcactcttttctcctgttttgtaaaaaataaaaataaataataacaataatacgggggaaaggaacgaaaggaaaataaaaatct

SEQ ID NO: 448117 - DNA, 3577 bp, Homo sapiens
aggttgggagagcggcggagaagcgagtgaggagggcgagcgcgaagccgggaagaggggcgcgcgtggagggggtgccgggcgccgcgagggcctgctccgggcacctgcgaacgcgcggcgctctcaaggagcgcctggctctcgcccgccagcctccggccgcgacgcgcccagggcgcggagagggggtggggacggattgggattctgccatcgccctcaccggctgggccctggagccgctcccaggataactccacgttggggagggcgcccgccgagcctccccggcctgtgcagacggcgcgcgcggcgggagggcgcggaccagcgtccccagcccggccccgggcggaaggcgagcggagcgcggccgcgcgggcagcagacggcagacggtgcccggcgcccacgggttctggaggctgggaagtccaagacaaggtgccagcatctggtgaaggctgctgtctgctttcaagatggtgcctcgaatgctgtttcctcacatggcagaagggctgcccctgatggggcctggcaatgactgagcaggcccagccccagaggacaaggaagagaaggcatattgaggagggcaagaagtgacgcccggtgtagaatgactgccctgggagggtggttccttgggccctggcagggttgctgacccttaccctgcaaaacacaaagagcaggactccagactcttcttgtgaatggtcccctgccctgcagctccaccatgaggcttctcgtggccccactcttgctagcttgggtggctggtgccactgccgctgtgcccgtggtaccctggcatgttccctgcccccctcagtgtgcctgccagatccggccctggtatacgccccgctcgtcctaccgcgaggctaccactgtggactgcaatgacctattcctgacggcagtccccccggcactccccgcaggcacacagaccctgctcctgcagagcaacagcattgtccgtgtggaccagagtgagctgggctacctggccaatctcacagagctggacctgtcccagaacagcttttcggatgcccgagactgtgatttccatgccctgccccagctgctgagcctgcacctagaggagaaccagctgacccggctggaggaccacagctttgcagggctggccagcctacaggaactctatctcaaccacaaccagctctaccgcatcgcccccagggccttttctggcctcagcaacttgctgcggctgcacctcaactccaacctcctgagggccattgacagccgctggtttgaaatgctgcccaacttggagatactcatgattggcggcaacaaggtagatgccatcctggacatgaacttccggcccctggccaacctgcgtagcctggtgctagcaggcatgaacctgcgggagatctccgactatgccctggaggggctgcaaagcctggagagcctctccttctatgacaaccagctggcccgggtgcccaggcgggcactggaacaggtgcccgggctcaagttcctagacctcaacaagaacccgctccagcgggtagggccgggggactttgccaacatgctgcaccttaaggagctgggactgaacaacatggaggagctggtctccatcgacaagtttgccctggtgaacctccccgagctgaccaagctggacatcaccaataacccacggctgtccttcatccacccccgcgccttccaccacctgccccagatggagaccctcatgctcaacaacaacgctctcagtgccttgcaccagcagacggtggagtccctgcccaacctgcaggaggtaggtctccacggcaaccccatccgctgtgactgtgtcatccgctgggccaatgccacgggcacccgtgtccgcttcatcgagccgcaatccaccctgtgtgcggagcctccggacctccagcgcctcccggtccgtgaggtgcccttccgggagatgacggaccactgtttgcccctcatctccccacgaagcttccccccaagcctccaggtagccagtggagagagcatggtgctgcattgccgggcactggccgaacccgaacccgagatctactgggtcactccagctgggcttcgactgacacctgcccatgcaggcaggaggtaccgggtgtaccccgaggggaccctggagctgcggagggtgacagcagaagaggcagggctatacacctgtgtggcccagaacctggtgggggctgacactaagacggttagtgtggttgtgggccgtgctctcctccagccaggcagggacgaaggacaggggctggagctccgggtgcaggagacccacccctatcacatcctgctatcttgggtcaccccacccaacacagtgtccaccaacctcacctggtccagtgcctcctccctccggggccagggggccacagctctggcccgcctgcctcggggaacccacagctacaacattacccgcctccttcaggccacggagtactgggcctgcctgcaagtggcctttgctgatgcccacacccagttggcttgtgtatgggccaggaccaaagaggccacttcttgccacagagccttaggggatcgtcctgggctcattgccatcctggctctcgctgtccttctcctggcagctgggctagcggcccaccttggcacaggccaacccaggaagggtgtgggtgggaggcggcctctccctccagcctgggctttctggggctggagtgccccttctgtccgggttgtgtctgctcccctcgtcctgccctggaatccagggaggaagctgcccagatcctcagaaggggagacactgttgccaccattgtctcaaaattcttgaagctcagcctgttctcagcagtagagaaatcactaggactactttttaccaaaagagaagcagtctgggccagatgccctgccaggaaagggacatggacccacgtgcttgaggcctggcagctgggccaagacagatggggctttgtggccctgggggtgcttctgcagccttgaaaaagttgcccttacctcctagggtcacctctgctgccattctgaggaacatctccaaggaacaggagggactttggctagagcctcctgcctccccatcttctctctgcccagaggctcctgggcctggcttggctgtcccctacctgtgtccccgggctgcaccccttcctcttctctttctctgtacagtctcagttgcttgctcttgtgcctcctgggcaagggctgaaggaggccactccatctcacctcggggggctgccctcaatgtgggagtgaccccagccagatctgaaggacatttgggagagggatgcccaggaacgcctcatctcagcagcctgggctcggcattccgaagctgactttctataggcaattttgtacctttgtggagaaatgtgtcacctcccccaacccgattcactcttttctcctgttttgtaaaaaataaaaataaataataacaataatacgggggaaaggaacgaaaggaaaataaaaatct

SEQ ID NO: 448118 - DNA, 3602 bp, Homo sapiens
aggttgggagagcggcggagaagcgagtgaggagggcgagcgcgaagccgggaagaggggcgcgcgtggagggggtgccgggcgccgcgagggcctgctccgggcacctgcgaacgcgcggcgctctcaaggagcgcctggctctcgcccgccagcctccggccgcgacgcgcccagggcgcggagagggggtggggacggattgggattctgccatcgccctcaccggctgggccctggagccgctcccaggataactccacgttggggagggcgcccgccgagcctccccggcctgtgcagacggcgcgcgcggcgggagggcgcggaccagcgtccccagcccggccccgggcggaaggcgagcggagcgcggccgcgcgggcagcagacggcagacggtgcccggcgcccacgggaagctgaagatacagcggtatacaaacctccatgtctcaagctgaccacacttgtatctggacttgccagctgattagctctgttcccaccaggctcgttcaaagacccacagcttgagggggcagagggctgcccctgatggggcctggcaatgactgagcaggcccagccccagaggacaaggaagagaaggcatattgaggagggcaagaagtgacgcccggtgtagaatgactgccctgggagggtggttccttgggccctggcagggttgctgacccttaccctgcaaaacacaaagagcaggactccagactcttcttgtgaatggtcccctgccctgcagctccaccatgaggcttctcgtggccccactcttgctagcttgggtggctggtgccactgccgctgtgcccgtggtaccctggcatgttccctgcccccctcagtgtgcctgccagatccggccctggtatacgccccgctcgtcctaccgcgaggctaccactgtggactgcaatgacctattcctgacggcagtccccccggcactccccgcaggcacacagaccctgctcctgcagagcaacagcattgtccgtgtggaccagagtgagctgggctacctggccaatctcacagagctggacctgtcccagaacagcttttcggatgcccgagactgtgatttccatgccctgccccagctgctgagcctgcacctagaggagaaccagctgacccggctggaggaccacagctttgcagggctggccagcctacaggaactctatctcaaccacaaccagctctaccgcatcgcccccagggccttttctggcctcagcaacttgctgcggctgcacctcaactccaacctcctgagggccattgacagccgctggtttgaaatgctgcccaacttggagatactcatgattggcggcaacaaggtagatgccatcctggacatgaacttccggcccctggccaacctgcgtagcctggtgctagcaggcatgaacctgcgggagatctccgactatgccctggaggggctgcaaagcctggagagcctctccttctatgacaaccagctggcccgggtgcccaggcgggcactggaacaggtgcccgggctcaagttcctagacctcaacaagaacccgctccagcgggtagggccgggggactttgccaacatgctgcaccttaaggagctgggactgaacaacatggaggagctggtctccatcgacaagtttgccctggtgaacctccccgagctgaccaagctggacatcaccaataacccacggctgtccttcatccacccccgcgccttccaccacctgccccagatggagaccctcatgctcaacaacaacgctctcagtgccttgcaccagcagacggtggagtccctgcccaacctgcaggaggtaggtctccacggcaaccccatccgctgtgactgtgtcatccgctgggccaatgccacgggcacccgtgtccgcttcatcgagccgcaatccaccctgtgtgcggagcctccggacctccagcgcctcccggtccgtgaggtgcccttccgggagatgacggaccactgtttgcccctcatctccccacgaagcttccccccaagcctccaggtagccagtggagagagcatggtgctgcattgccgggcactggccgaacccgaacccgagatctactgggtcactccagctgggcttcgactgacacctgcccatgcaggcaggaggtaccgggtgtaccccgaggggaccctggagctgcggagggtgacagcagaagaggcagggctatacacctgtgtggcccagaacctggtgggggctgacactaagacggttagtgtggttgtgggccgtgctctcctccagccaggcagggacgaaggacaggggctggagctccgggtgcaggagacccacccctatcacatcctgctatcttgggtcaccccacccaacacagtgtccaccaacctcacctggtccagtgcctcctccctccggggccagggggccacagctctggcccgcctgcctcggggaacccacagctacaacattacccgcctccttcaggccacggagtactgggcctgcctgcaagtggcctttgctgatgcccacacccagttggcttgtgtatgggccaggaccaaagaggccacttcttgccacagagccttaggggatcgtcctgggctcattgccatcctggctctcgctgtccttctcctggcagctgggctagcggcccaccttggcacaggccaacccaggaagggtgtgggtgggaggcggcctctccctccagcctgggctttctggggctggagtgccccttctgtccgggttgtgtctgctcccctcgtcctgccctggaatccagggaggaagctgcccagatcctcagaaggggagacactgttgccaccattgtctcaaaattcttgaagctcagcctgttctcagcagtagagaaatcactaggactactttttaccaaaagagaagcagtctgggccagatgccctgccaggaaagggacatggacccacgtgcttgaggcctggcagctgggccaagacagatggggctttgtggccctgggggtgcttctgcagccttgaaaaagttgcccttacctcctagggtcacctctgctgccattctgaggaacatctccaaggaacaggagggactttggctagagcctcctgcctccccatcttctctctgcccagaggctcctgggcctggcttggctgtcccctacctgtgtccccgggctgcaccccttcctcttctctttctctgtacagtctcagttgcttgctcttgtgcctcctgggcaagggctgaaggaggccactccatctcacctcggggggctgccctcaatgtgggagtgaccccagccagatctgaaggacatttgggagagggatgcccaggaacgcctcatctcagcagcctgggctcggcattccgaagctgactttctataggcaattttgtacctttgtggagaaatgtgtcacctcccccaacccgattcactcttttctcctgttttgtaaaaaataaaaataaataataacaataatacgggggaaaggaacgaaaggaaaataaaaatct

SEQ ID NO: 448119 - DNA, 3577 bp, Homo sapiens
tgtacacacacacatacacacacatacaccttcctctccttcactgaagactcacagtcactcactctgtgagcaggtcatagaaaaggacactaaagccttaaggacaggcctggccattacctctgcagctcctttggcttgttgagtcaaaaaacatgggaggggccaggcacggtgactcacacctgtaatcccagcattttgggagaccgaggtgagcagatcacttgaggtcaggagttcgagaccagcctggccaacatggagaaacccccatctctactaaaaatacaaaaattagccaggagtggtggcaggtgcctgtaatcccagctactcaggtggctgagccaggagaatcgcttgaatccaggaggcggaggatgcagtcagctgagtgcaccgctgcactccagcctgggtgacagaatgagactctgtctcaaacaaacaaacacgggaggaggggtagatactgcttctctgcaacctccttaactctgcatcctcttctttcagggctgcccctgatggggcctggcaatgactgagcaggcccagccccagaggacaaggaagagaaggcatattgaggagggcaagaagtgacgcccggtgtagaatgactgccctgggagggtggttccttgggccctggcagggttgctgacccttaccctgcaaaacacaaagagcaggactccagactcttcttgtgaatggtcccctgccctgcagctccaccatgaggcttctcgtggccccactcttgctagcttgggtggctggtgccactgccgctgtgcccgtggtaccctggcatgttccctgcccccctcagtgtgcctgccagatccggccctggtatacgccccgctcgtcctaccgcgaggctaccactgtggactgcaatgacctattcctgacggcagtccccccggcactccccgcaggcacacagaccctgctcctgcagagcaacagcattgtccgtgtggaccagagtgagctgggctacctggccaatctcacagagctggacctgtcccagaacagcttttcggatgcccgagactgtgatttccatgccctgccccagctgctgagcctgcacctagaggagaaccagctgacccggctggaggaccacagctttgcagggctggccagcctacaggaactctatctcaaccacaaccagctctaccgcatcgcccccagggccttttctggcctcagcaacttgctgcggctgcacctcaactccaacctcctgagggccattgacagccgctggtttgaaatgctgcccaacttggagatactcatgattggcggcaacaaggtagatgccatcctggacatgaacttccggcccctggccaacctgcgtagcctggtgctagcaggcatgaacctgcgggagatctccgactatgccctggaggggctgcaaagcctggagagcctctccttctatgacaaccagctggcccgggtgcccaggcgggcactggaacaggtgcccgggctcaagttcctagacctcaacaagaacccgctccagcgggtagggccgggggactttgccaacatgctgcaccttaaggagctgggactgaacaacatggaggagctggtctccatcgacaagtttgccctggtgaacctccccgagctgaccaagctggacatcaccaataacccacggctgtccttcatccacccccgcgccttccaccacctgccccagatggagaccctcatgctcaacaacaacgctctcagtgccttgcaccagcagacggtggagtccctgcccaacctgcaggaggtaggtctccacggcaaccccatccgctgtgactgtgtcatccgctgggccaatgccacgggcacccgtgtccgcttcatcgagccgcaatccaccctgtgtgcggagcctccggacctccagcgcctcccggtccgtgaggtgcccttccgggagatgacggaccactgtttgcccctcatctccccacgaagcttccccccaagcctccaggtagccagtggagagagcatggtgctgcattgccgggcactggccgaacccgaacccgagatctactgggtcactccagctgggcttcgactgacacctgcccatgcaggcaggaggtaccgggtgtaccccgaggggaccctggagctgcggagggtgacagcagaagaggcagggctatacacctgtgtggcccagaacctggtgggggctgacactaagacggttagtgtggttgtgggccgtgctctcctccagccaggcagggacgaaggacaggggctggagctccgggtgcaggagacccacccctatcacatcctgctatcttgggtcaccccacccaacacagtgtccaccaacctcacctggtccagtgcctcctccctccggggccagggggccacagctctggcccgcctgcctcggggaacccacagctacaacattacccgcctccttcaggccacggagtactgggcctgcctgcaagtggcctttgctgatgcccacacccagttggcttgtgtatgggccaggaccaaagaggccacttcttgccacagagccttaggggatcgtcctgggctcattgccatcctggctctcgctgtccttctcctggcagctgggctagcggcccaccttggcacaggccaacccaggaagggtgtgggtgggaggcggcctctccctccagcctgggctttctggggctggagtgccccttctgtccgggttgtgtctgctcccctcgtcctgccctggaatccagggaggaagctgcccagatcctcagaaggggagacactgttgccaccattgtctcaaaattcttgaagctcagcctgttctcagcagtagagaaatcactaggactactttttaccaaaagagaagcagtctgggccagatgccctgccaggaaagggacatggacccacgtgcttgaggcctggcagctgggccaagacagatggggctttgtggccctgggggtgcttctgcagccttgaaaaagttgcccttacctcctagggtcacctctgctgccattctgaggaacatctccaaggaacaggagggactttggctagagcctcctgcctccccatcttctctctgcccagaggctcctgggcctggcttggctgtcccctacctgtgtccccgggctgcaccccttcctcttctctttctctgtacagtctcagttgcttgctcttgtgcctcctgggcaagggctgaaggaggccactccatctcacctcggggggctgccctcaatgtgggagtgaccccagccagatctgaaggacatttgggagagggatgcccaggaacgcctcatctcagcagcctgggctcggcattccgaagctgactttctataggcaattttgtacctttgtggagaaatgtgtcacctcccccaacccgattcactcttttctcctgttttgtaaaaaataaaaataaataataacaataatacgggggaaaggaacgaaaggaaaataaaaatct

SEQ ID NO: 448120 - DNA, 266 bp, Homo sapiens
aaatgaagaatgttgaaccctcacaaagagataaaggttatttgatacatgttggtggcctctgcccttcagtatctgaggccgatttaaggtctcatttccaaaaataccaagtttctgaaatttcaatttatgattctactaattacagatatgcatctcttgcttttacaaaaaacagcgatgcaaagatagctgtgaaagaaatgaatgggatagaaataaatggaaagtcagtaaatgtgtggcctgttaaaattcttgga

SEQ ID NO: 448121 - DNA, 661 bp, Homo sapiens
ggtctctatctcctgacctcgtgatccacccgcctcagcctcccaaagtgctgggattacaggcgtgagccaccgtgcccggccaagagcatacattttcatgattctatttccctaatccacaactggaccatagtcagaggaaagcactttgggaacagtgctagcagaagaaggagggtggttttagtagtcactgctgtcaaaatagcctgtgtcaggcagtggtaaattctctgtcattgaagatattcagtcagaggaaaggatgccatagaaagaattaacatatcaaggaatgattggacaaggtgtggtttaaaacagtggacaaccaaacagggttttcacttgtctgcaacaagatgagaaaaaggccgagcaacagtggctcacacctctaatcccaacacttttgggaagtcaaggcaggaggatcgcttgaggccaggagtttaaaaccagcctggtcaacatggcaagaccccatctcaacaaagaaaaagaggaaaacaaggcaatacctgaatcaggtatgtgcagcctttgtcggggtaaggggggatgccttgactgaaatatgtcaccataaagttgctaacttcctattttgtgatggggttttactttattctgaataataaaatgttatttcatcttt

SEQ ID NO: 448122 - DNA, 481 bp, Homo sapiens
  misc_feature (437)..(437): n is a, c, g, or t
  misc_feature (441)..(441): n is a, c, g, or t
  misc_feature (468)..(468): n is a, c, g, or t
  misc_feature (470)..(472): n is a, c, g, or t
tatctgatactttacttactggcagaaatcaatatgcagaatggcattggcaataaaaggtgtcctaaaatggtcaaaagacacaaaacatgggatgaaccaaataagagagagcggagataacactgtgaatggagaaaggtaccactgaataccatccaaaccagaagatcctggctcaatacgtctcacgttaacagtcttccggcagaatggtgtgaagctcttcacagttttacagcagagaccagtgatgacttatcattcaagaggggagaccggatccagattctggaacgtctggattctgactggtgcaggggcagactgcaggacagggaggggatcttcccagcagtgtttgtgaggccctgcccagctgaggcaggaggatcacttgagcctgggaggtcaagactacagtgagctatgattgncctnctattctccagcctgggtaacagtganannntgtctcaaa

SEQ ID NO: 448123 - DNA, 5343 bp, Homo sapiens
tgaaatccaacttctgaaatgttctgggtggtagatagttaagggtgaagctgtattggtcttagtatttgcagatgttgtagctgactgctcatttttccccctccccattctgttagaagcttctgccaaccatgattcatggaatgatttttttgagctgagtaatctgtggctttgcagtttccttgctttctttccttagctaaatctcttctagtgttagcaaagtatttagcacaggaaagatcttataaaatgaaataatgcatgtaatgatgcattttccaagtagatgattttaacaaaccgtaagcttttatgcctgtccttcattgtgtcttttctgcctctgtcaggcgaactgtgatgaagagccttatacttaggaagacacaactacctttgaacagtcctttgtgaaatctaatgatcgcaacgaacgaaataaaccagaacatcgttcttcaagccaaggacccttgtcatccattagagcggtaatcaagagatcttctcggacttctattcagagtgaacttcatcgagatagaaggcgcccagagatcaccattgtggcagctgagccactgaggccagcctcgtggtttccaggaaccccacccccaggactgggatttcctacatcatctgcagcaggctcttggaggcctaatgagctggttcctgctgagctcccaccatcttatgaacaagttataaaagaaatcaaccaagttcaagttaatactacaaataataataatgctgctgctactccaaggcacactattacttctgcaactcagactgacttttcagaagaaatagacaacgatctgcctcaaagtaatgcaacactacaggcacctctcaagcctcttcagcctttctcagcagtctcgtctggcaatcttccaacaaatgtggcacctttaatcgtctttgatatttctgaagaaccgaattgtccagaaaaccccagtgctacaagatgtccagtgccaaaaccaagatcaaaaagcaacctcagaccaatacccagagattctcacattaaagagcaaagtcaacagaaaatcagcccagcagccgtaggagaggagtcatccccaggccggccccagtctctgctggacaacgctagcacctcagacagtcaggcagtgatgaacattatgaacacagaacaaagccaaaatagtattgtttccagaattaaagtgtttgagggtcagacaaacatagaaacctcaggactgcccaagaaaccagaaattactccacgttcacttcctccaaagcctactgtttcctcagggaaaccttctgtagctcccaaaccagctgctaacagagcttctggagagtgggactctgggactgagaacagactcaaggtgacctccaaggaaggactcaccccataccctcccctgcaagaagcgggaagcatcccagtaaccaaacctgaattgccaaagaaaccaaaccctggccttatacgaagtgttaatcctgagattccgggaagagggcccctggctgagagctctgatagtgggaagaaagtgccaactcctgccccgcggcctttgctgctgaagaaatctgtttcctcagaaaaccccacctacccttcagctccactgaaacctgtcactgttcctccccgactcgcaggggcatcacaagccaaagcatacaagtcactgggagaagggcccccagccaaccccccagttccagttctgcagagcaagcccttggtggacatcgatctcatcagctttgatgatgatgttttgcccaccccatcggggaacctggctgaagaatctgttggttcagagatggttctagatccctttcagctccctgcaaaaacagaaccaataaaagaacgagcagttcaaccagcacccaccaggaagcccactgtaattcgaattccagccaaaccaggaaaatgtttacatgaggatccacaaagtccacctcctctccctgctgaaaaacctattggaaacactttcagtacagtatctggaaagctcagtaatgttgagagaactagaaacttggaatccaaccacccaggtcaaacaggaggttttgtgcgagtacccccaaggttgccaccgagacctgtgaatggaaaaaccattccaactcaacagcctccaaccaaggtgccccctgagagaccacctcccccaaagctttctgcaaccagaagatctaataagaaactgccttttaatcgatcctcttctgacatggatcttcagaaaaaacaaagtaacttggcaactggactctcaaaagccaagagtcaagtttttaaaaatcaagatccggtgctaccccctcgtcccaaaccaggacaccctctctacagtaaatacatgctgtctgtgcctcatggaattgccaatgaagatattgtctctcaaaaccccggagaactctcttgtaagcgtggggatgtacttgtgatgctgaagcagacggaaaataattacttggagtgccaaaagggagaagacactggcagagttcacctgtctcaaatgaagattatcactccacttgatgaacatcttagaagcagaccaaacgatccaagccacgctcagaagcctgttgacagtggtgctcctcatgctgtcgttcttcatgatttcccagcagagcaagttgatgatttgaacctcacttctggagaaattgtttatcttctggagaagatagatacagattggtacagagggaactgtagaaaccagattggcatatttcctgccaactatgtcaaagtgattattgatatcccagaaggaggaaatgggaaaagagaatgtgtttcatctcattgtgttaaaggctcaagatgtgttgctcggtttgaatatattggagagcagaaggatgagttgagtttctcagagggagaaattattattcttaaagagtatgtgaatgaggaatgggccagaggagaagttcgaggcagaactgggattttccccctgaactttgtggagcctgttgaggattatcccacctctggtgcaaatgttttaagcacaaaggtaccactgaaaaccaaaaaagaagattctggctcaaactctcaggttaacagtcttccggcagaatggtgtgaagctcttcacagttttacagcagagaccagtgatgacttatcattcaagaggggagaccggatccagattctggaacgtctggattctgactggtgcaggggcagactgcaggacagggaggggatcttcccagcagtgtttgtgaggccctgcccagctgaggcaaaaagtatgttggccatagtaccgaaggggaggaaggccaaagccttatatgatttccgaggggagaatgaagatgaactttccttcaaggctggagatataataacagagctggaatctgtagatgatgactggatgagtggagaacttatgggaaaatctggaatatttcccaaaaactacatacagtttctacagatcagctagaggagaagcttgtctgtgttccttggcacaagaactcacttgaactatcaccttgactatcagatatgtttttgcactattttttttaactgaaaaagaaatatctaagctgtacatggtacactagaattttctgaaagcagaaaacgttcagattttgtagttaattttcattacaatagaaacatgcacatggaaacccatgagctaggattctaccgaggaaaacatctagtgggattagcaaggtgaagggaaagcatctggtggcatggcagcatggggaggctcacacacagaagttgcacgtggacatctgttttaatcagcacaagtgaattaaccatgcttcttcatttttttactttagttaaaaaagaggacatttaatattctacatgctgtaactatcaggacatggttagcaatctcaatttcatttttgatattcaaattaattcttacagcttgagcatatcagccttattaccagagcaaatccttccttcagatgggatagtttactgactagttggagcatttgtaagcacatggtgaaatcagcccctgcccaccaaaataatctttatgttaccaagtgattcccatttgtctaaggatttgaagggggtctaaattggatgtatcttagtctaaagaaccaaaaccatccctgaaatgccttgctaatacaactaatccttccatatatgtgccatacttatttttttcctcagtgtatactttatgttaacagggttattacaaagcacattttctgaatctgcaatcattcctttgacaattactggacccaaaggaaaattcattttctttgcattattccagtaatatataaaaactgtgtcttgttatagtagtacattatgaatcacatataaaatcttacaatacagaacaactgttaagatggaaaacagtgccaaacctccacagctcatttctttgtaatataatcagaatgaaaaataatttaagaggacagaagactggtacttttttgttttattttttctctagcttatccctgcacaattattagagtgaatgaaaaaccactttcctgctttccattgttataaattctaagcttaagataaaagtggttctttacatgactgaatcaattacaatttatgggctagagccaaataggttgaagacaatcatccaaacagatcaatggaatagaatttcattggaaatgtaaaacactttcccaacaatggtcatgactttcttctgtttttgagaagagtttcatatgctggaccacattttagcttttattgttttttttttcccattgtccaaaaagttaagcaacaagtggccacacttttacgtgactacaacctggagttctgcaaagaaggtaatatttacttggtctttgactaaagttatctccccattctatggttacattttattttggactatggggacttctaatacgttttggtaaagaagagagtataaagaaaattcttgtcaaatttcactcaaaagtaatttcatgagaaatcaatgatttaaagcattatccaaattaaattatcatttgcagcaaactgtacaacagcaggaaggatatggaatggaacatgaggtatatatctttgcctttataattttaacatcttatattgaagattctgaaaacctatctttattagaggaaaatctcaatcttcagttttggccttctgtcaccagaatgataagtgcaatagttgtaaatctacttgacactgtaataaactgaactgaactttca

SEQ ID NO: 448124 - DNA, 5050 bp, Homo sapiens
cccttcctcttgtgtgttgtaccactaggaagattagtggggaaatttgctattacatgcctaagtaaactatgtaactaggatcacagccacaggaaatgatgttctggacagagttttagctcggctttagccacagatcgcaacgaacgaaataaaccagaacatcgttcttcaagccaaggacccttgtcatccattagagcggtaatcaagagatcttctcggacttctattcagagtgaacttcatcgagatagaaggcgcccagagatcaccattgtggcagctgagccactgaggccagcctcgtggtttccaggaaccccacccccaggactgggatttcctacatcatctgcagcaggctcttggaggcctaatgagctggttcctgctgagctcccaccatcttatgaacaagttataaaagaaatcaaccaagttcaagttaatactacaaataataataatgctgctgctactccaaggcacactattacttctgcaactcagactgacttttcagaagaaatagacaacgatctgcctcaaagtaatgcaacactacaggcacctctcaagcctcttcagcctttctcagcagtctcgtctggcaatcttccaacaaatgtggcacctttaatcgtctttgatatttctgaagaaccgaattgtccagaaaaccccagtgctacaagatgtccagtgccaaaaccaagatcaaaaagcaacctcagaccaatacccagagattctcacattaaagagcaaagtcaacagaaaatcagcccagcagccgtaggagaggagtcatccccaggccggccccagtctctgctggacaacgctagcacctcagacagtcaggcagtgatgaacattatgaacacagaacaaagccaaaatagtattgtttccagaattaaagtgtttgagggtcagacaaacatagaaacctcaggactgcccaagaaaccagaaattactccacgttcacttcctccaaagcctactgtttcctcagggaaaccttctgtagctcccaaaccagctgctaacagagcttctggagagtgggactctgggactgagaacagactcaaggtgacctccaaggaaggactcaccccataccctcccctgcaagaagcgggaagcatcccagtaaccaaacctgaattgccaaagaaaccaaaccctggccttatacgaagtgttaatcctgagattccgggaagagggcccctggctgagagctctgatagtgggaagaaagtgccaactcctgccccgcggcctttgctgctgaagaaatctgtttcctcagaaaaccccacctacccttcagctccactgaaacctgtcactgttcctccccgactcgcaggggcatcacaagccaaagcatacaagtcactgggagaagggcccccagccaaccccccagttccagttctgcagagcaagcccttggtggacatcgatctcatcagctttgatgatgatgttttgcccaccccatcggggaacctggctgaagaatctgttggttcagagatggttctagatccctttcagctccctgcaaaaacagaaccaataaaagaacgagcagttcaaccagcacccaccaggaagcccactgtaattcgaattccagccaaaccaggaaaatgtttacatgaggatccacaaagtccacctcctctccctgctgaaaaacctattggaaacactttcagtacagtatctggaaagctcagtaatgttgagagaactagaaacttggaatccaaccacccaggtcaaacaggaggttttgtgcgagtacccccaaggttgccaccgagacctgtgaatggaaaaaccattccaactcaacagcctccaaccaaggtgccccctgagagaccacctcccccaaagctttctgcaaccagaagatctaataagaaactgccttttaatcgatcctcttctgacatggatcttcagaaaaaacaaagtaacttggcaactggactctcaaaagccaagagtcaagtttttaaaaatcaagatccggtgctaccccctcgtcccaaaccaggacaccctctctacagtaaatacatgctgtctgtgcctcatggaattgccaatgaagatattgtctctcaaaaccccggagaactctcttgtaagcgtggggatgtacttgtgatgctgaagcagacggaaaataattacttggagtgccaaaagggagaagacactggcagagttcacctgtctcaaatgaagattatcactccacttgatgaacatcttagaagcagaccaaacgatccaagccacgctcagaagcctgttgacagtggtgctcctcatgctgtcgttcttcatgatttcccagcagagcaagttgatgatttgaacctcacttctggagaaattgtttatcttctggagaagatagatacagattggtacagagggaactgtagaaaccagattggcatatttcctgccaactatgtcaaagtgattattgatatcccagaaggaggaaatgggaaaagagaatgtgtttcatctcattgtgttaaaggctcaagatgtgttgctcggtttgaatatattggagagcagaaggatgagttgagtttctcagagggagaaattattattcttaaagagtatgtgaatgaggaatgggccagaggagaagttcgaggcagaactgggattttccccctgaactttgtggagcctgttgaggattatcccacctctggtgcaaatgttttaagcacaaaggtaccactgaaaaccaaaaaagaagattctggctcaaactctcaggttaacagtcttccggcagaatggtgtgaagctcttcacagttttacagcagagaccagtgatgacttatcattcaagaggggagaccggatccagattctggaacgtctggattctgactggtgcaggggcagactgcaggacagggaggggatcttcccagcagtgtttgtgaggccctgcccagctgaggcaaaaagtatgttggccatagtaccgaaggggaggaaggccaaagccttatatgatttccgaggggagaatgaagatgaactttccttcaaggctggagatataataacagagctggaatctgtagatgatgactggatgagtggagaacttatgggaaaatctggaatatttcccaaaaactacatacagtttctacagatcagctagaggagaagcttgtctgtgttccttggcacaagaactcacttgaactatcaccttgactatcagatatgtttttgcactattttttttaactgaaaaagaaatatctaagctgtacatggtacactagaattttctgaaagcagaaaacgttcagattttgtagttaattttcattacaatagaaacatgcacatggaaacccatgagctaggattctaccgaggaaaacatctagtgggattagcaaggtgaagggaaagcatctggtggcatggcagcatggggaggctcacacacagaagttgcacgtggacatctgttttaatcagcacaagtgaattaaccatgcttcttcatttttttactttagttaaaaaagaggacatttaatattctacatgctgtaactatcaggacatggttagcaatctcaatttcatttttgatattcaaattaattcttacagcttgagcatatcagccttattaccagagcaaatccttccttcagatgggatagtttactgactagttggagcatttgtaagcacatggtgaaatcagcccctgcccaccaaaataatctttatgttaccaagtgattcccatttgtctaaggatttgaagggggtctaaattggatgtatcttagtctaaagaaccaaaaccatccctgaaatgccttgctaatacaactaatccttccatatatgtgccatacttatttttttcctcagtgtatactttatgttaacagggttattacaaagcacattttctgaatctgcaatcattcctttgacaattactggacccaaaggaaaattcattttctttgcattattccagtaatatataaaaactgtgtcttgttatagtagtacattatgaatcacatataaaatcttacaatacagaacaactgttaagatggaaaacagtgccaaacctccacagctcatttctttgtaatataatcagaatgaaaaataatttaagaggacagaagactggtacttttttgttttattttttctctagcttatccctgcacaattattagagtgaatgaaaaaccactttcctgctttccattgttataaattctaagcttaagataaaagtggttctttacatgactgaatcaattacaatttatgggctagagccaaataggttgaagacaatcatccaaacagatcaatggaatagaatttcattggaaatgtaaaacactttcccaacaatggtcatgactttcttctgtttttgagaagagtttcatatgctggaccacattttagcttttattgttttttttttcccattgtccaaaaagttaagcaacaagtggccacacttttacgtgactacaacctggagttctgcaaagaaggtaatatttacttggtctttgactaaagttatctccccattctatggttacattttattttggactatggggacttctaatacgttttggtaaagaagagagtataaagaaaattcttgtcaaatttcactcaaaagtaatttcatgagaaatcaatgatttaaagcattatccaaattaaattatcatttgcagcaaactgtacaacagcaggaaggatatggaatggaacatgaggtatatatctttgcctttataattttaacatcttatattgaagattctgaaaacctatctttattagaggaaaatctcaatcttcagttttggccttctgtcaccagaatgataagtgcaatagttgtaaatctacttgacactgtaataaactgaactgaactttca

SEQ ID NO: 448125 - DNA, 5129 bp, Homo sapiens
gaagagagcgggagtgggagtgggaaaggccaggattaagaggccgccgggacgccgcaaggaggcggggaatcggctcggcccgcgccctgccgctgcccggccggctgcaggtggagttcgcggaggtggccatttccacagccgccgccgacgcctcctctccgggagccgccttccccccggcccgagggcggtggcgtggggcgccgggtgcaggcgttctggggcgccggggccgcagctcgctggccatcccgcggctgcgccccgcgcctcgcccatggctgagggccggcggcgggaggacgaggaggaagagctacgcgagcgccgcgaacttggtggccagcgccgcgcccggggccgtgcgctctcgggccactcggccgcagatcgcaacgaacgaaataaaccagaacatcgttcttcaagccaaggacccttgtcatccattagagcggtaatcaagagatcttctcggacttctattcagagtgaacttcatcgagatagaaggcgcccagagatcaccattgtggcagctgagccactgaggccagcctcgtggtttccaggaaccccacccccaggactgggatttcctacatcatctgcagcaggctcttggaggcctaatgagctggttcctgctgagctcccaccatcttatgaacaagttataaaagaaatcaaccaagttcaagttaatactacaaataataataatgctgctgctactccaaggcacactattacttctgcaactcagactgacttttcagaagaaatagacaacgatctgcctcaaagtaatgcaacactacaggcacctctcaagcctcttcagcctttctcagcagtctcgtctggcaatcttccaacaaatgtggcacctttaatcgtctttgatatttctgaagaaccgaattgtccagaaaaccccagtgctacaagatgtccagtgccaaaaccaagatcaaaaagcaacctcagaccaatacccagagattctcacattaaagagcaaagtcaacagaaaatcagcccagcagccgtaggagaggagtcatccccaggccggccccagtctctgctggacaacgctagcacctcagacagtcaggcagtgatgaacattatgaacacagaacaaagccaaaatagtattgtttccagaattaaagtgtttgagggtcagacaaacatagaaacctcaggactgcccaagaaaccagaaattactccacgttcacttcctccaaagcctactgtttcctcagggaaaccttctgtagctcccaaaccagctgctaacagagcttctggagagtgggactctgggactgagaacagactcaaggtgacctccaaggaaggactcaccccataccctcccctgcaagaagcgggaagcatcccagtaaccaaacctgaattgccaaagaaaccaaaccctggccttatacgaagtgttaatcctgagattccgggaagagggcccctggctgagagctctgatagtgggaagaaagtgccaactcctgccccgcggcctttgctgctgaagaaatctgtttcctcagaaaaccccacctacccttcagctccactgaaacctgtcactgttcctccccgactcgcaggggcatcacaagccaaagcatacaagtcactgggagaagggcccccagccaaccccccagttccagttctgcagagcaagcccttggtggacatcgatctcatcagctttgatgatgatgttttgcccaccccatcggggaacctggctgaagaatctgttggttcagagatggttctaggtttacatgaggatccacaaagtccacctcctctccctgctgaaaaacctattggaaacactttcagtacagtatctggaaagctcagtaatgttgagagaactagaaacttggaatccaaccacccaggtcaaacaggaggttttgtgcgagtacccccaaggttgccaccgagacctgtgaatggaaaaaccattccaactcaacagcctccaaccaaggtgccccctgagagaccacctcccccaaagctttctgcaaccagaagatctaataagaaactgccttttaatcgatcctcttctgacatggatcttcagaaaaaacaaagtaacttggcaactggactctcaaaagccaagagtcaagtttttaaaaatcaagatccggtgctaccccctcgtcccaaaccaggacaccctctctacagtaaatacatgcgtggggatgtacttgtgatgctgaagcagacggaaaataattacttggagtgccaaaagggagaagacactggcagagttcacctgtctcaaatgaagattatcactccacttgatgaacatcttagaagcagaccaaacgatccaagccacgctcagaagcctgttgacagtggtgctcctcatgctgtcgttcttcatgatttcccagcagagcaagttgatgatttgaacctcacttctggagaaattgtttatcttctggagaagatagatacagattggtacagagggaactgtagaaaccagattggcatatttcctgccaactatgtcaaagtgattattgatatcccagaaggaggaaatgggaaaagagaatgtgtttcatctcattgtgttaaaggctcaagatgtgttgctcggtttgaatatattggagagcagaaggatgagttgagtttctcagagggagaaattattattcttaaagagtatgtgaatgaggaatgggccagaggagaagttcgaggcagaactgggattttccccctgaactttgtggagcctgttgaggattatcccacctctggtgcaaatgttttaagcacaaaggtaccactgaaaaccaaaaaagaagattctggctcaaactctcaggttaacagtcttccggcagaatggtgtgaagctcttcacagttttacagcagagaccagtgatgacttatcattcaagaggggagaccggatccagattctggaacgtctggattctgactggtgcaggggcagactgcaggacagggaggggatcttcccagcagtgtttgtgaggccctgcccagctgaggcaaaaagtatgttggccatagtaccgaaggggaggaaggccaaagccttatatgatttccgaggggagaatgaagatgaactttccttcaaggctggagatataataacagagctggaatctgtagatgatgactggatgagtggagaacttatgggaaaatctggaatatttcccaaaaactacatacagtttctacagatcagctagaggagaagcttgtctgtgttccttggcacaagaactcacttgaactatcaccttgactatcagatatgtttttgcactattttttttaactgaaaaagaaatatctaagctgtacatggtacactagaattttctgaaagcagaaaacgttcagattttgtagttaattttcattacaatagaaacatgcacatggaaacccatgagctaggattctaccgaggaaaacatctagtgggattagcaaggtgaagggaaagcatctggtggcatggcagcatggggaggctcacacacagaagttgcacgtggacatctgttttaatcagcacaagtgaattaaccatgcttcttcatttttttactttagttaaaaaagaggacatttaatattctacatgctgtaactatcaggacatggttagcaatctcaatttcatttttgatattcaaattaattcttacagcttgagcatatcagccttattaccagagcaaatccttccttcagatgggatagtttactgactagttggagcatttgtaagcacatggtgaaatcagcccctgcccaccaaaataatctttatgttaccaagtgattcccatttgtctaaggatttgaagggggtctaaattggatgtatcttagtctaaagaaccaaaaccatccctgaaatgccttgctaatacaactaatccttccatatatgtgccatacttatttttttcctcagtgtatactttatgttaacagggttattacaaagcacattttctgaatctgcaatcattcctttgacaattactggacccaaaggaaaattcattttctttgcattattccagtaatatataaaaactgtgtcttgttatagtagtacattatgaatcacatataaaatcttacaatacagaacaactgttaagatggaaaacagtgccaaacctccacagctcatttctttgtaatataatcagaatgaaaaataatttaagaggacagaagactggtacttttttgttttattttttctctagcttatccctgcacaattattagagtgaatgaaaaaccactttcctgctttccattgttataaattctaagcttaagataaaagtggttctttacatgactgaatcaattacaatttatgggctagagccaaataggttgaagacaatcatccaaacagatcaatggaatagaatttcattggaaatgtaaaacactttcccaacaatggtcatgactttcttctgtttttgagaagagtttcatatgctggaccacattttagcttttattgttttttttttcccattgtccaaaaagttaagcaacaagtggccacacttttacgtgactacaacctggagttctgcaaagaaggtaatatttacttggtctttgactaaagttatctccccattctatggttacattttattttggactatggggacttctaatacgttttggtaaagaagagagtataaagaaaattcttgtcaaatttcactcaaaagtaatttcatgagaaatcaatgatttaaagcattatccaaattaaattatcatttgcagcaaactgtacaacagcaggaaggatatggaatggaacatgaggtatatatctttgcctttataattttaacatcttatattgaagattctgaaaacctatctttattagaggaaaatctcaatcttcagttttggccttctgtcaccagaatgataagtgcaatagttgtaaatctacttgacactgtaataaactgaactgaactttca

SEQ ID NO: 448126 - DNA, 3444 bp, Homo sapiens
tagattatccccaactacagcactattccatgaagcccactgtaattcgaattccagccaaaccaggaaaatgtttacatgaggatccacaaagtccacctcctctccctgctgaaaaacctattggaaacactttcagtacagtatctggaaagctcagtaatgttgagagaactagaaacttggaatccaaccacccaggtcaaacaggaggttttgtgcgagtacccccaaggttgccaccgagacctgtgaatggaaaaaccattccaactcaacagcctccaaccaaggtgccccctgagagaccacctcccccaaagctttctgcaaccagaagatctaataagaaactgccttttaatcgatcctcttctgacatggatcttcagaaaaaacaaagtaacttggcaactggactctcaaaagccaagagtcaagtttttaaaaatcaagatccggtgctaccccctcgtcccaaaccaggacaccctctctacagtaaatacatgctgtctgtgcctcatggaattgccaatgaagatattgtctctcaaaaccccggagaactctcttgtaagcgtggggatgtacttgtgatgctgaagcagacggaaaataattacttggagtgccaaaagggagaagacactggcagagttcacctgtctcaaatgaagattatcactccacttgatgaacatcttagaagcagaccaaacgatccaagccacgctcagaagcctgttgacagtggtgctcctcatgctgtcgttcttcatgatttcccagcagagcaagttgatgatttgaacctcacttctggagaaattgtttatcttctggagaagatagatacagattggtacagagggaactgtagaaaccagattggcatatttcctgccaactatgtcaaagtgattattgatatcccagaaggaggaaatgggaaaagagaatgtgtttcatctcattgtgttaaaggctcaagatgtgttgctcggtttgaatatattggagagcagaaggatgagttgagtttctcagagggagaaattattattcttaaagagtatgtgaatgaggaatgggccagaggagaagttcgaggcagaactgggattttccccctgaactttgtggagcctgttgaggattatcccacctctggtgcaaatgttttaagcacaaaggtaccactgaaaaccaaaaaagaagattctggctcaaactctcaggttaacagtcttccggcagaatggtgtgaagctcttcacagttttacagcagagaccagtgatgacttatcattcaagaggggagaccggatccagattctggaacgtctggattctgactggtgcaggggcagactgcaggacagggaggggatcttcccagcagtgtttgtgaggccctgcccagctgaggcaaaaagtatgttggccatagtaccgaaggggaggaaggccaaagccttatatgatttccgaggggagaatgaagatgaactttccttcaaggctggagatataataacagagctggaatctgtagatgatgactggatgagtggagaacttatgggaaaatctggaatatttcccaaaaactacatacagtttctacagatcagctagaggagaagcttgtctgtgttccttggcacaagaactcacttgaactatcaccttgactatcagatatgtttttgcactattttttttaactgaaaaagaaatatctaagctgtacatggtacactagaattttctgaaagcagaaaacgttcagattttgtagttaattttcattacaatagaaacatgcacatggaaacccatgagctaggattctaccgaggaaaacatctagtgggattagcaaggtgaagggaaagcatctggtggcatggcagcatggggaggctcacacacagaagttgcacgtggacatctgttttaatcagcacaagtgaattaaccatgcttcttcatttttttactttagttaaaaaagaggacatttaatattctacatgctgtaactatcaggacatggttagcaatctcaatttcatttttgatattcaaattaattcttacagcttgagcatatcagccttattaccagagcaaatccttccttcagatgggatagtttactgactagttggagcatttgtaagcacatggtgaaatcagcccctgcccaccaaaataatctttatgttaccaagtgattcccatttgtctaaggatttgaagggggtctaaattggatgtatcttagtctaaagaaccaaaaccatccctgaaatgccttgctaatacaactaatccttccatatatgtgccatacttatttttttcctcagtgtatactttatgttaacagggttattacaaagcacattttctgaatctgcaatcattcctttgacaattactggacccaaaggaaaattcattttctttgcattattccagtaatatataaaaactgtgtcttgttatagtagtacattatgaatcacatataaaatcttacaatacagaacaactgttaagatggaaaacagtgccaaacctccacagctcatttctttgtaatataatcagaatgaaaaataatttaagaggacagaagactggtacttttttgttttattttttctctagcttatccctgcacaattattagagtgaatgaaaaaccactttcctgctttccattgttataaattctaagcttaagataaaagtggttctttacatgactgaatcaattacaatttatgggctagagccaaataggttgaagacaatcatccaaacagatcaatggaatagaatttcattggaaatgtaaaacactttcccaacaatggtcatgactttcttctgtttttgagaagagtttcatatgctggaccacattttagcttttattgttttttttttcccattgtccaaaaagttaagcaacaagtggccacacttttacgtgactacaacctggagttctgcaaagaaggtaatatttacttggtctttgactaaagttatctccccattctatggttacattttattttggactatggggacttctaatacgttttggtaaagaagagagtataaagaaaattcttgtcaaatttcactcaaaagtaatttcatgagaaatcaatgatttaaagcattatccaaattaaattatcatttgcagcaaactgtacaacagcaggaaggatatggaatggaacatgaggtatatatctttgcctttataattttaacatcttatattgaagattctgaaaacctatctttattagaggaaaatctcaatcttcagttttggccttctgtcaccagaatgataagtgcaatagttgtaaatctacttgacactgtaataaactgaactgaactttca

SEQ ID NO: 448127 - DNA, 5324 bp, Homo sapiens
gaagagagcgggagtgggagtgggaaaggccaggattaagaggccgccgggacgccgcaaggaggcggggaatcggctcggcccgcgccctgccgctgcccggccggctgcaggtggagttcgcggaggtggccatttccacagccgccgccgacgcctcctctccgggagccgccttccccccggcccgagggcggtggcgtggggcgccgggtgcaggcgttctggggcgccggggccgcagctcgctggccatcccgcggctgcgccccgcgcctcgcccatggctgagggccggcggcgggaggacgaggaggaagagctacgcgagcgccgcgaacttggtggccagcgccgcgcccggggccgtgcgctctcgggccactcggccgcagatcgcaacgaacgaaataaaccagaacatcgttcttcaagccaaggacccttgtcatccattagagcggtaatcaagagatcttctcggacttctattcagagtgaacttcatcgagatagaaggcgcccagagatcaccattgtggcagctgagccactgaggccagcctcgtggtttccaggaaccccacccccaggactgggatttcctacatcatctgcagcaggctcttggaggcctaatgagctggttcctgctgagctcccaccatcttatgaacaagttataaaagaaatcaaccaagttcaagttaatactacaaataataataatgctgctgctactccaaggcacactattacttctgcaactcagactgacttttcagaagaaatagacaacgatctgcctcaaagtaatgcaacactacaggcacctctcaagcctcttcagcctttctcagcagtctcgtctggcaatcttccaacaaatgtggcacctttaatcgtctttgatatttctgaagaaccgaattgtccagaaaaccccagtgctacaagatgtccagtgccaaaaccaagatcaaaaagcaacctcagaccaatacccagagattctcacattaaagagcaaagtcaacagaaaatcagcccagcagccgtaggagaggagtcatccccaggccggccccagtctctgctggacaacgctagcacctcagacagtcaggcagtgatgaacattatgaacacagaacaaagccaaaatagtattgtttccagaattaaagtgtttgagggtcagacaaacatagaaacctcaggactgcccaagaaaccagaaattactccacgttcacttcctccaaagcctactgtttcctcagggaaaccttctgtagctcccaaaccagctgctaacagagcttctggagagtgggactctgggactgagaacagactcaaggtgacctccaaggaaggactcaccccataccctcccctgcaagaagcgggaagcatcccagtaaccaaacctgaattgccaaagaaaccaaaccctggccttatacgaagtgttaatcctgagattccgggaagagggcccctggctgagagctctgatagtgggaagaaagtgccaactcctgccccgcggcctttgctgctgaagaaatctgtttcctcagaaaaccccacctacccttcagctccactgaaacctgtcactgttcctccccgactcgcaggggcatcacaagccaaagcatacaagtcactgggagaagggcccccagccaaccccccagttccagttctgcagagcaagcccttggtggacatcgatctcatcagctttgatgatgatgttttgcccaccccatcggggaacctggctgaagaatctgttggttcagagatggttctagatccctttcagctccctgcaaaaacagaaccaataaaagaacgagcagttcaaccagcacccaccaggaagcccactgtaattcgaattccagccaaaccaggaaaatgtttacatgaggatccacaaagtccacctcctctccctgctgaaaaacctattggaaacactttcagtacagtatctggaaagctcagtaatgttgagagaactagaaacttggaatccaaccacccaggtcaaacaggaggttttgtgcgagtacccccaaggttgccaccgagacctgtgaatggaaaaaccattccaactcaacagcctccaaccaaggtgccccctgagagaccacctcccccaaagctttctgcaaccagaagatctaataagaaactgccttttaatcgatcctcttctgacatggatcttcagaaaaaacaaagtaacttggcaactggactctcaaaagccaagagtcaagtttttaaaaatcaagatccggtgctaccccctcgtcccaaaccaggacaccctctctacagtaaatacatgctgtctgtgcctcatggaattgccaatgaagatattgtctctcaaaaccccggagaactctcttgtaagcgtggggatgtacttgtgatgctgaagcagacggaaaataattacttggagtgccaaaagggagaagacactggcagagttcacctgtctcaaatgaagattatcactccacttgatgaacatcttagaagcagaccaaaccccttttctccccctaaggatccaagccacgctcagaagcctgttgacagtggtgctcctcatgctgtcgttcttcatgatttcccagcagagcaagttgatgatttgaacctcacttctggagaaattgtttatcttctggagaagatagatacagattggtacagagggaactgtagaaaccagattggcatatttcctgccaactatgtcaaagtgattattgatatcccagaaggaggaaatgggaaaagagaatgtgtttcatctcattgtgttaaaggctcaagatgtgttgctcggtttgaatatattggagagcagaaggatgagttgagtttctcagagggagaaattattattcttaaagagtatgtgaatgaggaatgggccagaggagaagttcgaggcagaactgggattttccccctgaactttgtggagcctgttgaggattatcccacctctggtgcaaatgttttaagcacaaaggtaccactgaaaaccaaaaaagaagattctggctcaaactctcaggttaacagtcttccggcagaatggtgtgaagctcttcacagttttacagcagagaccagtgatgacttatcattcaagaggggagaccggatccagattctggaacgtctggattctgactggtgcaggggcagactgcaggacagggaggggatcttcccagcagtgtttgtgaggccctgcccagctgaggcaaaaagtatgttggccatagtaccgaaggggaggaaggccaaagccttatatgatttccgaggggagaatgaagatgaactttccttcaaggctggagatataataacagagctggaatctgtagatgatgactggatgagtggagaacttatgggaaaatctggaatatttcccaaaaactacatacagtttctacagatcagctagaggagaagcttgtctgtgttccttggcacaagaactcacttgaactatcaccttgactatcagatatgtttttgcactattttttttaactgaaaaagaaatatctaagctgtacatggtacactagaattttctgaaagcagaaaacgttcagattttgtagttaattttcattacaatagaaacatgcacatggaaacccatgagctaggattctaccgaggaaaacatctagtgggattagcaaggtgaagggaaagcatctggtggcatggcagcatggggaggctcacacacagaagttgcacgtggacatctgttttaatcagcacaagtgaattaaccatgcttcttcatttttttactttagttaaaaaagaggacatttaatattctacatgctgtaactatcaggacatggttagcaatctcaatttcatttttgatattcaaattaattcttacagcttgagcatatcagccttattaccagagcaaatccttccttcagatgggatagtttactgactagttggagcatttgtaagcacatggtgaaatcagcccctgcccaccaaaataatctttatgttaccaagtgattcccatttgtctaaggatttgaagggggtctaaattggatgtatcttagtctaaagaaccaaaaccatccctgaaatgccttgctaatacaactaatccttccatatatgtgccatacttatttttttcctcagtgtatactttatgttaacagggttattacaaagcacattttctgaatctgcaatcattcctttgacaattactggacccaaaggaaaattcattttctttgcattattccagtaatatataaaaactgtgtcttgttatagtagtacattatgaatcacatataaaatcttacaatacagaacaactgttaagatggaaaacagtgccaaacctccacagctcatttctttgtaatataatcagaatgaaaaataatttaagaggacagaagactggtacttttttgttttattttttctctagcttatccctgcacaattattagagtgaatgaaaaaccactttcctgctttccattgttataaattctaagcttaagataaaagtggttctttacatgactgaatcaattacaatttatgggctagagccaaataggttgaagacaatcatccaaacagatcaatggaatagaatttcattggaaatgtaaaacactttcccaacaatggtcatgactttcttctgtttttgagaagagtttcatatgctggaccacattttagcttttattgttttttttttcccattgtccaaaaagttaagcaacaagtggccacacttttacgtgactacaacctggagttctgcaaagaaggtaatatttacttggtctttgactaaagttatctccccattctatggttacattttattttggactatggggacttctaatacgttttggtaaagaagagagtataaagaaaattcttgtcaaatttcactcaaaagtaatttcatgagaaatcaatgatttaaagcattatccaaattaaattatcatttgcagcaaactgtacaacagcaggaaggatatggaatggaacatgaggtatatatctttgcctttataattttaacatcttatattgaagattctgaaaacctatctttattagaggaaaatctcaatcttcagttttggccttctgtcaccagaatgataagtgcaatagttgtaaatctacttgacactgtaataaactgaactgaactttca

SEQ ID NO: 448128 - DNA, 4708 bp, Homo sapiens
cactttcagtaggtaaattttattgtatgtgggttatatctcaaagatgtttaacaaattcattgagctaatgcatataaggtatttaacacagtgactagcacatggtgaatgagcagtaaatattagctattcttaatattacaaaaccatttgcattagcagttatagtcatattagaaagacctttgcattatgttatatttacctaccagatacctaccccagtggtatggtctgaattgtatggaccacttgttggcaaccctgtctagcctgttcctcttgcccttcacctgctaggctgggttgatgagcagcattgccagtgatatccatacactgaaggcagagaagggaaaatgtgtgactgggaggcacaaattatcccctccctccaaggactggtttatgtttaggcctctggtccatttggagatttcatgtttgtgtttggtgtgtggtaggtctctgacatcattttttccaaatggataggcatctagcctaataacacttattgaatagtaattcctttttctccacagatgtaaatcagaaaaaaatgaaaatcacacatgcacatgtataacacattatataaataataattaatttgtttaactttttttggagagagtcactcagtcatccaagtcagagtatagtgacagagcaagaccctgtgtcaaagaaaaaaaagccatgtcagacctaaaatatctcagaattcatgaaatttccatattgttcatttatttagagaaaagcattaagcagtccatgaaaaaatgttagggtcttcttagtaagctaatatagtaagctacattagccattagagtcttaagttatatttcagtttacctaacttgagagaatgaaagttttgtttctgcaggtgcattttggttgaaagagcagctgagatttagaaaagatctcagcaaaggtgctgcagggttgaaatggagaaagtggaccatcattcacagtgcgctgcaatcagcctggtgcatcatggccaggggaagggcagaggtatagatgtgtcaggacgtctctaaggggacaagagttattagaggaggtgaagagacaagaaagggcacaaaaatctgcctttatttatttcacaggcttgccagtgttgaagagtgttaagttataactccaaataatatccttcagtgggatttgatgatgatgaggataagcctgtctcttgatataaagaaactaagaataacaattgctagtcaataagaagaggtcgctcttcagctttgccttatcctctggccaatctcggcatttggctagatggatagagaatgttagattctttttgctaatttatttagaactactgttgaataaaccattcagattaaatacaaaatgcagaccaggcatgggaggtagcattgctttcaaattagaaaaagcacttagttaagtggtaataaatgaaatggattttactttttgtgaattatacttctgttgaaagtcattagctcctttcattacaaaaggcaagagcataaatcatagaactttcttcttttcccatcctaataaagacacaacttttaagactctgtcttgatcacagttttaaggaaaaagctattcttgaaagggaaagaggtcaaaaaccactactttggggtagaatagatactgtttcaaaataaataaacagttcccttttgttttactctctcagcttaaaaaagcaaaaagaaaacatactgggggatattttaattgagattttcgtcctcccttagcaaggacacattcttcttcaacttgataataattcccttgtttggctcaactgtgtggtttgcatcatgtactcataatgtaattgtgtcaagaggactctaatgagaaaaaaaaaattggtctcagagtgaataataaatccaccatctatcctgcacacttcattcacagcccttttctccccctaaggatccaagccacgctcagaagcctgttgacagtggtgctcctcatgctgtcgttcttcatgatttcccagcagagcaagttgatgatttgaacctcacttctggagaaattgtttatcttctggagaagatagatacagattggtacagagggaactgtagaaaccagattggcatatttcctgccaactatgtcaaagtgattattgatatcccagaaggaggaaatgggaaaagagaatgtgtttcatctcattgtgttaaaggctcaagatgtgttgctcggtttgaatatattggagagcagaaggatgagttgagtttctcagagggagaaattattattcttaaagagtatgtgaatgaggaatgggccagaggagaagttcgaggcagaactgggattttccccctgaactttgtggagcctgttgaggattatcccacctctggtgcaaatgttttaagcacaaaggtaccactgaaaaccaaaaaagaagattctggctcaaactctcaggttaacagtcttccggcagaatggtgtgaagctcttcacagttttacagcagagaccagtgatgacttatcattcaagaggggagaccggatccagattctggaacgtctggattctgactggtgcaggggcagactgcaggacagggaggggatcttcccagcagtgtttgtgaggccctgcccagctgaggcaaaaagtatgttggccatagtaccgaaggggaggaaggccaaagccttatatgatttccgaggggagaatgaagatgaactttccttcaaggctggagatataataacagagctggaatctgtagatgatgactggatgagtggagaacttatgggaaaatctggaatatttcccaaaaactacatacagtttctacagatcagctagaggagaagcttgtctgtgttccttggcacaagaactcacttgaactatcaccttgactatcagatatgtttttgcactattttttttaactgaaaaagaaatatctaagctgtacatggtacactagaattttctgaaagcagaaaacgttcagattttgtagttaattttcattacaatagaaacatgcacatggaaacccatgagctaggattctaccgaggaaaacatctagtgggattagcaaggtgaagggaaagcatctggtggcatggcagcatggggaggctcacacacagaagttgcacgtggacatctgttttaatcagcacaagtgaattaaccatgcttcttcatttttttactttagttaaaaaagaggacatttaatattctacatgctgtaactatcaggacatggttagcaatctcaatttcatttttgatattcaaattaattcttacagcttgagcatatcagccttattaccagagcaaatccttccttcagatgggatagtttactgactagttggagcatttgtaagcacatggtgaaatcagcccctgcccaccaaaataatctttatgttaccaagtgattcccatttgtctaaggatttgaagggggtctaaattggatgtatcttagtctaaagaaccaaaaccatccctgaaatgccttgctaatacaactaatccttccatatatgtgccatacttatttttttcctcagtgtatactttatgttaacagggttattacaaagcacattttctgaatctgcaatcattcctttgacaattactggacccaaaggaaaattcattttctttgcattattccagtaatatataaaaactgtgtcttgttatagtagtacattatgaatcacatataaaatcttacaatacagaacaactgttaagatggaaaacagtgccaaacctccacagctcatttctttgtaatataatcagaatgaaaaataatttaagaggacagaagactggtacttttttgttttattttttctctagcttatccctgcacaattattagagtgaatgaaaaaccactttcctgctttccattgttataaattctaagcttaagataaaagtggttctttacatgactgaatcaattacaatttatgggctagagccaaataggttgaagacaatcatccaaacagatcaatggaatagaatttcattggaaatgtaaaacactttcccaacaatggtcatgactttcttctgtttttgagaagagtttcatatgctggaccacattttagcttttattgttttttttttcccattgtccaaaaagttaagcaacaagtggccacacttttacgtgactacaacctggagttctgcaaagaaggtaatatttacttggtctttgactaaagttatctccccattctatggttacattttattttggactatggggacttctaatacgttttggtaaagaagagagtataaagaaaattcttgtcaaatttcactcaaaagtaatttcatgagaaatcaatgatttaaagcattatccaaattaaattatcatttgcagcaaactgtacaacagcaggaaggatatggaatggaacatgaggtatatatctttgcctttataattttaacatcttatattgaagattctgaaaacctatctttattagaggaaaatctcaatcttcagttttggccttctgtcaccagaatgataagtgcaatagttgtaaatctacttgacactgtaataaactgaactgaactttca

SEQ ID NO: 448129 - DNA, 4035 bp, Homo sapiens
gaagagagcgggagtgggagtgggaaaggccaggattaagaggccgccgggacgccgcaaggaggcggggaatcggctcggcccgcgccctgccgctgcccggccggctgcaggtggagttcgcggaggtggccatttccacagccgccgccgacgcctcctctccgggagccgccttccccccggcccgagggcggtggcgtggggcgccgggtgcaggcgttctggggcgccggggccgcagctcgctggccatcccgcggctgcgccccgcgcctcgcccatggctgagggccggcggcgggaggacgaggaggaagagctacgcgagcgccgcgaacttggtggccagcgccgcgcccggggccgtgcgctctcgggccactcggccgcagatcgcaacgaacgaaataaaccagaacatcgttcttcaagccaaggacccttgtcatccattagagcggtaatcaagagatcttctcggacttctattcagagtgaacttcatcgagatagaaggcgcccagagatcaccattgtggcagctgagccactgaggccagcctcgtggtttccaggaaccccacccccaggactgggatttcctacatcatctgcagcaggctcttggaggcctaatgagctggttcctgctgagctcccaccatcttatgaacaagttataaaagaaatcaaccaagttcaagttaatactacaaataataataatgctgctgctactccaaggcacactattacttctgcaactcagactgacttttcagaagaaatagacaacgatctgcctcaaagtaatgcaacactacaggcacctctcaagcctcttcagcctttctcagcagtctcgtctggcaatcttccaacaaatgtggcacctttaatcgtctttgatatttctgaagaaccgaattgtccagaaaaccccagtgctacaagatgtccagtgccaaaaccaagatcaaaaagcaacctcagaccaatacccagagattctcacattaaagagcaaagtcaacagaaaatcagcccagcagccgtaggagaggagtcatccccaggccggccccagtctctgctggacaacgctagcacctcagacagtcaggcagtgatgaacattatgaacacagaacaaagccaaaatagtattgtttccagaattaaagtgtttgagggtcagacaaacatagaaacctcaggactgcccaagaaaccagaaattactccacgttcacttcctccaaagcctactgtttcctcagggaaaccttctgtagctcccaaaccagctgctaacagagcttctggagagtgggactctgggactgagaacagactcaaggtgacctccaaggaaggactcaccccataccctcccctgcaagaagcgggaagcatcccagtaaccaaacctgaattgccaaagaaaccaaaccctggccttatacgaagtgttaatcctgagattccgggaagagggcccctggctgagagctctgatagtgggaagaaagtgccaactcctgccccgcggcctttgctgctgaagaaatctgtttcctcagaaaaccccacctacccttcagctccactgaaacctgtcactgttcctccccgactcgcaggggcatcacaagccaaagcatacaagtcactgggagaagggcccccagccaaccccccagttccagttctgcagagcaagcccttggtggacatcgatctcatcagctttgatgatgatgttttgcccaccccatcggggaacctggctgaagaatctgttggttcagagatggttctaggtttacatgaggatccacaaagtccacctcctctccctgctgaaaaacctattggaaacactttcagtacagtatctggaaagctcagtaatgttgagagaactagaaacttggaatccaaccacccaggtcaaacaggaggttttgtgcgagtacccccaaggttgccaccgagacctgtgaatggaaaaaccattccaactcaacagcctccaaccaaggtgccccctgagagaccacctcccccaaagctttctgcaaccagaagatctaataagaaactgccttttaatcgatcctcttctgacatggatcttcagaaaaaacaaagtaacttggcaactggactctcaaaagccaagagtcaagtttttaaaaatcaagatccggtgctaccccctcgtcccaaaccaggacaccctctctacagtaaatacatgcgtggggatgtacttgtgatgctgaagcagacggaaaataattacttggagtgccaaaagggagaagacactggcagagttcacctgtctcaaatgaagattatcactccacttgatgaacatcttagaagcagaccaaacgatccaagccacgctcagaagcctgttgacagtggtgctcctcatgctgtcgttcttcatgatttcccagcagagcaagttgatgatttgaacctcacttctggagaaattgtttatcttctggagaagatagatacagattggtacagagggaactgtagaaaccagattggcatatttcctgccaactatgtcaaagtgattattgatatcccagaaggaggaaatgggaaaagagaatgtgtttcatctcattgtgttaaaggctcaagatgtgttgctcggtttgaatatattggagagcagaaggatgagttgagtttctcagagggagaaattattattcttaaagagtatgtgaatgaggaatgggccagaggagaagttcgaggcagaactgggattttccccctgaactttgtggagcctgttgaggattatcccacctctggtgcaaatgttttaagcacaaaggtaccactgaaaaccaaaaaagaagattctggctcaaactctcaggttaacagtcttccggcagaatggtgtgaagctcttcacagttttacagcagagaccagtgatgacttatcattcaagaggggagaccggatccagattctggaacgtctggattctgactggtgcaggggcagactgcaggacagggaggggatcttcccagcagtgtttgtgaggccctgcccagctgaggcaaaaagtatgttggccatagtaccgaaggggaggaaggccaaagccttatatgatttccgaggggagaatgaagatgaactttccttcaaggctggagatataataacagagctggaatctgtagatgatgactggatgagtggagaacttatgggaaaatctggaatatttcccaaaaactacatacagtttctacagatcagctagaggagaagcttgtctgtgttccttggcacaagaactcacttgaactatcaccttgactatcagatatgtttttgcactattttttttaactgaaaaagaaatatctaagctgtacatggtacactagaattttctgaaagcagaaaacgttcagattttgtagttaattttcattacaatagaaacatgcacatggaaacccatgagctaggattctaccgaggaaaacatctagtgggattagcaaggtgaagggaaagcatctggtggcatggcagcatggggaggctcacacacagaagttgcacgtggacatctgttttaatcagcacaagtgaattaaccatgcttcttcatttttttactttagttaaaaaagaggacatttaatattctacatgctgtaactatcaggacatggttagcaatctcaatttcatttttgatattcaaattaattcttacagcttgagcatatcagccttattaccagagcaaatccttccttcagatgggatagtttactgactagttggagcatttgtaagcacatggtgaaatcagcccctgcccaccaaaataatctttatgttaccaagtgattcccatttgtctaaggatttgaagggggtctaaattggatgtatcttagtctaaagaaccaaaaccatccctgaaatgccttgctaatacaactaatccttcca

SEQ ID NO: 448130 - DNA, 2128 bp, Homo sapiens
agcggggtcgccttccaccaggccctaccgccaacactggggattatgattcaacttgagatttggtggctacacagatccaaaccatatcaggctcttcgccattcaaatcctccctacacagtgaagcattatccatctctggtactggcaagggcaaaactcagactttgttgatggcatctggatgcaatcgtctttgagtacatcgctggagatataataacagagctggaatctgtagatgatgactggatgagtggagaacttatgggaaaatctggaatatttcccaaaaactacatacagtttctacagatcagctagaggagaagcttgtctgtgttccttggcacaagaactcacttgaactatcaccttgactatcagatatgtttttgcactattttttttaactgaaaaagaaatatctaagctgtacatggtacactagaattttctgaaagcagaaaacgttcagattttgtagttaattttcattacaatagaaacatgcacatggaaacccatgagctaggattctaccgaggaaaacatctagtgggattagcaaggtgaagggaaagcatctggtggcatggcagcatggggaggctcacacacagaagttgcacgtggacatctgttttaatcagcacaagtgaattaaccatgcttcttcatttttttactttagttaaaaaagaggacatttaatattctacatgctgtaactatcaggacatggttagcaatctcaatttcatttttgatattcaaattaattcttacagcttgagcatatcagccttattaccagagcaaatccttccttcagatgggatagtttactgactagttggagcatttgtaagcacatggtgaaatcagcccctgcccaccaaaataatctttatgttaccaagtgattcccatttgtctaaggatttgaagggggtctaaattggatgtatcttagtctaaagaaccaaaaccatccctgaaatgccttgctaatacaactaatccttccatatatgtgccatacttatttttttcctcagtgtatactttatgttaacagggttattacaaagcacattttctgaatctgcaatcattcctttgacaattactggacccaaaggaaaattcattttctttgcattattccagtaatatataaaaactgtgtcttgttatagtagtacattatgaatcacatataaaatcttacaatacagaacaactgttaagatggaaaacagtgccaaacctccacagctcatttctttgtaatataatcagaatgaaaaataatttaagaggacagaagactggtacttttttgttttattttttctctagcttatccctgcacaattattagagtgaatgaaaaaccactttcctgctttccattgttataaattctaagcttaagataaaagtggttctttacatgactgaatcaattacaatttatgggctagagccaaataggttgaagacaatcatccaaacagatcaatggaatagaatttcattggaaatgtaaaacactttcccaacaatggtcatgactttcttctgtttttgagaagagtttcatatgctggaccacattttagcttttattgttttttttttcccattgtccaaaaagttaagcaacaagtggccacacttttacgtgactacaacctggagttctgcaaagaaggtaatatttacttggtctttgactaaagttatctccccattctatggttacattttattttggactatggggacttctaatacgttttggtaaagaagagagtataaagaaaattcttgtcaaatttcactcaaaagtaatttcatgagaaatcaatgatttaaagcattatccaaattaaattatcatttgcagcaaactgtacaacagcaggaaggatatggaatggaacatgaggtatatatctttgcctttataattttaacatcttatattgaagattctgaaaacctatctttattagaggaaaatctcaatcttcagttttggccttctgtcaccagaatgataagtgcaatagttgtaaatctacttgacactgtaataaactgaactgaactttca

SEQ ID NO: 448131 - DNA, 3865 bp, Homo sapiens
gaagagagcgggagtgggagtgggaaaggccaggattaagaggccgccgggacgccgcaaggaggcggggaatcggctcggcccgcgccctgccgctgcccggccggctgcaggtggagttcgcggaggtggccatttccacagccgccgccgacgcctcctctccgggagccgccttccccccggcccgagggcggtggcgtggggcgccgggtgcaggcgttctggggcgccggggccgcagctcgctggccatcccgcggctgcgccccgcgcctcgcccatggctgagggccggcggcgggaggacgaggaggaagagctacgcgagcgccgcgaacttggtggccagcgccgcgcccggggccgtgcgctctcgggccactcggccgcagatcgcaacgaacgaaataaaccagaacatcgttcttcaagccaaggacccttgtcatccattagagcggtaatcaagagatcttctcggacttctattcagagtgaacttcatcgagatagaaggcgcccagagatcaccattgtggcagctgagccactgaggccagcctcgtggtttccaggaaccccacccccaggactgggatttcctacatcatctgcagcaggctcttggaggcctaatgagctggttcctgctgagctcccaccatcttatgaacaagttataaaagaaatcaaccaagttcaagttaatactacaaataataataatgctgctgctactccaaggcacactattacttctgcaactcagactgacttttcagaagaaatagacaacgatctgcctcaaagtaatgcaacactacaggcacctctcaagcctcttcagcctttctcagcagtctcgtctggcaatcttccaacaaatgtggcacctttaatcgtctttgatatttctgaagaaccgaattgtccagaaaaccccagtgctacaagatgtccagtgccaaaaccaagatcaaaaagcaacctcagaccaatacccagagattctcacattaaagagcaaagtcaacagaaaatcagcccagcagccgtaggagaggagtcatccccaggccggccccagtctctgctggacaacgctagcacctcagacagtcaggcagtgatgaacattatgaacacagaacaaagccaaaatagtattgtttccagaattaaagtgtttgagggtcagacaaacatagaaacctcaggactgcccaagaaaccagaaattactccacgttcacttcctccaaagcctactgtttcctcagggaaaccttctgtagctcccaaaccagctgctaacagagcttctggagagtgggactctgggactgagaacagactcaaggtgacctccaaggaaggactcaccccataccctcccctgcaagaagcgggaagcatcccagtaaccaaacctgaattgccaaagaaaccaaaccctggccttatacgaagtgttaatcctgagattccgggaagagggcccctggctgagagctctgatagtgggaagaaagtgccaactcctgccccgcggcctttgctgctgaagaaatctgtttcctcagaaaaccccacctacccttcagctccactgaaacctgtcactgttcctccccgactcgcaggggcatcacaagccaaagcatacaagtcactgggagaagggcccccagccaaccccccagttccagttctgcagagcaagcccttggtggacatcgatctcatcagctttgatgatgatgttttgcccaccccatcggggaacctggctgaagaatctgttggttcagagatggttctaggtttacatgaggatccacaaagtccacctcctctccctgctgaaaaacctattggaaacactttcagtacagtatctggaaagctcagtaatgttgagagaactagaaacttggaatccaaccacccaggtcaaacaggaggttttgtgcgagtacccccaaggttgccaccgagacctgtgaatggaaaaaccattccaactcaacagcctccaaccaaggtgccccctgagagaccacctcccccaaagctttctgcaaccagaagatctaataagaaactgccttttaatcgatcctcttctgacatggatcttcagaaaaaacaaagtaacttggcaactggactctcaaaagccaagagtcaagtttttaaaaatcaagatccggtgctaccccctcgtcccaaaccaggacaccctctctacagtaaatacatgcgtggggatgtacttgtgatgctgaagcagacggaaaataattacttggagtgccaaaagggagaagacactggcagagttcacctgtctcaaatgaagattatcactccacttgatgaacatcttagaagcagaccaaacgatccaagccacgctcagaagcctgttgacagtggtgctcctcatgctgtcgttcttcatgatttcccagcagagcaagttgatgatttgaacctcacttctggagaaattgtttatcttctggagaagatagatacagattggtacagagggaactgtagaaaccagattggcatatttcctgccaactatgtcaaagtgattattgatatcccagaaggaggaaatgggaaaagagaatgtgtttcatctcattgtgttaaaggctcaagatgtgttgctcggtttgaatatattggagagcagaaggatgagttgagtttctcagagggagaaattattattcttaaagagtatgtgaatgaggaatgggccagaggagaagttcgaggcagaactgggattttccccctgaactttgtggagcctgttgaggattatcccacctctggtgcaaatgttttaagcacaaaggtaccactgaaaaccaaaaaagaagattctggctcaaactctcaggttaacagtcttccggcagaatggtgtgaagctcttcacagttttacagcagagaccagtgatgacttatcattcaagaggggagaccggatccagattctggaacgtctggattctgactggtgcaggggcagactgcaggacagggaggggatcttcccagcagtgtttgtgaggccctgcccagctgaggcaaaaagtatgttggccatagtaccgaaggggaggaaggccaaagccttatatgatttccgaggggagaatgaagatgaactttccttcaaggtcagaatgtgtatctcttcataactgcattaagcactataattttttaaatgttttccattgaaggatggaacatttgggtggaatattaatcattactcaagaatgaagagatctcaggccctgattctaggggaagacattagagaaagtgaacagtcagaagaaggagggtggttttagtagtcactgctgtcaaaatagcctgtgtcaggcagtggtaaattctctgtcattgaagatattcagtcagaggaaaggatgccatagaaagaattaacatatcaaggaatgattggacaaggtgtggtttaaaacagtggacaaccaaacagggttttcacttgtctgcaacaagatgagaaaaaggccgagcaacagtggctcacacctctaatcccaacacttttgggaagtcaaggcaggaggatcgcttgaggccaggagtttaaaaccagcctggtcaacatggcaagaccccatctcaacaaagaaaaagaggaaaacaaggcaatacctgaatcaggtatgtgcagcctttgtcggggtaaggggggatgccttgactgaaatatgtcaccataaagttgctaacttcctattttgtgatggggttttactttattctgaataataaaatgttatttcatcttt

SEQ ID NO: 448132 - DNA, 3215 bp, Homo sapiens
  misc_feature (3171)..(3171): n is a, c, g, or t
  misc_feature (3175)..(3175): n is a, c, g, or t
  misc_feature (3202)..(3202): n is a, c, g, or t
  misc_feature (3204)..(3206): n is a, c, g, or t
gaagagagcgggagtgggagtgggaaaggccaggattaagaggccgccgggacgccgcaaggaggcggggaatcggctcggcccgcgccctgccgctgcccggccggctgcaggtggagttcgcggaggtggccatttccacagccgccgccgacgcctcctctccgggagccgccttccccccggcccgagggcggtggcgtggggcgccgggtgcaggcgttctggggcgccggggccgcagctcgctggccatcccgcggctgcgccccgcgcctcgcccatggctgagggccggcggcgggaggacgaggaggaagagctacgcgagcgccgcgaacttggtggccagcgccgcgcccggggccgtgcgctctcgggccactcggccgcagatcgcaacgaacgaaataaaccagaacatcgttcttcaagccaaggacccttgtcatccattagagcggtaatcaagagatcttctcggacttctattcagagtgaacttcatcgagatagaaggcgcccagagatcaccattgtggcagctgagccactgaggccagcctcgtggtttccaggaaccccacccccaggactgggatttcctacatcatctgcagcaggctcttggaggcctaatgagctggttcctgctgagctcccaccatcttatgaacaagttataaaagaaatcaaccaagttcaagttaatactacaaataataataatgctgctgctactccaaggcacactattacttctgcaactcagactgacttttcagaagaaatagacaacgatctgcctcaaagtaatgcaacactacaggcacctctcaagcctcttcagcctttctcagcagtctcgtctggcaatcttccaacaaatgtggcacctttaatcgtctttgatatttctgaagaaccgaattgtccagaaaaccccagtgctacaagatgtccagtgccaaaaccaagatcaaaaagcaacctcagaccaatacccagagattctcacattaaagagcaaagtcaacagaaaatcagcccagcagccgtaggagaggagtcatccccaggccggccccagtctctgctggacaacgctagcacctcagacagtcaggcagtgatgaacattatgaacacagaacaaagccaaaatagtattgtttccagaattaaagtgtttgagggtcagacaaacatagaaacctcaggactgcccaagaaaccagaaattactccacgttcacttcctccaaagcctactgtttcctcagggaaaccttctgtagctcccaaaccagctgctaacagagcttctggagagtgggactctgggactgagaacagactcaaggtgacctccaaggaaggactcaccccataccctcccctgcaagaagcgggaagcatcccagtaaccaaacctgaattgccaaagaaaccaaaccctggccttatacgaagtgttaatcctgagattccgggaagagggcccctggctgagagctctgatagtgggaagaaagtgccaactcctgccccgcggcctttgctgctgaagaaatctgtttcctcagaaaaccccacctacccttcagctccactgaaacctgtcactgttcctccccgactcgcaggggcatcacaagccaaagcatacaagtcactgggagaagggcccccagccaaccccccagttccagttctgcagagcaagcccttggtggacatcgatctcatcagctttgatgatgatgttttgcccaccccatcggggaacctggctgaagaatctgttggttcagagatggttctaggtttacatgaggatccacaaagtccacctcctctccctgctgaaaaacctattggaaacactttcagtacagtatctggaaagctcagtaatgttgagagaactagaaacttggaatccaaccacccaggtcaaacaggaggttttgtgcgagtacccccaaggttgccaccgagacctgtgaatggaaaaaccattccaactcaacagcctccaaccaaggtgccccctgagagaccacctcccccaaagctttctgcaaccagaagatctaataagaaactgccttttaatcgatcctcttctgacatggatcttcagaaaaaacaaagtaacttggcaactggactctcaaaagccaagagtcaagtttttaaaaatcaagatccggtgctaccccctcgtcccaaaccaggacaccctctctacagtaaatacatgcgtggggatgtacttgtgatgctgaagcagacggaaaataattacttggagtgccaaaagggagaagacactggcagagttcacctgtctcaaatgaagattatcactccacttgatgaacatcttagaagcagaccaaacgatccaagccacgctcagaagcctgttgacagtggtgctcctcatgctgtcgttcttcatgatttcccagcagagcaagttgatgatttgaacctcacttctggagaaattgtttatcttctggagaagatagatacagattggtacagagggaactgtagaaaccagattggcatatttcctgccaactatgtcaaagtgattattgatatcccagaaggaggaaatgggaaaagagaatgtgtttcatctcattgtgttaaaggctcaagatgtgttgctcggtttgaatatattggagagcagaaggatgagttgagtttctcagagggagaaattattattcttaaagagtatgtgaatgaggaatgggccagaggagaagttcgaggcagaactgggattttccccctgaactttgtggagcctgttgaggattatcccacctctggtgcaaatgttttaagcacaaaggtaccactgaaaaccaaaaaagaagattctggctcaaactctcaggttaacagtcttccggcagaatggtgtgaagctcttcacagttttacagcagagaccagtgatgacttatcattcaagaggggagaccggatccagattctggaacgtctggattctgactggtgcaggggcagactgcaggacagggaggggatcttcccagcagtgtttgtgaggccctgcccagctgaggcaggaggatcacttgagcctgggaggtcaagactacagtgagctatgattgncctnctattctccagcctgggtaacagtganannntgtctcaaa

SEQ ID NO: 448133 - DNA, 2319 bp, Homo sapiens
  misc_feature (2288)..(2290): n is a, c, g, or t
cactttcagtaggtaaattttattgtatgtgggttatatctcaaagatgtttaacaaattcattgagctaatgcatataaggtatttaacacagtgactagcacatggtgaatgagcagtaaatattagctattcttaatattacaaaaccatttgcattagcagttatagtcatattagaaagacctttgcattatgttatatttacctaccagatacctaccccagtggtatggtctgaattgtatggaccacttgttggcaaccctgtctagcctgttcctcttgcccttcacctgctaggctgggttgatgagcagcattgccagtgatatccatacactgaaggcagagaagggaaaatgtgtgactgggaggcacaaattatcccctccctccaaggactggtttatgtttaggcctctggtccatttggagatttcatgtttgtgtttggtgtgtggtaggtctctgacatcattttttccaaatggataggcatctagcctaataacacttattgaatagtaattcctttttctccacagatgtaaatcagaaaaaaatgaaaatcacacatgcacatgtataacacattatataaataataattaatttgtttaactttttttggagagagtcactcagtcatccaagtcagagtatagtgacagagcaagaccctgtgtcaaagaaaaaaaagccatgtcagacctaaaatatctcagaattcatgaaatttccatattgttcatttatttagagaaaagcattaagcagtccatgaaaaaatgttagggtcttcttagtaagctaatatagtaagctacattagccattagagtcttaagttatatttcagtttacctaacttgagagaatgaaagttttgtttctgcaggtgcattttggttgaaagagcagctgagatttagaaaagatctcagcaaaggtgctgcagggttgaaatggagaaagtggaccatcattcacagtgcgctgcaatcagcctggtgcatcatggccaggggaagggcagaggtatagatgtgtcaggacgtctctaaggggacaagagttattagaggaggtgaagagacaagaaagggcacaaaaatctgcctttatttatttcacaggcttgccagtgttgaagagtgttaagttataactccaaataatatccttcagtgggatttgatgatgatgaggataagcctgtctcttgatataaagaaactaagaataacaattgctagtcaataagaagaggtcgctcttcagctttgccttatcctctggccaatctcggcatttggctagatggatagagaatgttagattctttttgctaatttatttagaactactgttgaataaaccattcagattaaatacaaaatgcagaccaggcatgggaggtagcattgctttcaaattagaaaaagcacttagttaagtggtaataaatgaaatggattttactttttgtgaattatacttctgttgaaagtcattagctcctttcattacaaaaggcaagagcataaatcatagaactttcttcttttcccatcctaataaagacacaacttttaagactctgtcttgatcacagttttaaggaaaaagctattcttgaaagggaaagaggtcaaaaaccactactttggggtagaatagatactgtttcaaaataaataaacagttcccttttgttttactctctcagcttaaaaaagcaaaaagaaaacatactgggggatattttaattgagattttcgtcctcccttagcaaggacacattcttcttcaacttgataataattcccttgtttggctcaactgtgtggtttgcatcatgtactcataatgtaattgtgtcaagaggactctaatgagaaaaaaaaaattggtctcagagtgaataataaatccaccatctatcctgcacacttcattcacagcccttttctccccctaaggatccaagccacgctcagaagcctgttgacagtggtgctcctcatgctgtcgttcttcatgatttcccagcaggtaaggatgtaaataatgcagtgggagaaccacaggatccaggagtaagtctttttccctgccgggggttagcctctcaaggacatccttcttcatttttctgtgcctatagagtccgagactggagaggtcatcttatccaggactccacttcaagaagggttgattgtaccagccattccagaaagcttagttgtatacccttgcctttgaagctccccctcgaggnnnccccccccgccccacgcggttggcagcac

SEQ ID NO: 448134 - DNA, 914 bp, Homo sapiens
attgaacatgtttttaaaaatgtttttctttgcctaatatcactacctctgaagagaagatactgtgtttttagagcgataagcgttttttttaaaaaaatgttagatttgtgttttagtccactgtgtttctatatatttaaattttttatgtcttcacagctgaggcaaaaagtatgttggccatagtaccgaaggggaggaaggccaaagccttatatgatttccgaggggagaatgaagatgaactttccttcaaggtcagaatgtgtatctcttcataactgcattaagcactataattttttaaatgttttccattgaaggatggaacatttgggtggaatattaatcattactcaagaatgaagagatctcaggccctgattctaggggaagacattagagaaagtgaacagtcagaagaaggagggtggttttagtagtcactgctgtcaaaatagcctgtgtcaggcagtggtaaattctctgtcattgaagatattcagtcagaggaaaggatgccatagaaagaattaacatatcaaggaatgattggacaaggtgtggtttaaaacagtggacaaccaaacagggttttcacttgtctgcaacaagatgagaaaaaggccgagcaacagtggctcacacctctaatcccaacacttttgggaagtcaaggcaggaggatcgcttgaggccaggagtttaaaaccagcctggtcaacatggcaagaccccatctcaacaaagaaaaagaggaaaacaaggcaatacctgaatcaggtatgtgcagcctttgtcggggtaaggggggatgccttgactgaaatatgtcaccataaagttgctaacttcctattttgtgatggggttttactttattctgaataataaaatgttatttcatcttt

SEQ ID NO: 448135 - DNA, 342 bp, Homo sapiens
gtaagtaaatgtgggaaaagttagagaaaaattaatgactcagagacccaactcttttttatcaccaagattgagtgttgttggccttgaatctttttttagagataaaataatctcaccgatttcacgcaggcccctaatccactgtctgctcctaatggtaggttgtgggaatctctgctccctttttaacacagttcaactcatagagcatttatttcctcaaataaatgaacaagactcatttctgaacttaaaacagctccacttctagaatatacgtatacatgcacacaaacaccctcctggttaagaaactggtttttggcatttccgaaggag

SEQ ID NO: 448136 - DNA, 459 bp, Homo sapiens
gacagtcatgctcctgaattccttttaaagcttaggcaactaggttcactcttttctcttcctttcctcttctataaccccttctttttttcccttagcactcatgaatagtacacagcaaaaatgccccgtggaagaggtatgtttgtgatgataacatgaagtcttttaaaagtgttatccctgctgatttcagcattagtgatggtggtgatgtgattgtagcaaacttgaatgggcctctgacttaatgaaaccattcttacaaatcagacacaccatgcagagctctagcctccctgtcagcttggtttagctcttgataaaaatgttaatagtcagtcaaaccagttgatgatatgaatatgaggacatcctccaagtagaaacccaggggtttggtttcagatcttagaggtttgctttgccaacccagcagaggttcacctgttacggctc

SEQ ID NO: 448137 - DNA, 503 bp, Homo sapiens
tctttttgaaagttaaataagttcaaaattaattgaacatgtttttaaaaatgtttttctttgcctaatatcactacctctgaagagaagatactgtgtttttagagcgataagcgttttttttaaaaaaatgttagatttgtgttttagtccactgtgtttctatatatttaaattttttatgtcttcacagctgaggcaaaaagtatgttggccatagtaccgaaggggaggaaggccaaagccttatatgatttccgaggggagaatgaagatgaactttccttcaaggtcagaatgtgtatctcttcataactgcattaagcactataattttttaaatgttttccattgaaggatggaacatttgggtggaatattaatcattactcaagaatgaagagatctcaggccctgattctaggggaagacattagagaaagtgaacagtgcaaataggcctgttaatttacagtatcaaccaggcattaatgtacttagag

SEQ ID NO: 448138 - DNA, 5306 bp, Homo sapiens
gaagagagcgggagtgggagtgggaaaggccaggattaagaggccgccgggacgccgcaaggaggcggggaatcggctcggcccgcgccctgccgctgcccggccggctgcaggtggagttcgcggaggtggccatttccacagccgccgccgacgcctcctctccgggagccgccttccccccggcccgagggcggtggcgtggggcgccgggtgcaggcgttctggggcgccggggccgcagctcgctggccatcccgcggctgcgccccgcgcctcgcccatggctgagggccggcggcgggaggacgaggaggaagagctacgcgagcgccgcgaacttggtggccagcgccgcgcccggggccgtgcgctctcgggccactcggccgcagatcgcaacgaacgaaataaaccagaacatcgttcttcaagccaaggacccttgtcatccattagagcggtaatcaagagatcttctcggacttctattcagagtgaacttcatcgagatagaaggcgcccagagatcaccattgtggcagctgagccactgaggccagcctcgtggtttccaggaaccccacccccaggactgggatttcctacatcatctgcagcaggctcttggaggcctaatgagctggttcctgctgagctcccaccatcttatgaacaagttataaaagaaatcaaccaagttcaagttaatactacaaataataataatgctgctgctactccaaggcacactattacttctgcaactcagactgacttttcagaagaaatagacaacgatctgcctcaaagtaatgcaacactacaggcacctctcaagcctcttcagcctttctcagcagtctcgtctggcaatcttccaacaaatgtggcacctttaatcgtctttgatatttctgaagaaccgaattgtccagaaaaccccagtgctacaagatgtccagtgccaaaaccaagatcaaaaagcaacctcagaccaatacccagagattctcacattaaagagcaaagtcaacagaaaatcagcccagcagccgtaggagaggagtcatccccaggccggccccagtctctgctggacaacgctagcacctcagacagtcaggcagtgatgaacattatgaacacagaacaaagccaaaatagtattgtttccagaattaaagtgtttgagggtcagacaaacatagaaacctcaggactgcccaagaaaccagaaattactccacgttcacttcctccaaagcctactgtttcctcagggaaaccttctgtagctcccaaaccagctgctaacagagcttctggagagtgggactctgggactgagaacagactcaaggtgacctccaaggaaggactcaccccataccctcccctgcaagaagcgggaagcatcccagtaaccaaacctgaattgccaaagaaaccaaaccctggccttatacgaagtgttaatcctgagattccgggaagagggcccctggctgagagctctgatagtgggaagaaagtgccaactcctgccccgcggcctttgctgctgaagaaatctgtttcctcagaaaaccccacctacccttcagctccactgaaacctgtcactgttcctccccgactcgcaggggcatcacaagccaaagcatacaagtcactgggagaagggcccccagccaaccccccagttccagttctgcagagcaagcccttggtggacatcgatctcatcagctttgatgatgatgttttgcccaccccatcggggaacctggctgaagaatctgttggttcagagatggttctagatccctttcagctccctgcaaaaacagaaccaataaaagaacgagcagttcaaccagcacccaccaggaagcccactgtaattcgaattccagccaaaccaggaaaatgtttacatgaggatccacaaagtccacctcctctccctgctgaaaaacctattggaaacactttcagtacagtatctggaaagctcagtaatgttgagagaactagaaacttggaatccaaccacccaggtcaaacaggaggttttgtgcgagtacccccaaggttgccaccgagacctgtgaatggaaaaaccattccaactcaacagcctccaaccaaggtgccccctgagagaccacctcccccaaagctttctgcaaccagaagatctaataagaaactgccttttaatcgatcctcttctgacatggatcttcagaaaaaacaaagtaacttggcaactggactctcaaaagccaagagtcaagtttttaaaaatcaagatccggtgctaccccctcgtcccaaaccaggacaccctctctacagtaaatacatgctgtctgtgcctcatggaattgccaatgaagatattgtctctcaaaaccccggagaactctcttgtaagcgtggggatgtacttgtgatgctgaagcagacggaaaataattacttggagtgccaaaagggagaagacactggcagagttcacctgtctcaaatgaagattatcactccacttgatgaacatcttagaagcagaccaaacgatccaagccacgctcagaagcctgttgacagtggtgctcctcatgctgtcgttcttcatgatttcccagcagagcaagttgatgatttgaacctcacttctggagaaattgtttatcttctggagaagatagatacagattggtacagagggaactgtagaaaccagattggcatatttcctgccaactatgtcaaagtgattattgatatcccagaaggaggaaatgggaaaagagaatgtgtttcatctcattgtgttaaaggctcaagatgtgttgctcggtttgaatatattggagagcagaaggatgagttgagtttctcagagggagaaattattattcttaaagagtatgtgaatgaggaatgggccagaggagaagttcgaggcagaactgggattttccccctgaactttgtggagcctgttgaggattatcccacctctggtgcaaatgttttaagcacaaaggtaccactgaaaaccaaaaaagaagattctggctcaaactctcaggttaacagtcttccggcagaatggtgtgaagctcttcacagttttacagcagagaccagtgatgacttatcattcaagaggggagaccggatccagattctggaacgtctggattctgactggtgcaggggcagactgcaggacagggaggggatcttcccagcagtgtttgtgaggccctgcccagctgaggcaaaaagtatgttggccatagtaccgaaggggaggaaggccaaagccttatatgatttccgaggggagaatgaagatgaactttccttcaaggctggagatataataacagagctggaatctgtagatgatgactggatgagtggagaacttatgggaaaatctggaatatttcccaaaaactacatacagtttctacagatcagctagaggagaagcttgtctgtgttccttggcacaagaactcacttgaactatcaccttgactatcagatatgtttttgcactattttttttaactgaaaaagaaatatctaagctgtacatggtacactagaattttctgaaagcagaaaacgttcagattttgtagttaattttcattacaatagaaacatgcacatggaaacccatgagctaggattctaccgaggaaaacatctagtgggattagcaaggtgaagggaaagcatctggtggcatggcagcatggggaggctcacacacagaagttgcacgtggacatctgttttaatcagcacaagtgaattaaccatgcttcttcatttttttactttagttaaaaaagaggacatttaatattctacatgctgtaactatcaggacatggttagcaatctcaatttcatttttgatattcaaattaattcttacagcttgagcatatcagccttattaccagagcaaatccttccttcagatgggatagtttactgactagttggagcatttgtaagcacatggtgaaatcagcccctgcccaccaaaataatctttatgttaccaagtgattcccatttgtctaaggatttgaagggggtctaaattggatgtatcttagtctaaagaaccaaaaccatccctgaaatgccttgctaatacaactaatccttccatatatgtgccatacttatttttttcctcagtgtatactttatgttaacagggttattacaaagcacattttctgaatctgcaatcattcctttgacaattactggacccaaaggaaaattcattttctttgcattattccagtaatatataaaaactgtgtcttgttatagtagtacattatgaatcacatataaaatcttacaatacagaacaactgttaagatggaaaacagtgccaaacctccacagctcatttctttgtaatataatcagaatgaaaaataatttaagaggacagaagactggtacttttttgttttattttttctctagcttatccctgcacaattattagagtgaatgaaaaaccactttcctgctttccattgttataaattctaagcttaagataaaagtggttctttacatgactgaatcaattacaatttatgggctagagccaaataggttgaagacaatcatccaaacagatcaatggaatagaatttcattggaaatgtaaaacactttcccaacaatggtcatgactttcttctgtttttgagaagagtttcatatgctggaccacattttagcttttattgttttttttttcccattgtccaaaaagttaagcaacaagtggccacacttttacgtgactacaacctggagttctgcaaagaaggtaatatttacttggtctttgactaaagttatctccccattctatggttacattttattttggactatggggacttctaatacgttttggtaaagaagagagtataaagaaaattcttgtcaaatttcactcaaaagtaatttcatgagaaatcaatgatttaaagcattatccaaattaaattatcatttgcagcaaactgtacaacagcaggaaggatatggaatggaacatgaggtatatatctttgcctttataattttaacatcttatattgaagattctgaaaacctatctttattagaggaaaatctcaatcttcagttttggccttctgtcaccagaatgataagtgcaatagttgtaaatctacttgacactgtaataaactgaactgaactttca

SEQ ID NO: 448139 - DNA, 5020 bp, Homo sapiens
cgagctcgtaccatatggttggacgaggaggaagagctacgcgagcgccgcgaacttggtggccagcgccgcgcccggggccgtgcgctctcgggccactcggccgcagatcgcaacgaacgaaataaaccagaacatcgttcttcaagccaaggacccttgtcatccattagagcggtaatcaagagatcttctcggacttctattcagagtgaacttcatcgagatagaaggcgcccagagatcaccattgtggcagctgagccactgaggccagcctcgtggtttccaggaaccccacccccaggactgggatttcctacatcatctgcagcaggctcttggaggcctaatgagctggttcctgctgagctcccaccatcttatgaacaagttataaaagaaatcaaccaagttcaagttaatactacaaataataataatgctgctgctactccaaggcacactattacttctgcaactcagactgacttttcagaagaaatagacaacgatctgcctcaaagtaatgcaacactacaggcacctctcaagcctcttcagcctttctcagcagtctcgtctggcaatcttccaacaaatgtggcacctttaatcgtctttgatatttctgaagaaccgaattgtccagaaaaccccagtgctacaagatgtccagtgccaaaaccaagatcaaaaagcaacctcagaccaatacccagagattctcacattaaagagcaaagtcaacagaaaatcagcccagcagccgtaggagaggagtcatccccaggccggccccagtctctgctggacaacgctagcacctcagacagtcaggcagtgatgaacattatgaacacagaacaaagccaaaatagtattgtttccagaattaaagtgtttgagggtcagacaaacatagaaacctcaggactgcccaagaaaccagaaattactccacgttcacttcctccaaagcctactgtttcctcagggaaaccttctgtagctcccaaaccagctgctaacagagcttctggagagtgggactctgggactgagaacagactcaaggtgacctccaaggaaggactcaccccataccctcccctgcaagaagcgggaagcatcccagtaaccaaacctgaattgccaaagaaaccaaaccctggccttatacgaagtgttaatcctgagattccgggaagagggcccctggctgagagctctgatagtgggaagaaagtgccaactcctgccccgcggcctttgctgctgaagaaatctgtttcctcagaaaaccccacctacccttcagctccactgaaacctgtcactgttcctccccgactcgcaggggcatcacaagccaaagcatacaagtcactgggagaagggcccccagccaaccccccagttccagttctgcagagcaagcccttggtggacatcgatctcatcagctttgatgatgatgttttgcccaccccatcggggaacctggctgaagaatctgttggttcagagatggttctagatccctttcagctccctgcaaaaacagaaccaataaaagaacgagcagttcaaccagcacccaccaggaagcccactgtaattcgaattccagccaaaccaggaaaatgtttacatgaggatccacaaagtccacctcctctccctgctgaaaaacctattggaaacactttcagtacagtatctggaaagctcagtaatgttgagagaactagaaacttggaatccaaccacccaggtcaaacaggaggttttgtgcgagtacccccaaggttgccaccgagacctgtgaatggaaaaaccattccaactcaacagcctccaaccaaggtgccccctgagagaccacctcccccaaagctttctgcaaccagaagatctaataagaaactgccttttaatcgatcctcttctgacatggatcttcagaaaaaacaaagtaacttggcaactggactctcaaaagccaagagtcaagtttttaaaaatcaagatccggtgctaccccctcgtcccaaaccaggacaccctctctacagtaaatacatgctgtctgtgcctcatggaattgccaatgaagatattgtctctcaaaaccccggagaactctcttgtaagcgtggggatgtacttgtgatgctgaagcagacggaaaataattacttggagtgccaaaagggagaagacactggcagagttcacctgtctcaaatgaagattatcactccacttgatgaacatcttagaagcagaccaaacgatccaagccacgctcagaagcctgttgacagtggtgctcctcatgctgtcgttcttcatgatttcccagcagagcaagttgatgatttgaacctcacttctggagaaattgtttatcttctggagaagatagatacagattggtacagagggaactgtagaaaccagattggcatatttcctgccaactatgtcaaagtgattattgatatcccagaaggaggaaatgggaaaagagaatgtgtttcatctcattgtgttaaaggctcaagatgtgttgctcggtttgaatatattggagagcagaaggatgagttgagtttctcagagggagaaattattattcttaaagagtatgtgaatgaggaatgggccagaggagaagttcgaggcagaactgggattttccccctgaactttgtggagcctgttgaggattatcccacctctggtgcaaatgttttaagcacaaaggtaccactgaaaaccaaaaaagaagattctggctcaaactctcaggttaacagtcttccggcagaatggtgtgaagctcttcacagttttacagcagagaccagtgatgacttatcattcaagaggggagaccggatccagattctggaacgtctggattctgactggtgcaggggcagactgcaggacagggaggggatcttcccagcagtgtttgtgaggccctgcccagctgaggcaaaaagtatgttggccatagtaccgaaggggaggaaggccaaagccttatatgatttccgaggggagaatgaagatgaactttccttcaaggctggagatataataacagagctggaatctgtagatgatgactggatgagtggagaacttatgggaaaatctggaatatttcccaaaaactacatacagtttctacagatcagctagaggagaagcttgtctgtgttccttggcacaagaactcacttgaactatcaccttgactatcagatatgtttttgcactattttttttaactgaaaaagaaatatctaagctgtacatggtacactagaattttctgaaagcagaaaacgttcagattttgtagttaattttcattacaatagaaacatgcacatggaaacccatgagctaggattctaccgaggaaaacatctagtgggattagcaaggtgaagggaaagcatctggtggcatggcagcatggggaggctcacacacagaagttgcacgtggacatctgttttaatcagcacaagtgaattaaccatgcttcttcatttttttactttagttaaaaaagaggacatttaatattctacatgctgtaactatcaggacatggttagcaatctcaatttcatttttgatattcaaattaattcttacagcttgagcatatcagccttattaccagagcaaatccttccttcagatgggatagtttactgactagttggagcatttgtaagcacatggtgaaatcagcccctgcccaccaaaataatctttatgttaccaagtgattcccatttgtctaaggatttgaagggggtctaaattggatgtatcttagtctaaagaaccaaaaccatccctgaaatgccttgctaatacaactaatccttccatatatgtgccatacttatttttttcctcagtgtatactttatgttaacagggttattacaaagcacattttctgaatctgcaatcattcctttgacaattactggacccaaaggaaaattcattttctttgcattattccagtaatatataaaaactgtgtcttgttatagtagtacattatgaatcacatataaaatcttacaatacagaacaactgttaagatggaaaacagtgccaaacctccacagctcatttctttgtaatataatcagaatgaaaaataatttaagaggacagaagactggtacttttttgttttattttttctctagcttatccctgcacaattattagagtgaatgaaaaaccactttcctgctttccattgttataaattctaagcttaagataaaagtggttctttacatgactgaatcaattacaatttatgggctagagccaaataggttgaagacaatcatccaaacagatcaatggaatagaatttcattggaaatgtaaaacactttcccaacaatggtcatgactttcttctgtttttgagaagagtttcatatgctggaccacattttagcttttattgttttttttttcccattgtccaaaaagttaagcaacaagtggccacacttttacgtgactacaacctggagttctgcaaagaaggtaatatttacttggtctttgactaaagttatctccccattctatggttacattttattttggactatggggacttctaatacgttttggtaaagaagagagtataaagaaaattcttgtcaaatttcactcaaaagtaatttcatgagaaatcaatgatttaaagcattatccaaattaaattatcatttgcagcaaactgtacaacagcaggaaggatatggaatggaacatgaggtatatatctttgcctttataattttaacatcttatattgaagattctgaaaacctatctttattagaggaaaatctcaatcttcagttttggccttctgtcaccagaatgataagtgcaatagttgtaaatctacttgacactgtaataaactgaactgaactttca

SEQ ID NO: 448140 - DNA, 4871 bp, Homo sapiens
cactcatgaatagtacacagcaaaaatgccccgtggaagagcttctcggacttctattcagagtgaacttcatcgagatagaaggcgcccagagatcaccattgtggcagctgagccactgaggccagcctcgtggtttccaggaaccccacccccaggactgggatttcctacatcatctgcagcaggctcttggaggcctaatgagctggttcctgctgagctcccaccatcttatgaacaagttataaaagaaatcaaccaagttcaagttaatactacaaataataataatgctgctgctactccaaggcacactattacttctgcaactcagactgacttttcagaagaaatagacaacgatctgcctcaaagtaatgcaacactacaggcacctctcaagcctcttcagcctttctcagcagtctcgtctggcaatcttccaacaaatgtggcacctttaatcgtctttgatatttctgaagaaccgaattgtccagaaaaccccagtgctacaagatgtccagtgccaaaaccaagatcaaaaagcaacctcagaccaatacccagagattctcacattaaagagcaaagtcaacagaaaatcagcccagcagccgtaggagaggagtcatccccaggccggccccagtctctgctggacaacgctagcacctcagacagtcaggcagtgatgaacattatgaacacagaacaaagccaaaatagtattgtttccagaattaaagtgtttgagggtcagacaaacatagaaacctcaggactgcccaagaaaccagaaattactccacgttcacttcctccaaagcctactgtttcctcagggaaaccttctgtagctcccaaaccagctgctaacagagcttctggagagtgggactctgggactgagaacagactcaaggtgacctccaaggaaggactcaccccataccctcccctgcaagaagcgggaagcatcccagtaaccaaacctgaattgccaaagaaaccaaaccctggccttatacgaagtgttaatcctgagattccgggaagagggcccctggctgagagctctgatagtgggaagaaagtgccaactcctgccccgcggcctttgctgctgaagaaatctgtttcctcagaaaaccccacctacccttcagctccactgaaacctgtcactgttcctccccgactcgcaggggcatcacaagccaaagcatacaagtcactgggagaagggcccccagccaaccccccagttccagttctgcagagcaagcccttggtggacatcgatctcatcagctttgatgatgatgttttgcccaccccatcggggaacctggctgaagaatctgttggttcagagatggttctagatccctttcagctccctgcaaaaacagaaccaataaaagaacgagcagttcaaccagcacccaccaggaagcccactgtaattcgaattccagccaaaccaggaaaatgtttacatgaggatccacaaagtccacctcctctccctgctgaaaaacctattggaaacactttcagtacagtatctggaaagctcagtaatgttgagagaactagaaacttggaatccaaccacccaggtcaaacaggaggttttgtgcgagtacccccaaggttgccaccgagacctgtgaatggaaaaaccattccaactcaacagcctccaaccaaggtgccccctgagagaccacctcccccaaagctttctgcaaccagaagatctaataagaaactgccttttaatcgatcctcttctgacatggatcttcagaaaaaacaaagtaacttggcaactggactctcaaaagccaagagtcaagtttttaaaaatcaagatccggtgctaccccctcgtcccaaaccaggacaccctctctacagtaaatacatgctgtctgtgcctcatggaattgccaatgaagatattgtctctcaaaaccccggagaactctcttgtaagcgtggggatgtacttgtgatgctgaagcagacggaaaataattacttggagtgccaaaagggagaagacactggcagagttcacctgtctcaaatgaagattatcactccacttgatgaacatcttagaagcagaccaaacgatccaagccacgctcagaagcctgttgacagtggtgctcctcatgctgtcgttcttcatgatttcccagcagagcaagttgatgatttgaacctcacttctggagaaattgtttatcttctggagaagatagatacagattggtacagagggaactgtagaaaccagattggcatatttcctgccaactatgtcaaagtgattattgatatcccagaaggaggaaatgggaaaagagaatgtgtttcatctcattgtgttaaaggctcaagatgtgttgctcggtttgaatatattggagagcagaaggatgagttgagtttctcagagggagaaattattattcttaaagagtatgtgaatgaggaatgggccagaggagaagttcgaggcagaactgggattttccccctgaactttgtggagcctgttgaggattatcccacctctggtgcaaatgttttaagcacaaaggtaccactgaaaaccaaaaaagaagattctggctcaaactctcaggttaacagtcttccggcagaatggtgtgaagctcttcacagttttacagcagagaccagtgatgacttatcattcaagaggggagaccggatccagattctggaacgtctggattctgactggtgcaggggcagactgcaggacagggaggggatcttcccagcagtgtttgtgaggccctgcccagctgaggcaaaaagtatgttggccatagtaccgaaggggaggaaggccaaagccttatatgatttccgaggggagaatgaagatgaactttccttcaaggctggagatataataacagagctggaatctgtagatgatgactggatgagtggagaacttatgggaaaatctggaatatttcccaaaaactacatacagtttctacagatcagctagaggagaagcttgtctgtgttccttggcacaagaactcacttgaactatcaccttgactatcagatatgtttttgcactattttttttaactgaaaaagaaatatctaagctgtacatggtacactagaattttctgaaagcagaaaacgttcagattttgtagttaattttcattacaatagaaacatgcacatggaaacccatgagctaggattctaccgaggaaaacatctagtgggattagcaaggtgaagggaaagcatctggtggcatggcagcatggggaggctcacacacagaagttgcacgtggacatctgttttaatcagcacaagtgaattaaccatgcttcttcatttttttactttagttaaaaaagaggacatttaatattctacatgctgtaactatcaggacatggttagcaatctcaatttcatttttgatattcaaattaattcttacagcttgagcatatcagccttattaccagagcaaatccttccttcagatgggatagtttactgactagttggagcatttgtaagcacatggtgaaatcagcccctgcccaccaaaataatctttatgttaccaagtgattcccatttgtctaaggatttgaagggggtctaaattggatgtatcttagtctaaagaaccaaaaccatccctgaaatgccttgctaatacaactaatccttccatatatgtgccatacttatttttttcctcagtgtatactttatgttaacagggttattacaaagcacattttctgaatctgcaatcattcctttgacaattactggacccaaaggaaaattcattttctttgcattattccagtaatatataaaaactgtgtcttgttatagtagtacattatgaatcacatataaaatcttacaatacagaacaactgttaagatggaaaacagtgccaaacctccacagctcatttctttgtaatataatcagaatgaaaaataatttaagaggacagaagactggtacttttttgttttattttttctctagcttatccctgcacaattattagagtgaatgaaaaaccactttcctgctttccattgttataaattctaagcttaagataaaagtggttctttacatgactgaatcaattacaatttatgggctagagccaaataggttgaagacaatcatccaaacagatcaatggaatagaatttcattggaaatgtaaaacactttcccaacaatggtcatgactttcttctgtttttgagaagagtttcatatgctggaccacattttagcttttattgttttttttttcccattgtccaaaaagttaagcaacaagtggccacacttttacgtgactacaacctggagttctgcaaagaaggtaatatttacttggtctttgactaaagttatctccccattctatggttacattttattttggactatggggacttctaatacgttttggtaaagaagagagtataaagaaaattcttgtcaaatttcactcaaaagtaatttcatgagaaatcaatgatttaaagcattatccaaattaaattatcatttgcagcaaactgtacaacagcaggaaggatatggaatggaacatgaggtatatatctttgcctttataattttaacatcttatattgaagattctgaaaacctatctttattagaggaaaatctcaatcttcagttttggccttctgtcaccagaatgataagtgcaatagttgtaaatctacttgacactgtaataaactgaactgaactttca

SEQ ID NO: 448141 - DNA, 5667 bp, Homo sapiens
gaagagagcgggagtgggagtgggaaaggccaggattaagaggccgccgggacgccgcaaggaggcggggaatcggctcggcccgcgccctgccgctgcccggccggctgcaggtggagttcgcggaggtggccatttccacagccgccgccgacgcctcctctccgggagccgccttccccccggcccgagggcggtggcgtggggcgccgggtgcaggcgttctggggcgccggggccgcagctcgctggccatcccgcggctgcgccccgcgcctcgcccatggctgagggccggcggcgggaggacgaggaggaagagctacgcgagcgccgcgaacttggtggccagcgccgcgcccggggccgtgcgctctcgggccactcggccgcagatcgcaacgaacgaaataaaccagaacatcgttcttcaagccaaggacccttgtcatccattagagcggtaatcaagagatcttctcggacttctattcagagtgaacttcatcgagatagaaggcgcccagagatcaccattgtggcagctgagccactgaggccagcctcgtggtttccaggaaccccacccccaggactgggatttcctacatcatctgcagcaggctcttggaggcctaatgagctggttcctgctgagctcccaccatcttatgaacaagttataaaagaaatcaaccaagttcaagttaatactacaaataataataatgctgctgctactccaaggcacactattacttctgcaactcagactgacttttcagaagaaatagacaacgatctgcctcaaagtaatgcaacactacaggcacctctcaagcctcttcagcctttctcagcagtctcgtctggcaatcttccaacaaatgtggcacctttaatcgtctttgatatttctgaagaaccgaattgtccagaaaaccccagtgctacaagatgtccagtgccaaaaccaagatcaaaaagcaacctcagaccaatacccagagattctcacattaaagagcaaagtcaacagaaaatcagcccagcagccgtaggagaggagtcatccccaggccggccccagtctctgctggacaacgctagcacctcagacagtcaggcagtgatgaacattatgaacacagaacaaagccaaaatagtattgtttccagaattaaagtgtttgagggtcagacaaacatagaaacctcaggactgcccaagaaaccagaaattactccacgttcacttcctccaaagcctactgtttcctcagggaaaccttctgtagctcccaaaccagctgctaacagagcttctggagagtgggactctgggactgagaacagactcaaggtgacctccaaggaaggactcaccccataccctcccctgcaagaagcgggaagcatcccagtaaccaaacctgaattgccaaagaaaccaaaccctggccttatacgaagtgttaatcctgagattccgggaagagggcccctggctgagagctctgatagtgggaagaaagtgccaactcctgccccgcggcctttgctgctgaagaaatctgtttcctcagaaaaccccacctacccttcagctccactgaaacctgtcactgttcctccccgactcgcaggggcatcacaagccaaagcatacaagtcactgggagaagggcccccagccaaccccccagttccagttctgcagagcaagcccttggtggacatcgatctcatcagctttgatgatgatgttttgcccaccccatcggggaacctggctgaagaatctgttggttcagagatggttctaggtttacatgaggatccacaaagtccacctcctctccctgctgaaaaacctattggaaacactttcagtacagtatctggaaagctcagtaatgttgagagaactagaaacttggaatccaaccacccaggtcaaacaggaggttttgtgcgagtacccccaaggttgccaccgagacctgtgaatggaaaaaccattccaactcaacagcctccaaccaaggtgccccctgagagaccacctcccccaaagctttctgcaaccagaagatctaataagaaactgccttttaatcgatcctcttctgacatggatcttcagaaaaaacaaagtaacttggcaactggactctcaaaagccaagagtcaagtttttaaaaatcaagatccggtgctaccccctcgtcccaaaccaggacaccctctctacagtaaatacatgcgtggggatgtacttgtgatgctgaagcagacggaaaataattacttggagtgccaaaagggagaagacactggcagagttcacctgtctcaaatgaagattatcactccacttgatgaacatcttagaagcagaccaaacgatccaagccacgctcagaagcctgttgacagtggtgctcctcatgctgtcgttcttcatgatttcccagcagagcaagttgatgatttgaacctcacttctggagaaattgtttatcttctggagaagatagatacagattggtacagagggaactgtagaaaccagattggcatatttcctgccaactatgtcaaagtgattattgatatcccagaaggaggaaatgggaaaagagaatgtgtttcatctcattgtgttaaaggctcaagatgtgttgctcggtttgaatatattggagagcagaaggatgagttgagtttctcagagggagaaattattattcttaaagagtatgtgaatgaggaatgggccagaggagaagttcgaggcagaactgggattttccccctgaactttgtggagcctgttgaggattatcccacctctggtgcaaatgttttaagcacaaaggtaccactgaaaaccaaaaaagaagattctggctcaaactctcaggttaacagtcttccggcagaatggtgtgaagctcttcacagttttacagcagagaccagtgatgacttatcattcaagaggggagaccggatccagattctggaacgtctggattctgactggtgcaggggcagactgcaggacagggaggggatcttcccagcagtgtttgtgaggccctgcccagctgaggcaaaaagtatgttggccatagtaccgaaggggaggaaggccaaagccttatatgatttccgaggggagaatgaagatgaactttccttcaaggctggagatataataacagagctggaatctgtagatgatgactggatgagtggagaacttatgggaaaatctggaatatttcccaaaaactacatacagtttctacagatcagctagaggagaagcttgtctgtgttccttggcacaagaactcacttgaactatcaccttgactatcagatatgtttttgcactattttttttaactgaaaaagaaatatctaagctgtacatggtacactagaattttctgaaagcagaaaacgttcagattttgtagttaattttcattacaatagaaacatgcacatggaaacccatgagctaggattctaccgaggaaaacatctagtgggattagcaaggtgaagggaaagcatctggtggcatggcagcatggggaggctcacacacagaagttgcacgtggacatctgttttaatcagcacaagtgaattaaccatgcttcttcatttttttactttagttaaaaaagaggacatttaatattctacatgctgtaactatcaggacatggttagcaatctcaatttcatttttgatattcaaattaattcttacagcttgagcatatcagccttattaccagagcaaatccttccttcagatgggatagtttactgactagttggagcatttgtaagcacatggtgaaatcagcccctgcccaccaaaataatctttatgttaccaagtgattcccatttgtctaaggatttgaagggggtctaaattggatgtatcttagtctaaagaaccaaaaccatccctgaaatgccttgctaatacaactaatccttccatatatgtgccatacttatttttttcctcagtgtatactttatgttaacagggttattacaaagcacattttctgaatctgcaatcattcctttgacaattactggacccaaaggaaaattcattttctttgcattattccagtaatatataaaaactgtgtcttgttatagtagtacattatgaatcacatataaaatcttacaatacagaacaactgttaagatggaaaacagtgccaaacctccacagctcatttctttgtaatataatcagaatgaaaaataatttaagaggacagaagactggtacttttttgttttattttttctctagcttatccctgcacaattattagagtgaatgaaaaaccactttcctgctttccattgttataaattctaagcttaagataaaagtggttctttacatgactgaatcaattacaatttatgggctagagccaaataggttgaagacaatcatccaaacagatcaatggaatagaatttcattggaaatgtaaaacactttcccaacaatggtcatgactttcttctgtttttgagaagagtttcatatgctggaccacattttagcttttattgttttttttttcccattgtccaaaaagttaagcaacaagtggccacacttttacgtgactacaacctggagttctgcaaagaaggtaatatttacttggtctttgactaaagttatctccccattctatggttacattttattttggactatggggacttctaatacgttttggtaaagaagagagtataaagaaaattcttgtcaaatttcactcaaaagtaatttcatgagaaatcaatgatttaaagcattatccaaattaaattatcatttgcagcaaactgtacaacagcaggaaggatatggaatggaacatgaggtatatatctttgcctttataattttaacatcttatattgaagattctgaaaacctatctttattagaggaaaatctcaatcttcagttttggccttctgtcaccagaatgataagtgcaatagttgtaaatctacttgacactgtaataaactgaactgaactttcaaagtccctttctcatactagactgagttttttgagaatggaggtggtatcttttttttttttttttttgagacaggatttaattccctttgaccaggctggagtgcaatgcaatgttggctcactgcagcctctgcctcctgggctcaagtgattctcctgccacagcctcctgagtagctgggactacaggcgcacaccaccgtgcccagctaatttctggtatttttttttctttttgtagagacagggtttcgccatgttgcccaggctggtttcaaacacctgggctcaagcagtctgcctgcctcagcctcccaaagtgctggtattactgcacctggcctgtggtaccttatttatctttgtatctctagtcctttgcaccattcagcctcaataaaggttggttggtgggttgggtgagttggttggttggaatggatggatggatggatgaatgactttcacatacagcaataccatcttggattcactcaatatctttcctctttaatttttgacataaatctatacta

SEQ ID NO: 448142 - DNA, 5124 bp, Homo sapiens
  misc_feature (4708)..(4708): n is a, c, g, or t
  misc_feature (4713)..(4713): n is a, c, g, or t
  misc_feature (4733)..(4733): n is a, c, g, or t
  misc_feature (4735)..(4735): n is a, c, g, or t
  misc_feature (4746)..(4746): n is a, c, g, or t
  misc_feature (4749)..(4749): n is a, c, g, or t
  misc_feature (4751)..(4751): n is a, c, g, or t
  misc_feature (4754)..(4754): n is a, c, g, or t
  misc_feature (4756)..(4756): n is a, c, g, or t
  misc_feature (4766)..(4766): n is a, c, g, or t
  misc_feature (4778)..(4778): n is a, c, g, or t
  misc_feature (4784)..(4784): n is a, c, g, or t
  misc_feature (4794)..(4794): n is a, c, g, or t
  misc_feature (4796)..(4796): n is a, c, g, or t
  misc_feature (4799)..(4800): n is a, c, g, or t
  misc_feature (4804)..(4804): n is a, c, g, or t
  misc_feature (4809)..(4809): n is a, c, g, or t
  misc_feature (4812)..(4812): n is a, c, g, or t
  misc_feature (4820)..(4820): n is a, c, g, or t
  misc_feature (4826)..(4826): n is a, c, g, or t
  misc_feature (4829)..(4829): n is a, c, g, or t
  misc_feature (4840)..(4840): n is a, c, g, or t
  misc_feature (4847)..(4847): n is a, c, g, or t
  misc_feature (4853)..(4853): n is a, c, g, or t
  misc_feature (4868)..(4868): n is a, c, g, or t
  misc_feature (4874)..(4874): n is a, c, g, or t
  misc_feature (4890)..(4890): n is a, c, g, or t
  misc_feature (4892)..(4892): n is a, c, g, or t
  misc_feature (4896)..(4896): n is a, c, g, or t
  misc_feature (4898)..(4899): n is a, c, g, or t
  misc_feature (4904)..(4904): n is a, c, g, or t
gaagagagcgggagtgggagtgggaaaggccaggattaagaggccgccgggacgccgcaaggaggcggggaatcggctcggcccgcgccctgccgctgcccggccggctgcaggtggagttcgcggaggtggccatttccacagccgccgccgacgcctcctctccgggagccgccttccccccggcccgagggcggtggcgtggggcgccgggtgcaggcgttctggggcgccggggccgcagctcgctggccatcccgcggctgcgccccgcgcctcgcccatggctgagggccggcggcgggaggacgaggaggaagagctacgcgagcgccgcgaacttggtggccagcgccgcgcccggggccgtgcgctctcgggccactcggccgcagatcgcaacgaacgaaataaaccagaacatcgttcttcaagccaaggacccttgtcatccattagagcggtaatcaagagatcttctcggacttctattcagagtgaacttcatcgagatagaaggcgcccagagatcaccattgtggcagctgagccactgaggccagcctcgtggtttccaggaaccccacccccaggactgggatttcctacatcatctgcagcaggctcttggaggcctaatgagctggttcctgctgagctcccaccatcttatgaacaagttataaaagaaatcaaccaagttcaagttaatactacaaataataataatgctgctgctactccaaggcacactattacttctgcaactcagactgacttttcagaagaaatagacaacgatctgcctcaaagtaatgcaacactacaggcacctctcaagcctcttcagcctttctcagcagtctcgtctggcaatcttccaacaaatgtggcacctttaatcgtctttgatatttctgaagaaccgaattgtccagaaaaccccagtgctacaagatgtccagtgccaaaaccaagatcaaaaagcaacctcagaccaatacccagagattctcacattaaagagcaaagtcaacagaaaatcagcccagcagccgtaggagaggagtcatccccaggccggccccagtctctgctggacaacgctagcacctcagacagtcaggcagtgatgaacattatgaacacagaacaaagccaaaatagtattgtttccagaattaaagtgtttgagggtcagacaaacatagaaacctcaggactgcccaagaaaccagaaattactccacgttcacttcctccaaagcctactgtttcctcagggaaaccttctgtagctcccaaaccagctgctaacagagcttctggagagtgggactctgggactgagaacagactcaaggtgacctccaaggaaggactcaccccataccctcccctgcaagaagcgggaagcatcccagtaaccaaacctgaattgccaaagaaaccaaaccctggccttatacgaagtgttaatcctgagattccgggaagagggcccctggctgagagctctgatagtgggaagaaagtgccaactcctgccccgcggcctttgctgctgaagaaatctgtttcctcagaaaaccccacctacccttcagctccactgaaacctgtcactgttcctccccgactcgcaggggcatcacaagccaaagcatacaagtcactgggagaagggcccccagccaaccccccagttccagttctgcagagcaagcccttggtggacatcgatctcatcagctttgatgatgatgttttgcccaccccatcggggaacctggctgaagaatctgttggttcagagatggttctaggtttacatgaggatccacaaagtccacctcctctccctgctgaaaaacctattggaaacactttcagtacagtatctggaaagctcagtaatgttgagagaactagaaacttggaatccaaccacccaggtcaaacaggaggttttgtgcgagtacccccaaggttgccaccgagacctgtgaatggaaaaaccattccaactcaacagcctccaaccaaggtgccccctgagagaccacctcccccaaagctttctgcaaccagaagatctaataagaaactgccttttaatcgatcctcttctgacatggatcttcagaaaaaacaaagtaacttggcaactggactctcaaaagccaagagtcaagtttttaaaaatcaagatccggtgctaccccctcgtcccaaaccaggacaccctctctacagtaaatacatgcgtggggatgtacttgtgatgctgaagcagacggaaaataattacttggagtgccaaaagggagaagacactggcagagttcacctgtctcaaatgaagattatcactccacttgatgaacatcttagaagcagaccaaacgatccaagccacgctcagaagcctgttgacagtggtgctcctcatgctgtcgttcttcatgatttcccagcagagcaagttgatgatttgaacctcacttctggagaaattgtttatcttctggagaagatagatacagattggtacagagggaactgtagaaaccagattggcatatttcctgccaactatgtcaaagtgattattgatatcccagaaggaggaaatgggaaaagagaatgtgtttcatctcattgtgttaaaggctcaagatgtgttgctcggtttgaatatattggagagcagaaggatgagttgagtttctcagagggagaaattattattcttaaagagtatgtgaatgaggaatgggccagaggagaagttcgaggcagaactgggattttccccctgaactttgtggagcctgttgaggattatcccacctctggtgcaaatgttttaagcacaaaggtaccactgaaaaccaaaaaagaagattctggctcaaactctcaggttaacagtcttccggcagaatggtgtgaagctcttcacagttttacagcagagaccagtgatgacttatcattcaagaggggagaccggatccagattctggaacgtctggattctgactggtgcaggggcagactgcaggacagggaggggatcttcccagcagtgtttgtgaggccctgcccagctgaggcaaaaagtatgttggccatagtaccgaaggggaggaaggccaaagccttatatgatttccgaggggagaatgaagatgaactttccttcaaggctggagatataataacagagctggaatctgtagatgatgactggatgagtggagaacttatgggaaaatctggaatatttcccaaaaactacatacagtttctacagatcagctagaggagaagcttgtctgtgttccttggcacaagaactcacttgaactatcaccttgactatcagatatgtttttgcactattttttttaactgaaaaagaaatatctaagctgtacatggtacactagaattttctgaaagcagaaaacgttcagattttgtagttaattttcattacaatagaaacatgcacatggaaacccatgagctaggattctaccgaggaaaacatctagtgggattagcaaggtgaagggaaagcatctggtggcatggcagcatggggaggctcacacacagaagttgcacgtggacatctgttttaatcagcacaagtgaattaaccatgcttcttcatttttttactttagttaaaaaagaggacatttaatattctacatgctgtaactatcaggacatggttagcaatctcaatttcatttttgatattcaaattaattcttacagcttgagcatatcagccttattaccagagcaaatccttccttcagatgggatagtttactgactagttggagcatttgtaagcacatggtgaaatcagcccctgcccaccaaaataatctttatgttaccaagtgattcccatttgtctaaggatttgaagggggtctaaattggatgtatcttagtctaaagaaccaaaaccatccctgaaatgccttgctaatacaactaatccttccatatatgtgccatacttatttttttcctcagtgtatactttatgttaacagggttattacaaagcacattttctgaatctgcaatcattcctttgacaattactggacccaaaggaaaattcattttctttgcattattccagtaatatataaaaactgtgtcttgttatagtagtacattatgaatcacatataaaatcttacaatacagaacaactgttaagatggaaaacagtgccaaacctccacagctcatttctttgtaatataatcagaatgaaaaataatttaagaggacagaagactggtacttttttgttttattttttctctagcttatccctgcacaattattagagtgaatgaaaaaccactttcctgctttccattgttataaattctaagcttaagataaaagtggttctttacatgactgaatcaattacaatttatgggctagagccaaataggttgaagacaatcatccaaacagatcaatggaatagaatttcattggaaatgtaaaacactttcccaacaatggtcatgactttcttctgtttttgagaagagtttcatatgctggaccacaaaaaaaaaaaaaaaaaaaaaaaaaaaaaaaaaaaaaaaaaaaaaaaaaaaaaaaaaaaaaaaaaaaaaaaaaaaaccttgtngcccncttggcccaagcgattttanantgggcaggttnatncntgngnccgaatttgngctaattggccnaattcnccttatgggngncgnnttanaatcnatngcccgcgntttaanaangtcggactggnaaaaccntggggntacccaattaaatcncttggnagaaaatccccttttncnagtngnngaatnagcaaaaggccccgaccgatcggcctttccaaaaattggccaaccctaatgggcaaaggaaaattgaaggggtaaaaattttgtaaaaatcgcggtaaaattttggttaaacagctcattttttaacccaaaggcccaaattcggaaaaacccttttaattctaaagaatttacccggaaaaggttgagggttgtccatttggaacaagagcccctttta

SEQ ID NO: 448143 - DNA, 4102 bp, Homo sapiens
gaagagagcgggagtgggagtgggaaaggccaggattaagaggccgccgggacgccgcaaggaggcggggaatcggctcggcccgcgccctgccgctgcccggccggctgcaggtggagttcgcggaggtggccatttccacagccgccgccgacgcctcctctccgggagccgccttccccccggcccgagggcggtggcgtggggcgccgggtgcaggcgttctggggcgccggggccgcagctcgctggccatcccgcggctgcgccccgcgcctcgcccatggctgagggccggcggcgggaggacgaggaggaagagctacgcgagcgccgcgaacttggtggccagcgccgcgcccggggccgtgcgctctcgggccactcggccgcagatcgcaacgaacgaaataaaccagaacatcgttcttcaagccaaggacccttgtcatccattagagcggtaatcaagagatcttctcggacttctattcagagtgaacttcatcgagatagaaggcgcccagagatcaccattgtggcagctgagccactgaggccagcctcgtggtttccaggaaccccacccccaggactgggatttcctacatcatctgcagcaggctcttggaggcctaatgagctggttcctgctgagctcccaccatcttatgaacaagttataaaagaaatcaaccaagttcaagttaatactacaaataataataatgctgctgctactccaaggcacactattacttctgcaactcagactgacttttcagaagaaatagacaacgatctgcctcaaagtaatgcaacactacaggcacctctcaagcctcttcagcctttctcagcagtctcgtctggcaatcttccaacaaatgtggcacctttaatcgtctttgatatttctgaagaaccgaattgtccagaaaaccccagtgctacaagatgtccagtgccaaaaccaagatcaaaaagcaacctcagaccaatacccagagattctcacattaaagagcaaagtcaacagaaaatcagcccagcagccgtaggagaggagtcatccccaggccggccccagtctctgctggacaacgctagcacctcagacagtcaggcagtgatgaacattatgaacacagaacaaagccaaaatagtattgtttccagaattaaagtgtttgagggtcagacaaacatagaaacctcaggactgcccaagaaaccagaaattactccacgttcacttcctccaaagcctactgtttcctcagggaaaccttctgtagctcccaaaccagctgctaacagagcttctggagagtgggactctgggactgagaacagactcaaggtgacctccaaggaaggactcaccccataccctcccctgcaagaagcgggaagcatcccagtaaccaaacctgaattgccaaagaaaccaaaccctggccttatacgaagtgttaatcctgagattccgggaagagggcccctggctgagagctctgatagtgggaagaaagtgccaactcctgccccgcggcctttgctgctgaagaaatctgtttcctcagaaaaccccacctacccttcagctccactgaaacctgtcactgttcctccccgactcgcaggggcatcacaagccaaagcatacaagtcactgggagaagggcccccagccaaccccccagttccagttctgcagagcaagcccttggtggacatcgatctcatcagctttgatgatgatgttttgcccaccccatcggggaacctggctgaagaatctgttggttcagagatggttctaggtttacatgaggatccacaaagtccacctcctctccctgctgaaaaacctattggaaacactttcagtacagtatctggaaagctcagtaatgttgagagaactagaaacttggaatccaaccacccaggtcaaacaggaggttttgtgcgagtacccccaaggttgccaccgagacctgtgaatggaaaaaccattccaactcaacagcctccaaccaaggtgccccctgagagaccacctcccccaaagctttctgcaaccagaagatctaataagaaactgccttttaatcgatcctcttctgacatggatcttcagaaaaaacaaagtaacttggcaactggactctcaaaagccaagagtcaagtttttaaaaatcaagatccggtgctaccccctcgtcccaaaccaggacaccctctctacagtaaatacatgcgtggggatgtacttgtgatgctgaagcagacggaaaataattacttggagtgccaaaagggagaagacactggcagagttcacctgtctcaaatgaagattatcactccacttgatgaacatcttagaagcagaccaaacgatccaagccacgctcagaagcctgttgacagtggtgctcctcatgctgtcgttcttcatgatttcccagcagagcaagttgatgatttgaacctcacttctggagaaattgtttatcttctggagaagatagatacagattggtacagagggaactgtagaaaccagattggcatatttcctgccaactatgtcaaagtgattattgatatcccagaaggaggaaatgggaaaagagaatgtgtttcatctcattgtgttaaaggctcaagatgtgttgctcggtttgaatatattggagagcagaaggatgagttgagtttctcagagggagaaattattattcttaaagagtatgtgaatgaggaatgggccagaggagaagttcgaggcagaactgggattttccccctgaactttgtggagcctgttgaggattatcccacctctggtgcaaatgttttaagcacaaaggtaccactgaaaaccaaaaaagaagattctggctcaaactctcaggttaacagtcttccggcagaatggtgtgaagctcttcacagttttacagcagagaccagtgatgacttatcattcaagaggggagaccggatccagattctggaacgtctggattctgactggtgcaggggcagactgcaggacagggaggggatcttcccagcagtgtttgtgaggccctgcccagctgaggcaaaaagtatgttggccatagtaccgaaggggaggaaggccaaagccttatatgatttccgaggggagaatgaagatgaactttccttcaaggctggagatataataacagagctggaatctgtagatgatgactggatgagtggagaacttatgggaaaatctggaatatttcccaaaaactacatacagtttctacagatcagctagaggagaagcttgtctgtgttccttggcacaagaactcacttgaactatcaccttgactatcagatatgtttttgcactattttttttaactgaaaaagaaatatctaagctgtacatggtacactagaattttctgaaagcagaaaacgttcagattttgtagttaattttcattacaatagaaacatgcacatggaaacccatgagctaggattctaccgaggaaaacatctagtgggattagcaaggtgaagggaaagcatctggtggcatggcagcatggggaggctcacacacagaagttgcacgtggacatctgttttaatcagcacaagtgaattaaccatgcttcttcatttttttactttagttaaaaaagaggacatttaatattctacatgctgtaactatcaggacatggttagcaatctcaatttcatttttgatattcaaattaattcttacagcttgagcatatcagccttattaccagagcaaatccttccttcagatgggatagtttactgactagttggagcatttgtaagcacatggtgaaatcagcccctgcccaccaaaataatctttatgttaccaagtgattcccatttgtctaaggatttgaagggggtctaaattggatgtatcttagtctaaagaaccaaaaccatccctgaaatgccattcttgctgggtatcgccatttccatggccctcctccctctccagtgtccccccacatcaataaaagcttccccctgatatgccattctt

SEQ ID NO: 448144 - DNA, 3507 bp, Homo sapiens
gaagagagcgggagtgggagtgggaaaggccaggattaagaggccgccgggacgccgcaaggaggcggggaatcggctcggcccgcgccctgccgctgcccggccggctgcaggtggagttcgcggaggtggccatttccacagccgccgccgacgcctcctctccgggagccgccttccccccggcccgagggcggtggcgtggggcgccgggtgcaggcgttctggggcgccggggccgcagctcgctggccatcccgcggctgcgccccgcgcctcgcccatggctgagggccggcggcgggaggacgaggaggaagagctacgcgagcgccgcgaacttggtggccagcgccgcgcccggggccgtgcgctctcgggccactcggccgcagatcgcaacgaacgaaataaaccagaacatcgttcttcaagccaaggacccttgtcatccattagagcggtaatcaagagatcttctcggacttctattcagagtgaacttcatcgagatagaaggcgcccagagatcaccattgtggcagctgagccactgaggccagcctcgtggtttccaggaaccccacccccaggactgggatttcctacatcatctgcagcaggctcttggaggcctaatgagctggttcctgctgagctcccaccatcttatgaacaagttataaaagaaatcaaccaagttcaagttaatactacaaataataataatgctgctgctactccaaggcacactattacttctgcaactcagactgacttttcagaagaaatagacaacgatctgcctcaaagtaatgcaacactacaggcacctctcaagcctcttcagcctttctcagcagtctcgtctggcaatcttccaacaaatgtggcacctttaatcgtctttgatatttctgaagaaccgaattgtccagaaaaccccagtgctacaagatgtccagtgccaaaaccaagatcaaaaagcaacctcagaccaatacccagagattctcacattaaagagcaaagtcaacagaaaatcagcccagcagccgtaggagaggagtcatccccaggccggccccagtctctgctggacaacgctagcacctcagacagtcaggcagtgatgaacattatgaacacagaacaaagccaaaatagtattgtttccagaattaaagtgtttgagggtcagacaaacatagaaacctcaggactgcccaagaaaccagaaattactccacgttcacttcctccaaagcctactgtttcctcagggaaaccttctgtagctcccaaaccagctgctaacagagcttctggagagtgggactctgggactgagaacagactcaaggtgacctccaaggaaggactcaccccataccctcccctgcaagaagcgggaagcatcccagtaaccaaacctgaattgccaaagaaaccaaaccctggccttatacgaagtgttaatcctgagattccgggaagagggcccctggctgagagctctgatagtgggaagaaagtgccaactcctgccccgcggcctttgctgctgaagaaatctgtttcctcagaaaaccccacctacccttcagctccactgaaacctgtcactgttcctccccgactcgcaggggcatcacaagccaaagcatacaagtcactgggagaagggcccccagccaaccccccagttccagttctgcagagcaagcccttggtggacatcgatctcatcagctttgatgatgatgttttgcccaccccatcggggaacctggctgaagaatctgttggttcagagatggttctaggtttacatgaggatccacaaagtccacctcctctccctgctgaaaaacctattggaaacactttcagtacagtatctggaaagctcagtaatgttgagagaactagaaacttggaatccaaccacccaggtcaaacaggaggttttgtgcgagtacccccaaggttgccaccgagacctgtgaatggaaaaaccattccaactcaacagcctccaaccaaggtgccccctgagagaccacctcccccaaagctttctgcaaccagaagatctaataagaaactgccttttaatcgatcctcttctgacatggatcttcagaaaaaacaaagtaacttggcaactggactctcaaaagccaagagtcaagtttttaaaaatcaagatccggtgctaccccctcgtcccaaaccaggacaccctctctacagtaaatacatgcgtggggatgtacttgtgatgctgaagcagacggaaaataattacttggagtgccaaaagggagaagacactggcagagttcacctgtctcaaatgaagattatcactccacttgatgaacatcttagaagcagaccaaacgatccaagccacgctcagaagcctgttgacagtggtgctcctcatgctgtcgttcttcatgatttcccagcagagcaagttgatgatttgaacctcacttctggagaaattgtttatcttctggagaagatagatacagattggtacagagggaactgtagaaaccagattggcatatttcctgccaactatgtcaaagtgattattgatatcccagaaggaggaaatgggaaaagagaatgtgtttcatctcattgtgttaaaggctcaagatgtgttgctcggtttgaatatattggagagcagaaggatgagttgagtttctcagagggagaaattattattcttaaagagtatgtgaatgaggaatgggccagaggagaagttcgaggcagaactgggattttccccctgaactttgtggagcctgttgaggattatcccacctctggtgcaaatgttttaagcacaaaggtaccactgaaaaccaaaaaagaagattctggctcaaactctcaggttaacagtcttccggcagaatggtgtgaagctcttcacagttttacagcagagaccagtgatgacttatcattcaagaggggagaccggatccagattctggaacgtctggattctgactggtgcaggggcagactgcaggacagggaggggatcttcccagcagtgtttgtgaggccctgcccagctgaggcaaaaagtatgttggccatagtaccgaaggggaggaaggccaaagccttatatgatttccgaggggagaatgaagatgaactttccttcaagatgagaaaaaggccgagcaacagtggctcacacctctaatcccaacacttttgggaagtcaaggcaggaggatcgcttgaggccaggagtttaaaaccagcctggtcaacatggcaagaccccatctcaacaaagaaaaagaggaaaacaaggcaatacctgaatcaggtatgtgcagcctttgtcggggtaaggggggatgccttgactgaaatatgtcaccataaagttgctaacttcctattttgtgatggggttttactttattctgaataataaaatgttatttcatcttt

SEQ ID NO: 448145 - DNA, 3123 bp, Homo sapiens
gaagagagcgggagtgggagtgggaaaggccaggattaagaggccgccgggacgccgcaaggaggcggggaatcggctcggcccgcgccctgccgctgcccggccggctgcaggtggagttcgcggaggtggccatttccacagccgccgccgacgcctcctctccgggagccgccttccccccggcccgagggcggtggcgtggggcgccgggtgcaggcgttctggggcgccggggccgcagctcgctggccatcccgcggctgcgccccgcgcctcgcccatggctgagggccggcggcgggaggacgaggaggaagagctacgcgagcgccgcgaacttggtggccagcgccgcgcccggggccgtgcgctctcgggccactcggccgcagatcgcaacgaacgaaataaaccagaacatcgttcttcaagccaaggacccttgtcatccattagagcggtaatcaagagatcttctcggacttctattcagagtgaacttcatcgagatagaaggcgcccagagatcaccattgtggcagctgagccactgaggccagcctcgtggtttccaggaaccccacccccaggactgggatttcctacatcatctgcagcaggctcttggaggcctaatgagctggttcctgctgagctcccaccatcttatgaacaagttataaaagaaatcaaccaagttcaagttaatactacaaataataataatgctgctgctactccaaggcacactattacttctgcaactcagactgacttttcagaagaaatagacaacgatctgcctcaaagtaatgcaacactacaggcacctctcaagcctcttcagcctttctcagcagtctcgtctggcaatcttccaacaaatgtggcacctttaatcgtctttgatatttctgaagaaccgaattgtccagaaaaccccagtgctacaagatgtccagtgccaaaaccaagatcaaaaagcaacctcagaccaatacccagagattctcacattaaagagcaaagtcaacagaaaatcagcccagcagccgtaggagaggagtcatccccaggccggccccagtctctgctggacaacgctagcacctcagacagtcaggcagtgatgaacattatgaacacagaacaaagccaaaatagtattgtttccagaattaaagtgtttgagggtcagacaaacatagaaacctcaggactgcccaagaaaccagaaattactccacgttcacttcctccaaagcctactgtttcctcagggaaaccttctgtagctcccaaaccagctgctaacagagcttctggagagtgggactctgggactgagaacagactcaaggtgacctccaaggaaggactcaccccataccctcccctgcaagaagcgggaagcatcccagtaaccaaacctgaattgccaaagaaaccaaaccctggccttatacgaagtgttaatcctgagattccgggaagagggcccctggctgagagctctgatagtgggaagaaagtgccaactcctgccccgcggcctttgctgctgaagaaatctgtttcctcagaaaaccccacctacccttcagctccactgaaacctgtcactgttcctccccgactcgcaggggcatcacaagccaaagcatacaagtcactgggagaagggcccccagccaaccccccagttccagttctgcagagcaagcccttggtggacatcgatctcatcagctttgatgatgatgttttgcccaccccatcggggaacctggctgaagaatctgttggttcagagatggttctagatccctttcagctccctgcaaaaacagaaccaataaaagaacgagcagttcaaccagcacccaccaggaagcccactgtaattcgaattccagccaaaccaggaaaatgtttacatgaggatccacaaagtccacctcctctccctgctgaaaaacctattggaaacactttcagtacagtatctggaaagctcagtaatgttgagagaactagaaacttggaatccaaccacccaggtcaaacaggaggttttgtgcgagtacccccaaggttgccaccgagacctgtgaatggaaaaaccattccaactcaacagcctccaaccaaggtgccccctgagagaccacctcccccaaagctttctgcaaccagaagatctaataagaaactgccttttaatcgatcctcttctgacatggatcttcagaaaaaacaaagtaacttggcaactggactctcaaaagccaagagtcaagtttttaaaaatcaagatccggtgctaccccctcgtcccaaaccaggacaccctctctacagtaaatacatgctgtctgtgcctcatggaattgccaatgaagatattgtctctcaaaaccccggagaactctcttgtaagcgtggggatgtacttgtgatgctgaagcagacggaaaataattacttggagtgccaaaagggagaagacactggcagagttcacctgtctcaaatgaagattatcactccacttgatgaacatcttagaagcagaccaaaccccttttctccccctaaggatccaagccacgctcagaagcctgttgacagtggtgctcctcatgctgtcgttcttcatgatttcccagcaggtaaggatgtaaataatgcagtgggagaaccacaggatccaggagtaagtctttttccctgccgggggttagcctctcaaggacatccttcttcatttttctgtgcctatagagtccgagactggagaggtcatcttatccaggactccacttcaagaagggttgattgtaccagccattccagaaagcttagttgtatacccttgcctttgaagctccctgagaaagagaaagagagagagagagactttcccttacaaatgaacattgcaaattgcctaccagtcacaaactttttaactctttcaaaatagtgggtactaggccgggcgcagtggctcacgcctgtaatcccagcactttgggaggccgaggcaggcggatcacgaggtcaggagattgagaccatcctggctaacatggtgaaaccccgtctctactaaaaata

SEQ ID NO: 448146 - DNA, 790 bp, Homo sapiens
ccacgcgtcgcggactgcgtgggtcgacccacgcgtccgggtggcggaactgctgctccggcggctggaggcgtctgatggcggcctggacagcgccgagttggcggctgagctgggcatggagcaccaggcggtggtgggcgccgtgaagagccttcaggcgctgggcgaggtcatcgaggctgaacttcggtccaccaagcactgggagcttactgcggagggcgaggagattgcccgggagggcagccatgaggcccgtgtgtttcgaagcattcccccagagggcctggcccagagcgagcttatgcgactgcccagtggcaaagtgggcttcagcaaggccatgtccaacaagtggattcgggtggacaagagtgcggctgacgggccccgggtgttccgagtggtggacagcatggaggatgaggtgcagcggcggctccagctggtccgggggggacaggctgagaagctgggggagaaggagaggagcgagctgaggaagaggaagctgttggctgaagtgactctgaagacctactgggtgagcaaaggcagtgcctttagtaccagcatctccaagcaagagacagagctgagcccagagatgatctccagtggctcttggcgggaccggcccttcaagccctacaacttcttggcccacggtgtcctccccgacagcggccaccttcacccgctgctcaaggtccgctcccagttccgacagatcttcctggagatggggtgagcacagggctgggggcggtgcctggtgcttctgctg

SEQ ID NO: 448147 - DNA, 1162 bp, Homo sapiens
gcgtggtagcaggtgcctgtaatcccagctacttaggaggctgaggcaggagaatcgtttgaacccaggaggcagaggttgcagtgagccaagatcatgccactgcactctattctagtctagacaacagagtgtgactctgtctcccgtctctactaaaactacaaaaattagccaggcactgttgcgtgcgtctgtagtcctagtcctaggtactcaggaggctgaggtatgagaatcacttgaacctgggaggcggaggttgcagtgagctgagattacgccactgcactccaccctaggttacagagtgagactctgtttcaaaaaaacaaatgcactcagcaaaagaagacagaagtgtgtaccagggcagtaagtggtatagggagggctaaggcaactacgtggtcagtgaaggcatcatggaggaagaagtgccacctaagcaaaatctagaggtagataaagaggtaaaccatgagagtatctggggaagggtgtcccaggtagtggtcacagtcagttcaaaggcccagaggtgggaatgtgctttttgtattaggagaagagtgaggaggctggtgtggctgaaggcggagggtgagaggtgatagagcagttggcgcagggccctgtgggtcatggggagaacttgaacttttcctctgaagaagatgggagccatggaaatctgagcagaagggtgcacgtgctgacctcatgataaactctgttccctcccccacaagcccaacgatgatcaaatatggcatcaacaatatccgggagctggtgggccacaaggtgaacctgcagatggtgtatgacagtcccctgtgccgcctggatgccgagccgaggccccctcccacacaggaggctgcgtgacatgggccactctaggacaggtcatcctccccgagtccctgctgctgcgctcctttgcatccctggccagtgaccttgtatttatgaggcctctgtgaggccagcccccaccttcctctttcccacctgtcccaggaccagaatcccagggacagaggactgggtagcaggttccttctgttgtcctgtgtggtgtgtctactgtgagggtgggccctgaggagacctgtgggccacctattgtctaataaagtgggcagttgcccccaaa

SEQ ID NO: 448148 - DNA, 454 bp, Homo sapiens
ggagctcgctacctgtaacattcgtgtccctctccctgtgagcgcccaacgatgatcaaatatggcatcaacaatatccgggagctggtgggccacaaggtgaacctgcagatggtgtatgacagtcccctgtgccgcctggatgccgagccgaggccccctcccacacaggaggctgcgtgacatgggccactctaggacaggtcatcctccccgagtccctgctgctgcgctcctttgcatccctggccagtgaccttgtatttatgaggcctctgtgaggccagcccccaccttcctctttcccacctgtcccaggaccagaatcccagggacagaggactgggtagcaggttccttctgttgtcctgtgtggtgtgtctactgtgagggtgggccctgaggagacctgtgggccacctattgtctaataaagtgggcagttgcccccaaa

SEQ ID NO: 448149 - DNA, 1813 bp, Homo sapiens
  misc_feature (1405)..(1405): n is a, c, g, or t
  misc_feature (1408)..(1408): n is a, c, g, or t
  misc_feature (1443)..(1443): n is a, c, g, or t
  misc_feature (1447)..(1447): n is a, c, g, or t
  misc_feature (1453)..(1453): n is a, c, g, or t
  misc_feature (1478)..(1478): n is a, c, g, or t
  misc_feature (1481)..(1481): n is a, c, g, or t
  misc_feature (1483)..(1483): n is a, c, g, or t
actgggaaggagtcatggcggatggtcaggtggcggaactgctgctccggcggctggaggcgtctgatggcggcctggacagcgccgagttggcggctgagctgggcatggagcaccaggcggtggtgggcgccgtgaagagccttcaggcgctgggcgaggtcatcgaggctgaacttcggtccaccaagcactgggagcttactgcggagggcgaggagattgcccgggagggcagccatgaggcccgtgtgtttcgaagcattcccccagagggcctggcccagagcgagcttatgcgactgcccagtggcaaagtgggcttcagcaaggccatgtccaacaagtggattcgggtggacaagagtgcggctgacgggccccgggtgttccgagtggtggacagcatggaggatgaggtgcagcggcggctccagctggtccgggggggacaggctgagaagctgggggagaaggagaggagcgagctgaggaagaggaagctgttggctgaagtgactctgaagacctactgggtgagcaaaggcagtgcctttagtaccagcatctccaagcaagagacagagctgagcccagagatgatctccagtggctcttggcgggaccggcccttcaagccctacaacttcttggcccacggtgtcctccccgacagcggccaccttcacccgctgctcaaggtccgctcccagttccgacagatcttcctggagatggggttcaccgagatgccgactgataacttcattgagagctccttctggaactttgacgccctcttccagccccagcagcacccagcccgtgaccagcacgacaccttcttccttcgagatccagcggaggccctgcagctcccaatggactatgtccagcgggtcaagcggacccactctcagggcggctacggctcacaggggtacaagtataactggaagctggacgaggcccggaaaaacctactgcgaacccacaccacatcagccagcgcccgtgcgctctaccgccttgcccagaagaagcccttcactccggtcaagtacttctccatcgaccgcgtattccggaatgagaccctggacgccacgcacctggctgagttccaccagatcgagggcgtggtggcggatcatggtctcaccttgggccacctcatgggcgttctgcgggagttcttcaccaagctgggtatcacgcaactccgcttcaagccagcctacaacccatacacagagcccagcatggaggtgttcagctaccaccaaggcctgaagaagtgggtggaggtcggaaactcgggggtcttccgtccagagatgctgctgcccatggggcttcccgagaacgtgtcggtcattgcctggggcctctccctggagcgttnatnataatattttcattcaatcaattattctctgtgtntttntttttntataattttaaccttcatatttttnttntntttttttttttcttttttttgccgagccgaggccccctcccacacaggaggctgcgtgacatgggccactctaggacaggtcatcctccccgagtccctgctgctgcgctcctttgcatccctggccagtgaccttgtatttatgaggcctctgtgaggccagcccccaccttcctctttcccacctgtcccaggaccagaatcccagggacagaggactgggtagcaggttccttctgttgtcctgtgtggtgtgtctactgtgagggtgggccctgaggagacctgtgggccacctattgtctaataaagtgggcagttgcccccaaa

SEQ ID NO: 448150 - DNA, 1116 bp, Homo sapiens
actgggaaggagtcatggcggatggtcaggtggcggaactgctgctccggcggctggaggcgtctgatggcggcctggacagcgccgagttggcggctgagctgggcatggagcaccaggcggtggtgggcgccgtgaagagccttcaggcgctgggcgaggtcatcgaggctgaacttcggtccaccaagcactgggagcttactgcggagggcgaggagattgcccgggagggcagccatgaggcccgtgtgtttcgaagcattcccccagagggcctggcccagagcgagcttatgcgactgcccagtggcaaagtgggcttcagcaaggccatgtccaacaagtggattcgggtggacaagagtgcggctgacgggccccgggtgttccgagtggtggacagcatggaggatgaggtgcagcggcggctccagctggtccgggggggacaggctgagaagctgggggagaaggagaggagcgagctgaggaagaggaagctgttggctgaagtgactctgaagacctactgggtgagcaaaggcagtgcctttagtaccagcatctccaagcaagagacagagctgagcccagagatgatctccagtggctcttggcgggaccggcccttcaagccctacaacttcttggcccacggtgtcctccccgacagcggccaccttcacccgctgctcaaggtccgctcccagttccgacagatcttcctggagatggggttcaccgagatgccgactgataacttcattgagagctccttctggaactttgacgccctcttccagccccagcagcacccagcccgtgaccagcacgacaccttcttccttcgagatccagcggaggccctgcagctcccaatggactatgtccagcgggtcaagcggacccactctcagggcggctacggctcacaggggtacaagtataactggaagctggacgaggcccggaaaaacctactgcgaacccacaccacatcagccagcgcccgtgcgctctaccgccttgcccagaagacaacatattttgtcaccaagaccctacttctaacctcactgttcttatgaattcgacgataccccccgattccgc

SEQ ID NO: 448151 - DNA, 1287 bp, Homo sapiens
actgggaaggagtcatggcggatggtcaggtggcggaactgctgctccggcggctggaggcgtctgatggcggcctggacagcgccgagttggcggctgagctgggcatggagcaccaggcggtggtgggcgccgtgaagagccttcaggcgctgggcgaggtcatcgaggctgaacttcggtccaccaagcactgggagcttactgcggagggcgaggagattgcccgggagggcagccatgaggcccgtgtgtttcgaagcattcccccagagggcctggcccagagcgagcttatgcgactgcccagtggcaaagtgggcttcagcaaggccatgtccaacaagtggattcgggtggacaagagtgcggctgacgggccccgggtgttccgagtggtggacagcatggaggatgaggtgcagcggcggctccagctggtccgggggggacaggctgagaagctgggggagaaggagaggagcgagctgaggaagaggaagctgttggctgaagtgactctgaagacctactgggtgagcaaaggcagtgcctttagtaccagcatctccaagcaagagacagagctgagcccagagatgatctccagtggctcttggcgggaccggcccttcaagccctacaacttcttggcccacggtgtcctccccgacagcggccaccttcacccgctgctcaaggtccgctcccagttccgacagatcttcctggagatggggttcaccgagatgccgactgataacttcattgagagctccttctggaactttgacgccctcttccagccccagcagcacccagcccgtgaccagcacgacaccttcttccttcgagatccagcggaggccctgcagctcccaacgatgatcaaatatggcatcaacaatatccgggagctggtgggccacaaggtgaacctgcagatggtgtatgacagtcccctgtgccgcctggatgccgagccgaggccccctcccacacaggaggctgcgtgacatgggccactctaggacaggtcatcctccccgagtccctgctgctgcgctcctttgcatccctggccagtgaccttgtatttatgaggcctctgtgaggccagcccccaccttcctctttcccacctgtcccaggaccagaatcccagggacagaggactgggtagcaggttccttctgttgtcctgtgtggtgtgtctactgtgagggtgggccctgaggagacctgtgggccacctattgtctaataaagtgggcagttgcccccaaa

SEQ ID NO: 448152 - DNA, 1623 bp, Homo sapiens
actgggaaggagtcatggcggatggtcaggtggcggaactgctgctccggcggctggaggcgtctgatggcggcctggacagcgccgagttggcggctgagctgggcatggagcaccaggcggtggtgggcgccgtgaagagccttcaggcgctgggcgaggtcatcgaggctgaacttcggtccaccaagcactgggagcttactgcggagggcgaggagattgcccgggagggcagccatgaggcccgtgtgtttcgaagcattcccccagagggcctggcccagagcgagcttatgctgaggaagaggaagctgttggctgaagtgactctgaagacctactgggtgagcaaaggcagtgcctttagtaccagcatctccaagcaagagacagagctgagcccagagatgatctccagtggctcttggcgggaccggcccttcaagccctacaacttcttggcccacggtgtcctccccgacagcggccaccttcacccgctgctcaaggtccgctcccagttccgacagatcttcctggagatggggttcaccgagatgccgactgataacttcattgagagctccttctggaactttgacgccctcttccagccccagcagcacccagcccgtgaccagcacgacaccttcttccttcgagatccagcggaggccctgcagctcccaatggactatgtccagcgggtcaagcggacccactctcagggcggctacggctcacaggggtacaagtataactggaagctggacgaggcccggaaaaacctactgcgaacccacaccacatcagccagcgcccgtgcgctctaccgccttgcccagaagaagcccttcactccggtcaagtacttctccatcgaccgcgtattccggaatgagaccctggacgccacgcacctggctgagttccaccagatcgagggcgtggtggcggatcatggtctcaccttgggccacctcatgggcgttctgcgggagttcttcaccaagctgggtatcacgcaactccgcttcaagccagcctacaacccatacacagagcccagcatggaggtgttcagctaccaccaaggcctgaagaagtgggtggaggtcggaaactcgggggtcttccgtccagagatgctgctgcccatggggcttcccgagaacgtgtcggtcattgcctggggcctctccctggagcgcccaacgatgatcaaatatggcatcaacaatatccgggagctggtgggccacaaggtgaacctgcagatggtgtatgacagtcccctgtgccgcctggatgccgagccgaggccccctcccacacaggaggctgcgtgacatgggccactctaggacaggtcatcctccccgagtccctgctgctgcgctcctttgcatccctggccagtgaccttgtatttatgaggcctctgtgaggccagcccccaccttcctctttcccacctgtcccaggaccagaatcccagggacagaggactgggtagcaggttccttctgttgtcctgtgtggtgtgtctactgtgagggtgggccctgaggagacctgtgggccacctattgtctaataaagtgggcagttgcccccaaa

SEQ ID NO: 448153 - DNA, 1464 bp, Homo sapiens
ccacccatctcccccccccccccccccccccctgcgctagctcgggccgtcggtggtaatcggccgtggcggaactgctgctccggcggctggaggcgtctgatggcggcctggacagcgccgagttggcggctgagctgggcatggagcaccaggcggtggtgggcgccgtgaagagccttcaggcgctgggcgaggtcatcgaggctgaacttcggtccaccaagcaagagacagagctgagcccagagatgatctccagtggctcttggcgggaccggcccttcaagccctacaacttcttggcccacggtgtcctccccgacagcggccaccttcacccgctgctcaaggtccgctcccagttccgacagatcttcctggagatggggttcaccgagatgccgactgataacttcattgagagctccttctggaactttgacgccctcttccagccccagcagcacccagcccgtgaccagcacgacaccttcttccttcgagatccagcggaggccctgcagctcccaatggactatgtccagcgggtcaagcggacccactctcagggcggctacggctcacaggggtacaagtataactggaagctggacgaggcccggaaaaacctactgcgaacccacaccacatcagccagcgcccgtgcgctctaccgccttgcccagaagaagcccttcactccggtcaagtacttctccatcgaccgcgtattccggaatgagaccctggacgccacgcacctggctgagttccaccagatcgagggcgtggtggcggatcatggtctcaccttgggccacctcatgggcgttctgcgggagttcttcaccaagctgggtatcacgcaactccgcttcaagccagcctacaacccatacacagagcccagcatggaggtgttcagctaccaccaaggcctgaagaagtgggtggaggtcggaaactcgggggtcttccgtccagagatgctgctgcccatggggcttcccgagaacgtgtcggtcattgcctggggcctctccctggagcgcccaacgatgatcaaatatggcatcaacaatatccgggagctggtgggccacaaggtgaacctgcagatggtgtatgacagtcccctgtgccgcctggatgccgagccgaggccccctcccacacaggaggctgcgtgacatgggccactctaggacaggtcatcctccccgagtccctgctgctgcgctcctttgcatccctggccagtgaccttgtatttatgaggcctctgtgaggccagcccccaccttcctctttcccacctgtcccaggaccagaatcccagggacagaggactgggtagcaggttccttctgttgtcctgtgtggtgtgtctactgtgagggtgggccctgaggagacctgtgggccacctattgtctaataaagtgggcagttgcccccaaa

SEQ ID NO: 448154 - DNA, 911 bp, Homo sapiens
actgggaaggagtcatggcggatggtcaggtggcggaactgctgctccggcggctggaggcgtctgatggcggcctggacagcgccgagttggcggctgagctgggcatggagcaccaggcggtggtgggcgccgtgaagagccttcaggcgctgggcgaggtcatcgaggctgaacttcggtccaccaagcactgggagcttactgcggagggcgaggagattgcccgggagggcagccatgaggcccgtgtgtttcgaagcattcccccagagggcctggcccagagcgagcttatgcgactgcccagtggcaaagtgggcttcagcaaggccatgtccaacaagtggattcgggtggacaagagtgcggctgacgggccccgggtgttccgagtggtggacagcatggaggatgaggtgcagcggcggctccagctggtccgggggggacaggctgagaagctgggggagaaggagaggagcgagctgaggaagaggaagctgttggctgaagtgactctgaagacctactgggtgagcaaaggcagtgcctttagtaccagcatctccaagcaagagacagagctgagcccagagatgatctccagtggctcttggcgggaccggcccttcaagccctacaacttcttggcccacggtgtcctccccgacagcggccaccttcacccgctttgcatccctggccagtgaccttgtatttatgaggcctctgtgaggccagcccccaccttcctctttcccacctgtcccaggaccagaatcccagggacagaggactgggtagcaggttccttctgttgtcctgtgtggtgtgtctactgtgagggtgggccctgaggagacctgtgggccacctattgtctaataaagtgggcagttgcccccaaa

SEQ ID NO: 448155 - DNA, 1118 bp, Homo sapiens
  misc_feature (921)..(921): n is a, c, g, or t
actgggaaggagtcatggcggatggtcaggtggcggaactgctgctccggcggctggaggcgtctgatggcggcctggacagcgccgagttggcggctgagctgggcatggagcaccaggcggtggtgggcgccgtgaagagccttcaggcgctgggcgaggtcatcgaggctgaacttcggtccaccaagcactgggagcttactgcggagggcgaggagattgcccgggagggcagccatgaggcccgtgtgtttcgaagcattcccccagagggcctggcccagagcgagcttatgcgactgcccagtggcaaagtgggcttcagcaaggccatgtccaacaagtggattcgggtggacaagagtgcggctgacgggccccgggtgttccgagtggtggacagcatggaggatgaggtgcagcggcggctccagctggtccgggggggacaggctgagaagctgggggagaaggagaggagcgagctgaggaagaggaagctgttggctgaagtgactctgaagacctactgggtgagcaaaggcagtgcctttagtaccagcatctccaagcaagagacagagctgagcccagagatgatctccagtggctcttggcgggaccggcccttcaagccctacaacttcttggcccacggtgtcctccccgacagcggccaccttcacccgctttgcatccctggccagtgaccttgtatttatgaggcctctgtgaggccagcccccaccttcctctttcccacctgtcccaggaccagaatcccagggacagaggactgggtagcaggttccttctgttgtcctgtgtggtgtgtctactgtgagggtgggccctgaggagacctgtgggccacctattgtctaataaagtgggcagttgcccccaaaaaaaaaaaanaaaaataaaacaaacccttcgagatttctttctcacctgttgtgttctgtcatcttttctggttctttttttcttcttattttcatcaatatcacctatcttatctggctctctttcatgttctttatatctcgcatctagcgtcacatagcttcaccttccatcacctcctctaccgcccccccatcgactccccc

SEQ ID NO: 448156 - DNA, 711 bp, Homo sapiens
actgggaaggagtcatggcggatggtcaggtggcggaactgctgctccggcggctggaggcgtctgatggcggcctggacagcgccgagttggcggctgagctgggcatggagcaccaggcggtggtgggcgccgtgaagagccttcaggcgctgggcgaggtcatcgaggctgaacttcggtccaccaagcactgggagcttactgcggagggcgaggagattgcccgggagggcagccatgaggcccgtgtgtttcgaagcattcccccagagggcctggcccagagcgagcttatgcgactgcccagtggcaaagtgggcttcagcaaggccatgtccaacaagtggattcgggtggacaagagtgcggctgacgggccccgggtgttccgagtggtggacagcatggaggatgaggtgcagcggcggctccagctggtccgggggggacaggctgagaagctgggggagaaggagaggagcgagctgaggaagaggaagctgttggctgaagtgactctgaagacctactgggtgagcaaaggcagtgcctttagtaccagcatctccaagcaagagacagagctgagcccagagatgatctccagtggctcttggcgggaccggcccttcaagccctacaacttcttggccctgaggagacctgtgggccacctattgtctaataaagtgggcagttgcccccaaa

SEQ ID NO: 448157 - DNA, 947 bp, Homo sapiens
ccacccatctcccccccccccccccccccccctgcgctagctcgggccgtcggtggtaatcggccgtggcggaactgctgctccggcggctggaggcgtctgatggcggcctggacagcgccgagttggcggctgagctgggcatggagcaccaggcggtggtgggcgccgtgaagagccttcaggcgctgggcgaggtcatcgaggctgaacttcggtccaccaagcactgggagcttactgcggagggcgaggagattgcccgggagggcagccatgaggcccgtgtgtttcgaagcattcccccagagggcctggcccagagcgagcttatgcgactgcccagtggcaaagtgggcttcagcaaggccatgtccaacaagtggattcgggtggacaagagtgcggctgacgggccccgggtgttccgagtggtggacagcatggaggatgaggtgcagcggcggctccagctggtccgggggggacaggctgagaagctgggggagaaggagaggagcgagctgaggaagaggaagctgttggctgaagtgactctgaagacctactgggtgagcaaaggcagtgcctttagtaccagcatctccaagcaagagacagagctgagcccagagatgatctccagtggctcttggcgggaccggcccttcaagccctacaacttcttggcccacggtgtcctccccgacagcggccaccttcacccgctttgcatccctggccagtgaccttgtatttatgaggcctctgtgaggccagcccccaccttcctctttcccacctgtcccaggaccagaatcccagggacagaggactgggtagcaggttccttctgttgtcctgtgtggtgtgtctactgtgagggtgggccctgaggagacctgtgggccacctattgtctaataaagtgggcagttgcccccaaa

SEQ ID NO: 448158 - DNA, 133 bp, Homo sapiens
aaaaaaaaaggggtgggaaatgctcgttgactgacctgatgttgctctgtcctgcccagatccagcggaggccctgcagctcccaatggactatgtccagcgggtcaagcggacccactctcagggcggctac

SEQ ID NO: 448159 - DNA, 1812 bp, Homo sapiens
actgggaaggagtcatggcggatggtcaggtggcggaactgctgctccggcggctggaggcgtctgatggcggcctggacagcgccgagttggcggctgagctgggcatggagcaccaggcggtggtgggcgccgtgaagagccttcaggcgctgggcgaggtcatcgaggctgaacttcggtccaccaagcactgggagcttactgcggagggcgaggagattgcccgggagggcagccatgaggcccgtgtgtttcgaagcattcccccagagggcctggcccagagcgagcttatgcgactgcccagtggcaaagtgggcttcagcaaggccatgtccaacaagtggattcgggtggacaagagtgcggctgacgggccccgggtgttccgagtggtggacagcatggaggatgaggtgcagcggcggctccagctggtccgggggggacaggctgagaagctgggggagaaggagaggagcgagctgaggaagaggaagctgttggctgaagtgactctgaagacctactgggtgagcaaaggcagtgcctttagtaccagcatctccaagcaagagacagagctgagcccagagatgatctccagtggctcttggcgggaccggcccttcaagccctacaacttcttggcccacggtgtcctccccgacagcggccaccttcacccgctgctcaaggtccgctcccagttccgacagatcttcctggagatggggttcaccgagatgccgactgataacttcattgagagctccttctggaactttgacgccctcttccagccccagcagcacccagcccgtgaccagcacgacaccttcttccttcgagatccagcggaggccctgcagctcccaatggactatgtccagcgggtcaagcggacccactctcagggcggctacggctcacaggggtacaagtataactggaagctggacgaggcccggaaaaacctactgcgaacccacaccacatcagccagcgcccgtgcgctctaccgccttgcccagaagaagcccttcactccggtcaagtacttctccatcgaccgcgtattccggaatgagaccctggacgccacgcacctggctgagttccaccagatcgagggcgtggtggcggatcatggtctcaccttgggccacctcatgggcgttctgcgggagttcttcaccaagctgggtatcacgcaactccgcttcaagccagcctacaacccatacacagagcccagcatggaggtgttcagctaccaccaaggcctgaagaagtgggtggaggtcggaaactcgggggtcttccgtccagagatgctgctgcccatggggcttcccgagaacgtgtcggtcattgcctggggcctctccctggagcgcccaacgatgatcaaatatggcatcaacaatatccgggagctggtgggccacaaggtgaacctgcagatggtgtatgacagtcccctgtgccgcctggatgccgagccgaggccccctcccacacaggaggctgcgtgacatgggccactctaggacaggtcatcctccccgagtccctgctgctgcgctcctttgcatccctggccagtgaccttgtatttatgaggcctctgtgaggccagcccccaccttcctctttcccacctgtcccaggaccagaatcccagggacagaggactgggtagcaggttccttctgttgtcctgtgtggtgtgtctactgtgagggtgggccctgaggagacctgtgggccacctattgtctaataaagtgggcagttgcccccaaa

SEQ ID NO: 448160 - DNA, 1908 bp, Homo sapiens
actgggaaggagtcatggcggatggtcaggtggcggaactgctgctccggcggctggaggcgtctgatggcggcctggacagcgccgagttggcggctgagctgggcatggagcaccaggcggtggtgggcgccgtgaagagccttcaggcgctgggcgaggtcatcgaggctgaacttcggtccaccaagcactgggagcttactgcggagggcgaggagattgcccgggagggcagccatgaggcccgtgtgtttcgaagcattcccccagagggcctggcccagagcgagcttatgcgactgcccagtggcaaagtgggcttcagcaaggccatgtccaacaagtggattcgggtggacaagagtgcggctgacgggccccgggtgttccgagtggtggacagcatggaggatgaggtgcagcggcggctccagctggtccgggggggacaggctgagaagctgggggagaaggagaggagcgagctgaggaagaggaagctgttggctgaagtgactctgaagacctactgggtgagcaaaggcagtgcctttagtaccagcatctccaagcaagagacagagctgagcccagagatgatctccagtggctcttggcgggaccggcccttcaagccctacaacttcttggcccacggtgtcctccccgacagcggccaccttcacccgctgctcaaggtccgctcccagttccgacagatcttcctggagatggggttcaccgagatgccgactgataacttcattgagagctccttctggaactttgacgccctcttccagccccagcagcacccagcccgtgaccagcacgacaccttcttccttcgagatccagcggaggccctgcagctcccaatggactatgtccagcgggtcaagcggacccactctcagggcggctacggctcacaggggtacaagtataactggaagctggacgaggcccggaaaaacctactgcgaacccacaccacatcagccagcgcccgtgcgctctaccgccttgcccagaaggtgcggttggcccaggcgggggccccagtggggagagggtgctgtcaaagggaccttctgacccatacctgggcctggctcggttgtcacccctagaagcccttcactccggtcaagtacttctccatcgaccgcgtattccggaatgagaccctggacgccacgcacctggctgagttccaccagatcgagggcgtggtggcggatcatggtctcaccttgggccacctcatgggcgttctgcgggagttcttcaccaagctgggtatcacgcaactccgcttcaagccagcctacaacccatacacagagcccagcatggaggtgttcagctaccaccaaggcctgaagaagtgggtggaggtcggaaactcgggggtcttccgtccagagatgctgctgcccatggggcttcccgagaacgtgtcggtcattgcctggggcctctccctggagcgcccaacgatgatcaaatatggcatcaacaatatccgggagctggtgggccacaaggtgaacctgcagatggtgtatgacagtcccctgtgccgcctggatgccgagccgaggccccctcccacacaggaggctgcgtgacatgggccactctaggacaggtcatcctccccgagtccctgctgctgcgctcctttgcatccctggccagtgaccttgtatttatgaggcctctgtgaggccagcccccaccttcctctttcccacctgtcccaggaccagaatcccagggacagaggactgggtagcaggttccttctgttgtcctgtgtggtgtgtctactgtgagggtgggccctgaggagacctgtgggccacctattgtctaataaagtgggcagttgcccccaaa

SEQ ID NO: 448161 - DNA, 1232 bp, Homo sapiens
actgggaaggagtcatggcggatggtcaggtggcggaactgctgctccggcggctggaggcgtctgatggcggcctggacagcgccgagttggcggctgagctgggcatggagcaccaggcggtggtgggcgccgtgaagagccttcaggcgctgggcgaggtcatcgaggctgaacttcggtccaccaagcactgggagcttactgcggagggcgaggagattgcccgggagggcagccatgaggcccgtgtgtttcgaagcattcccccagagggcctggcccagagcgagcttatgcgactgcccagtggcaaagtgggcttcagcaaggccatgtccaacaagtggattcgggtggacaagagtgcggctgacgggccccgggtgttccgagtggtggacagcatggaggatgaggtgcagcggcggctccagctggtccgggggggacaggctgagaagctgggggagaaggagaggagcgagctgaggaagaggaagctgttggctgaagtgactctgaagacctactgggtgagcaaaggcagtgcctttagtaccagcatctccaagcaagagacagagctgagcccagagatgatctccagtggctcttggcgggaccggcccttcaagccctacaacttcttggcccacggtgtcctccccgacagcggccaccttcacccgctgctcaaggtccgctcccagttccgacagatcttcctggagatggggttcaccgagatgccgactgataacttcattgagagctccttctggaactttgacgccctcttccagccccagcagcacccagcccgtgaccagcacgacaccttcttccttcgagatccagcggaggccctgcagctcccaatggactatgtccagcgggtcaagcggacccactctcagggcggctacggctcacaggggtacaagtataactggaagctggacgaggcccggaaaaacctactgcgaacccacaccacatcagccagcgcccgtgcgctctaccgccttgcccagaagagccttcactccggtcaagtacttctccatcgaccggtttcggattggggccttggcgcgcactggttgttcccagatggggggtgtgggactggctcactggcgccttctgggtttgggggtctcccaggggttccgcatccgttagccggtaacttaccggccgttgggtgtcttcccgcttattggtga

SEQ ID NO: 448162 - DNA, 1677 bp, Homo sapiens
agtcccacacctagtcccacacctgcaccggagtcccacacctagtcccacacctgcactgggagcttactgcggagggcgaggagattgcccgggagggcagccatgaggcccgtgtgtttcgaagcattcccccagagggcctggcccagagcgagcttatgcgactgcccagtggcaaagtgggcttcagcaaggccatgtccaacaagtggattcgggtggacaagagtgcggctgacgggccccgggtgttccgagtggtggacagcatggaggatgaggtgcagcggcggctccagctggtccgggggggacaggctgagaagctgggggagaaggagaggagcgagctgaggaagaggaagctgttggctgaagtgactctgaagacctactgggtgagcaaaggcagtgcctttagtaccagcatctccaagcaagagacagagctgagcccagagatgatctccagtggctcttggcgggaccggcccttcaagccctacaacttcttggcccacggtgtcctccccgacagcggccaccttcacccgctgctcaaggtccgctcccagttccgacagatcttcctggagatggggttcaccgagatgccgactgataacttcattgagagctccttctggaactttgacgccctcttccagccccagcagcacccagcccgtgaccagcacgacaccttcttccttcgagatccagcggaggccctgcagctcccaatggactatgtccagcgggtcaagcggacccactctcagggcggctacggctcacaggggtacaagtataactggaagctggacgaggcccggaaaaacctactgcgaacccacaccacatcagccagcgcccgtgcgctctaccgccttgcccagaagaagcccttcactccggtcaagtacttctccatcgaccgcgtattccggaatgagaccctggacgccacgcacctggctgagttccaccagatcgagggcgtggtggcggatcatggtctcaccttgggccacctcatgggcgttctgcgggagttcttcaccaagctgggtatcacgcaactccgcttcaagccagcctacaacccatacacagagcccagcatggaggtgttcagctaccaccaaggcctgaagaagtgggtggaggtcggaaactcgggggtcttccgtccagagatgctgctgcccatggggcttcccgagaacgtgtcggtcattgcctggggcctctccctggagcgcccaacgatgatcaaatatggcatcaacaatatccgggagctggtgggccacaaggtgaacctgcagatggtgtatgacagtcccctgtgccgcctggatgccgagccgaggccccctcccacacaggaggctgcgtgacatgggccactctaggacaggtcatcctccccgagtccctgctgctgcgctcctttgcatccctggccagtgaccttgtatttatgaggcctctgtgaggccagcccccaccttcctctttcccacctgtcccaggaccagaatcccagggacagaggactgggtagcaggttccttctgttgtcctgtgtggtgtgtctactgtgagggtgggccctgaggagacctgtgggccacctattgtctaataaagtgggcagttgcccccaaa

SEQ ID NO: 448163 - DNA, 779 bp, Homo sapiens
actgggaaggagtcatggcggatggtcaggtggcggaactgctgctccggcggctggaggcgtctgatggcggcctggacagcgccgagttggcggctgagctgggcatggagcaccaggcggtggtgggcgccgtgaagagccttcaggcgctgggcgaggtcatcgaggctgaacttcggtccaccaagcactgggagcttactgcggagggcgaggagattgcccgggagggcagccatgaggcccgtgtgtttcgaagcattcccccagagggcctggcccagagcgagcttatgcgactgcccagtggcaaagtgggcttcagcaaggccatgtccaacaagtggattcgggtggacaagagtgcggctgacgggccccgggtgttccgagtggtggacagcatggaggatgaggtgcagcggcggctccagctggtccgggggggacaggctgagaagctgggggagaaggagaggagcgagctgaggaagaggaagctgttggctgaagtgactctgaagacctactgggtgagcaaaggcagtgcctttagtaccagcatctccaagcaagagacagagctgagcccagagatgatctccagtggctcttggcgggaccggcccttcaagccctacaacttcttggcccacggtgtcctccccgacagcggccaccttcacccgctgctcaaggtccgctcccagttccgacagatcttcctggagatggggtgagcacagggctgggggcggtgcctggtgcttctgctg

SEQ ID NO: 448164 - DNA, 849 bp, Homo sapiens
actgggaaggagtcatggcggatggtcaggtggcggaactgctgctccggcggctggaggcgtctgatggcggcctggacagcgccgagttggcggctgagctgggcatggagcaccaggcggtggtgggcgccgtgaagagccttcaggcgctgggcgaggtcatcgaggctgaacttcggtccaccaagcactgggagcttactgcggagggcgaggagattgcccgggagggcagccatgaggcccgtgtgtttcgaagcattcccccagagggcctggcccagagcgagcttatgcgactgcccagtggcaaagtgggcttcagcaaggccatgtccaacaagtggattcgggtggacaagagtgcggctgacgggccccgggtgttccgagtggtggacagcatggaggatgaggtgcagcggcggctccagctggtccgggggggacaggctgagaagctgggggagaaggagaggagcgagctgaggaagaggaagctgttggctgaagtgactctgaagacctactgggtgagcaaaggcagtgcctttagtaccagcatctccaagcaagagacagagctgagcccagagatgatctccagtggctcttggcgggaccggcccttcaagccctacaacttcttggcccacggtgtcctccccgacagcggccaccttcacccgctgctcaaggtccgctcccagttccagaatcccagggacagaggactgggtagcaggttccttctgttgtcctgtgtggtgtgtctactgtgagggtgggccctgaggagacctgtgggccacctattgtctaataaagtgggcagttgcccccaaa

SEQ ID NO: 448165 - DNA, 629 bp, Homo sapiens
actgggaaggagtcatggcggatggtcaggtggcggaactgctgctccggcggctggaggcgtctgatggcggcctggacagcgccgagttggcggctgagctgggcatggagcaccaggcggtggtgggcgccgtgaagagccttcaggcgctgggcgaggtcatcgaggctgaacttcggtccaccaagcactgggagcttactgcggagggcgaggagattgcccgggagggcagccatgaggcccgtgtgtttcgaagcattcccccagagggcctggcccagagcgagcttatgcgactgcccagtggcaaagtgggcttcagcaaggccatgtccaacaagtggattcgggtggacaagagtgcggctgacgggccccgggtgttccgagtggtggacagcatggaggatgaggtgcagcggcggctccagctggtccgggggggacaggctgagaagctgggggagaaggagaggagcgagctgaggaagaggaagctgttggctgaagtgactctgaagacctactgggtgagcaaaggcagtgcctttagtaccagcatctccaacaagaacccacacgccatacaagaaccacaggggacctcgagacagctacacaca

SEQ ID NO: 448166 - DNA, 2198 bp, Homo sapiens
cgcctcagccatggccctgcgcaaggaactgctcaagtccatctggtacgcctttaccgcgctggacgtggagaagagtggcaaagtctccaagtcccagctcaaggtgctgtcccacaacctgtacacggtcctgcacatcccccatgaccccgtggccctggaggaacacttccgagatgatgatgacggccctgtgtccagccagggatacatgccctacctcaacaagtacatcctggacaaggtggaggagggggcttttgttaaagagcactttgatgagctgtgctggacgctgacggccaagaagaactatcgggcagatagcaacgggaacagtatgctctccaatcaggatgccttccgcctctggtgcctcttcaacttcctgtctgaggacaagtaccctctgatcatggttcctgatgaggtggaatacctgctgaaaaaggtactcagcagcatgagcttggaggtgagcttgggtgagctggaggagcttctggcccaggaggcccaggtggcccagaccaccggggggctcagcgtctggcagttcctggagctcttcaattcgggccgctgcctgcggggcgtgggccgggacaccctcagcatggccatccacgaggtctaccaggagctcatccaagatgtcctgaagcagggctacctgtggaagcgagggcacctgagaaggaactgggccgaacgctggttccagctgcagcccagctgcctctgctactttgggagtgaagagtgcaaagagaaaaggggcattatcccgctggatgcacactgctgcgtggaggtgctgccagaccgcgacggaaagcgctgcatgttctgtgtgaagacagccacccgcacgtatgagatgagcgcctcagacacgcgccagcgccaggagtggacagctgccatccagatggcgatccggctgcaggccgaggggaagacgtccctacacaaggacctgaagcagaaacggcgcgagcagcgggagcagcgggagcggcgccgggcggccaaggaagaggagctgctgcggctgcagcagctgcaggaggagaaggagcggaagctgcaggagctggagctctgcagcaggcgctcgagggccaactgcgcgaggcggagcaggcccgggcctccatgcaggctgagatggagctgaaggaggaggaggctgcccggcagcggcagcgcatcaaggagctggaggagatgcagcagcggttgcaggaggccctgcaactagaggtgaaagctcggcgagatgaagaatctgtgcgaatcgctcagaccagactgctggaagaggaggaagagaagctgaagcagttgatgcagctgaaggaggagcaggagcgctacatcgaacgggcgcagcaggagaaggaagagctgcagcaggagatggcacagcagagccgctccctgcagcaggcccagcagcagctggaggaggtgcggcagaaccggcagagggctgacgaggatgtggaggctgcccagagaaaactgcgccaggccagcaccaacgtgaaacactggaatgtccagatgaaccggctgatgcatccaattgagcctggagataagcgtccggtcaccagcagctccttctcaggcttccagccccctctgcttgcccaccgtgactcctccctaaagcgcctgacccgctggggatcccagggcaacaggaccccctcgcccaacagcaatgagcagcagaagtccctcaatggtggggatgaggctcctgccccggcttccacccctcaggaagataaactggatccagcaccagaaaattagcctctcttagccccttgttcttcccaatgtcatatccaccaggacctggccacagctggcctgtgggtgatcccagctcttactaggagagggagctgaggtcctggtgccaggggcccaggccctccaaccataaacagtccaggatggaacctggttcacccttcataccagctccaagccccagaccatgggagctgtctgggatgttgatccttgagaacttggccctgtgctttagacccaaggacccgattcctgggctaggaaagagagaacaagcaagccggggctacctgcccccaggtggccaccaagttgtggaagcacatttctaaataaaaactgctcttagaatgaaaaaatgg

SEQ ID NO: 448167 - DNA, 2163 bp, Homo sapiens
cgcctcagccatggccctgcgcaaggaactgctcaagtccatctggtacgcctttaccgcgctggacgtggagaagagtggcaaagtctccaagtcccagctcaaggtgctgtcccacaacctgtacacggtcctgcacatcccccatgaccccgtggccctggaggaacacttccgagatgatgatgacggccctgtgtccagccagggatacatgccctacctcaacaagtacatcctggacaaggatgccttccgcctctggtgcctcttcaacttcctgtctgaggacaagtaccctctgatcatggttcctgatgaggtggaatacctgctgaaaaaggtactcagcagcatgagcttggaggtgagcttgggtgagctggaggagcttctggcccaggaggcccaggtggcccagaccaccggggggctcagcgtctggcagttcctggagctcttcaattcgggccgctgcctgcggggcgtgggccgggacaccctcagcatggccatccacgaggtctaccaggagctcatccaagatgtcctgaagcagggctacctgtggaagcgagggcacctgagaaggaactgggccgaacgctggttccagctgcagcccagctgcctctgctactttgggagtgaagagtgcaaagagaaaaggggcattatcccgctggatgcacactgctgcgtggaggtgctgccagaccgcgacggaaagcgctgcatgttctgtgtgaagacagccacccgcacgtatgagatgagcgcctcagacacgcgccagcgccaggagtggacagctgccatccagatggcgatccggctgcaggccgaggggaagacgtccctacacaaggacctgaagcagaaacggcgcgagcagcgggagcagcgggagcggcgccgggcggccaaggaagaggagctgctgcggctgcagcagctgcaggaggagaaggagcggaagctgcaggagctggagctgctgcaggaggcgcagcggcaggccgagcggctgctgcaggaggaggaggaacggcgccgcagccagcaccgcgagctgcagcaggcgctcgagggccaactgcgcgaggcggagcaggcccgggcctccatgcaggctgagatggagctgaaggaggaggaggctgcccggcagcggcagcgcatcaaggagctggaggagatgcagcagcggttgcaggaggccctgcaactagaggtgaaagctcggcgagatgaagaatctgtgcgaatcgctcagaccagactgctggaagaggaggaagagaagctgaagcagttgatgcagctgaaggaggagcaggagcgctacatcgaacgggcgcagcaggagaaggaagagctgcagcaggagatggcacagcagagccgctccctgcagcaggcccagcagcagctggaggaggtgcggcagaaccggcagagggctgacgaggatgtggaggctgcccagagaaaactgcgccaggccagcaccaacgtgaaacactggaatgtccagatgaaccggctgatgcatccaattgagcctggagataagcgtccggtcaccagcagctccttctcaggcttccagccccctctgcttgcccaccgtgactcctccctaaagcgcctgacccgctggggatcccagggcaacaggaccccctcgcccaacagcaatgagcagcagaagtccctcaatggtggggatgaggctcctgccccggcttccacccctcaggaagataaactggatccagcaccagaaaattagcctctcttagccccttgttcttcccaatgtcatatccaccaggacctggccacagctggcctgtgggtgatcccagctcttactaggagagggagctgaggtcctggtgccaggggcccaggccctccaaccataaacagtccaggatggaacctggttcacccttcataccagctccaagccccagaccatgggagctgtctgggatgttgatccttgagaacttggccctgtgctttagacccaaggacccgattcctgggctaggaaagagagaacaagcaagccggggctacctgcccccaggtggccaccaagttgtggaagcacatttctaaataaaaactgctcttagaatgaaaaaatgg

SEQ ID NO: 448168 - DNA, 1741 bp, Homo sapiens
agcgtgatctgcataaacactgagtggcgattatgtactgggccccgtggaataatagcaagatggaaacgcacccacctagccttcaaagagcaaaggctacagagttgtggggacttaagtcccccataacttatgatgcaagccatgcaggctcctggcagagtggggtccccagggaagatagccaggagggctaggggcttgagctggagcacccttggggcaggtggggccctgacccagtgaggccagcctggctgcggccacctaccctgtgccaggtgctgccagaccgcgacggaaagcgctgcatgttctgtgtgaagacagccacccgcacgtatgagatgagcgcctcagacacgcgccagcgccaggagtggacagctgccatccagatggcgatccggctgcaggccgaggggaagacgtccctacacaaggacctgaagcagaaacggcgcgagcagcgggagcagcgggagcggcgccgggcggccaaggaagaggagctgctgcggctgcagcagctgcaggaggagaaggagcggaagctgcaggagctggagctgctgcaggaggcgcagcggcaggccgagcggctgctgcaggaggaggaggaacggcgccgcagccagcaccgcgagctgcagcaggcgctcgagggccaactgcgcgaggcggagcaggcccgggcctccatgcaggctgagatggagctgaaggaggaggaggctgcccggcagcggcagcgcatcaaggagctggaggagatgcagcagcggttgcaggaggccctgcaactagaggtgaaagctcggcgagatgaagaatctgtgcgaatcgctcagaccagactgctggaagaggaggaagagaagctgaagcagttgatgcagctgaaggaggagcaggagcgctacatcgaacgggcgcagcaggagaaggaagagctgcagcaggagatggcacagcagagccgctccctgcagcaggcccagcagcagctggaggaggtgcggcagaaccggcagagggctgacgaggatgtggaggctgcccagagaaaactgcgccaggccagcaccaacgtgaaacactggaatgtccagatgaaccggctgatgcatccaattgagcctggagataagcgtccggtcaccagcagctccttctcaggcttccagccccctctgcttgcccaccgtgactcctccctaaagcgcctgacccgctggggatcccagggcaacaggaccccctcgcccaacagcaatgagcagcagaagtccctcaatggtggggatgaggctcctgccccggcttccacccctcaggaagataaactggatccagcaccagaaaattagcctctcttagccccttgttcttcccaatgtcatatccaccaggacctggccacagctggcctgtgggtgatcccagctcttactaggagagggagctgaggtcctggtgccaggggcccaggccctccaaccataaacagtccaggatggaacctggttcacccttcataccagctccaagccccagaccatgggagctgtctgggatgttgatccttgagaacttggccctgtgctttagacccaaggacccgattcctgggctaggaaagagagaacaagcaagccggggctacctgcccccaggtggccaccaagttgtggaagcacatttctaaataaaaactgctcttagaatgaaaaaatgg

SEQ ID NO: 448169 - DNA, 657 bp, Homo sapiens
cgcctcagccatggccctgcgcaaggaactgctcaagtccatctggtacgcctttaccgcgctggacgtggagaagagtggcaaagtctccaagtcccagctcaaggtgctgtcccacaacctgtacacggtcctgcacatcccccatgaccccgtggccctggaggaacacttccgagatgatgatgacggccctgtgtccagccagggatacatgccctacctcaacaagtacatcctggacaaggtggaggagggggcttttgttaaagagcactttgatgagctgtgctggacgctgacggccaagaagaactatcgggcagatagcaacgggaacagtatgctctccaatcaggatgccttccgcctctggtgcctcttcaacttcctgtctgaggacaagtaccctctgatcatggttcctgatgaggtgagggtgatggcagccccagggactgaatcacttgggaccagacctaagcaaaaccatgaatgagaccaaaccacctttggtgccttcccatatcccctttctttctttaccatcttcccatgctggtatctgtcctcacccagctgtctccagatgcctagaactgcctgtgtcagagtaattttgccttcttccaggaaaactgaaattacactttcatg

SEQ ID NO: 448170 - DNA, 2274 bp, Homo sapiens
cgcctcagccatggccctgcgcaaggaactgctcaagtccatctggtacgcctttaccgcgctggacgtggagaagagtggcaaagtctccaagtcccagctcaaggtgctgtcccacaacctgtacacggtcctgcacatcccccatgaccccgtggccctggaggaacacttccgagatgatgatgacggccctgtgtccagccagggatacatgccctacctcaacaagtacatcctggacaaggtggaggagggggcttttgttaaagagcactttgatgagctgtgctggacgctgacggccaagaagaactatcgggcagatagcaacgggaacagtatgctctccaatcaggatgccttccgcctctggtgcctcttcaacttcctgtctgaggacaagtaccctctgatcatggttcctgatgaggtggaatacctgctgaaaaaggtactcagcagcatgagcttggaggtgagcttgggtgagctggaggagcttctggcccaggaggcccaggtggcccagaccaccggggggctcagcgtctggcagttcctggagctcttcaattcgggccgctgcctgcggggcgtgggccgggacaccctcagcatggccatccacgaggtctaccaggagctcatccaagatgtcctgaagcagggctacctgtggaagcgagggcacctgagaaggaactgggccgaacgctggttccagctgcagcccagctgcctctgctactttgggagtgaagagtgcaaagagaaaaggggcattatcccgctggatgcacactgctgcgtggaggtgctgccagaccgcgacggaaagcgctgcatgttctgtgtgaagacagccacccgcacgtatgagatgagcgcctcagacacgcgccagcgccaggagtggacagctgccatccagatggcgatccggctgcaggccgaggggaagacgtccctacacaaggacctgaagcagaaacggcgcgagcagcgggagcagcgggagcggcgccgggcggccaaggaagaggagctgctgcggctgcagcagctgcaggaggagaaggagcggaagctgcaggagctggagctgctgcaggaggcgcagcggcaggccgagcggctgctgcaggaggaggaggaacggcgccgcagccagcaccgcgagctgcagcaggcgctcgagggccaactgcgcgaggcggagcaggcccgggcctccatgcaggctgagatggagctgaaggaggaggaggctgcccggcagcggcagcgcatcaaggagctggaggagatgcagcagcggttgcaggaggccctgcaactagaggtgaaagctcggcgagatgaagaatctgtgcgaatcgctcagaccagactgctggaagaggaggaagagaagctgaagcagttgatgcagctgaaggaggagcaggagcgctacatcgaacgggcgcagcaggagaaggaagagctgcagcaggagatggcacagcagagccgctccctgcagcaggcccagcagcagctggaggaggtgcggcagaaccggcagagggctgacgaggatgtggaggctgcccagagaaaactgcgccaggccagcaccaacgtgaaacactggaatgtccagatgaaccggctgatgcatccaattgagcctggagataagcgtccggtcaccagcagctccttctcaggcttccagccccctctgcttgcccaccgtgactcctccctaaagcgcctgacccgctggggatcccagggcaacaggaccccctcgcccaacagcaatgagcagcagaagtccctcaatggtggggatgaggctcctgccccggcttccacccctcaggaagataaactggatccagcaccagaaaattagcctctcttagccccttgttcttcccaatgtcatatccaccaggacctggccacagctggcctgtgggtgatcccagctcttactaggagagggagctgaggtcctggtgccaggggcccaggccctccaaccataaacagtccaggatggaacctggttcacccttcataccagctccaagccccagaccatgggagctgtctgggatgttgatccttgagaacttggccctgtgctttagacccaaggacccgattcctgggctaggaaagagagaacaagcaagccggggctacctgcccccaggtggccaccaagttgtggaagcacatttctaaataaaaactgctcttagaatgaaaaaatgg

SEQ ID NO: 448171 - DNA, 1103 bp, Homo sapiens
tgattatctacacataggctcttcctctcattgttaagcagaattcaccaagcgttggatggttcacccactaaggagatggagctgaaggaggaggaggctgcccggcagcggcagcgcatcaaggagctggaggagatgcagcagcggttgcaggaggccctgcaactagaggtgaaagctcggcgagatgaagaatctgtgcgaatcgctcagaccagactgctggaagaggaggaagagaagctgaagcagttgatgcagctgaaggaggagcaggagcgctacatcgaacgggcgcagcaggagaaggaagagctgcagcaggagatggcacagcagagccgctccctgcagcaggcccagcagcagctggaggaggtgcggcagaaccggcagagggctgacgaggatgtggaggctgcccagagaaaactgcgccaggccagcaccaacgtgaaacactggaatgtccagatgaaccggctgatgcatccaattgagcctggagataagcgtccggtcaccagcagctccttctcaggcttccagccccctctgcttgcccaccgtgactcctccctaaagcgcctgacccgctggggatcccagggcaacaggaccccctcgcccaacagcaatgagcagcagaagtccctcaatggtggggatgaggctcctgccccggcttccacccctcaggaagataaactggatccagcaccagaaaattagcctctcttagccccttgttcttcccaatgtcatatccaccaggacctggccacagctggcctgtgggtgatcccagctcttactaggagagggagctgaggtcctggtgccaggggcccaggccctccaaccataaacagtccaggatggaacctggttcacccttcataccagctccaagccccagaccatgggagctgtctgggatgttgatccttgagaacttggccctgtgctttagacccaaggacccgattcctgggctaggaaagagagaacaagcaagccggggctacctgcccccaggtggccaccaagttgtggaagcacatttctaaataaaaactgctcttagaatgaaaaaatgg

SEQ ID NO: 448172 - DNA, 1962 bp, Homo sapiens
cgcaggtaggaggaacgtaccaactgcgaggcggggggtgcgcgcgaagacccccgcaggctgcgcttccggaagtaacccctggcgcatcccggaatccagagcgcccactacggcctttggccaggccccctgggcgcgttccgggagctcaggcctgcggcgctgggagaagcacgctggccaacaagttgggtggtgggcacgcggcccaggggtcaggggccgccaggcggcgggcggcggggctgcggctcttacctgccgaggaggcgccggctctgcggtgcggagttgcgccggacttcccagcttggccagtggctccgcaggctgccggctccacccctcagattcatttggattcaaggttggctctcaacagtgccagctgcactgtcatcctaaagtacttctgtggaagagaacatggtggtgtcactgttgtaccagtgatgacacaaaatcccagatctacctgacgggcctgcgagggttgaagattgtgaagcaatagcctaagggactggctggcttcgagcagggcatcggaaccaggcctcctggcactggcctgggtagagccagggcgagcaccagctgacccccagtggaaccctgtgacagtcctgccagggcccaggccatcccaaccgacttccatctcatggaccctccagcggagaagccgggagaggctggcggactgcagatcacaccccagctgctgaagtcacgcacaggcgagttctccctggagtccatcctgctactgaagctgcgtggcttgggactggctgacctgggctgcctgggagagtgcctgggcctggagtggctggacctatcaggcaacgcgctcacccacctgggcccgctggcctccttgcgccagctagctgtgctcaatgtctccaacaatcggctgacgggcctggagccactggccacctgtgagaacttgcagagtctcaatgccgcaggcaacctactggccaccccgggccagctgcagtgtctggctgggctaccgtgcctggagtacctgcggctccgagaccctttggcccggctcagcaacccgctctgtgccaacccctcctactgggctgcagtccgggagctgctgcctggcctgaaagtcatcgacggtgagcgtgtgattgggcgtggtagtgagttctaccagctgtgccgagacctggacagctccttgcgtcccagctccagtccaggccccagagccaccgaggcccagccctgggtggagccaggctactgggagtcctggcccagccggagcagctccatcctggaggaggcctgccggcagttccaggacacactgcaggagtgctgggacctggaccgccaggccagcgacagcctggcccaggcggagcaggtactcagctctgcgggccccacctcttccttcgtcttctgaacgtggcctatggcccaggacagcctggcaggtggcctcgctgcccccagttcccctctctgcccccacactcgtcttagttgcttcacactggtcactggccctgcacactgggctattgctttatccctatcctgagagcagcccctccccaccatccctccacatgctgcaaggacagactgaagggctgtgagcaggtgtaagggctcccacatccgtgagcctgtgtccgcagctgctgccactctgggctgctccagcctgcaacttagtggaaggaattacttcctcctgaggctacaggcgagaaaggtagggatgggccagcctcccgtctcagctgttgggagacagtaggcaggctgagtggcccagagcactcctggaagtgggactcccctgccttgcaaatgtgcctctccagactgctcctgcacttaccccctccccgcagcaccttctctgcccgttcttgtccacacatctattaaatgcttctgttttcatttgca

SEQ ID NO: 448173 - DNA, 1800 bp, Homo sapiens
cgcaggtaggaggaacgtaccaactgcgaggcggggggtgcgcgcgaagacccccgcaggctgcgcttccggaagtaacccctggcgcatcccggaatccagagcgcccactacggcctttggccaggccccctgggcgcgttccgggagctcaggcctgcggcgctgggagaagcacgctggccaacaagttgggtggtgggcacgcggcccaggggtcaggggccgccaggcggcgggcggcggggctgcggctcttacctgccgaggaggcgccggctctgcggtgcggagttgcgccggacttcccagcttggccagtggctccgcaggctgccggctccacccctcagattcatttggattcaaggttggctctcaacagtgccagctgcactgtcatcctaaagtacttctgtggaagagaacatggtggtgtcactgttgtaccagtgatgacacaaaatcccagatctacctgacgggcctgcgagggttgaagattgtgaagcaatagcctaagggactggctggcttcgagcagggcatcggaaccaggcctcctggcactggcctgggtagagccagggcgagcaccagctgacccccagtggaaccctgtgacagtcctgccagggcccaggccatcccaaccgacttccatctcatggaccctccagcggagaagccgggagaggctggcggactgcagatcacaccccagctgctgaagtcacgcacaggcgagttctccctggagtccatcctgctactgaagctgcgtggcttgggactggctgacctgggctgcctgggagagtgcctgggcctggagtggctggacctatcaggcaacgcgctcacccacctgggcccgctggcctccttgcgccagctagctgtgctcaatgtctccaacaatcggctgacgggcctggagccactggccacctgtgagaacttgcagagtctcaatgccgcaggcaacctactggccaccccgggccagctgcagtgtctggctgggctaccgtgcctggagtacctgcggctccgagaccctttggcccggctcagcaacccgctctgtgccaacccctcctactgggctgcagtccgggagctgctgcctggcctgaaagtcatcgacggtgagcgtgtgattgggcgtggtagtgagttctaccagctgtgccgagacctggaccgccaggccagcgacagcctggcccaggcggagcaggtactcagctctgcgggccccacctcttccttcgtcttctgaacgtggcctatggcccaggacagcctggcaggtggcctcgctgcccccagttcccctctctgcccccacactcgtcttagttgcttcacactggtcactggccctgcacactgggctattgctttatccctatcctgagagcagcccctccccaccatccctccacatgctgcaaggacagactgaagggctgtgagcaggtgtaagggctcccacatccgtgagcctgtgtccgcagctgctgccactctgggctgctccagcctgcaacttagtggaaggaattacttcctcctgaggctacaggcgagaaaggtagggatgggccagcctcccgtctcagctgttgggagacagtaggcaggctgagtggcccagagcactcctggaagtgggactcccctgccttgcaaatgtgcctctccagactgctcctgcacttaccccctccccgcagcaccttctctgcccgttcttgtccacacatctattaaatgcttctgttttcatttgca

SEQ ID NO: 448174 - DNA, 1817 bp, Homo sapiens
cgcaggtaggaggaacgtaccaactgcgaggcggggggtgcgcgcgaagacccccgcaggctgcgcttccggaagtaacccctggcgcatcccggaatccagagcgcccactacggcctttggccaggccccctgggcgcgttccgggagctcaggcctgcggcgctgggagaagcacgctggccaacaagttgggtggtgggcacgcggcccaggggtcaggggccgccaggcggcgggcggcggggctgcggctcttacctgccgaggaggcgccggctctgcggtgcggagttgcgccggacttcccagcttggccagtggctccgcaggctgccggctccacccctcagattcatttggattcaaggttggctctcaacagtgccagctgcactgtcatcctaaagtacttctgtggaagagaacatggtggtgtcactgttgtaccagtgatgacacaaaatcccagatctacctgacgggcctgcgagggttgaagattgtgaagcaatagcctaagggactggctggcttcgagcagggcatcggaaccaggcctcctggcactggcctgggtagagccagggcgagcaccagctgacccccagtggaaccctgtgacagtcctgccagggcccaggccatcccaaccgacttccatctcatggaccctccagcggagaagccgggagaggctggcggactgcagatcacaccccagctgctgaagtcacgcacaggcgagttctccctggagtccatcctgctactgaagctgcgtggcttgggactggctgacctgggctgcctgggagagtgcctgggcctggagtggctggacctatcaggcaacgcgctcacccacctgggcccgctggcctccttgcgccagctagctgtgctcaatgtctccaacaatcggctgacgggcctggagccactggccacctgtgagaacttgcagagtctcaatgccgcaggcaacctactggccaccccgggccagctgcagtgtctggctgggctaccgtgcctggagtacctgcggctccgagaccctttggcccggctcagcaacccgctctgtgccaacccctcctactgggctgcagtccgggagctgctgcctggcctgaaagtcatcgacggtgagcgtgtgattgggcgtggtagtgagttctaccagctgtgccgagacctggacagctccttgcgtcccagctccagtccaggccccagagccaccgaggcccagccctgggtggagccaggctactgggagtcctggcccagccggagcagctccatcctggaggaggcctgccggcagttccaggacacactgcaggagtgctgggacctggaccgccaggccagcgacagcctggcccaggcggagcaggtactcagctctgcgggccccacctcttccttcgtcttctgaacgtggcctatggcccaggacagcctggcaggtggcctcgctgcccccagttcccctctctgcgctcccacatccgtgagcctgtgtccgcagctgctgccactctgggctgctccagcctgcaacttagtggaaggaattacttcctcctgaggctacaggcgagaaaggtagggatgggccagcctcccgtctcagctgttgggagacagtaggcaggctgagtggcccagagcactcctggaagtgggactcccctgccttgcaaatgtgcctctccagactgctcctgcacttaccccctccccgcagcaccttctctgcccgttcttgtccacacatctattaaatgcttctgttttcatttgca

SEQ ID NO: 448175 - DNA, 1546 bp, Homo sapiens
  misc_feature (1514)..(1514): n is a, c, g, or t
cgcaggtaggaggaacgtaccaactgcgaggcggggggtgcgcgcgaagacccccgcaggctgcgcttccggaagtaacccctggcgcatcccggaatccagagcgcccactacggcctttggccaggccccctgggcgcgttccgggagctcaggcctgcggcgctgggagaagcacgctggccaacaagttgggtggtgggcacgcggcccaggggtcaggggccgccaggcggcgggcggcggggctgcggctcttacctgccgaggaggcgccggctctgcggtgcggagttgcgccggacttcccagcttggccagtggctccgcaggctgccggctccacccctcagattcatttggattcaaggttggctctcaacagtgccagctgcactgtcatcctaaagtacttctgtggaagagaacatggtggtgtcactgttgtaccagtgatgacacaaaatcccagatctacctgacgggcctgcgagggttgaagattgtgaagcaatagcctaagggactggctggcttcgagcagggcatcggaaccaggcctcctggcactggcctgggtagagccagggcgagcaccagctgacccccagtggaaccctgtgacagtcctgccagggcccaggccatcccaaccgacttccatctcatggaccctccagcggagaagccgggagaggctggcggactgcagatcacaccccagctgctgaagtcacgcacaggcgagttctccctggagtccatcctgctactgaagctgcgtggcttgggactggctgacctgggctgcctgggagagtgcctgggcctggagtggctggacctatcaggcaacgcgctcacccacctgggcccgctggcctccttgcgccagctagctgtgctcaatgtctccaacaatcggctgacgggcctggagccactggccacctgtgagaacttgcagagtctcaatgccgcaggcaacctactggccaccccgggccagctgcagtgtctggctgggctaccgtgcctggagtacctgcggctccgagaccctttggcccggctcagcaacccgctctgtgccaacccctcctactgggctgcagtccgggagctgctgcctggcctgaaagtcatcgacggtgagcgtgtgattgggcgtggtagtgagttctaccagctgtgccgagacctggacagctccttgcgtcccagctccagtccaggccccagagccaccgaggcccagccctgggtggagccaggctactgggagtcctggcccagccggagcagctccatcctggaggaggcctgccggcagttccaggacacactgcaggagtgctgggacctggaccgccaggccagcgacagcctggcccaggcggagcaggtactcagctctgcgggccccacctcttccttcgtcttctgaacgtggcctatggcccaggacagcctggcaggtggcctcgctgcccccagttcccctctctgctatnttgtcctggaatatttttggggttggaactca

SEQ ID NO: 448176 - DNA, 1586 bp, Homo sapiens
cgcaggtaggaggaacgtaccaactgcgaggcggggggtgcgcgcgaagacccccgcaggctgcgcttccggaagtaacccctggcgcatcccggaatccagagcgcccactacggcctttggccaggccccctgggcgcgttccgggagctcaggcctgcggcgctgggagaagcacgctggccaacaagttgggtggtgggcacgcggcccaggggtcaggggccgccaggcggcgggcggcggggctgcggctcttacctgccgaggaggcgccggctctgcggtgcggagttgcgccggacttcccagcttggccagtggctccgcaggctgccggctccacccctcagattcatttggattcaaggttggctctcaacagtgccagctgcactgtcatcctaaagtacttctgtggaagagaacatggtggtgtcactgttgtaccagtgatgacacaaaatcccagatctacctgacgggcctgcgagggttgaagattgtgaagcaatagcctaagggactggctggcttcgagcagggcatcggaaccaggcctcctggcactggcctgggtagagccagggcgagcaccagctgacccccagtggaaccctgtgacagtcctgccagggcccaggccatcccaaccgacttccatctcatggaccctccagcggagaagccgggagaggctggcggactgcagatcacaccccagctgctgaagtcacgcacaggcgagttctccctggagtccatcctgctactgaagctgcgtggcttgggactggctgacctgggctgcctgggagagtgcctgggcctggagtggctggacctatcaggcaacgcgctcacccacctgggcccgctggcctccttgcgccagctagctgtgctcaatgtctccaacaatcggctgacgggcctggagccactggccacctgtgagaacttgcagagtctcaatgccgcaggcaacctactggccaccccgggccagctgcagtgtctggctgggctaccgtgcctggagtacctgcggctccgagaccctttggcccggctcagcaacccgctctgtgccaacccctcctactgggctgcagtccgggagctgctgcctggcctgaaagtcatcgacggtgagcgtgtgattgggcgtggtagtgagttctaccagctgtgccgagacctggacagctccttgcgtcccagctccagtccaggccccagagccaccgaggcccagccctgggtggagccaggctactgggagtcctggcccagccggagcagctccatcctggaggaggcctgccggcagttccaggacacactgcaggagtgctgggacctggaccgccaggccagcgacagcctggcccaggcggagcaggtactcagctctgcgggccccacctcttccttcgtcttctgaacgtggcctatggcccaggacagcccctgccttgcaaatgtgcctctccagactgctcctgcacttaccccctccccgcagcaccttctctgcccgttcttgtccacacatctattaaatgcttctgttttcatttgca

SEQ ID NO: 448177 - DNA, 1792 bp, Homo sapiens
cgcaggtaggaggaacgtaccaactgcgaggcggggggtgcgcgcgaagacccccgcaggctgcgcttccggaagtaacccctggcgcatcccggaatccagagcgcccactacggcctttggccaggccccctgggcgcgttccgggagctcaggcctgcggcgctgggagaagcacgctggccaacaagttgggtggtgggcacgcggcccaggggtcaggggccgccaggcggcgggcggcggggctgcggctcttacctgccgaggaggcgccggctctgcggtgcggagttgcgccggacttcccagcttggccagtggctccgcaggctgccggctccacccctcagggactggctggcttcgagcagggcatcggaaccaggcctcctggcactggcctgggtagagccagggcgagcaccagctgacccccagtggaaccctgtgacagtcctgccagggcccaggccatcccaaccgacttccatctcatggaccctccagcggagaagccgggagaggctggcggactgcagatcacaccccagctgctgaagtcacgcacaggcgagttctccctggagtccatcctgctactgaagctgcgtggcttgggactggctgacctgggctgcctgggagagtgcctgggcctggagtggctggacctatcaggcaacgcgctcacccacctgggcccgctggcctccttgcgccagctagctgtgctcaatgtctccaacaatcggctgacgggcctggagccactggccacctgtgagaacttgcagagtctcaatgccgcaggcaacctactggccaccccgggccagctgcagtgtctggctgggctaccgtgcctggagtacctgcggctccgagaccctttggcccggctcagcaacccgctctgtgccaacccctcctactgggctgcagtccgggagctgctgcctggcctgaaagtcatcgacggtgagcgtgtgattgggcgtggtagtgagttctaccagctgtgccgagacctggacagctccttgcgtcccagctccagtccaggccccagagccaccgaggcccagccctgggtggagccaggctactgggagtcctggcccagccggagcagctccatcctggaggaggcctgccggcagttccaggacacactgcaggagtgctgggacctggaccgccaggccagcgacagcctggcccaggcggagcaggtactcagctctgcgggccccacctcttccttcgtcttctgaacgtggcctatggcccaggacagcctggcaggtggcctcgctgcccccagttcccctctctgcccccacactcgtcttagttgcttcacactggtcactggccctgcacactgggctattgctttatccctatcctgagagcagcccctccccaccatccctccacatgctgcaaggacagactgaagggctgtgagcaggtgtaagggctcccacatccgtgagcctgtgtccgcagctgctgccactctgggctgctccagcctgcaacttagtggaaggaattacttcctcctgaggctacaggcgagaaaggtagggatgggccagcctcccgtctcagctgttgggagacagtaggcaggctgagtggcccagagcactcctggaagtgggactcccctgccttgcaaatgtgcctctccagactgctcctgcacttaccccctccccgcagcaccttctctgcccgttcttgtccacacatctattaaatgcttctgttttcatttgca

SEQ ID NO: 448178 - DNA, 2053 bp, Homo sapiens
cgcaggtaggaggaacgtaccaactgcgaggcggggggtgcgcgcgaagacccccgcaggctgcgcttccggaagtaacccctggcgcatcccggaatccagagcgcccactacggcctttggccaggccccctgggcgcgttccgggagctcaggcctgcggcgctgggagaagcacgctggccaacaagttgggtggtgggcacgcggcccaggggtcaggggccgccaggcggcgggcggcggggctgcggctcttacctgccgaggaggcgccggctctgcggtgcggagttgcgccggacttcccagcttggccagtggctccgcaggctgccggctccacccctcagattcatttggattcaaggttggctctcaacagtgccagctgcactgtcatcctaaagtacttctgtggaagagaacatggtggtgtcactgttgtaccagtgatgacacaaaatcccagatctacctgacgggcctgcgagggttgaagattgtgaagcaatagcctaagggactggctggcttcgagcagggcatcggaaccaggcctcctggcactggcctgggtagagccagggcgagcaccagctgacccccagtggaaccctgtgacagtcctgccagggcccaggccatcccaaccgacttccatctcatggaccctccagcggagaagccgggagaggctggcggactgcagatcacaccccagctgctgaagtcacgcacaggcgagttctccctggagtccatcctgctactgaagctgcgtggcttgggactggctgacctgggctgcctgggagagtgcctgggcctggagtggctggacctatcaggcaacgcgctcacccacctgggcccgctggcctccttgcgccagctagctgtgctcaatgtctccaacaatcggctgacgggcctggagccactggccacctgtgagaacttgcagagtctcaatgccgcaggcaacctactggccaccccgggccagctgcagtgtctggctgggctaccgtgcctggagtacctgcggctccgagaccctttggcccggctcagcaacccgctctgtgccaacccctcctactgggctgcagtccgggagctgctgcctggcctgaaagtcatcgacggtgagcgtgtgattgggcgtggtagtgagttctaccagctgtgccgagacctggacagctccttgcgtcccagctccagtccaggccccagagccaccgaggcccagccctgggtggagccaggctactgggagtcctggcccagccggagcagctccatcctggaggaggcctgccggcagttccaggacacactgcaggagtgctgggacctggaccgccaggccagcgacagcctggcccaggcggagcaggtactcagctctgcgggccccacctcttccttcgtcttctgaacgtggcctatggcccaggacagcctggcaggtggcctcgctgcccccagttcccctctctgcccccacactcgtcttagttgcttcacactggtcactggccctgcacactgggctattgctttatccctatcctgagagcagcccctccccaccatccctccacatgctgcaaggacagactgaagggctgtgagcaggtgtaagggctcccacatccgtgagcctgtgtccgcagctgctgccactctgggctgctccagcctgcaacttagtggaaggaattacttcctcctgaggctacaggcgagaaaggtagggatgggccagcctcccgtctcagctgttgggagacagtaggcaggctgagtggcccagagcactcctggaagtgggactcccctgccttgcaaatgtgcctctccagactgctcctgcacttaccccctccccgcagcaccttctctgcccgttcttgtccacacatctattaaatgcttctgttttcatttgcatccctgcctggcatttcatgggggcacctctggctctggagcacaggaggctctgctcaccctgcccacaggaaggggtcccagaggaagg

SEQ ID NO: 448179 - DNA, 1839 bp, Homo sapiens
cgcaggtaggaggaacgtaccaactgcgaggcggggggtgcgcgcgaagacccccgcaggctgcgcttccggaagtaacccctggcgcatcccggaatccagagcgcccactacggcctttggccaggccccctgggcgcgttccgggagctcaggcctgcggcgctgggagaagcacgctggccaacaagttgggtggtgggcacgcggcccaggggtcaggggccgccaggcggcgggcggcggggctgcggctcttacctgccgaggaggcgccggctctgcggtgcggagttgcgccggacttcccagcttggccagtggctccgcaggctgccggctccacccctcagattcatttggattcaaggttggctctcaacagtgccagctgcactgtcatcctaaagtacttctgtggaagagaacatggtggtgtcactgttgtaccagtgatgacacaaaatcccagatctacctgacgggcctgcgagggttgaagattgtgaagcaatagcctaagggactggctggcttcgagcagggcatcggaaccaggcctcctggcactggcctgggtagagccagggcgagcaccagctgacccccagtggaaccctgtgacagtcctgccagggcccaggccatcccaaccgacttccatctcatggaccctccagcggagaagccgggagaggctggcggactgcagatcacaccccagctgctgaagtcacgcacaggcgagttctccctggagtccatcctgctactgaagctgcgtggcttgggactggctgacctgggctgcctgggagagtgcctgggcctggagtggctggacctatcaggcaacgcgctcacccacctgggcccgctggcctccttgcgccagctagctgtgctcaatgtctccaacaatcggctgacgggcctggagccactggccacctgtgagaacttgcagagtctcaatgccgcaggcaacctactggccaccccgggccagctgcagtgtctggctgggctaccgtgcctggagtacctgcggctccgagaccctttggcccggctcagcaacccgctctgtgccaacccctcctactgggctgcagtccgggagctgctgcctggcctgaaagtcatcgacggtgagcgtgtgattgggcgtggtagtgagttctaccagctgtgccgagacctggacagctccttgcgtcccagctccagtccaggccccagagccaccgaggcccagccctgggtggagccaggctactgggagtcctggcccagccggagcagctccatcctggaggaggcctgccggcagttccaggacacactgcaggagtgctgggacctggaccgccaggccagcgacagcctggcccaggcggagcaggtactcagctctgcgggccccacctcttccttcgtcttctgaacgtggcctatggcccaggacagcctggcaggtggcctcgctgcccccagttcccctctctgcccccacactcgtcttagttgcttcacactggtcactggccctgcacactgggctattgctttatccctatcctgagagcagcccctccccaccatccctccacatgctgcaaggacagactgaagggctgtgagcaggtgtaaggctcccgtctcagctgttgggagacagtaggcaggctgagtggcccagagcactcctggaagtgggactcccctgccttgcaaatgtgcctctccagactgctcctgcacttaccccctccccgcagcaccttctctgcccgttcttgtccacacatctattaaatgcttctgttttcatttgca

SEQ ID NO: 448180 - DNA, 1709 bp, Homo sapiens
cgcaggtaggaggaacgtaccaactgcgaggcggggggtgcgcgcgaagacccccgcaggctgcgcttccggaagtaacccctggcgcatcccggaatccagagcgcccactacggcctttggccaggccccctgggcgcgttccgggagctcaggcctgcggcgctgggagaagcacgctggccaacaagttgggtggtgggcacgcggcccaggggtcaggggccgccaggcggcgggcggcggggctgcggctcttacctgccgaggaggcgccggctctgcggtgcggagttgcgccggacttcccagcttggccagtggctccgcaggctgccggctccacccctcagattcatttggattcaaggttggctctcaacagtgccagctgcactgtcatcctaaagtacttctgtggaagagaacatggtggtgtcactgttgtaccagtgatgacacaaaatcccagatctacctgacgggcctgcgagggttgaagattgtgaagcaatagcctaagggactggctggcttcgagcagggcatcggaaccaggcctcctggcactggcctgggtagagccagggcgagcaccagctgacccccagtggaaccctgtgacagtcctgccagggcccaggccatcccaaccgacttccatctcatggaccctccagcggagaagccgggagaggctggcggactgcagatcacaccccagctgctgaagtcacgcacaggcgagttctccctggagtccatcctgctactgaagctgcgtggcttgggactggctgacctgggctgcctgggagagtgcctgggcctggagtggctggacctatcaggcaacgcgctcacccacctgggcccgctggcctccttgcgccagctagctgtgctcaatgtctccaacaatcggctgacgggcctggagccactggccacctgtgagaacttgcagagtctcaatgccgcaggcaacctactggccaccccgggccagctgcagtgtctggctgggctaccgtgcctggagtacctgcggctccgagaccctttggcccggctcagcaacccgctctgtgccaacccctcctactgggctgcagtccgggagctgctgcctggcctgaaagtcatcgacggtgagcgtgtgattgggcgtggtagtgagttctaccagctgtgccgagacctggacagctccttgcgtcccagctccagtccaggccccagagccaccgaggcccagccctgggtggagccaggctactgggagtcctggcccagccggagcagctccatcctggaggaggcctgccggcagttccaggacacactgcaggagtgctgggacctggaccgccaggccagcgacagcctggcccaggcggagcaggtactcagctctgcgggccccacctcttccttcgtcttctgaacgtggcctatggcccaggacagcctggcaggtggcctcgctgcccccagttcccctctctgcccccacactcgtcttagttgcttcacactggtcactggccctgcacactgggctattgctttatccctatcctgagagcagcccccctgccttgcaaatgtgcctctccagactgctcctgcacttaccccctccccgcagcaccttctctgcccgttcttgtccacacatctattaaatgcttctgttttcatttgca

SEQ ID NO: 448181 - DNA, 1509 bp, Homo sapiens
cgcaggtaggaggaacgtaccaactgcgaggcggggggtgcgcgcgaagacccccgcaggctgcgcttccggaagtaacccctggcgcatcccggaatccagagcgcccactacggcctttggccaggccccctgggcgcgttccgggagctcaggcctgcggcgctgggagaagcacgctggccaacaagttgggtggtgggcacgcggcccaggggtcaggggccgccaggcggcgggcggcggggctgcggctcttacctgccgaggaggcgccggctctgcggtgcggagttgcgccggacttcccagcttggccagtggctccgcaggctgccggctccacccctcagattcatttggattcaaggttggctctcaacagtgccagctgcactgtcatcctaaagtacttctgtggaagagaacatggtggtgtcactgttgtaccagtgatgacacaaaatcccagatctacctgacgggcctgcgagggttgaagattgtgaagcaatagcctaagggactggctggcttcgagcagggcatcggaaccaggcctcctggcactggcctgggtagagccagggcgagcaccagctgacccccagtggaaccctgtgacagtcctgccagggcccaggccatcccaaccgacttccatctcatggaccctccagcggagaagccgggagaggctggcggactgcagatcacaccccagctgctgaagtcacgcacaggcgagttctccctggagtccatcctgctactgaagctgcgtggcttgggactggctgacctgggctgcctgggagagtgcctgggcctggagtggctggacctatcaggcaacgcgctcacccacctgggcccgctggcctccttgcgccagctagctgtgctcaatgtctccaacaatcggctgacgggcctggagccactggccacctgtgagaacttgcagagtctcaatgccgcaggcaacctactggccaccccgggccagctgcagtgtctggctgggctaccgtgcctggagtacctgcggctccgagaccctttggcccggctcagcaacccgctctgtgccaacccctcctactgggctgcagtccgggagctgctgcctggcctgaaagtcatcgacggtgagcgtgtgattgggcgtggtagtgagttctaccagctgtgccgagacctggacagctccttgcgtcccagctccagtccaggccccagagccaccgaggcccagccctgggtggagccaggctactgggagtcctggcccagccaggcgagaaaggtagggatgggccagcctcccgtctcagctgttgggagacagtaggcaggctgagtggcccagagcactcctggaagtgggactcccctgccttgcaaatgtgcctctccagactgctcctgcacttaccccctccccgcagcaccttctctgcccgttcttgtccacacatctattaaatgcttctgttttcatttgca

SEQ ID NO: 448182 - DNA, 260 bp, Homo sapiens
taaaaagaaaaccatgatcaacaagctttgccacgaatttaagagttttatcaagatatatcgaatacagcatgggattgggaaagttaactaaaggtatttgagcttgcactggatcttgaaaggtagaaaaagggagcaggaggaaactcatccaggtaagaaaaatagactgtgcaagatgggcatgagaaacagtgaggtccctggctggaggtgggtgctagtcatgttgagcactgctggcaggagaggttttt

SEQ ID NO: 448183 - DNA, 735 bp, Homo sapiens
agagatgagaagacctaaatgaagcttttttgaaaaaggagagatattatgaacagaggcccattaatgttaaatttgaagtggagtgatgaggaacagcttcttactagaacagtgttttataatccattagccacaatttatacttggatctcaaaggccaggatcagtattattgctacttctgtagcttcttccctatagctcatgggcatttctgggtcagtgaagggggagaagacccaaagaaactgaaatccacctttttgtattcctgcactgcttctaatcatatttgctcagtaaaggggccaaatagattattcgtgcactgagcaacagtagatttcctaggaagaagcttgtgtcagggaaatatgagtgaggaatgggctggttgatagtgtgtggtccctgagggggagatggtattctagcacataggaggctgtttttcctgtttttccccccccccagagcttataatgatacatgaatacgaaaaataattaatagcatgagtggcagaggaatgggaggataagcatgggattgggaaagttaactaaaggtatttgagcttgcactggatcttgaaaggtagaaaaagggagcaggaggaaactcatccaggtaagaaaaatagactgtgcaagatgggcatgagaaacagtgaggtccctggctggaggtgggtgctagtcatgttgagcactgctggcaggagaggttttt

SEQ ID NO: 448184 - DNA, 1072 bp, Homo sapiens
cttccttgataactgcttcaaagagggaaaggaagattttaattgcttcaaagagggaaaggaagaaagcacagaaatctaatgcaagtaaaggcacaatgaatgtggagttgaatggaaccaaacccttccttgataactgctgtttctttctactcttgtttctggcaatttagtgggttccttctctagtggtcttaaatctcattccactggtggcaagatggggcctagccttcttttcacatgtctaatcttttcctttctcatggtgccctccatggaagtcacagtcaacactgaataaatgactagaatgacacgtgtgcgtgcgcacgcgtgtgcgtgtgtgtgttcatctgtctgcatgtggatcaatttcttttagaaaataatttattgtatgatttattttggagttatattctgattacagtgctccctctcccaaatagcattgattttttcccccctctaaaatgtataatctggtctcaggttggattctttggtacatttctctcttctggatgccatgcagcttaattaaaaccttgcttaaaaacaaaaagtgaaaattgtgtactcttgtctggaataccgcctcaggtggtggcacagagaggggagaaaacctttgcctcataatttgggtaagtgtagtggtttgattccaggtcccttgaaaaagtagatctactgaattgggcagactcatctatagctttctgagggtcttctctcctcctctccagctgtattttgaaaattacagttctagttggctgggcgcgatggctcatgtctgtaatcccagcactttgggaggccaaggcgggtggatcatttgaggtcaggagttcgagaccagcttggccaacatggtgaaaccccgtctctactgaaaatacaaaaattaaccggtgtcatggcgcatgcctgtggtcccagctactcgggaggccgaggcaggaaaatcacttgaacccaggaggcggaggttgcactgagctgagatcatgccactgcactaaaaaaaaaaaaaaaaaaaaaaaaaaaaaaaaaaaaaaaa

SEQ ID NO: 448185 - DNA, 5876 bp, Homo sapiens
ggagcagatccatttccgggttggcaaaaggggcggtggcggcggcggcggcggcggcggcggcggcggcggcgacggcgagaaagagcttgccggggggcgagcaggacaggacgaagccggagtgtaggcggcagaggattcgctcccagagcagctgcggccaggtatatgaatgacctaaaggtacaaataaagacggagagagaacagtgccaactgggagcagggcaagaatgccaattcctcctcccccgccacccccacctggtcctcctccacctcccacatttcatcaggcaaacacagagcagcccaagctgagtagagatgagcagcggggtcgaggcgccctcttacaggacatttgcaaagggaccaagctgaagaaggtgaccaacattaatgatcggagtgctcccatcctcgagaagccgaaaggaagcagtggtggctatggctctggaggagctgccctgcagcccaagggaggtctcttccaaggaggagtgctgaagcttcgacctgtgggagccaaggatggttcagagaacctagctggtaagccagccctgcaaatccccagttctcgagctgctgccccaaggcctccagtatctgccgccagcgggcgtcctcaggatgatacagacagcagccgggcctcactcccagaactgccccggatgcagagaccctctttaccggacctctctcggcctaataccaccagcagtacgggcatgaagcacagctcctctgcccctcccccaccacccccagggcggcgtgccaacgcaccccccacacctctgcctatgcacagcagcaaagcccccgcctacaacagagagaaacccttgccaccgacgcctggacaaaggcttcaccctggtcgagagggacctcctgctccacccccagtcaaaccacctccttcccctgtgaatatcagaacaggaccaagtggccagtctctggctcctcctcctccgccttaccgccagcctcctggggtccccaatggaccctctagccccactaatgagtcagcccctgagctgccacagagacacaattctttgcataggaagacaccagggcctgtcagaggcctagcacctcctccacccacctcggcctccccatctttactgagtaataggccacctcccccagcccgagaccctcccagtcggggaggccaccccctcctcctccaccgcccctgaggaatggccacagagattctatcaccactgtccggtctttcttggatgattttgagtcaaagtattccttccatccagtagaagactttcctgctccagaagaatataaacactttcagaggatatatcccagcaaaacaaaccgagctgcccgtggagccccacctctgccacccattctcaggtgaagcctggcttggtcccgttcctcaggaaaaggatggaccttctcttcttctcagatggtcccttccattcccctgaaacctgcatgagagctcctaacatgtttctccaatgcaatcaagccctagactccaaatgtcctcccagctcacctccatctatgcatctcatctctggatttggtgatcagactctatattgacagtaggatctcaaaccctgcatccatccttcctccagcaagccctgctagccacatgaggaacaagtttccgtgtcttctgccttcctcttggggaaaggtgccttgttgtgatgaattaactcactgttagggcagggtggagaatggtactccttccttctcctgtccactgtgggggaagcttggcaggtatattatatttcatcatttaggaggctggcatgaccaggacttatgggtgggaggggagcatttttagtgaagcaagaaaggagtttgccaagaagtgatctgttttaaaggtcatatttggagaaagggcaaggaattgggtctgctttatttttgggggtattttgtttttgttctcacctgctgcccccccaccccaccaccccagggataaattggatataaacactaaatactaatcagttgaacttaacatttaataaaaagaaagggtgaaataaactgaagaccattttagaactagtcagttctctgcagcaaagggaacaggagccatttgaaccctctgggacccctcaccccactgcttcagggtgctaggctgagggatgtttttcctcccccttaccgcccatgcccttgaaagaaaagtcactttttgtggagggcatcattcattcctgattcacaaaccccaaaaacctctggtgggagataggaagatagggcgtgggcctgggccttaacctcaatcttgtgtctgcctcagtcttttctgactggccctgaagttgtcagtggctctttctgtccttcagcccctggaaggtgctccaggataacaaagaagggcaggttgaagcccctcatggaaggagctggctttgtggggctgcaaaggacttttaagtcctgcctgtactgaagttcacagcccacctgactgagcagactcttcctgttcctttctctaccacccttgccttcccaggactgcacggtttaacacagcagagtacagaagggtgaagaagtgagcagaggcttatgaagatattcagatactcttctatgccaggaagcacaaagactttgttgagatttgcctcagttcagtagatcttccttggcagccagccataggttgtttctttgtcttccgggtcctaaagagcacagagaaaatggaggtccccagtctaggtaggaagctgattggatgaggacttctttttttccgacagcaggatggggctcttgggctccacacaccagatgctttggttttctacaactgttgctatgtgtagagggtgctcagagcgtggcatgagagcaaggagaccatggctactctttgaaatggatggggaaaattagcttaaaaatttaatcacgagattgcgccactgcactccagcctgggcgacagagccagactccgtctcaaaaaaaaaaaaaaaaaaaaatttaatcacacacatcacaggcttaaactgtcttagagacctttccagttgattggatcacaggctagggatctgtgcatggtgccaggtgaaacccaagtctccccagtgctaggtgagggagggctcaacgggggtaatgtgtatggggtctgctgtcctttgccatcccctggaccatattaactctgggacagaccatgattaggtctgtcaccaaacttttcctaatcattttttatgtatcattcttctttctaatctgttagcagttatctcccagaagtatccctagcatcctgaagcaaacagaactgccgggcgctgtggcttatgcctgtaatctcagcaatttgggaggccgaggcgggcggatcacctgaggtcagaagttcgagaccagcctgtccaacatggtgaaaccccgtctccactaaaaacacaaaaattatctgggcgtggtggcatgtgcctgtagtcccagctactggggaggctgaggcaggagaatcgcttgaatccaggaggtggaggttgcagtgagtggagatggcgccactgcgctccagcccgggtgacagagtgaaactccatctcagaaaacaaacaaaccaaacaactgagagagggcatgctagtggagggaaaaggagagagtacaagagttgatactgcatcagagttccagggcagatactgacaagtgactgaactttgactgtgaagtcttcccatttatttttgaaatgggagtcgatgccttttgtacgttatcaaagtgtttttttttttttcctcctttactcagacatagagcatcaaaatatcacgagtaaagccaaaccccagcttttcactggggctgatatcttcctccccatggcccactgccccctcatattccccagcacttggactgtgtcacatgggtattgattgtatacttgttgtcttggcctcatgcaaaaaggcctgggtctagatctagtcagatgagttttttttagagcatgttgatgatacaacacctgtttaaatgtctgccttatatgttatttggtcccactgttaataatagatttattactatgtatatttactattgaagatgggaatgtgatctgcatagttatcagtctattttgtatgttgtaaaaagcttctaatttaggtttaaggtgggctggctacaagagcactaaaactcctcaccttttaaactgctctttttatctgcttgtgggaatgtcgtctctttcgtggaagattgggtggtctcatgttgaggctgttgcccagtcccattaactcccttgtccccccacagaaggaagagacattgcccagctaagcatcaggaagctgtgttaaaagcccttctatgggtttggttttgtgatgtttttccctaatgggaaaaacgttatagttgtttcttactgccctgtctgggaagcagggcaaacctccaggtttttaaatgagctagatgcccctcttcctcttctctggtcactgaacctggaccaaagcactttgatattccaggtgtgattttctctgtcatggggatttgctccactgcagagccccatcattttcacagcgtaggccaacagagtgagaacctagggctaccctagctgatggatgtgaggctgctgtctacaggagctcatcccagccctgttaactggcagtggcaaggatactcgtcatcggccattgcactggggaactccctcaccccatggcttcccaacttgaaacccagatttacctccagggagaggtgagaaaaaaattgtaaatagacttgctaaagagcaactcagggttggggtgtgttttaattctcctgatcacttgaaataatctgtaggctgagtgcttatgggggtgggggagaagggtgactccagggtccttccattttgtgaagctctgggggtggagtgtgggcatctgaggccctatgatggcactacattgagctgtctgcccttccggaaacccaacctgcaatcaactgcaaatcaaattcttcacattccagctacagtctttctttccccattgaatctcagtccctggccatgtggtcaaggtggctttctgttaagctaccctaatttcgggaatgggaggggagagaggagggccattacaactctgccttcaagactcatctcttaaaaacaaaacgaaacaaaactacaaccaccatcaaaaccacacgcaaaaaaaaaaaaaaaaaaaaaaaaggataactttaaccgaaggaagggtttggttccattcaactccacattcattgtgcctttacttgcattagatttctgtgctttcttcctttccctctttgaagcaattaaaatcttccttgataactgctgtttctttctactcttgtttctggcaatttagtgggttccttctctagtggtcttaaatctcattccactggtggcaagatggggcctagccttcttttcacatgtctaatcttttcctttctcatggtgccctccatggaagtcacagtcaacactgaataaatgactagaatgacacgtgtgcgtgcgcacgcgtgtgcgtgtgtgtgttcatctgtctgcatgtggatcaatttcttttagaaaataatttattgtatgatttattttggagttatattctgattacagtgctccctctcccaaatagcattgattttttcccccctctaaaatgtataatctggtctcaggttggattctttggtacatttctctcttctggatgccatgcagcttaattaaaaccttgctt

SEQ ID NO: 448186 - DNA, 6388 bp, Homo sapiens
ggagcagatccatttccgggttggcaaaaggggcggtggcggcggcggcggcggcggcggcggcggcggcggcgacggcgagaaagagcttgccggggggcgagcaggacaggacgaagccggagtgtaggcggcagaggattcgctcccagagcagctgcggccaggtatatgaatgacctaaaggtacaaataaagacggagagagaacagtgccaactgggagcagggcaagaatgccaattcctcctcccccgccacccccacctggtcctcctccacctcccacatttcatcaggcaaacacagagcagcccaagctgagtagagatgagcagcggggtcgaggcgccctcttacaggacatttgcaaagggaccaagctgaagaaggtgaccaacattaatgatcggagtgctcccatcctcgagaagccgaaaggaagcagtggtggctatggctctggaggagctgccctgcagcccaagggaggtctcttccaaggaggagtgctgaagcttcgacctgtgggagccaaggatggttcagagaacctagctggtaagccagccctgcaaatccccagttctcgagctgctgccccaaggcctccagtatctgccgccagcgggcgtcctcaggatgatacagacagcagccgggcctcactcccagaactgccccggatgcagagaccctctttaccggacctctctcggcctaataccaccagcagtacgggcatgaagcacagctcctctgcccctcccccaccacccccagggcggcgtgccaacgcaccccccacacctctgcctatgcacagcagcaaagcccccgcctacaacagagagaaacccttgccaccgacgcctggacaaaggcttcaccctggtcgagagggacctcctgctccacccccagtcaaaccacctccttcccctgtgaatatcagaacaggaccaagtggccagtctctggctcctcctcctccgccttaccgccagcctcctggggtccccaatggaccctctagccccactaatgagtcagcccctgagctgccacagagacacaattctttgcataggaagacaccagggcctgtcagaggcctagcacctcctccacccacctcggcctccccatctttactgagtaataggccacctcccccagcccgagaccctcccagtcggggaggccaccccctcctcctccaccgcccctgaggaatggccacagagattctatcaccactgtccggtctttcttggatgattttgagtcaaagtattccttccatccagtagaagactttcctgctccagaagaatataaacactttcagaggatatatcccagcaaaacaaaccgagctgcccgtggagccccacctctgccacccattctcaggtgaagcctggcttggtcccgttcctcaggaaaaggatggaccttctcttcttctcagatggtcccttccattcccctgaaacctgcatgagagctcctaacatgtttctccaatgcaatcaagccctagactccaaatgtcctcccagctcacctccatctatgcatctcatctctggatttggtgatcagactctatattgacagtaggatctcaaaccctgcatccatccttcctccagcaagccctgctagccacatgaggaacaagtttccgtgtcttctgccttcctcttggggaaaggtgccttgttgtgatgaattaactcactgttagggcagggtggagaatggtactccttccttctcctgtccactgtgggggaagcttggcaggtatattatatttcatcatttaggaggctggcatgaccaggacttatgggtgggaggggagcatttttagtgaagcaagaaaggagtttgccaagaagtgatctgttttaaaggtcatatttggagaaagggcaaggaattgggtctgctttatttttgggggtattttgtttttgttctcacctgctgcccccccaccccaccaccccagggataaattggatataaacactaaatactaatcagttgaacttaacatttaataaaaagaaagggtgaaataaactgaagaccattttagaactagtcagttctctgcagcaaagggaacaggagccatttgaaccctctgggacccctcaccccactgcttcagggtgctaggctgagggatgtttttcctcccccttaccgcccatgcccttgaaagaaaagtcactttttgtggagggcatcattcattcctgattcacaaaccccaaaaacctctggtgggagataggaagatagggcgtgggcctgggccttaacctcaatcttgtgtctgcctcagtcttttctgactggccctgaagttgtcagtggctctttctgtccttcagcccctggaaggtgctccaggataacaaagaagggcaggttgaagcccctcatggaaggagctggctttgtggggctgcaaaggacttttaagtcctgcctgtactgaagttcacagcccacctgactgagcagactcttcctgttcctttctctaccacccttgccttcccaggactgcacggtttaacacagcagagtacagaagggtgaagaagtgagcagaggcttatgaagatattcagatactcttctatgccaggaagcacaaagactttgttgagatttgcctcagttcagtagatcttccttggcagccagccataggttgtttctttgtcttccgggtcctaaagagcacagagaaaatggaggtccccagtctaggtaggaagctgattggatgaggacttctttttttccgacagcaggatggggctcttgggctccacacaccagatgctttggttttctacaactgttgctatgtgtagagggtgctcagagcgtggcatgagagcaaggagaccatggctactctttgaaatggatggggaaaattagcttaaaaatttaatcacgagattgcgccactgcactccagcctgggcgacagagccagactccgtctcaaaaaaaaaaaaaaaaaaaaatttaatcacacacatcacaggcttaaactgtcttagagacctttccagttgattggatcacaggctagggatctgtgcatggtgccaggtgaaacccaagtctccccagtgctaggtgagggagggctcaacgggggtaatgtgtatggggtctgctgtcctttgccatcccctggaccatattaactctgggacagaccatgattaggtctgtcaccaaacttttcctaatcattttttatgtatcattcttctttctaatctgttagcagttatctcccagaagtatccctagcatcctgaagcaaacagaactgccgggcgctgtggcttatgcctgtaatctcagcaatttgggaggccgaggcgggcggatcacctgaggtcagaagttcgagaccagcctgtccaacatggtgaaaccccgtctccactaaaaacacaaaaattatctgggcgtggtggcatgtgcctgtagtcccagctactggggaggctgaggcaggagaatcgcttgaatccaggaggtggaggttgcagtgagtggagatggcgccactgcgctccagcccgggtgacagagtgaaactccatctcagaaaacaaacaaaccaaacaactgagagagggcatgctagtggagggaaaaggagagagtacaagagttgatactgcatcagagttccagggcagatactgacaagtgactgaactttgactgtgaagtcttcccatttatttttgaaatgggagtcgatgccttttgtacgttatcaaagtgtttttttttttttcctcctttactcagacatagagcatcaaaatatcacgagtaaagccaaaccccagcttttcactggggctgatatcttcctccccatggcccactgccccctcatattccccagcacttggactgtgtcacatgggtattgattgtatacttgttgtcttggcctcatgcaaaaaggcctgggtctagatctagtcagatgagttttttttagagcatgttgatgatacaacacctgtttaaatgtctgccttatatgttatttggtcccactgttaataatagatttattactatgtatatttactattgaagatgggaatgtgatctgcatagttatcagtctattttgtatgttgtaaaaagcttctaatttaggtttaaggtgggctggctacaagagcactaaaactcctcaccttttaaactgctctttttatctgcttgtgggaatgtcgtctctttcgtggaagattgggtggtctcatgttgaggctgttgcccagtcccattaactcccttgtccccccacagaaggaagagacattgcccagctaagcatcaggaagctgtgttaaaagcccttctatgggtttggttttgtgatgtttttccctaatgggaaaaacgttatagttgtttcttactgccctgtctgggaagcagggcaaacctccaggtttttaaatgagctagatgcccctcttcctcttctctggtcactgaacctggaccaaagcactttgatattccaggtgtgattttctctgtcatggggatttgctccactgcagagccccatcattttcacagcgtaggccaacagagtgagaacctagggctaccctagctgatggatgtgaggctgctgtctacaggagctcatcccagccctgttaactggcagtggcaaggatactcgtcatcggccattgcactggggaactccctcaccccatggcttcccaacttgaaacccagatttacctccagggagaggtgagaaaaaaattgtaaatagacttgctaaagagcaactcagggttggggtgtgttttaattctcctgatcacttgaaataatctgtaggctgagtgcttatgggggtgggggagaagggtgactccagggtccttccattttgtgaagctctgggggtggagtgtgggcatctgaggccctatgatggcactacattgagctgtctgcccttccggaaacccaacctgcaatcaactgcaaatcaaattcttcacattccagctacagtctttctttccccattgaatctcagtccctggccatgtggtcaaggtggctttctgttaagctaccctaatttcgggaatgggaggggagagaggagggccattacaactctgccttcaagactcatctcttaaaaacaaaacgaaacaaaactacaaccaccatcaaaaccacacgcaaaaaaaaaaaaaaaaaaaaaaaaggataactttaaccgaaggaagggtttggttccattcaactccacattcattgtgcctttacttgcattagatttctgtgctttcttcctttccctctttgaagcaattaaaatcttccttgataactgctgtttctttctactcttgtttctggcaatttagtgggttccttctctagtggtcttaaatctcattccactggtggcaagatggggcctagccttcttttcacatgtctaatcttttcctttctcatggtgccctccatggaagtcacagtcaacactgaataaatgactagaatgacacgtgtgcgtgcgcacgcgtgtgcgtgtgtgtgttcatctgtctgcatgtggatcaatttcttttagaaaataatttattgtatgatttattttggagttatattctgattacagtgctccctctcccaaatagcattgattttttcccccctctaaaatgtataatctggtctcaggttggattctttggtacatttctctcttctggatgccatgcagcttaattaaaaccttgcttaaaaacaaaaagtgaaaattgtgtactcttgtctggaataccgcctcaggtggtggcacagagaggggagaaaacctttgcctcataatttgggtaagtgtagtggtttgattccaggtcccttgaaaaagtagatctactgaattgggcagactcatctatagctttctgagggtcttctctcctcctctccagctgtattttgaaaattacagttctagttggctgggcgcgatggctcatgtctgtaatcccagcactttgggaggccaaggcgggtggatcatttgaggtcaggagttcgagaccagcttggccaacatggtgaaaccccgtctctactgaaaatacaaaaattaaccggtgtcatggcgcatgcctgtggtcccagctactcgggaggccgaggcaggaaaatcacttgaacccaggaggcggaggttgcactgagctgagatcatgccactgcactaaaaaaaaaaaaaaaaaaaaaaaaaaaaaaaaaaaaaaaa

SEQ ID NO: 448187 - DNA, 4971 bp, Homo sapiens
atctggaagaatggtgatgctgttcaagtaataaggacaaaggggaaccaggcactgtgagcctctgtggggtgtgttactcttttagctcatgtgtttcaagtcattctaccccttgccgtctccacatccaaacctaactactttggattttaattgcagctcctccacccccaccacctgtgatccgaaatggtgccagggatgctccccctcccccaccaccataccgaatgcatgggtcagaacccccgagccgaggaaagcccccacctccaccctcaaggacgccagctgggccaccccctcctcctccaccgcccctgaggaatggccacagagattctatcaccactgtccggtctttcttggatgattttgagtcaaagtattccttccatccagtagaagactttcctgctccagaagaatataaacactttcagaggatatatcccagcaaaacaaaccgagctgcccgtggagccccacctctgccacccattctcaggtgaagcctggcttggtcccgttcctcaggaaaaggatggaccttctcttcttctcagatggtcccttccattcccctgaaacctgcatgagagctcctaacatgtttctccaatgcaatcaagccctagactccaaatgtcctcccagctcacctccatctatgcatctcatctctggatttggtgatcagactctatattgacagtaggatctcaaaccctgcatccatccttcctccagcaagccctgctagccacatgaggaacaagtttccgtgtcttctgccttcctcttggggaaaggtgccttgttgtgatgaattaactcactgttagggcagggtggagaatggtactccttccttctcctgtccactgtgggggaagcttggcaggtatattatatttcatcatttaggaggctggcatgaccaggacttatgggtgggaggggagcatttttagtgaagcaagaaaggagtttgccaagaagtgatctgttttaaaggtcatatttggagaaagggcaaggaattgggtctgctttatttttgggggtattttgtttttgttctcacctgctgcccccccaccccaccaccccagggataaattggatataaacactaaatactaatcagttgaacttaacatttaataaaaagaaagggtgaaataaactgaagaccattttagaactagtcagttctctgcagcaaagggaacaggagccatttgaaccctctgggacccctcaccccactgcttcagggtgctaggctgagggatgtttttcctcccccttaccgcccatgcccttgaaagaaaagtcactttttgtggagggcatcattcattcctgattcacaaaccccaaaaacctctggtgggagataggaagatagggcgtgggcctgggccttaacctcaatcttgtgtctgcctcagtcttttctgactggccctgaagttgtcagtggctctttctgtccttcagcccctggaaggtgctccaggataacaaagaagggcaggttgaagcccctcatggaaggagctggctttgtggggctgcaaaggacttttaagtcctgcctgtactgaagttcacagcccacctgactgagcagactcttcctgttcctttctctaccacccttgccttcccaggactgcacggtttaacacagcagagtacagaagggtgaagaagtgagcagaggcttatgaagatattcagatactcttctatgccaggaagcacaaagactttgttgagatttgcctcagttcagtagatcttccttggcagccagccataggttgtttctttgtcttccgggtcctaaagagcacagagaaaatggaggtccccagtctaggtaggaagctgattggatgaggacttctttttttccgacagcaggatggggctcttgggctccacacaccagatgctttggttttctacaactgttgctatgtgtagagggtgctcagagcgtggcatgagagcaaggagaccatggctactctttgaaatggatggggaaaattagcttaaaaatttaatcacgagattgcgccactgcactccagcctgggcgacagagccagactccgtctcaaaaaaaaaaaaaaaaaaaaatttaatcacacacatcacaggcttaaactgtcttagagacctttccagttgattggatcacaggctagggatctgtgcatggtgccaggtgaaacccaagtctccccagtgctaggtgagggagggctcaacgggggtaatgtgtatggggtctgctgtcctttgccatcccctggaccatattaactctgggacagaccatgattaggtctgtcaccaaacttttcctaatcattttttatgtatcattcttctttctaatctgttagcagttatctcccagaagtatccctagcatcctgaagcaaacagaactgccgggcgctgtggcttatgcctgtaatctcagcaatttgggaggccgaggcgggcggatcacctgaggtcagaagttcgagaccagcctgtccaacatggtgaaaccccgtctccactaaaaacacaaaaattatctgggcgtggtggcatgtgcctgtagtcccagctactggggaggctgaggcaggagaatcgcttgaatccaggaggtggaggttgcagtgagtggagatggcgccactgcgctccagcccgggtgacagagtgaaactccatctcagaaaacaaacaaaccaaacaactgagagagggcatgctagtggagggaaaaggagagagtacaagagttgatactgcatcagagttccagggcagatactgacaagtgactgaactttgactgtgaagtcttcccatttatttttgaaatgggagtcgatgccttttgtacgttatcaaagtgtttttttttttttcctcctttactcagacatagagcatcaaaatatcacgagtaaagccaaaccccagcttttcactggggctgatatcttcctccccatggcccactgccccctcatattccccagcacttggactgtgtcacatgggtattgattgtatacttgttgtcttggcctcatgcaaaaaggcctgggtctagatctagtcagatgagttttttttagagcatgttgatgatacaacacctgtttaaatgtctgccttatatgttatttggtcccactgttaataatagatttattactatgtatatttactattgaagatgggaatgtgatctgcatagttatcagtctattttgtatgttgtaaaaagcttctaatttaggtttaaggtgggctggctacaagagcactaaaactcctcaccttttaaactgctctttttatctgcttgtgggaatgtcgtctctttcgtggaagattgggtggtctcatgttgaggctgttgcccagtcccattaactcccttgtccccccacagaaggaagagacattgcccagctaagcatcaggaagctgtgttaaaagcccttctatgggtttggttttgtgatgtttttccctaatgggaaaaacgttatagttgtttcttactgccctgtctgggaagcagggcaaacctccaggtttttaaatgagctagatgcccctcttcctcttctctggtcactgaacctggaccaaagcactttgatattccaggtgtgattttctctgtcatggggatttgctccactgcagagccccatcattttcacagcgtaggccaacagagtgagaacctagggctaccctagctgatggatgtgaggctgctgtctacaggagctcatcccagccctgttaactggcagtggcaaggatactcgtcatcggccattgcactggggaactccctcaccccatggcttcccaacttgaaacccagatttacctccagggagaggtgagaaaaaaattgtaaatagacttgctaaagagcaactcagggttggggtgtgttttaattctcctgatcacttgaaataatctgtaggctgagtgcttatgggggtgggggagaagggtgactccagggtccttccattttgtgaagctctgggggtggagtgtgggcatctgaggccctatgatggcactacattgagctgtctgcccttccggaaacccaacctgcaatcaactgcaaatcaaattcttcacattccagctacagtctttctttccccattgaatctcagtccctggccatgtggtcaaggtggctttctgttaagctaccctaatttcgggaatgggaggggagagaggagggccattacaactctgccttcaagactcatctcttaaaaacaaaacgaaacaaaactacaaccaccatcaaaaccacacgcaaaaaaaaaaaaaaaaaaaaaaaaggataactttaaccgaaggaagggtttggttccattcaactccacattcattgtgcctttacttgcattagatttctgtgctttcttcctttccctctttgaagcaattaaaatcttccttgataactgctgtttctttctactcttgtttctggcaatttagtgggttccttctctagtggtcttaaatctcattccactggtggcaagatggggcctagccttcttttcacatgtctaatcttttcctttctcatggtgccctccatggaagtcacagtcaacactgaataaatgactagaatgacacgtgtgcgtgcgcacgcgtgtgcgtgtgtgtgttcatctgtctgcatgtggatcaatttcttttagaaaataatttattgtatgatttattttggagttatattctgattacagtgctccctctcccaaatagcattgattttttcccccctctaaaatgtataatctggtctcaggttggattctttggtacatttctctcttctggatgccatgcagcttaattaaaaccttgctt

SEQ ID NO: 448188 - DNA, 4961 bp, Homo sapiens
ggagcagatccatttccgggttggcaaaaggggcggtggcggcggcggcggcggcggcggcggcggcggcggcgacggcgagaaagagcttgccggggggcgagcaggacaggacgaagccggagtgtaggcggcagaggattcgctcccagagcagctgcggccaggtatatgaatgacctaaaggtacaaataaagacggagagagaacagtgccaactgggagcagggcaagaatgccaattcctcctcccccgccacccccacctggtcctcctccacctcccacatttcatcaggcaaacacagagcagcccaagctgagtagagatgagcagcggggtcgaggcgccctcttacaggacatttgcaaagggaccaagctgaagaaggtgaccaacattaatgatcggagtgctcccatcctcgagaagccgaaaggaagcagtggtggctatggctctggaggagctgccctgcagcccaagggaggtctcttccaaggaggagtgctgaagcttcgacctgtgggagccaaggatggttcagagaacctagctggtaagccagccctgcaaatccccagttctcgagctgctgccccaaggcctccagtatctgccgccagcgggcgtcctcaggatgatacagacagcagccgggcctcactcccagaactgccccggatgcagagaccctctttaccggacctctctcggcctaataccaccagcagtacgggcatgaagcacagctcctctgcccctcccccaccacccccagggcggcgtgccaacgcaccccccacacctctgcctatgcacagcagcaaagcccccgcctacaacagagagaaacccttgccaccgacgcctggacaaaggcttcaccctggtcgagagggacctcctgctccacccccagtcaaaccacctccttcccctgtgaatatcagaacaggaccaagtggccagtctctggctcctcctcctccgccttaccgccagcctcctggggtccccaatggaccctctagccccactaatgagtcagcccctgagctgccacagagacacaattctttgcataggaagacaccagggcctgtcagaggcctagcacctcctccacccacctcggcctccccatctttactgagtaataggccacctcccccagcccgagaccctcccagtcggggaggccaccccctcctcctccaccgcccctgaggaatggccacagagattctatcaccactgtccggtctttcttggatgattttgagtcaaagtattccttccatccagtagaagactttcctgctccagaagaatataaacactttcagaggatatatcccagcaaaacaaaccgagctgcccgtggagccccacctctgccacccattctcaggtgaagcctggcttggtcccgttcctcaggaaaaggatggaccttctcttcttctcagatggtcccttccattcccctgaaacctgcatgagagctcctaacatgtttctccaatgcaatcaagccctagactccaaatgtcctcccagctcacctccatctatgcatctcatctctggatttggtgatcagactctatattgacagtaggatctcaaaccctgcatccatccttcctccagcaagccctgctagccacatgaggaacaagtttccgtgtcttctgccttcctcttggggaaaggtgccttgttgtgatgaattaactcactgttagggcagggtggagaatggtactccttccttctcctgtccactgtgggggaagcttggcaggtatattatatttcatcatttaggaggctggcatgaccaggacttatgggtgggaggggagcatttttagtgaagcaagaaaggagtttgccaagaagtgatctgttttaaaggtcatatttggagaaagggcaaggaattgggtctgctttatttttgggggtattttgtttttgttctcacctgctgcccccccaccccaccaccccagggataaattggatataaacactaaatactaatcagttgaacttaacatttaataaaaagaaagggtgaaataaactgaagaccattttagaactagtcagttctctgcagcaaagggaacaggagccatttgaaccctctgggacccctcaccccactgcttcagggtgctaggctgagggatgtttttcctcccccttaccgcccatgcccttgaaagaaaagtcactttttgtggagggcatcattcattcctgattcacaaaccccaaaaacctctggtgggagataggaagatagggcgtgggcctgggccttaacctcaatcttgtgtctgcctcagtcttttctgactggccctgaagttgtcagtggctctttctgtccttcagcccctggaaggtgctccaggataacaaagaagggcaggttgaagcccctcatggaaggagctggctttgtggggctgcaaaggacttttaagtcctgcctgtactgaagttcacagcccacctgactgagcagactcttcctgttcctttctctaccacccttgccttcccaggactgcacggtttaacacagcagagtacagaagggtgaagaagtgagcagaggcttatgaagatattcagatactcttctatgccaggaagcacaaagactttgttgagatttgcctcagttcagtagatcttccttggcagccagccataggttgtttctttgtcttccgggtcctaaagagcacagagaaaatggaggtccccagtctaggtaggaagctgattggatgaggacttctttttttccgacagcaggatggggctcttgggctccacacaccagatgctttggttttctacaactgttgctatgtgtagagggtgctcagagcgtggcatgagagcaaggagaccatggctactctttgaaatggatggggaaaattagcttaaaaatttaatcacgagattgcgccactgcactccagcctgggcgacagagccagactccgtctcaaaaaaaaaaaaaaaaaaaaatttaatcacacacatcacaggcttaaactgtcttagagacctttccagttgattggatcacaggctagggatctgtgcatggtgccaggtgaaacccaagtctccccagtgctaggtgagggagggctcaacgggggtaatgtgtatggggtctgctgtcctttgccatcccctggaccatattaactctgggacagaccatgattaggtctgtcaccaaacttttcctaatcattttttatgtatcattcttctttctaatctgttagcagttatctcccagaagtatccctagcatcctgaagcaaacagaactgccgggcgctgtggcttatgcctgtaatctcagcaatttgggaggccgaggcgggcggatcacctgaggtcagaagttcgagaccagcctgtccaacatggtgaaaccccgtctccactaaaaacacaaaaattatctgggcgtggtggcatgtgcctgtagtcccagctactggggaggctgaggcaggagaatcgcttgaatccaggaggtggaggttgcagtgagtggagatggcgccactgcgctccagcccgggtgacagagtgaaactccatctcagaaaacaaacaaaccaaacaactgagagagggcatgctagtggagggaaaaggagagagtacaagagttgatactgcatcagagttccagggcagatactgacaagtgactgaactttgactgtgaagtcttcccatttatttttgaaatgggagtcgatgccttttgtacgttatcaaagtgtttttttttttttcctcctttactcagacatagagcatcaaaatatcacgagtaaagccaaaccccagcttttcactggggctgatatcttcctccccatggcccactgccccctcatattccccagcacttggactgtgtcacatgggtattgattgtatacttgttgtcttggcctcatgcaaaaaggcctgggtctagatctagtcagatgagttttttttagagcatgttgatgatacaacacctgtttaaatgtctgccttatatgttatttggtcccactgttaataatagatttattactatgtatatttactattgaagatgggaatgtgatctgcatagttatcagtctattttgtatgttgtaaaaagcttctaatttaggtttaaggtgggctggctacaagagcactaaaactcctcaccttttaaactgctctttttatctgcttgtgggaatgtcgtctctttcgtggaagattgggtggtctcatgttgaggctgttgcccagtcccattaactcccttgtccccccacagaaggaagagacattgcccagctaagcatcaggaagctgtgttaaaagcccttctatgggtttggttttgtgatgtttttccctaatgggaaaaacgttatagttgtttcttactgccctgtctgggaagcagggcaaacctccaggtttttaaatgagctagatgcccctcttcctcttctctggtcactgaacctggaccaaagcactttgatattccaggtgtgattttctctgtcatggggatttgctccactgcagagccccatcattttcacagcgtaggccaacagagtgagaacctagggctaccctagctgatggatgtgaggctgctgtctacaggagctcatcccagccctgttaactggcagtggcaaggatactcgtcatcggccattgcactggggaactccctcaccccatggcttcccaacttgaaacccagatttacctcccaaatagcattgattttttcccccctctaaaatgtataatctggtctcaggttggattctttggtacatttctctcttctggatgccatgcagcttaattaaaaccttgctt

SEQ ID NO: 448189 - DNA, 2291 bp, Homo sapiens
  misc_feature (51)..(51): n is a, c, g, or t
agagggcgtggggaatctggggaggagtggtcgaatattggtatatgaatnacctaaaggtacaaataaagacggagagaaaacaaacaaaccaaacaactgagagagggcatgctagtggagggaaaaggagagagtacaagagttgatactgcatcagagttccagggcagatactgacaagtgactgaactttgactgtgaagtcttcccatttatttttgaaatgggagtcgatgccttttgtacgttatcaaagtgtttttttttttttcctcctttactcagacatagagcatcaaaatatcacgagtaaagccaaaccccagcttttcactggggctgatatcttcctccccatggcccactgccccctcatattccccagcacttggactgtgtcacatgggtattgattgtatacttgttgtcttggcctcatgcaaaaaggcctgggtctagatctagtcagatgagttttttttagagcatgttgatgatacaacacctgtttaaatgtctgccttatatgttatttggtcccactgttaataatagatttattactatgtatatttactattgaagatgggaatgtgatctgcatagttatcagtctattttgtatgttgtaaaaagcttctaatttaggtttaaggtgggctggctacaagagcactaaaactcctcaccttttaaactgctctttttatctgcttgtgggaatgtcgtctctttcgtggaagattgggtggtctcatgttgaggctgttgcccagtcccattaactcccttgtccccccacagaaggaagagacattgcccagctaagcatcaggaagctgtgttaaaagcccttctatgggtttggttttgtgatgtttttccctaatgggaaaaacgttatagttgtttcttactgccctgtctgggaagcagggcaaacctccaggtttttaaatgagctagatgcccctcttcctcttctctggtcactgaacctggaccaaagcactttgatattccaggtgtgattttctctgtcatggggatttgctccactgcagagccccatcattttcacagcgtaggccaacagagtgagaacctagggctaccctagctgatggatgtgaggctgctgtctacaggagctcatcccagccctgttaactggcagtggcaaggatactcgtcatcggccattgcactggggaactccctcaccccatggcttcccaacttgaaacccagatttacctccagggagaggtgagaaaaaaattgtaaatagacttgctaaagagcaactcagggttggggtgtgttttaattctcctgatcacttgaaataatctgtaggctgagtgcttatgggggtgggggagaagggtgactccagggtccttccattttgtgaagctctgggggtggagtgtgggcatctgaggccctatgatggcactacattgagctgtctgcccttccggaaacccaacctgcaatcaactgcaaatcaaattcttcacattccagctacagtctttctttccccattgaatctcagtccctggccatgtggtcaaggtggctttctgttaagctaccctaatttcgggaatgggaggggagagaggagggccattacaactctgccttcaagactcatctcttaaaaacaaaacgaaacaaaactacaaccaccatcaaaaccacacgcaaaaaaaaaaaaaaaaaaaaaaaaggataactttaaccgaaggaagggtttggttccattcaactccacattcattgtgcctttacttgcattagatttctgtgctttcttcctttccctctttgaagcaattaaaatcttccttgataactgctgtttctttctactcttgtttctggcaatttagtgggttccttctctagtggtcttaaatctcattccactggtggcaagatggggcctagccttcttttcacatgtctaatcttttcctttctcatggtgccctccatggaagtcacagtcaacactgaataaatgactagaatgacacgtgtgcgtgcgcacgcgtgtgcgtgtgtgtgttcatctgtctgcatgtggatcaatttcttttagaaaataatttattgtatgatttattttggagttatattctgattacagtgctccctctcccaaatagcattgattttttcccccctctaaaatgtataatctggtctcaggttggattctttggtacatttctctcttctggatgccatgcagcttaattaaaaccttgctt

SEQ ID NO: 448190 - DNA, 714 bp, Homo sapiens
ggagcagatccatttccgggttggcaaaaggggcggtggcggcggcggcggcggcggcggcggcggcggcggcgacggcgagaaagagcttgccggggggcgagcaggacaggacgaagccggagtgtaggcggcagaggattcgctcccagagcagctgcggccaggtatatgaatgacctaaaggtacaaataaagacggagagagaacagtgccaactgggagcagggcaagaatgccaattcctcctcccccgccacccccacctggtcctcctccacctcccacatttcatcaggcaaacacagagcagcccaagctgagtagagatgagcagcggggtcgaggcgccctcttacaggacatttgcaaagggaccaagctgaagaaggtgaccaacattaatgatcggagtgctcccatcctcgagaagccgaaaggaagcagtggtggctatggctctggaggagctgccctgcagcccaagggaggtctcttccaaggaggagtgctgaagcttcgacctgtgggagccaaggatggttcagagaacctagctggtaagccagccctgcaaatccccagttctcgagctgctgccccaaggcctccagtatctgccgccagcgggcgtcctcaggatgatacagacagcagccgggcctcactcccagaactgccccggatcacagcgggatcctctagaacactac

SEQ ID NO: 448191 - DNA, 188 bp, Homo sapiens
tggtttggtggggcagtaggtcctcacagtacctcagaatgcctgagagattagtaagtggggagggtcgaagcgatcagaggcctgtgggagcacaagcaaggatgataggaattaatgttctattcttttcgcagatgattttgagtcaaagtattccttccatccagtagaagactttcctgctc

SEQ ID NO: 448192 - DNA, 218 bp, Homo sapiens
acagagcagcccaagctgagtagagatgagcagcggggtcgaggcgccctcttacaggacatttgcaaagggaccaagctgaagaaggtgaccaacattaatgatcggagtgctcccatcctcgagagtgagtccgagcttcatttcctagtgaactggcaggatcccaggagtgacttggagacttggctgggttcttatttttattgggccttgag

SEQ ID NO: 448193 - DNA, 5822 bp, Homo sapiens
ggagcagatccatttccgggttggcaaaaggggcggtggcggcggcggcggcggcggcggcggcggcggcggcgacggcgagaaagagcttgccggggggcgagcaggacaggacgaagccggagtgtaggcggcagaggattcgctcccagagcagctgcggccaggtatatgaatgacctaaaggtacaaataaagacggagagagaacagtgccaactgggagcagggcaagaatgccaattcctcctcccccgccacccccacctggtcctcctccacctcccacatttcatcaggcaaacacagagcagcccaagctgagtagagatgagcagcggggtcgaggcgccctcttacaggacatttgcaaagggaccaagctgaagaaggtgaccaacattaatgatcggagtgctcccatcctcgagaagccgaaaggaagcagtggtggctatggctctggaggagctgccctgcagcccaagggaggtctcttccaaggaggagtgctgaagcttcgacctgtgggagccaaggatggttcagagaacctagctggtaagccagccctgcaaatccccagttctcgagctgctgccccaaggcctccagtatctgccgccagcgggcgtcctcaggatgatacagacagcagccgggcctcactcccagaactgccccggatgcagagaccctctttaccggacctctctcggcctaataccaccagcagtacgggcatgaagcacagctcctctgcccctcccccaccacccccagggcggcgtgccaacgcaccccccacacctctgcctatgcacagcagcaaagcccccgcctacaacagagagaaacccttgccaccgacgcctggacaaaggcttcaccctggtcgagagggacctcctgctccacccccagtcaaaccacctccttcccctgtgaatatcagaacaggaccaagtggccagtctctggctcctcctcctccgccttaccgccagcctcctggggtccccaatggaccctctagccccactaatgagtcagcccctgagctgccacagagacacaattctttgcataggaagacaccagggcctgtcagaggcctagcacctcctccacccacctcggcctccccatctttactgagtaataggccacctcccccagcccgagaccctcccagtcggggaggccaccccctcctcctccaccgcccctgaggaatggccacagagattctatcaccactgtccggtctttcttggatgattttgagtcaaagtattccttccatccagtagaagactttcctgctccagaagaatataaacactttcagaggatatatcccagcaaaacaaaccgagctgcccgtggagccccacctctgccacccattctcaggtgaagcctggcttggtcccgttcctcaggaaaaggatggaccttctcttcttctcagatggtcccttccattcccctgaaacctgcatgagagctcctaacatgtttctccaatgcaatcaagccctagactccaaatgtcctcccagctcacctccatctatgcatctcatctctggatttggtgatcagactctatattgacagtaggatctcaaaccctgcatccatccttcctccagcaagccctgctagccacatgaggaacaagtttccgtgtcttctgccttcctcttggggaaaggtgccttgttgtgatgaattaactcactgttagggcagggtggagaatggtactccttccttctcctgtccactgtgggggaagcttggcaggtatattatatttcatcatttaggaggctggcatgaccaggacttatgggtgggaggggagcatttttagtgaagcaagaaaggagtttgccaagaagtgatctgttttaaaggtcatatttggagaaagggcaaggaattgggtctgctttatttttgggggtattttgtttttgttctcacctgctgcccccccaccccaccaccccagggataaattggatataaacactaaatactaatcagttgaacttaacatttaataaaaagaaagggtgaaataaactgaagaccattttagaactagtcagttctctgcagcaaagggaacaggagccatttgaaccctctgggacccctcaccccactgcttcagggtgctaggctgagggatgtttttcctcccccttaccgcccatgcccttgaaagaaaagtcactttttgtggagggcatcattcattcctgattcacaaaccccaaaaacctctggtgggagataggaagatagggcgtgggcctgggccttaacctcaatcttgtgtctgcctcagtcttttctgactggccctgaagttgtcagtggctctttctgtccttcagcccctggaaggtgctccaggataacaaagaagggcaggttgaagcccctcatggaaggagctggctttgtggggctgcaaaggacttttaagtcctgcctgtactgaagttcacagcccacctgactgagcagactcttcctgttcctttctctaccacccttgccttcccaggactgcacggtttaacacagcagagtacagaagggtgaagaagtgagcagaggcttatgaagatattcagatactcttctatgccaggaagcacaaagactttgttgagatttgcctcagttcagtagatcttccttggcagccagccataggttgtttctttgtcttccgggtcctaaagagcacagagaaaatggaggtccccagtctaggtaggaagctgattggatgaggacttctttttttccgacagcaggatggggctcttgggctccacacaccagatgctttggttttctacaactgttgctatgtgtagagggtgctcagagcgtggcatgagagcaaggagaccatggctactctttgaaatggatggggaaaattagcttaaaaatttaatcacgagattgcgccactgcactccagcctgggcgacagagccagactccgtctcaaaaaaaaaaaaaaaaaaaaatttaatcacacacatcacaggcttaaactgtcttagagacctttccagttgattggatcacaggctagggatctgtgcatggtgccaggtgaaacccaagtctccccagtgctaggtgagggagggctcaacgggggtaatgtgtatggggtctgctgtcctttgccatcccctggaccatattaactctgggacagaccatgattaggtctgtcaccaaacttttcctaatcattttttatgtatcattcttctttctaatctgttagcagttatctcccagaagtatccctagcatcctgaagcaaacagaactgccgggcgctgtggcttatgcctgtaatctcagcaatttgggaggccgaggcgggcggatcacctgaggtcagaagttcgagaccagcctgtccaacatggtgaaaccccgtctccactaaaaacacaaaaattatctgggcgtggtggcatgtgcctgtagtcccagctactggggaggctgaggcaggagaatcgcttgaatccaggaggtggaggttgcagtgagtggagatggcgccactgcgctccagcccgggtgacagagtgaaactccatctcagaaaacaaacaaaccaaacaactgagagagggcatgctagtggagggaaaaggagagagtacaagagttgatactgcatcagagttccagggcagatactgacaagtgactgaactttgactgtgaagtcttcccatttatttttgaaatgggagtcgatgccttttgtacgttatcaaagtgtttttttttttttcctcctttactcagacatagagcatcaaaatatcacgagtaaagccaaaccccagcttttcactggggctgatatcttcctccccatggcccactgccccctcatattccccagcacttggactgtgtcacatgggtattgattgtatacttgttgtcttggcctcatgcaatacaacacctgtttaaatgtctgccttatatgttatttggtcccactgttaataatagatttattactatgtatatttactattgaagatgggaatgtgatctgcatagttatcagtctattttgtatgttgtaaaaagcttctaatttaggtttaaggtgggctggctacaagagcactaaaactcctcaccttttaaactgctctttttatctgcttgtgggaatgtcgtctctttcgtggaagattgggtggtctcatgttgaggctgttgcccagtcccattaactcccttgtccccccacagaaggaagagacattgcccagctaagcatcaggaagctgtgttaaaagcccttctatgggtttggttttgtgatgtttttccctaatgggaaaaacgttatagttgtttcttactgccctgtctgggaagcagggcaaacctccaggtttttaaatgagctagatgcccctcttcctcttctctggtcactgaacctggaccaaagcactttgatattccaggtgtgattttctctgtcatggggatttgctccactgcagagccccatcattttcacagcgtaggccaacagagtgagaacctagggctaccctagctgatggatgtgaggctgctgtctacaggagctcatcccagccctgttaactggcagtggcaaggatactcgtcatcggccattgcactggggaactccctcaccccatggcttcccaacttgaaacccagatttacctccagggagaggtgagaaaaaaattgtaaatagacttgctaaagagcaactcagggttggggtgtgttttaattctcctgatcacttgaaataatctgtaggctgagtgcttatgggggtgggggagaagggtgactccagggtccttccattttgtgaagctctgggggtggagtgtgggcatctgaggccctatgatggcactacattgagctgtctgcccttccggaaacccaacctgcaatcaactgcaaatcaaattcttcacattccagctacagtctttctttccccattgaatctcagtccctggccatgtggtcaaggtggctttctgttaagctaccctaatttcgggaatgggaggggagagaggagggccattacaactctgccttcaagactcatctcttaaaaacaaaacgaaacaaaactacaaccaccatcaaaaccacacgcaaaaaaaaaaaaaaaaaaaaaaaaggataactttaaccgaaggaagggtttggttccattcaactccacattcattgtgcctttacttgcattagatttctgtgctttcttcctttccctctttgaagcaattaaaatcttccttgataactgctgtttctttctactcttgtttctggcaatttagtgggttccttctctagtggtcttaaatctcattccactggtggcaagatggggcctagccttcttttcacatgtctaatcttttcctttctcatggtgccctccatggaagtcacagtcaacactgaataaatgactagaatgacacgtgtgcgtgcgcacgcgtgtgcgtgtgtgtgttcatctgtctgcatgtggatcaatttcttttagaaaataatttattgtatgatttattttggagttatattctgattacagtgctccctctcccaaatagcattgattttttcccccctctaaaatgtataatctggtctcaggttggattctttggtacatttctctcttctggatgccatgcagcttaattaaaaccttgctt

SEQ ID NO: 448194 - DNA, 2601 bp, Homo sapiens
ggagcagatccatttccgggttggcaaaaggggcggtggcggcggcggcggcggcggcggcggcggcggcggcgacggcgagaaagagcttgccggggggcgagcaggacaggacgaagccggagtgtaggcggcagaggattcgctcccagagcagctgcggccaggtatatgaatgacctaaaggtacaaataaagacggagagagaacagtgccaactgggagcagggcaagaatgccaattcctcctcccccgccacccccacctggtcctcctccacctcccacatttcatcaggcacattctcgccctgttgcccaggttgcagtgagtggagatggcgccactgcgctccagcccgggtgacagagtgaaactccatctcagaaaacaaacaaaccaaacaactgagagagggcatgctagtggagggaaaaggagagagtacaagagttgatactgcatcagagttccagggcagatactgacaagtgactgaactttgactgtgaagtcttcccatttatttttgaaatgggagtcgatgccttttgtacgttatcaaagtgtttttttttttttcctcctttactcagacatagagcatcaaaatatcacgagtaaagccaaaccccagcttttcactggggctgatatcttcctccccatggcccactgccccctcatattccccagcacttggactgtgtcacatgggtattgattgtatacttgttgtcttggcctcatgcaaaaaggcctgggtctagatctagtcagatgagttttttttagagcatgttgatgatacaacacctgtttaaatgtctgccttatatgttatttggtcccactgttaataatagatttattactatgtatatttactattgaagatgggaatgtgatctgcatagttatcagtctattttgtatgttgtaaaaagcttctaatttaggtttaaggtgggctggctacaagagcactaaaactcctcaccttttaaactgctctttttatctgcttgtgggaatgtcgtctctttcgtggaagattgggtggtctcatgttgaggctgttgcccagtcccattaactcccttgtccccccacagaaggaagagacattgcccagctaagcatcaggaagctgtgttaaaagcccttctatgggtttggttttgtgatgtttttccctaatgggaaaaacgttatagttgtttcttactgccctgtctgggaagcagggcaaacctccaggtttttaaatgagctagatgcccctcttcctcttctctggtcactgaacctggaccaaagcactttgatattccaggtgtgattttctctgtcatggggatttgctccactgcagagccccatcattttcacagcgtaggccaacagagtgagaacctagggctaccctagctgatggatgtgaggctgctgtctacaggagctcatcccagccctgttaactggcagtggcaaggatactcgtcatcggccattgcactggggaactccctcaccccatggcttcccaacttgaaacccagatttacctccagggagaggtgagaaaaaaattgtaaatagacttgctaaagagcaactcagggttggggtgtgttttaattctcctgatcacttgaaataatctgtaggctgagtgcttatgggggtgggggagaagggtgactccagggtccttccattttgtgaagctctgggggtggagtgtgggcatctgaggccctatgatggcactacattgagctgtctgcccttccggaaacccaacctgcaatcaactgcaaatcaaattcttcacattccagctacagtctttctttccccattgaatctcagtccctggccatgtggtcaaggtggctttctgttaagctaccctaatttcgggaatgggaggggagagaggagggccattacaactctgccttcaagactcatctcttaaaaacaaaacgaaacaaaactacaaccaccatcaaaaccacacgcaaaaaaaaaaaaaaaaaaaaaaaaggataactttaaccgaaggaagggtttggttccattcaactccacattcattgtgcctttacttgcattagatttctgtgctttcttcctttccctctttgaagcaattaaaatcttccttgataactgctgtttctttctactcttgtttctggcaatttagtgggttccttctctagtggtcttaaatctcattccactggtggcaagatggggcctagccttcttttcacatgtctaatcttttcctttctcatggtgccctccatggaagtcacagtcaacactgaataaatgactagaatgacacgtgtgcgtgcgcacgcgtgtgcgtgtgtgtgttcatctgtctgcatgtggatcaatttcttttagaaaataatttattgtatgatttattttggagttatattctgattacagtgctccctctcccaaatagcattgattttttcccccctctaaaatgtataatctggtctcaggttggattctttggtacatttctctcttctggatgccatgcagcttaattaaaaccttgctt

SEQ ID NO: 448195 - DNA, 661 bp, Homo sapiens
actcccctttataaaaccaccagatctcatgagatttattcactatcacaagcacagcatgggaaagacccgcccccaggattcaattacctcctaccaggtaactcccatgacacgtgggaattatgggagctaaaattcaagatgagatttgggtagggacacagccaaaccatatcatcatctgtccacctatggccttcatcagcccttcaggtaacttagtttttgacacctgtttcctatttcacttaatcaaatctattttgcttttgtatgttttttttccactttttcaaacagaaatgtttgcttgccagtgataagctaagttggtaggtaatgaataacaaaatgacctggatattttctaaggcctttattcccccttggttgtaatcttagtttgagagaagccataaggatacccagttatttgtagaatggatacatacacttgaggtgaccatgaagtcaaagaatgggacatagaggactactctgcttagctagttttttttttttcctattttcccatccttgcagaatcagattcataaaattttagaaagattctcacagttcagccatggttgtgacaaactctgaataccagaggacacaaagggagaggaaaaactgttctattttttttccccag

SEQ ID NO: 448196 - DNA, 8106 bp, Homo sapiens
ccaaaatgcaggccccagcggaacgcacagccctcctgtcctccgccggtgcccctttagccgccccacccccatccctaagggctctcattctccagctgcagccgcagctgggttccgaacacgccgccgggccccgggagggagaggggcaggtgccagggcggcgcgcagcctctgctcccggtgccagcttcagtgcgccgggcacacgcgcgccccgcaacccctccctcaccctttccccgttgctcaatctccgccagccgcggtcgctgcatcgtcagagagctgcaagagggaggcagcaaggtgcggccgccagcagtgacaccatgtgaccggcacggctcactgacacgcagctttggttaaagagcgggcgcacaggaggggaggagaccgcgcgcgggacggggaggaatggcctgtccgcgttaaaccatcacaagccatggttgcggaagggccacgcgtcccccagtaggagaatgactccgattcgtgaccctcagcgccggtgcatgtcgatatatttattgagtgtctactgtgtgccaggcactatatctatgtgcatagaaaaaccctggaaggccatacaacaatatatatagagtgatcgtctctgcttgctgagctaacaggggtgtcaagcttccattttggtatctacttctaaatacactcagaacaggagaaatttggactaattttcaaactacagacactttctaatcatgatgcatttcaaaagtggactcgaattaactgagttgcaaaacatgacagtgcccgaggatgataacattagcaatgactccaatgatttcaccgaagtagaaaatggtcagataaatagcaagtttatttctgatcgtgaaagtagaagaagtctcacaaacagccatttggaaaaaaagaagtgtgatgagtatattccaggtacaacctccttaggcatgtctgtttttaacctaagcaacgccattatgggcagtgggattttgggactcgcctttgccctggcaaacactggaatcctactttttctggtacttttgacttcagtgacattgctgtctatatattcaataaacctcctattgatctgttcaaaagaaacaggctgcatggtgtatgaaaagctgggggaacaagtctttggcaccacagggaagttcgtaatctttggagccacctctctacagaacactggagcaatgctgagctacctcttcatcgtaaaaaatgaactaccctctgccataaagtttctaatgggaaaggaagagacattttcagcctggtacgtggatggccgcgttctggtggtgatagttacctttggcataattctccctctgtgtctcttgaagaacttagggtatcttggctatactagtggattttccttgagctgtatggtttttttcctaattgtggttatttacaagaaatttcaaattccctgcattgttccagagctaaattcaacaataagtgctaattcaacaaatgctgacacgtgtacgccaaaatatgttaccttcaattcaaagaccgtgtatgctttacccaccattgcatttgcatttgtttgccacccgtcagtcctgccaatttacagtgagcttaaagaccgatcacagaaaaaaatgcagatggtttcaaacatctcctttttcgccatgtttgttatgtacttcttgactgccatttttggctacttgacattctatgacaacgtgcagtccgacctccttcacaaatatcagagtaaagatgacattctcatcctgacagtgcggctggctgtcattgttgctgtgatcctcacagtgccggtgttatttttcacggttcgttcatctttatttgaactggctaagaaaacaaagtttaatttatgtcgtcataccgtggttacctgcatactcttggttgttatcaacttgttggtgatcttcataccctccatgaaggatatttttggagtcgtaggagttacatctgctaacatgcttattttcattcttccttcatctctttatttaaaaatcacagaccaggatggagataaaggaactcaaagaatttgggctgcccttttcttgggcctgggggtgttgttctccttggtcagcattcccttggtcatctatgactgggcctgctcatcgagtagtgacgaaggccactgaaacccgccgagaaaaagaaacatccctgttgtctgctcagtcaagtccccacacatcagcaatctctcaccacttcttttgcaagtttacagaagcaaacagaaatgtacaggatacttaaaatggaataactttttggttgcaaaacagagacatggttctataatgcttcatgtccctccaagatttgagatcaatttagggattgtgaaatttttttttcaaatttcatacaatcatatttcccagtacttttcacaatcattttttacccatctaactctatgttttgtggcttcccggtctcttagaactttgaaaacatgatatacaataatgtttatttattatacatccagattctgaaataattttcctactgatgttcagctcacactatctgtacctttttagaagagaaaagaatcttgaattgtatatatttattttgctttacagaaaaaaatggtttcgtaaataatttgcctattttggttaacatagcacatggagataatcatctgaaagttatagggcactgccactgctgaatcagagcatgcccaatatttgaggtggctctgatttcctggcagctgaactcgggtagtccagtggcctagctggtaccacatctattcccatccagagacattctctggcaagtgttctcagctgaaaagtggttggggatgattcttaccttggtaattaaatgaagctacacatttgggtaatctagcaaatgaagtattttttccctcttggcaacttgtgtcagagttactctggtctgagtcaactttcgctggggaaaacctatggaacctactgcaaaaagattgtccaaaatgcctaagaaaatactcctctgatgcatttagccttcaaccctacctgtcttgctgaagggagaaaaatgttttagtacattataggcccagcagcttttattcatgtccaccagctagttgcacagagaatcatgtgtacctaactaaggatgatctaggataagtaactcctgttttatattgagtattttagggaagtctttaaaagacttgttttatatctataaatctaggttattacaaatacaagaattttgtaccttaaataagcctcatttctatttcttcttcattaattctccatctagtcttgtgaaaaaaaaaaaaaaccctcagagatagtctttgtgaagagcttctgacagaatcactgagtaccttccttcccccagatgaggaagacaagggggtctcagtgtctgtgctgtctcctcttctcttccccaaccaaggactgtgccattactgcccgtctcaactgtccatgcaggaggacagagttgcctggtactcttacccttgtccctctcctaaagggagcacaaggaaactgaagagactgaaaaagaagagagtttgtagctgaaaaagaatagggatagcaaggaaacccagaactgcattcccctaagtggggccatcccatgtgattgaattgtccatagcttgcctatggtgagaaatgtgcatgctccgtgagctggtctcttgaaacaggacttatgcttcctctatattctggttaaattttccaaacacataagttcactgagcacagatttcttatccagagacaagtagaatctaaccgcagactgttggcagagtttccaggcacttagccatgttcccttcctgactcaaatccccaaaggccttcactctcactgagaatcacactactgtcccatagataaggcaggcattgaagcacctgtcgtgatcctctaggggggagaatgaaaggttatttcctgcattgcatcatcatagcttttaatataatgctacagaatcatatccacattaggttagagttcagatatttggatatgaatacctaacctagccatatccatggccatctctgttcttttcagcaatgttttccatattatattagcaatgacagaaacagaacaagccaagatccagtcagttcttgggagcttgtctagagcaccaagtaatgaaatagccaggtagtgggatgactgtacctttaaaaatacataatttagtttgcaagctatattatgctactttctattttccttgttactttatagcaattcattttaccctcacaaagtcaatttagaaccttatcattaactgggatgtgtagtgatatttttgggcctctgggtttcatgtgtcaatacaaggaatatttatttaaaatagatttatttagaggaggcacagtgttgttgatctgtgtgacaccacccatatttttaaaaacctttgtatgtttctctaaatttgttgttgactgaatataatagaccctaccataattcgtcaaatatcactgattagttacatcctttgtgtgagattagctgtaaagtatactgctcttattcttattcagaatagttaattggtagccaaaaatacatgtatcacagatgttaggtcgaatttaaacagcacagtcaagtgctatggaagtttttctgctaaattagtagattaaagaatactataccctaggcatggggagcagcacgttttcctttggtaggtaggatctctatactagtgaacagtgccagttccacactttggacttagaactgttctctagttattgtaacacagaatactgtcaatccctaatttacttaatgttacttattggaagtggggctgatgaaatacgcacaggagggaaatctactgtgtttaggcacaggcagccccagtgtataaggagatcatattccaaaaggttgtcagttggttgtttgcaacctggaatgtattttcctttagagaccaggttatccatggtggttaggcccctagagcagctggaaaagatgatcaaaccaataggttagctgacatcgaataatgtaataggtttgctaaagaatctaaccatcaaatataatattgtttccagggagggtgtttgttcagagttgcctgttagtagaatctggactgtccatcccagccacatcccacctactggacagtaggggtagagatgccaccagactacaggtgaccagattggcctgaaacatggtgtccagtaaaaacggggaggaataagtccatgactgccggagagcttggtggtaggaggagggtgaaggagggtgagggggcctctcatgggtcagaaacctccagggacatccctcagctggtaactctgctgttgtccggagggttcaggcttggtgtgccttcttctgtttgtctgacttttggctcctatggttcatctcctgccctgcccaccacagaaaaggatgctgctgcacagcttctccaatgtaccagtcattgaggccagcgcgcagcacttttaatgtttttagtgctagtaactgtgttttaactctccaggaataagctgggaggttagaaaacaagaaaaaagggggaaaaaaaaacctctccacccactttccttttttacagttacagaccctgttgagaaaaagaagcacccagatgggtgatggtgatagggcttgtggtggacacagggttgtggtaagattcctcagtgcttcggcgagcacctaagactattaccctggaactgactgctttctagagcttgattcatgcctctaagccagtggttctcaaagtgtggcccctagaccagtagcatcagcatcatcggggacctcattagaatgcagattctcagccccctcccagacatggtgaagtcagaagctctcagggagggactcagcaaatgattctaaagcgcatcaagtttgagaaccaccctaagccaatgagtctcccttttacttcccattagtcctccctcaccagatgattcctaggactcatggtgcaacatacaggagccaggctttagggaggggaggaaaggagcctggcggcaggggtctctgcaatggcaagaaagtgagtgaatccagcgctgccacctggttatccccttctcgttgaaaatagcagcgcgggtgcaaattcctaaacacaggctgcctgcactcggtgttacctcgggctgaggcatgataatattttattttttaaagctgtgaggaaatgaaagtgaggctttggttggggcgaggcagttgtgaaagaaattaaaataaaagaccctttgtaaatgcagacttagaagaaatactgaatttgtgtcagaagttctccagtgtttgtgttaatcgtgtggtgataatcctgtcctccttttaaagcgaattctctactgaaaggtctgctctgcttaaggagctacaaactgctctcaaaagaatgaaatactgagttccaattcagtgaggcacagtgttggactatggcacatttagttggagtcggggggaggtcaggaatatgatcagataatggattttataccttagagcaaaatctattagtctctctcagtttatcaatttaaatggctttaggcttatagggggtgtaaactttaagaatataattctcccattcaagtttacagcaaacatctagccaccttcaaaacaaagaagatacagaccatcatttagcaatactaatacatgattttccttggggatggcaggtttgagaatcctttagcaacaggacatacttcccctaaattacagtgaattatttataacgagataaagctttcaggtacaagctgaaggtggggtgtctaacaactaaaaactatcactaaatctcaaagagaaagttcttgcaaaatatgtaaagttcacaaggtgcagacattttccttctttaggcttttatctaaggaagggctatgaaactgggcccatctgtatacaggctcaaatttacgtttttaaaggaagaatctatgcagctgaggcttattgcaggaaatacttcatttgtatgtaaatattattgtaaataaataggaggctgtatatttttgaagttgttgatccgcactgaaatagaagtctctaggatctgcatataaacaataaatgtttcctagaaattagtggtttgtttgggaattagaaaaatttacattctctcccaggtaacatagttctctcaatgtaaacttggaacctgaaaccctacttaatttagagaaagaaatgtctgagaaatagttcccttgatttcttatgctggcattaagatcaattatttaacagatagtcctctgagatacaagtaaggaatatttagacacaaatccttgtcctatagaaacagatatacccaaatgacaaattgtttcttcataatgatcttccatttttaacactgataccactacacagtacatatgaaaacagaagctggggagaagaatgtttttttcacaattgaattgctgcatttctcaaactttgggatctatgaaagcggggagagggaacctgaatattaattatgagcacaaatttgaaggaaagaaaacaaagaaccattatctaatcaagctttgaaagtcctgcatgtttgccttttattttagtgttgacgccaacatagactgtctaaggtatttttttccccaaacacttgaatcttggtcgttggtatgtaatccactctctagagtccagtgtactttagacttcatctgagtccaatacatgtaccacactactgttttattaatgtaaaaaccttgtaaatgaatttcagatgggtgatttaagtgagtcacaagtcacaaaactttgctattcatagttaatcaaatagaactgggttttttttttcagagtgtggtgtaaataaagaaatataagaagttctgttctataactgctctgttaacatagtttttaaacattaaaaaatgtgaactaaaagta

SEQ ID NO: 448197 - DNA, 8568 bp, Homo sapiens
ccaaaatgcaggccccagcggaacgcacagccctcctgtcctccgccggtgcccctttagccgccccacccccatccctaagggctctcattctccagctgcagccgcagctgggttccgaacacgccgccgggccccgggagggagaggggcaggtgccagggcggcgcgcagcctctgctcccggtgccagcttcagtgcgccgggcacacgcgcgccccgcaacccctccctcaccctttccccgttgctcaatctccgccagccgcggtcgctgcatcgtcagagagctgcaagagggaggcagcaaggtgcggccgccagcagtgacaccatgtgaccggcacggctcactgacacgcagctttggttaaagagcgggcgcacaggaggggaggagaccgcgcgcgggacggggaggaatggcctgtccgcgttaaaccatcacaagccatggttgcggaagggccacgcgtcccccagtaggagaatgactccgattcgtgaccctcagcgccggtgcatgtcgatgtaagtgcgaggccggcgagcagagtgtgagtgggggttggtggtgaggggagattctgatgcaatcggcccggaaaggaggagagccaggcgagcgcggactggggcggccacgccactccgccagaaggtcgccaggagcctccgcccttcaccttcctccgaaatccgccaggccacgccaagctccctgcccaacccttactgacgggggccacattttcccggcctccgcagccagaccttgacacaaaggacatcaaactgccgagggtaaaaaccccggaagggcggacacctccacatcgccttttgccacctttccctttatttccggagagtcaaggaaacttttgagctatttacagcttgtagcaattatgtaaagtatactcctctgaacaaaatttggagcatgtttgtttctctctacctgatttccccagaatctggaaactatctatatttattgagtgtctactgtgtgccaggcactatatctatgtgcatagaaaaaccctggaaggccatacaacaatatatatagagtgatcgtctctgcttgctgagctaacaggggtgtcaagcttccattttggtatctacttctaaatacactcagaacaggagaaatttggactaattttcaaactacagacactttctaatcatgatgcatttcaaaagtggactcgaattaactgagttgcaaaacatgacagtgcccgaggatgataacattagcaatgactccaatgatttcaccgaagtagaaaatggtcagataaatagcaagtttatttctgatcgtgaaagtagaagaagtctcacaaacagccatttggaaaaaaagaagtgtgatgagtatattccaggtacaacctccttaggcatgtctgtttttaacctaagcaacgccattatgggcagtgggattttgggactcgcctttgccctggcaaacactggaatcctactttttctggtacttttgacttcagtgacattgctgtctatatattcaataaacctcctattgatctgttcaaaagaaacaggctgcatggtgtatgaaaagctgggggaacaagtctttggcaccacagggaagttcgtaatctttggagccacctctctacagaacactggagcaatgctgagctacctcttcatcgtaaaaaatgaactaccctctgccataaagtttctaatgggaaaggaagagacattttcagcctggtacgtggatggccgcgttctggtggtgatagttacctttggcataattctccctctgtgtctcttgaagaacttagggtatcttggctatactagtggattttccttgagctgtatggtttttttcctaattgtggttatttacaagaaatttcaaattccctgcattgttccagagctaaattcaacaataagtgctaattcaacaaatgctgacacgtgtacgccaaaatatgttaccttcaattcaaagaccgtgtatgctttacccaccattgcatttgcatttgtttgccacccgtcagtcctgccaatttacagtgagcttaaagaccgatcacagaaaaaaatgcagatggtttcaaacatctcctttttcgccatgtttgttatgtacttcttgactgccatttttggctacttgacattctatgacaacgtgcagtccgacctccttcacaaatatcagagtaaagatgacattctcatcctgacagtgcggctggctgtcattgttgctgtgatcctcacagtgccggtgttatttttcacggttcgttcatctttatttgaactggctaagaaaacaaagtttaatttatgtcgtcataccgtggttacctgcatactcttggttgttatcaacttgttggtgatcttcataccctccatgaaggatatttttggagtcgtaggagttacatctgctaacatgcttattttcattcttccttcatctctttatttaaaaatcacagaccaggatggagataaaggaactcaaagaatttgggctgcccttttcttgggcctgggggtgttgttctccttggtcagcattcccttggtcatctatgactgggcctgctcatcgagtagtgacgaaggccactgaaacccgccgagaaaaagaaacatccctgttgtctgctcagtcaagtccccacacatcagcaatctctcaccacttcttttgcaagtttacagaagcaaacagaaatgtacaggatacttaaaatggaataactttttggttgcaaaacagagacatggttctataatgcttcatgtccctccaagatttgagatcaatttagggattgtgaaatttttttttcaaatttcatacaatcatatttcccagtacttttcacaatcattttttacccatctaactctatgttttgtggcttcccggtctcttagaactttgaaaacatgatatacaataatgtttatttattatacatccagattctgaaataattttcctactgatgttcagctcacactatctgtacctttttagaagagaaaagaatcttgaattgtatatatttattttgctttacagaaaaaaatggtttcgtaaataatttgcctattttggttaacatagcacatggagataatcatctgaaagttatagggcactgccactgctgaatcagagcatgcccaatatttgaggtggctctgatttcctggcagctgaactcgggtagtccagtggcctagctggtaccacatctattcccatccagagacattctctggcaagtgttctcagctgaaaagtggttggggatgattcttaccttggtaattaaatgaagctacacatttgggtaatctagcaaatgaagtattttttccctcttggcaacttgtgtcagagttactctggtctgagtcaactttcgctggggaaaacctatggaacctactgcaaaaagattgtccaaaatgcctaagaaaatactcctctgatgcatttagccttcaaccctacctgtcttgctgaagggagaaaaatgttttagtacattataggcccagcagcttttattcatgtccaccagctagttgcacagagaatcatgtgtacctaactaaggatgatctaggataagtaactcctgttttatattgagtattttagggaagtctttaaaagacttgttttatatctataaatctaggttattacaaatacaagaattttgtaccttaaataagcctcatttctatttcttcttcattaattctccatctagtcttgtgaaaaaaaaaaaaaaccctcagagatagtctttgtgaagagcttctgacagaatcactgagtaccttccttcccccagatgaggaagacaagggggtctcagtgtctgtgctgtctcctcttctcttccccaaccaaggactgtgccattactgcccgtctcaactgtccatgcaggaggacagagttgcctggtactcttacccttgtccctctcctaaagggagcacaaggaaactgaagagactgaaaaagaagagagtttgtagctgaaaaagaatagggatagcaaggaaacccagaactgcattcccctaagtggggccatcccatgtgattgaattgtccatagcttgcctatggtgagaaatgtgcatgctccgtgagctggtctcttgaaacaggacttatgcttcctctatattctggttaaattttccaaacacataagttcactgagcacagatttcttatccagagacaagtagaatctaaccgcagactgttggcagagtttccaggcacttagccatgttcccttcctgactcaaatccccaaaggccttcactctcactgagaatcacactactgtcccatagataaggcaggcattgaagcacctgtcgtgatcctctaggggggagaatgaaaggttatttcctgcattgcatcatcatagcttttaatataatgctacagaatcatatccacattaggttagagttcagatatttggatatgaatacctaacctagccatatccatggccatctctgttcttttcagcaatgttttccatattatattagcaatgacagaaacagaacaagccaagatccagtcagttcttgggagcttgtctagagcaccaagtaatgaaatagccaggtagtgggatgactgtacctttaaaaatacataatttagtttgcaagctatattatgctactttctattttccttgttactttatagcaattcattttaccctcacaaagtcaatttagaaccttatcattaactgggatgtgtagtgatatttttgggcctctgggtttcatgtgtcaatacaaggaatatttatttaaaatagatttatttagaggaggcacagtgttgttgatctgtgtgacaccacccatatttttaaaaacctttgtatgtttctctaaatttgttgttgactgaatataatagaccctaccataattcgtcaaatatcactgattagttacatcctttgtgtgagattagctgtaaagtatactgctcttattcttattcagaatagttaattggtagccaaaaatacatgtatcacagatgttaggtcgaatttaaacagcacagtcaagtgctatggaagtttttctgctaaattagtagattaaagaatactataccctaggcatggggagcagcacgttttcctttggtaggtaggatctctatactagtgaacagtgccagttccacactttggacttagaactgttctctagttattgtaacacagaatactgtcaatccctaatttacttaatgttacttattggaagtggggctgatgaaatacgcacaggagggaaatctactgtgtttaggcacaggcagccccagtgtataaggagatcatattccaaaaggttgtcagttggttgtttgcaacctggaatgtattttcctttagagaccaggttatccatggtggttaggcccctagagcagctggaaaagatgatcaaaccaataggttagctgacatcgaataatgtaataggtttgctaaagaatctaaccatcaaatataatattgtttccagggagggtgtttgttcagagttgcctgttagtagaatctggactgtccatcccagccacatcccacctactggacagtaggggtagagatgccaccagactacaggtgaccagattggcctgaaacatggtgtccagtaaaaacggggaggaataagtccatgactgccggagagcttggtggtaggaggagggtgaaggagggtgagggggcctctcatgggtcagaaacctccagggacatccctcagctggtaactctgctgttgtccggagggttcaggcttggtgtgccttcttctgtttgtctgacttttggctcctatggttcatctcctgccctgcccaccacagaaaaggatgctgctgcacagcttctccaatgtaccagtcattgaggccagcgcgcagcacttttaatgtttttagtgctagtaactgtgttttaactctccaggaataagctgggaggttagaaaacaagaaaaaagggggaaaaaaaaacctctccacccactttccttttttacagttacagaccctgttgagaaaaagaagcacccagatgggtgatggtgatagggcttgtggtggacacagggttgtggtaagattcctcagtgcttcggcgagcacctaagactattaccctggaactgactgctttctagagcttgattcatgcctctaagccagtggttctcaaagtgtggcccctagaccagtagcatcagcatcatcggggacctcattagaatgcagattctcagccccctcccagacatggtgaagtcagaagctctcagggagggactcagcaaatgattctaaagcgcatcaagtttgagaaccaccctaagccaatgagtctcccttttacttcccattagtcctccctcaccagatgattcctaggactcatggtgcaacatacaggagccaggctttagggaggggaggaaaggagcctggcggcaggggtctctgcaatggcaagaaagtgagtgaatccagcgctgccacctggttatccccttctcgttgaaaatagcagcgcgggtgcaaattcctaaacacaggctgcctgcactcggtgttacctcgggctgaggcatgataatattttattttttaaagctgtgaggaaatgaaagtgaggctttggttggggcgaggcagttgtgaaagaaattaaaataaaagaccctttgtaaatgcagacttagaagaaatactgaatttgtgtcagaagttctccagtgtttgtgttaatcgtgtggtgataatcctgtcctccttttaaagcgaattctctactgaaaggtctgctctgcttaaggagctacaaactgctctcaaaagaatgaaatactgagttccaattcagtgaggcacagtgttggactatggcacatttagttggagtcggggggaggtcaggaatatgatcagataatggattttataccttagagcaaaatctattagtctctctcagtttatcaatttaaatggctttaggcttatagggggtgtaaactttaagaatataattctcccattcaagtttacagcaaacatctagccaccttcaaaacaaagaagatacagaccatcatttagcaatactaatacatgattttccttggggatggcaggtttgagaatcctttagcaacaggacatacttcccctaaattacagtgaattatttataacgagataaagctttcaggtacaagctgaaggtggggtgtctaacaactaaaaactatcactaaatctcaaagagaaagttcttgcaaaatatgtaaagttcacaaggtgcagacattttccttctttaggcttttatctaaggaagggctatgaaactgggcccatctgtatacaggctcaaatttacgtttttaaaggaagaatctatgcagctgaggcttattgcaggaaatacttcatttgtatgtaaatattattgtaaataaataggaggctgtatatttttgaagttgttgatccgcactgaaatagaagtctctaggatctgcatataaacaataaatgtttcctagaaattagtggtttgtttgggaattagaaaaatttacattctctcccaggtaacatagttctctcaatgtaaacttggaacctgaaaccctacttaatttagagaaagaaatgtctgagaaatagttcccttgatttcttatgctggcattaagatcaattatttaacagatagtcctctgagatacaagtaaggaatatttagacacaaatccttgtcctatagaaacagatatacccaaatgacaaattgtttcttcataatgatcttccatttttaacactgataccactacacagtacatatgaaaacagaagctggggagaagaatgtttttttcacaattgaattgctgcatttctcaaactttgggatctatgaaagcggggagagggaacctgaatattaattatgagcacaaatttgaaggaaagaaaacaaagaaccattatctaatcaagctttgaaagtcctgcatgtttgccttttattttagtgttgacgccaacatagactgtctaaggtatttttttccccaaacacttgaatcttggtcgttggtatgtaatccactctctagagtccagtgtactttagacttcatctgagtccaatacatgtaccacactactgttttattaatgtaaaaaccttgtaaatgaatttcagatgggtgatttaagtgagtcacaagtcacaaaactttgctattcatagttaatcaaatagaactgggttttttttttcagagtgtggtgtaaataaagaaatataagaagttctgttctataactgctctgttaacatagtttttaaacattaaaaaatgtgaactaaaagta

SEQ ID NO: 448198 - DNA, 8229 bp, Homo sapiens
ccaaaatgcaggccccagcggaacgcacagccctcctgtcctccgccggtgcccctttagccgccccacccccatccctaagggctctcattctccagctgcagccgcagctgggttccgaacacgccgccgggccccgggagggagaggggcaggtgccagggcggcgcgcagcctctgctcccggtgccagcttcagtgcgccgggcacacgcgcgccccgcaacccctccctcaccctttccccgttgctcaatctccgccagccgcggtcgctgcatcgtcagagagctgcaagagggaggcagcaaggtgcggccgccagcagtgacaccatgtgaccggcacggctcactgacacgcagctttggttaaagagcgggcgcacaggaggggaggagaccgcgcgcgggacggggaggaatggcctgtccgcgttaaaccatcacaagccatggttgcggaagggccacgcgtcccccagtaggagaatgactccgattcgtgaccctcagcgccggtgcatgtcgatagtcaaggaaacttttgagctatttacagcttgtagcaattatgtaaagtatactcctctgaacaaaatttggagcatgtttgtttctctctacctgatttccccagaatctggaaactatctatatttattgagtgtctactgtgtgccaggcactatatctatgtgcatagaaaaaccctggaaggccatacaacaatatatatagagtgatcgtctctgcttgctgagctaacaggggtgtcaagcttccattttggtatctacttctaaatacactcagaacaggagaaatttggactaattttcaaactacagacactttctaatcatgatgcatttcaaaagtggactcgaattaactgagttgcaaaacatgacagtgcccgaggatgataacattagcaatgactccaatgatttcaccgaagtagaaaatggtcagataaatagcaagtttatttctgatcgtgaaagtagaagaagtctcacaaacagccatttggaaaaaaagaagtgtgatgagtatattccaggtacaacctccttaggcatgtctgtttttaacctaagcaacgccattatgggcagtgggattttgggactcgcctttgccctggcaaacactggaatcctactttttctggtacttttgacttcagtgacattgctgtctatatattcaataaacctcctattgatctgttcaaaagaaacaggctgcatggtgtatgaaaagctgggggaacaagtctttggcaccacagggaagttcgtaatctttggagccacctctctacagaacactggagcaatgctgagctacctcttcatcgtaaaaaatgaactaccctctgccataaagtttctaatgggaaaggaagagacattttcagcctggtacgtggatggccgcgttctggtggtgatagttacctttggcataattctccctctgtgtctcttgaagaacttagggtatcttggctatactagtggattttccttgagctgtatggtttttttcctaattgtggttatttacaagaaatttcaaattccctgcattgttccagagctaaattcaacaataagtgctaattcaacaaatgctgacacgtgtacgccaaaatatgttaccttcaattcaaagaccgtgtatgctttacccaccattgcatttgcatttgtttgccacccgtcagtcctgccaatttacagtgagcttaaagaccgatcacagaaaaaaatgcagatggtttcaaacatctcctttttcgccatgtttgttatgtacttcttgactgccatttttggctacttgacattctatgacaacgtgcagtccgacctccttcacaaatatcagagtaaagatgacattctcatcctgacagtgcggctggctgtcattgttgctgtgatcctcacagtgccggtgttatttttcacggttcgttcatctttatttgaactggctaagaaaacaaagtttaatttatgtcgtcataccgtggttacctgcatactcttggttgttatcaacttgttggtgatcttcataccctccatgaaggatatttttggagtcgtaggagttacatctgctaacatgcttattttcattcttccttcatctctttatttaaaaatcacagaccaggatggagataaaggaactcaaagaatttgggctgcccttttcttgggcctgggggtgttgttctccttggtcagcattcccttggtcatctatgactgggcctgctcatcgagtagtgacgaaggccactgaaacccgccgagaaaaagaaacatccctgttgtctgctcagtcaagtccccacacatcagcaatctctcaccacttcttttgcaagtttacagaagcaaacagaaatgtacaggatacttaaaatggaataactttttggttgcaaaacagagacatggttctataatgcttcatgtccctccaagatttgagatcaatttagggattgtgaaatttttttttcaaatttcatacaatcatatttcccagtacttttcacaatcattttttacccatctaactctatgttttgtggcttcccggtctcttagaactttgaaaacatgatatacaataatgtttatttattatacatccagattctgaaataattttcctactgatgttcagctcacactatctgtacctttttagaagagaaaagaatcttgaattgtatatatttattttgctttacagaaaaaaatggtttcgtaaataatttgcctattttggttaacatagcacatggagataatcatctgaaagttatagggcactgccactgctgaatcagagcatgcccaatatttgaggtggctctgatttcctggcagctgaactcgggtagtccagtggcctagctggtaccacatctattcccatccagagacattctctggcaagtgttctcagctgaaaagtggttggggatgattcttaccttggtaattaaatgaagctacacatttgggtaatctagcaaatgaagtattttttccctcttggcaacttgtgtcagagttactctggtctgagtcaactttcgctggggaaaacctatggaacctactgcaaaaagattgtccaaaatgcctaagaaaatactcctctgatgcatttagccttcaaccctacctgtcttgctgaagggagaaaaatgttttagtacattataggcccagcagcttttattcatgtccaccagctagttgcacagagaatcatgtgtacctaactaaggatgatctaggataagtaactcctgttttatattgagtattttagggaagtctttaaaagacttgttttatatctataaatctaggttattacaaatacaagaattttgtaccttaaataagcctcatttctatttcttcttcattaattctccatctagtcttgtgaaaaaaaaaaaaaaccctcagagatagtctttgtgaagagcttctgacagaatcactgagtaccttccttcccccagatgaggaagacaagggggtctcagtgtctgtgctgtctcctcttctcttccccaaccaaggactgtgccattactgcccgtctcaactgtccatgcaggaggacagagttgcctggtactcttacccttgtccctctcctaaagggagcacaaggaaactgaagagactgaaaaagaagagagtttgtagctgaaaaagaatagggatagcaaggaaacccagaactgcattcccctaagtggggccatcccatgtgattgaattgtccatagcttgcctatggtgagaaatgtgcatgctccgtgagctggtctcttgaaacaggacttatgcttcctctatattctggttaaattttccaaacacataagttcactgagcacagatttcttatccagagacaagtagaatctaaccgcagactgttggcagagtttccaggcacttagccatgttcccttcctgactcaaatccccaaaggccttcactctcactgagaatcacactactgtcccatagataaggcaggcattgaagcacctgtcgtgatcctctaggggggagaatgaaaggttatttcctgcattgcatcatcatagcttttaatataatgctacagaatcatatccacattaggttagagttcagatatttggatatgaatacctaacctagccatatccatggccatctctgttcttttcagcaatgttttccatattatattagcaatgacagaaacagaacaagccaagatccagtcagttcttgggagcttgtctagagcaccaagtaatgaaatagccaggtagtgggatgactgtacctttaaaaatacataatttagtttgcaagctatattatgctactttctattttccttgttactttatagcaattcattttaccctcacaaagtcaatttagaaccttatcattaactgggatgtgtagtgatatttttgggcctctgggtttcatgtgtcaatacaaggaatatttatttaaaatagatttatttagaggaggcacagtgttgttgatctgtgtgacaccacccatatttttaaaaacctttgtatgtttctctaaatttgttgttgactgaatataatagaccctaccataattcgtcaaatatcactgattagttacatcctttgtgtgagattagctgtaaagtatactgctcttattcttattcagaatagttaattggtagccaaaaatacatgtatcacagatgttaggtcgaatttaaacagcacagtcaagtgctatggaagtttttctgctaaattagtagattaaagaatactataccctaggcatggggagcagcacgttttcctttggtaggtaggatctctatactagtgaacagtgccagttccacactttggacttagaactgttctctagttattgtaacacagaatactgtcaatccctaatttacttaatgttacttattggaagtggggctgatgaaatacgcacaggagggaaatctactgtgtttaggcacaggcagccccagtgtataaggagatcatattccaaaaggttgtcagttggttgtttgcaacctggaatgtattttcctttagagaccaggttatccatggtggttaggcccctagagcagctggaaaagatgatcaaaccaataggttagctgacatcgaataatgtaataggtttgctaaagaatctaaccatcaaatataatattgtttccagggagggtgtttgttcagagttgcctgttagtagaatctggactgtccatcccagccacatcccacctactggacagtaggggtagagatgccaccagactacaggtgaccagattggcctgaaacatggtgtccagtaaaaacggggaggaataagtccatgactgccggagagcttggtggtaggaggagggtgaaggagggtgagggggcctctcatgggtcagaaacctccagggacatccctcagctggtaactctgctgttgtccggagggttcaggcttggtgtgccttcttctgtttgtctgacttttggctcctatggttcatctcctgccctgcccaccacagaaaaggatgctgctgcacagcttctccaatgtaccagtcattgaggccagcgcgcagcacttttaatgtttttagtgctagtaactgtgttttaactctccaggaataagctgggaggttagaaaacaagaaaaaagggggaaaaaaaaacctctccacccactttccttttttacagttacagaccctgttgagaaaaagaagcacccagatgggtgatggtgatagggcttgtggtggacacagggttgtggtaagattcctcagtgcttcggcgagcacctaagactattaccctggaactgactgctttctagagcttgattcatgcctctaagccagtggttctcaaagtgtggcccctagaccagtagcatcagcatcatcggggacctcattagaatgcagattctcagccccctcccagacatggtgaagtcagaagctctcagggagggactcagcaaatgattctaaagcgcatcaagtttgagaaccaccctaagccaatgagtctcccttttacttcccattagtcctccctcaccagatgattcctaggactcatggtgcaacatacaggagccaggctttagggaggggaggaaaggagcctggcggcaggggtctctgcaatggcaagaaagtgagtgaatccagcgctgccacctggttatccccttctcgttgaaaatagcagcgcgggtgcaaattcctaaacacaggctgcctgcactcggtgttacctcgggctgaggcatgataatattttattttttaaagctgtgaggaaatgaaagtgaggctttggttggggcgaggcagttgtgaaagaaattaaaataaaagaccctttgtaaatgcagacttagaagaaatactgaatttgtgtcagaagttctccagtgtttgtgttaatcgtgtggtgataatcctgtcctccttttaaagcgaattctctactgaaaggtctgctctgcttaaggagctacaaactgctctcaaaagaatgaaatactgagttccaattcagtgaggcacagtgttggactatggcacatttagttggagtcggggggaggtcaggaatatgatcagataatggattttataccttagagcaaaatctattagtctctctcagtttatcaatttaaatggctttaggcttatagggggtgtaaactttaagaatataattctcccattcaagtttacagcaaacatctagccaccttcaaaacaaagaagatacagaccatcatttagcaatactaatacatgattttccttggggatggcaggtttgagaatcctttagcaacaggacatacttcccctaaattacagtgaattatttataacgagataaagctttcaggtacaagctgaaggtggggtgtctaacaactaaaaactatcactaaatctcaaagagaaagttcttgcaaaatatgtaaagttcacaaggtgcagacattttccttctttaggcttttatctaaggaagggctatgaaactgggcccatctgtatacaggctcaaatttacgtttttaaaggaagaatctatgcagctgaggcttattgcaggaaatacttcatttgtatgtaaatattattgtaaataaataggaggctgtatatttttgaagttgttgatccgcactgaaatagaagtctctaggatctgcatataaacaataaatgtttcctagaaattagtggtttgtttgggaattagaaaaatttacattctctcccaggtaacatagttctctcaatgtaaacttggaacctgaaaccctacttaatttagagaaagaaatgtctgagaaatagttcccttgatttcttatgctggcattaagatcaattatttaacagatagtcctctgagatacaagtaaggaatatttagacacaaatccttgtcctatagaaacagatatacccaaatgacaaattgtttcttcataatgatcttccatttttaacactgataccactacacagtacatatgaaaacagaagctggggagaagaatgtttttttcacaattgaattgctgcatttctcaaactttgggatctatgaaagcggggagagggaacctgaatattaattatgagcacaaatttgaaggaaagaaaacaaagaaccattatctaatcaagctttgaaagtcctgcatgtttgccttttattttagtgttgacgccaacatagactgtctaaggtatttttttccccaaacacttgaatcttggtcgttggtatgtaatccactctctagagtccagtgtactttagacttcatctgagtccaatacatgtaccacactactgttttattaatgtaaaaaccttgtaaatgaatttcagatgggtgatttaagtgagtcacaagtcacaaaactttgctattcatagttaatcaaatagaactgggttttttttttcagagtgtggtgtaaataaagaaatataagaagttctgttctataactgctctgttaacatagtttttaaacattaaaaaatgtgaactaaaagta

SEQ ID NO: 448199 - DNA, 7730 bp, Homo sapiens
agtcctttgtcttgctctgcggcgcggacccggggtttgtacaaaccctcgttctctgttagaaacctaactgccgccaggatcacgtactttctcggacgaatccgcggtgatgtgtgtagcaaaagtgaaaaaagacgcctctgctagaaaacgatatttattgagtgtctactgtgtgccaggcactatatctatgtgcatagaaaaaccctggaaggccatacaacaatatatatagagtgatcgtctctgcttgctgagctaacaggggtgtcaagcttccattttggtatctacttctaaatacactcagaacaggagaaatttggactaattttcaaactacagacactttctaatcatgatgcatttcaaaagtggactcgaattaactgagttgcaaaacatgacagtgcccgaggatgataacattagcaatgactccaatgatttcaccgaagtagaaaatggtcagataaatagcaagtttatttctgatcgtgaaagtagaagaagtctcacaaacagccatttggaaaaaaagaagtgtgatgagtatattccaggtacaacctccttaggcatgtctgtttttaacctaagcaacgccattatgggcagtgggattttgggactcgcctttgccctggcaaacactggaatcctactttttctggtacttttgacttcagtgacattgctgtctatatattcaataaacctcctattgatctgttcaaaagaaacaggctgcatggtgtatgaaaagctgggggaacaagtctttggcaccacagggaagttcgtaatctttggagccacctctctacagaacactggagcaatgctgagctacctcttcatcgtaaaaaatgaactaccctctgccataaagtttctaatgggaaaggaagagacattttcagcctggtacgtggatggccgcgttctggtggtgatagttacctttggcataattctccctctgtgtctcttgaagaacttagggtatcttggctatactagtggattttccttgagctgtatggtttttttcctaattgtggttatttacaagaaatttcaaattccctgcattgttccagagctaaattcaacaataagtgctaattcaacaaatgctgacacgtgtacgccaaaatatgttaccttcaattcaaagaccgtgtatgctttacccaccattgcatttgcatttgtttgccacccgtcagtcctgccaatttacagtgagcttaaagaccgatcacagaaaaaaatgcagatggtttcaaacatctcctttttcgccatgtttgttatgtacttcttgactgccatttttggctacttgacattctatgacaacgtgcagtccgacctccttcacaaatatcagagtaaagatgacattctcatcctgacagtgcggctggctgtcattgttgctgtgatcctcacagtgccggtgttatttttcacggttcgttcatctttatttgaactggctaagaaaacaaagtttaatttatgtcgtcataccgtggttacctgcatactcttggttgttatcaacttgttggtgatcttcataccctccatgaaggatatttttggagtcgtaggagttacatctgctaacatgcttattttcattcttccttcatctctttatttaaaaatcacagaccaggatggagataaaggaactcaaagaatttgggctgcccttttcttgggcctgggggtgttgttctccttggtcagcattcccttggtcatctatgactgggcctgctcatcgagtagtgacgaaggccactgaaacccgccgagaaaaagaaacatccctgttgtctgctcagtcaagtccccacacatcagcaatctctcaccacttcttttgcaagtttacagaagcaaacagaaatgtacaggatacttaaaatggaataactttttggttgcaaaacagagacatggttctataatgcttcatgtccctccaagatttgagatcaatttagggattgtgaaatttttttttcaaatttcatacaatcatatttcccagtacttttcacaatcattttttacccatctaactctatgttttgtggcttcccggtctcttagaactttgaaaacatgatatacaataatgtttatttattatacatccagattctgaaataattttcctactgatgttcagctcacactatctgtacctttttagaagagaaaagaatcttgaattgtatatatttattttgctttacagaaaaaaatggtttcgtaaataatttgcctattttggttaacatagcacatggagataatcatctgaaagttatagggcactgccactgctgaatcagagcatgcccaatatttgaggtggctctgatttcctggcagctgaactcgggtagtccagtggcctagctggtaccacatctattcccatccagagacattctctggcaagtgttctcagctgaaaagtggttggggatgattcttaccttggtaattaaatgaagctacacatttgggtaatctagcaaatgaagtattttttccctcttggcaacttgtgtcagagttactctggtctgagtcaactttcgctggggaaaacctatggaacctactgcaaaaagattgtccaaaatgcctaagaaaatactcctctgatgcatttagccttcaaccctacctgtcttgctgaagggagaaaaatgttttagtacattataggcccagcagcttttattcatgtccaccagctagttgcacagagaatcatgtgtacctaactaaggatgatctaggataagtaactcctgttttatattgagtattttagggaagtctttaaaagacttgttttatatctataaatctaggttattacaaatacaagaattttgtaccttaaataagcctcatttctatttcttcttcattaattctccatctagtcttgtgaaaaaaaaaaaaaaccctcagagatagtctttgtgaagagcttctgacagaatcactgagtaccttccttcccccagatgaggaagacaagggggtctcagtgtctgtgctgtctcctcttctcttccccaaccaaggactgtgccattactgcccgtctcaactgtccatgcaggaggacagagttgcctggtactcttacccttgtccctctcctaaagggagcacaaggaaactgaagagactgaaaaagaagagagtttgtagctgaaaaagaatagggatagcaaggaaacccagaactgcattcccctaagtggggccatcccatgtgattgaattgtccatagcttgcctatggtgagaaatgtgcatgctccgtgagctggtctcttgaaacaggacttatgcttcctctatattctggttaaattttccaaacacataagttcactgagcacagatttcttatccagagacaagtagaatctaaccgcagactgttggcagagtttccaggcacttagccatgttcccttcctgactcaaatccccaaaggccttcactctcactgagaatcacactactgtcccatagataaggcaggcattgaagcacctgtcgtgatcctctaggggggagaatgaaaggttatttcctgcattgcatcatcatagcttttaatataatgctacagaatcatatccacattaggttagagttcagatatttggatatgaatacctaacctagccatatccatggccatctctgttcttttcagcaatgttttccatattatattagcaatgacagaaacagaacaagccaagatccagtcagttcttgggagcttgtctagagcaccaagtaatgaaatagccaggtagtgggatgactgtacctttaaaaatacataatttagtttgcaagctatattatgctactttctattttccttgttactttatagcaattcattttaccctcacaaagtcaatttagaaccttatcattaactgggatgtgtagtgatatttttgggcctctgggtttcatgtgtcaatacaaggaatatttatttaaaatagatttatttagaggaggcacagtgttgttgatctgtgtgacaccacccatatttttaaaaacctttgtatgtttctctaaatttgttgttgactgaatataatagaccctaccataattcgtcaaatatcactgattagttacatcctttgtgtgagattagctgtaaagtatactgctcttattcttattcagaatagttaattggtagccaaaaatacatgtatcacagatgttaggtcgaatttaaacagcacagtcaagtgctatggaagtttttctgctaaattagtagattaaagaatactataccctaggcatggggagcagcacgttttcctttggtaggtaggatctctatactagtgaacagtgccagttccacactttggacttagaactgttctctagttattgtaacacagaatactgtcaatccctaatttacttaatgttacttattggaagtggggctgatgaaatacgcacaggagggaaatctactgtgtttaggcacaggcagccccagtgtataaggagatcatattccaaaaggttgtcagttggttgtttgcaacctggaatgtattttcctttagagaccaggttatccatggtggttaggcccctagagcagctggaaaagatgatcaaaccaataggttagctgacatcgaataatgtaataggtttgctaaagaatctaaccatcaaatataatattgtttccagggagggtgtttgttcagagttgcctgttagtagaatctggactgtccatcccagccacatcccacctactggacagtaggggtagagatgccaccagactacaggtgaccagattggcctgaaacatggtgtccagtaaaaacggggaggaataagtccatgactgccggagagcttggtggtaggaggagggtgaaggagggtgagggggcctctcatgggtcagaaacctccagggacatccctcagctggtaactctgctgttgtccggagggttcaggcttggtgtgccttcttctgtttgtctgacttttggctcctatggttcatctcctgccctgcccaccacagaaaaggatgctgctgcacagcttctccaatgtaccagtcattgaggccagcgcgcagcacttttaatgtttttagtgctagtaactgtgttttaactctccaggaataagctgggaggttagaaaacaagaaaaaagggggaaaaaaaaacctctccacccactttccttttttacagttacagaccctgttgagaaaaagaagcacccagatgggtgatggtgatagggcttgtggtggacacagggttgtggtaagattcctcagtgcttcggcgagcacctaagactattaccctggaactgactgctttctagagcttgattcatgcctctaagccagtggttctcaaagtgtggcccctagaccagtagcatcagcatcatcggggacctcattagaatgcagattctcagccccctcccagacatggtgaagtcagaagctctcagggagggactcagcaaatgattctaaagcgcatcaagtttgagaaccaccctaagccaatgagtctcccttttacttcccattagtcctccctcaccagatgattcctaggactcatggtgcaacatacaggagccaggctttagggaggggaggaaaggagcctggcggcaggggtctctgcaatggcaagaaagtgagtgaatccagcgctgccacctggttatccccttctcgttgaaaatagcagcgcgggtgcaaattcctaaacacaggctgcctgcactcggtgttacctcgggctgaggcatgataatattttattttttaaagctgtgaggaaatgaaagtgaggctttggttggggcgaggcagttgtgaaagaaattaaaataaaagaccctttgtaaatgcagacttagaagaaatactgaatttgtgtcagaagttctccagtgtttgtgttaatcgtgtggtgataatcctgtcctccttttaaagcgaattctctactgaaaggtctgctctgcttaaggagctacaaactgctctcaaaagaatgaaatactgagttccaattcagtgaggcacagtgttggactatggcacatttagttggagtcggggggaggtcaggaatatgatcagataatggattttataccttagagcaaaatctattagtctctctcagtttatcaatttaaatggctttaggcttatagggggtgtaaactttaagaatataattctcccattcaagtttacagcaaacatctagccaccttcaaaacaaagaagatacagaccatcatttagcaatactaatacatgattttccttggggatggcaggtttgagaatcctttagcaacaggacatacttcccctaaattacagtgaattatttataacgagataaagctttcaggtacaagctgaaggtggggtgtctaacaactaaaaactatcactaaatctcaaagagaaagttcttgcaaaatatgtaaagttcacaaggtgcagacattttccttctttaggcttttatctaaggaagggctatgaaactgggcccatctgtatacaggctcaaatttacgtttttaaaggaagaatctatgcagctgaggcttattgcaggaaatacttcatttgtatgtaaatattattgtaaataaataggaggctgtatatttttgaagttgttgatccgcactgaaatagaagtctctaggatctgcatataaacaataaatgtttcctagaaattagtggtttgtttgggaattagaaaaatttacattctctcccaggtaacatagttctctcaatgtaaacttggaacctgaaaccctacttaatttagagaaagaaatgtctgagaaatagttcccttgatttcttatgctggcattaagatcaattatttaacagatagtcctctgagatacaagtaaggaatatttagacacaaatccttgtcctatagaaacagatatacccaaatgacaaattgtttcttcataatgatcttccatttttaacactgataccactacacagtacatatgaaaacagaagctggggagaagaatgtttttttcacaattgaattgctgcatttctcaaactttgggatctatgaaagcggggagagggaacctgaatattaattatgagcacaaatttgaaggaaagaaaacaaagaaccattatctaatcaagctttgaaagtcctgcatgtttgccttttattttagtgttgacgccaacatagactgtctaaggtatttttttccccaaacacttgaatcttggtcgttggtatgtaatccactctctagagtccagtgtactttagacttcatctgagtccaatacatgtaccacactactgttttattaatgtaaaaaccttgtaaatgaatttcagatgggtgatttaagtgagtcacaagtcacaaaactttgctattcatagttaatcaaatagaactgggttttttttttcagagtgtggtgtaaataaagaaatataagaagttctgttctataactgctctgttaacatagtttttaaacattaaaaaatgtgaactaaaagta

SEQ ID NO: 448200 - DNA, 7891 bp, Homo sapiens
ccaaaatgcaggccccagcggaacgcacagccctcctgtcctccgccggtgcccctttagccgccccacccccatccctaagggctctcattctccagctgcagccgcagctgggttccgaacacgccgccgggccccgggagggagaggggcaggtgccagggcggcgcgcagcctctgctcccggtgccagcttcagtgcgccgggcacacgcgcgccccgcaacccctccctcaccctttccccgttgctcaatctccgccagccgcggtcgctgcatcgtcagagagctgcaagagggaggcagcaaggtgcggccgccagcagtgacaccatgtgaccggcacggctcactgacacgcagctttggttaaagagcgggcgcacaggaggggaggagaccgcgcgcgggacggggaggaatggcctgtccgcgttaaaccatcacaagccatggttgcggaagggccacgcgtcccccagtaggagaatgactccgattcgtgaccctcagcgccggtgcatgtcgatatatttattgagtgtctactgtgtgccaggcactatatctatgtgcatagaaaaaccctggaaggccatacaacaatatatatagagtgatcgtctctgcttgctgagctaacagcaagtttatttctgatcgtgaaagtagaagaagtctcacaaacagccatttggaaaaaaagaagtgtgatgagtatattccaggtacaacctccttaggcatgtctgtttttaacctaagcaacgccattatgggcagtgggattttgggactcgcctttgccctggcaaacactggaatcctactttttctggtacttttgacttcagtgacattgctgtctatatattcaataaacctcctattgatctgttcaaaagaaacaggctgcatggtgtatgaaaagctgggggaacaagtctttggcaccacagggaagttcgtaatctttggagccacctctctacagaacactggagcaatgctgagctacctcttcatcgtaaaaaatgaactaccctctgccataaagtttctaatgggaaaggaagagacattttcagcctggtacgtggatggccgcgttctggtggtgatagttacctttggcataattctccctctgtgtctcttgaagaacttagggtatcttggctatactagtggattttccttgagctgtatggtttttttcctaattgtggttatttacaagaaatttcaaattccctgcattgttccagagctaaattcaacaataagtgctaattcaacaaatgctgacacgtgtacgccaaaatatgttaccttcaattcaaagaccgtgtatgctttacccaccattgcatttgcatttgtttgccacccgtcagtcctgccaatttacagtgagcttaaagaccgatcacagaaaaaaatgcagatggtttcaaacatctcctttttcgccatgtttgttatgtacttcttgactgccatttttggctacttgacattctatgacaacgtgcagtccgacctccttcacaaatatcagagtaaagatgacattctcatcctgacagtgcggctggctgtcattgttgctgtgatcctcacagtgccggtgttatttttcacggttcgttcatctttatttgaactggctaagaaaacaaagtttaatttatgtcgtcataccgtggttacctgcatactcttggttgttatcaacttgttggtgatcttcataccctccatgaaggatatttttggagtcgtaggagttacatctgctaacatgcttattttcattcttccttcatctctttatttaaaaatcacagaccaggatggagataaaggaactcaaagaatttgggctgcccttttcttgggcctgggggtgttgttctccttggtcagcattcccttggtcatctatgactgggcctgctcatcgagtagtgacgaaggccactgaaacccgccgagaaaaagaaacatccctgttgtctgctcagtcaagtccccacacatcagcaatctctcaccacttcttttgcaagtttacagaagcaaacagaaatgtacaggatacttaaaatggaataactttttggttgcaaaacagagacatggttctataatgcttcatgtccctccaagatttgagatcaatttagggattgtgaaatttttttttcaaatttcatacaatcatatttcccagtacttttcacaatcattttttacccatctaactctatgttttgtggcttcccggtctcttagaactttgaaaacatgatatacaataatgtttatttattatacatccagattctgaaataattttcctactgatgttcagctcacactatctgtacctttttagaagagaaaagaatcttgaattgtatatatttattttgctttacagaaaaaaatggtttcgtaaataatttgcctattttggttaacatagcacatggagataatcatctgaaagttatagggcactgccactgctgaatcagagcatgcccaatatttgaggtggctctgatttcctggcagctgaactcgggtagtccagtggcctagctggtaccacatctattcccatccagagacattctctggcaagtgttctcagctgaaaagtggttggggatgattcttaccttggtaattaaatgaagctacacatttgggtaatctagcaaatgaagtattttttccctcttggcaacttgtgtcagagttactctggtctgagtcaactttcgctggggaaaacctatggaacctactgcaaaaagattgtccaaaatgcctaagaaaatactcctctgatgcatttagccttcaaccctacctgtcttgctgaagggagaaaaatgttttagtacattataggcccagcagcttttattcatgtccaccagctagttgcacagagaatcatgtgtacctaactaaggatgatctaggataagtaactcctgttttatattgagtattttagggaagtctttaaaagacttgttttatatctataaatctaggttattacaaatacaagaattttgtaccttaaataagcctcatttctatttcttcttcattaattctccatctagtcttgtgaaaaaaaaaaaaaaccctcagagatagtctttgtgaagagcttctgacagaatcactgagtaccttccttcccccagatgaggaagacaagggggtctcagtgtctgtgctgtctcctcttctcttccccaaccaaggactgtgccattactgcccgtctcaactgtccatgcaggaggacagagttgcctggtactcttacccttgtccctctcctaaagggagcacaaggaaactgaagagactgaaaaagaagagagtttgtagctgaaaaagaatagggatagcaaggaaacccagaactgcattcccctaagtggggccatcccatgtgattgaattgtccatagcttgcctatggtgagaaatgtgcatgctccgtgagctggtctcttgaaacaggacttatgcttcctctatattctggttaaattttccaaacacataagttcactgagcacagatttcttatccagagacaagtagaatctaaccgcagactgttggcagagtttccaggcacttagccatgttcccttcctgactcaaatccccaaaggccttcactctcactgagaatcacactactgtcccatagataaggcaggcattgaagcacctgtcgtgatcctctaggggggagaatgaaaggttatttcctgcattgcatcatcatagcttttaatataatgctacagaatcatatccacattaggttagagttcagatatttggatatgaatacctaacctagccatatccatggccatctctgttcttttcagcaatgttttccatattatattagcaatgacagaaacagaacaagccaagatccagtcagttcttgggagcttgtctagagcaccaagtaatgaaatagccaggtagtgggatgactgtacctttaaaaatacataatttagtttgcaagctatattatgctactttctattttccttgttactttatagcaattcattttaccctcacaaagtcaatttagaaccttatcattaactgggatgtgtagtgatatttttgggcctctgggtttcatgtgtcaatacaaggaatatttatttaaaatagatttatttagaggaggcacagtgttgttgatctgtgtgacaccacccatatttttaaaaacctttgtatgtttctctaaatttgttgttgactgaatataatagaccctaccataattcgtcaaatatcactgattagttacatcctttgtgtgagattagctgtaaagtatactgctcttattcttattcagaatagttaattggtagccaaaaatacatgtatcacagatgttaggtcgaatttaaacagcacagtcaagtgctatggaagtttttctgctaaattagtagattaaagaatactataccctaggcatggggagcagcacgttttcctttggtaggtaggatctctatactagtgaacagtgccagttccacactttggacttagaactgttctctagttattgtaacacagaatactgtcaatccctaatttacttaatgttacttattggaagtggggctgatgaaatacgcacaggagggaaatctactgtgtttaggcacaggcagccccagtgtataaggagatcatattccaaaaggttgtcagttggttgtttgcaacctggaatgtattttcctttagagaccaggttatccatggtggttaggcccctagagcagctggaaaagatgatcaaaccaataggttagctgacatcgaataatgtaataggtttgctaaagaatctaaccatcaaatataatattgtttccagggagggtgtttgttcagagttgcctgttagtagaatctggactgtccatcccagccacatcccacctactggacagtaggggtagagatgccaccagactacaggtgaccagattggcctgaaacatggtgtccagtaaaaacggggaggaataagtccatgactgccggagagcttggtggtaggaggagggtgaaggagggtgagggggcctctcatgggtcagaaacctccagggacatccctcagctggtaactctgctgttgtccggagggttcaggcttggtgtgccttcttctgtttgtctgacttttggctcctatggttcatctcctgccctgcccaccacagaaaaggatgctgctgcacagcttctccaatgtaccagtcattgaggccagcgcgcagcacttttaatgtttttagtgctagtaactgtgttttaactctccaggaataagctgggaggttagaaaacaagaaaaaagggggaaaaaaaaacctctccacccactttccttttttacagttacagaccctgttgagaaaaagaagcacccagatgggtgatggtgatagggcttgtggtggacacagggttgtggtaagattcctcagtgcttcggcgagcacctaagactattaccctggaactgactgctttctagagcttgattcatgcctctaagccagtggttctcaaagtgtggcccctagaccagtagcatcagcatcatcggggacctcattagaatgcagattctcagccccctcccagacatggtgaagtcagaagctctcagggagggactcagcaaatgattctaaagcgcatcaagtttgagaaccaccctaagccaatgagtctcccttttacttcccattagtcctccctcaccagatgattcctaggactcatggtgcaacatacaggagccaggctttagggaggggaggaaaggagcctggcggcaggggtctctgcaatggcaagaaagtgagtgaatccagcgctgccacctggttatccccttctcgttgaaaatagcagcgcgggtgcaaattcctaaacacaggctgcctgcactcggtgttacctcgggctgaggcatgataatattttattttttaaagctgtgaggaaatgaaagtgaggctttggttggggcgaggcagttgtgaaagaaattaaaataaaagaccctttgtaaatgcagacttagaagaaatactgaatttgtgtcagaagttctccagtgtttgtgttaatcgtgtggtgataatcctgtcctccttttaaagcgaattctctactgaaaggtctgctctgcttaaggagctacaaactgctctcaaaagaatgaaatactgagttccaattcagtgaggcacagtgttggactatggcacatttagttggagtcggggggaggtcaggaatatgatcagataatggattttataccttagagcaaaatctattagtctctctcagtttatcaatttaaatggctttaggcttatagggggtgtaaactttaagaatataattctcccattcaagtttacagcaaacatctagccaccttcaaaacaaagaagatacagaccatcatttagcaatactaatacatgattttccttggggatggcaggtttgagaatcctttagcaacaggacatacttcccctaaattacagtgaattatttataacgagataaagctttcaggtacaagctgaaggtggggtgtctaacaactaaaaactatcactaaatctcaaagagaaagttcttgcaaaatatgtaaagttcacaaggtgcagacattttccttctttaggcttttatctaaggaagggctatgaaactgggcccatctgtatacaggctcaaatttacgtttttaaaggaagaatctatgcagctgaggcttattgcaggaaatacttcatttgtatgtaaatattattgtaaataaataggaggctgtatatttttgaagttgttgatccgcactgaaatagaagtctctaggatctgcatataaacaataaatgtttcctagaaattagtggtttgtttgggaattagaaaaatttacattctctcccaggtaacatagttctctcaatgtaaacttggaacctgaaaccctacttaatttagagaaagaaatgtctgagaaatagttcccttgatttcttatgctggcattaagatcaattatttaacagatagtcctctgagatacaagtaaggaatatttagacacaaatccttgtcctatagaaacagatatacccaaatgacaaattgtttcttcataatgatcttccatttttaacactgataccactacacagtacatatgaaaacagaagctggggagaagaatgtttttttcacaattgaattgctgcatttctcaaactttgggatctatgaaagcggggagagggaacctgaatattaattatgagcacaaatttgaaggaaagaaaacaaagaaccattatctaatcaagctttgaaagtcctgcatgtttgccttttattttagtgttgacgccaacatagactgtctaaggtatttttttccccaaacacttgaatcttggtcgttggtatgtaatccactctctagagtccagtgtactttagacttcatctgagtccaatacatgtaccacactactgttttattaatgtaaaaaccttgtaaatgaatttcagatgggtgatttaagtgagtcacaagtcacaaaactttgctattcatagttaatcaaatagaactgggttttttttttcagagtgtggtgtaaataaagaaatataagaagttctgttctataactgctctgttaacatagtttttaaacattaaaaaatgtgaactaaaagta

SEQ ID NO: 448201 - DNA, 8052 bp, Homo sapiens
ccaaaatgcaggccccagcggaacgcacagccctcctgtcctccgccggtgcccctttagccgccccacccccatccctaagggctctcattctccagctgcagccgcagctgggttccgaacacgccgccgggccccgggagggagaggggcaggtgccagggcggcgcgcagcctctgctcccggtgccagcttcagtgcgccgggcacacgcgcgccccgcaacccctccctcaccctttccccgttgctcaatctccgccagccgcggtcgctgcatcgtcagagagctgcaagagggaggcagcaaggtgcggccgccagcagtgacaccatgtgaccggcacggctcactgacacgcagctttggttaaagagcgggcgcacaggaggggaggagaccgcgcgcgggacggggaggaatggcctgtccgcgttaaaccatcacaagccatggttgcggaagggccacgcgtcccccagtaggagaatgactccgattcgtgaccctcagcgccggtgcatgtcgatatatttattgagtgtctactgtgtgccaggcactatatctatgtgcatagaaaaaccctggaaggccatacaacaatatatatagagtgatcgtctctgcttgctgagctaacaggggtgtcaagcttccattttggtatctacttctaaatacactcagaacaggagaaatttggactaattttcaaactacagacactttctaatcatgatgcatttcaaaagtggactcgaattaactgagttgcaaaacatgacagtgcccgaggatgataacattagcaatgactccaatgatttcaccgaagtagaaaatggtcagataaatagcaagtttatttctgatcgtgaaagtagaagaagtctcacaaacagccatttggaaaaaaagaagtgtgatgagtatattccaggtacaacctccttaggcatgtctgtttttaacctaagcaacgccattatgggcagtgggattttgggactcgcctttgccctggcaaacactggaatcctactttttctggtacttttgacttcagtgacattgctgtctatatattcaataaacctcctattgatctgttcaaaagaaacaggctgcatggtgtatgaaaagctgggggaacaagtctttggcaccacagggaagttcgtaatctttggagccacctctctacagaacactggagcaatgctgagctacctcttcatcgtaaaaaatgaactaccctctgccataaagtttctaatgggaaaggaagagacattttcagcctggtacgtggatggccgcgttctggtggtgatagttacctttggcataattctccctctgtgtctcttgaagaacttagggtatcttggctatactagtggattttccttgagctgtatggtttttttcctaattgtggttatttacaagaaatttcaaattccctgcattgttccagagctaaattcaacaataagtgctaattcaacaaatgctgacacgtgtacgccaaaatatgttaccttcaattcaaagaccgtgtatgctttacccaccattgcatttgcatttgtttgccacccgtcagtcctgccaatttacagtgagcttaaagaccgatcacagaaaaaaatgcagatggtttcaaacatctcctttttcgccatgtttgttatgtacttcttgactgccatttttggctacttgacattctatgacaacgtgcagtccgacctccttcacaaatatcagagtaaagatgacattctcatcctgacagtgcggctggctgtcattgttgctgtgatcctcacagtgccggtgttatttttcacggttcgttcatctttatttgaactggctaagaaaacaaagtttaatttatgtcgtcataccgtggttacctgcatactcttggttgttatcaacttgttggtgatcttcataccctccatgaaggatatttttggagtcgtaggagttacatctgctaacatgcttattttcattcttccttcatctctttatttaaaaatcacagaccaggatggagataaaggaactcaaagaatttgggctgcccttttcttgggcctgggggtgttgttctccttggtcagcattcccttggtcatctatgactgggcctgctcatcgagtagtgacgaaggccactgaaacccgccgagaaaaagaaacatccctgttgtctgctcagtcaagtccccacacatcagcaatctctcaccacttcttttgcaagtttacagaagcaaacagaaatgtacaggatacttaaaatggaataactttttggttgcaaaacagagacatggttctataatgcttcatgtccctccaagatttgagatcaatttagggattgtgaaatttttttttcaaatttcatacaatcatatttcccagtacttttcacaatcattttttacccatctaactctatgttttgtggcttcccggtctcttagaactttgaaaacatgatatacaataatgtttatttattatacatccagattctgaaataattttcctactgatgttcagctcacactatctgtacctttttagaagagaaaagaatcttgaattgtatatatttattttgctttacagaaaaaaatggtttcgtaaataatttgcctattttggttaacatagcacatggagataatcatctgaaagttatagggcactgccactgctgaatcagagcatgcccaatatttgaggtggctctgatttcctggcagctgaactcgggtagtccagtggcctagctggtaccacatctattcccatccagagacattctctggcaagtgttctcagctgaaaagtggttggggatgattcttaccttggtaattaaatgaagctacacatttgggtaatctagcaaatgaagtattttttccctcttggcaacttgtgtcagagttactctggtctgagtcaactttcgctggggaaaacctatggaacctactgcaaaaagattgtccaaaatgcctaagaaaatactcctctgatgcatttagccttcaaccctacctgtcttgctgaagggagaaaaatgttttagtacattataggcccagcagcttttattcatgtccaccagctagttgcacagagaatcatgtgtacctaactaaggatgatctaggataagtaactcctgttttatattgagtattttagggaagtctttaaaagacttgttttatatctataaatctaggttattacaaatacaagaattttgtaccttaaataagcctcatttctatttcttcttcattaattctccatctagtcttgtgaaaaaaaaaaaaaaccctcagagatagtctttgtgaagagcttctgacagaatcactgagtaccttccttcccccagatgaggaagacaagggggtctcagtgtctgtgctgtctcctcttctcttccccaaccaaggactgtgccattactgcccgtctcaactgtccatgcaggaggacagagttgcctggtactcttacccttgtccctctcctaaagggagcacaaggaaactgaagagactgaaaaagaagagagtttgtagctgaaaaagaatagggatagcaaggaaacccagaactgcattcccctaagtggggccatcccatgtgattgaattgtccatagcttgcctatggtgagaaatgtgcatgctccgtgagctggtctcttgaaacaggacttatgcttcctctatattctggttaaattttccaaacacataagttcactgagcacagatttcttatccagagacaagtagaatctaaccgcagactgttggcagagtttccaggcacttagccatgttcccttcctgactcaaatccccaaaggccttcactctcactgagaatcacactactgtcccatagataaggcaggcattgaagcacctgtcgtgatcctctaggggggagaatgaaaggttatttcctgcattgcatcatcatagcttttaatataatgctacagaatcatatccacattaggttagagttcagatatttggatatgaatacctaacctagccatatccatggccatctctgttcttttcagcaatgttttccatattatattagcaatgacagaaacagaacaagccaagatccagtcagttcttgggagcttgtctagagcaccaagtaatgaaatagccaggtagtgggatgactgtacctttaaaaatacataatttagtttgcaagctatattatgctactttctattttccttgttactttatagcaattcattttaccctcacaaagtcaatttagaaccttatcattaactgggatgtgtagtgatatttttgggcctctgggtttcatgtgtcaatacaaggaatatttatttaaaatagatttatttagaggaggcacagtgttgttgatctgtgtgacaccacccatatttttaaaaacctttgtatgtttctctaaatttgttgttgactgaatataatagaccctaccataattcgtcaaatatcactgattagttacatcctttgtgtgagattagctgtaaagtatactgctcttattcttattcagaatagttaattggtagccaaaaatacatgtatcacagatgttaggtcgaatttaaacagcacagtcaagtgctatggaagtttttctgctaaattagtagattaaagaatactataccctaggcatggggagcagcacgttttcctttggtaggtaggatctctatactagtgaacagtgccagttccacactttggacttagaactgttctctagttattgtaacacagaatactgtcaatccctaatttacttaatgttacttattggaagtggggctgatgaaatacgcacaggagggaaatctactgtgtttaggcacaggcagccccagtgtataaggagatcatattccaaaaggttgtcagttggttgtttgcaacctggaatgtattttcctttagagaccaggttatccatggtggttaggcccctagagcagctggaaaagatgatcaaaccaataggttagctgacatcgaataatgtaataggtttgctaaagaatctaaccatcaaatataatattgtttccagggagggtgtttgttcagagttgcctgttagtagaatctggactgtccatcccagccacatcccacctactggacagtaggggtagagatgccaccagactacaggtgaccagattggcctgaaacatggtgtccagtaaaaacggggaggaataagtccatgactgccggagagcttggtggtaggaggagggtgaaggagggtgagggggcctctcatgggtcagaaacctccagggacatccctcagctggtaactctgctgttgtccggagggttcaggcttggtgtgccttcttctgtttgtctgacttttggctcctatggttcatctcctgccctgcccaccacagaaaaggatgctgctgcacagcttctccaatgtaccagtcattgaggccagcgcgcagcacttttaatgtttttagtgctagtaactgtgttttaactctccaggaataagctgggaggttagaaaacaagaaaaaagggggaaaaaaaaacctctccacccactttccttttttacagttacagaccctgttgagaaaaagaagcacccagatgggtgatggtgatagggcttgtggtggacacagggttgtggtaagattcctcagtgcttcggcgagcacctaagactattaccctggaactgactgctttctagagcttgattcatgcctctaagccagtggttctcaaagtgtggcccctagaccagtagcatcagcatcatcggggacctcattagaatgcagattctcagccccctcccagacatggtgaagtcagaagctctcagggagggactcagcaaatgattctaaagcgcatcaagtttgagaaccaccctaagccaatgagtctcccttttacttcccattagtcctccctcaccagatgattcctaggactcatggtgcaacatacaggagccaggctttagggaggggaggaaaggagcctggcggcaggggtctctgcaatggcaagaaagtgagtgaatccagcgctgccacctggttatccccttctcgttgaaaatagcagcgcgggtgcaaattcctaaacacaggctgcctgcactcggtgttacctcgggctgaggcatgataatattttattttttaaagctgtgaggaaatgaaagtgaggctttggttggggcgaggcagttgtgaaagaaattaaaataaaagaccctttgtaaatgcagacttagaagaaatactgaatttgtgtcagaagttctccagtgtttgtgttaatcgtgtggtgataatcctgtcctccttttaaagcgaattctctactgaaaggtctgctctgcttaaggagctacaaactgctctcaaaagaatgaaatactgagttccaattcagtgaggcacagtgttggactatggcacatttagttggagtcggggggaggtcaggaatatgatcagataatggattttataccttagagcaaaatctattagtctctctcagtttatcaatttaaatggctttaggcttatagggggtgtaaactttaagaatataattctcccattcaagtttacagcaaacatctagccaccttcaaaacaaagaagatacagaccatcatttagcaatactaatacatgattttccttggggatggcaggtttgagaatcctttagcaacaggacatacttcccctaaattacagtgaattatttataacgagataaagctttcaggtacaagctgaaggtggggtgtctaacaactaaaaactatcactaaatctcaaagagaaagttcttgcaaaatatgtaaagttcacaaggtgcagacattttccttctttaggcttttatctaaggaagggctatgaaactgggcccatctgtatacaggctcaaatttacgtttttaaaggaagaatctatgcagctgaggcttattgcaggaaatacttcatttgtatgtaaatattattgtaaataaataggaggctgtatatttttgaagttgttgatccgcactgaaatagaagtctctaggatctgcatataaacaataaatgtttcctagaaattagtggtttgtttgggaattagaaaaatttacattctctcccaggtaacatagttctctcaatgtaaacttggaacctgaaaccctacttaatttagagaaagaaatgtctgagaaatagttcccttgatttcttatgctggcattaagatcaattatttaacagatagtcctctgagatacaagtaaggaatatttagacacaaatccttgtcctatagaaacagatatacccaaatgacaaattgtttcttcataatgatcttccatttttaacactgataccactacacagtacatatgtcaaactttgggatctatgaaagcggggagagggaacctgaatattaattatgagcacaaatttgaaggaaagaaaacaaagaaccattatctaatcaagctttgaaagtcctgcatgtttgccttttattttagtgttgacgccaacatagactgtctaaggtatttttttccccaaacacttgaatcttggtcgttggtatgtaatccactctctagagtccagtgtactttagacttcatctgagtccaatacatgtaccacactactgttttattaatgtaaaaaccttgtaaatgaatttcagatgggtgatttaagtgagtcacaagtcacaaaactttgctattcatagttaatcaaatagaactgggttttttttttcagagtgtggtgtaaataaagaaatataagaagttctgttctataactgctctgttaacatagtttttaaacattaaaaaatgtgaactaaaagta

SEQ ID NO: 448202 - DNA, 8052 bp, Homo sapiens
ccaaaatgcaggccccagcggaacgcacagccctcctgtcctccgccggtgcccctttagccgccccacccccatccctaagggctctcattctccagctgcagccgcagctgggttccgaacacgccgccgggccccgggagggagaggggcaggtgccagggcggcgcgcagcctctgctcccggtgccagcttcagtgcgccgggcacacgcgcgccccgcaacccctccctcaccctttccccgttgctcaatctccgccagccgcggtcgctgcatcgtcagagagctgcaagagggaggcagcaaggtgcggccgccagcagtgacaccatgtgaccggcacggctcactgacacgcagctttggttaaagagcgggcgcacaggaggggaggagaccgcgcgcgggacggggaggaatggcctgtccgcgttaaaccatcacaagccatggttgcggaagggccacgcgtcccccagtaggagaatgactccgattcgtgaccctcagcgccggtgcatgtcgatatatttattgagtgtctactgtgtgccaggcactatatctatgtgcatagaaaaaccctggaaggccatacaacaatatatatagagtgatcgtctctgcttgctgagctaacaggggtgtcaagcttccattttggtatctacttctaaatacactcagaacaggagaaatttggactaattttcaaactacagacactttctaatcatgatgcatttcaaaagtggactcgaattaactgagttgcaaaacatgacagtgcccgaggatgataacattagcaatgactccaatgatttcaccgaagtagaaaatggtcagataaatagcaagtttatttctgatcgtgaaagtagaagaagtctcacaaacagccatttggaaaaaaagaagtgtgatgagtatattccaggtacaacctccttaggcatgtctgtttttaacctaagcaacgccattatgggcagtgggattttgggactcgcctttgccctggcaaacactggaatcctactttttctggtacttttgacttcagtgacattgctgtctatatattcaataaacctcctattgatctgttcaaaagaaacaggctgcatggtgtatgaaaagctgggggaacaagtctttggcaccacagggaagttcgtaatctttggagccacctctctacagaacactggagcaatgctgagctacctcttcatcgtaaaaaatgaactaccctctgccataaagtttctaatgggaaaggaagagacattttcagcctggtacgtggatggccgcgttctggtggtgatagttacctttggcataattctccctctgtgtctcttgaagaacttagggtatcttggctatactagtggattttccttgagctgtatggtttttttcctaattgtggttatttacaagaaatttcaaattccctgcattgttccagagctaaattcaacaataagtgctaattcaacaaatgctgacacgtgtacgccaaaatatgttaccttcaattcaaagaccgtgtatgctttacccaccattgcatttgcatttgtttgccacccgtcagtcctgccaatttacagtgagcttaaagaccgatcacagaaaaaaatgcagatggtttcaaacatctcctttttcgccatgtttgttatgtacttcttgactgccatttttggctacttgacattctatgacaacgtgcagtccgacctccttcacaaatatcagagtaaagatgacattctcatcctgacagtgcggctggctgtcattgttgctgtgatcctcacagtgccggtgttatttttcacggttcgttcatctttatttgaactggctaagaaaacaaagtttaatttatgtcgtcataccgtggttacctgcatactcttggttgttatcaacttgttggtgatcttcataccctccatgaaggatatttttggagtcgtaggagttacatctgctaacatgcttattttcattcttccttcatctctttatttaaaaatcacagaccaggatggagataaaggaactcaaagaatttgggctgcccttttcttgggcctgggggtgttgttctccttggtcagcattcccttggtcatctatgactgggcctgctcatcgagtagtgacgaaggccactgaaacccgccgagaaaaagaaacatccctgttgtctgctcagtcaagtccccacacatcagcaatctctcaccacttcttttgcaagtttacagaagcaaacagaaatgtacaggatacttaaaatggaataactttttggttgcaaaacagagacatggttctataatgcttcatgtccctccaagatttgagatcaatttagggattgtgaaatttttttttcaaatttcatacaatcatatttcccagtacttttcacaatcattttttacccatctaactctatgttttgtggcttcccggtctcttagaactttgaaaacatgatatacaataatgtttatttattatacatccagattctgaaataattttcctactgatgttcagctcacactatctgtacctttttagaagagaaaagaatcttgaattgtatatatttattttgctttacagaaaaaaatggtttcgtaaataatttgcctattttggttaacatagcacatggagataatcatctgaaagttatagggcactgccactgctgaatcagagcatgcccaatatttgaggtggctctgatttcctggcagctgaactcgggtagtccagtggcctagctggtaccacatctattcccatccagagacattctctggcaagtgttctcagctgaaaagtggttggggatgattcttaccttggtaattaaatgaagctacacatttgggtaatctagcaaatgaagtattttttccctcttggcaacttgtgtcagagttactctggtctgagtcaactttcgctggggaaaacctatggaacctactgcaaaaagattgtccaaaatgcctaagaaaatactcctctgatgcatttagccttcaaccctacctgtcttgctgaagggagaaaaatgttttagtacattataggcccagcagcttttattcatgtccaccagctagttgcacagagaatcatgtgtacctaactaaggatgatctaggataagtaactcctgttttatattgagtattttagggaagtctttaaaagacttgttttatatctataaatctaggttattacaaatacaagaattttgtaccttaaataagcctcatttctatttcttcttcattaattctccatctagtcttgtgaaaaaaaaaaaaaaccctcagagatagtctttgtgaagagcttctgacagaatcactgagtaccttccttcccccagatgaggaagacaagggggtctcagtgtctgtgctgtctcctcttctcttccccaaccaaggactgtgccattactgcccgtctcaactgtccatgcaggaggacagagttgcctggtactcttacccttgtccctctcctaaagggagcacaaggaaactgaagagactgaaaaagaagagagtttgtagctgaaaaagaatagggatagcaaggaaacccagaactgcattcccctaagtggggccatcccatgtgattgaattgtccatagcttgcctatggtgagaaatgtgcatgctccgtgagctggtctcttgaaacaggacttatgcttcctctatattctggttaaattttccaaacacataagttcactgagcacagatttcttatccagagacaagtagaatctaaccgcagactgttggcagagtttccaggcacttagccatgttcccttcctgactcaaatccccaaaggccttcactctcactgagaatcacactactgtcccatagataaggcaggcattgaagcacctgtcgtgatcctctaggggggagaatgaaaggttatttcctgcattgcatcatcatagcttttaatataatgctacagaatcatatccacattaggttagagttcagatatttggatatgaatacctaacctagccatatccatggccatctctgttcttttcagcaatgttttccatattatattagcaatgacagaaacagaacaagccaagatccagtcagttcttgggagcttgtctagagcaccaagtaatgaaatagccaggtagtgggatgactgtacctttaaaaatacataatttagtttgcaagctatattatgctactttctattttccttgttactttatagcaattcattttaccctcacaaagtcaatttagaaccttatcattaactgggatgtgtagtgatatttttgggcctctgggtttcatgtgtcaatacaaggaatatttatttaaaatagatttatttagaggaggcacagtgttgttgatctgtgtgacaccacccatatttttaaaaacctttgtatgtttctctaaatttgttgttgactgaatataatagaccctaccataattcgtcaaatatcactgattagttacatcctttgtgtgagattagctgtaaagtatactgctcttattcttattcagaatagttaattggtagccaaaaatacatgtatcacagatgttaggtcgaatttaaacagcacagtcaagtgctatggaagtttttctgctaaattagtagattaaagaatactataccctaggcatggggagcagcacgttttcctttggtaggtaggatctctatactagtgaacagtgccagttccacactttggacttagaactgttctctagttattgtaacacagaatactgtcaatccctaatttacttaatgttacttattggaagtggggctgatgaaatacgcacaggagggaaatctactgtgtttaggcacaggcagccccagtgtataaggagatcatattccaaaaggttgtcagttggttgtttgcaacctggaatgtattttcctttagagaccaggttatccatggtggttaggcccctagagcagctggaaaagatgatcaaaccaataggttagctgacatcgaataatgtaataggtttgctaaagaatctaaccatcaaatataatattgtttccagggagggtgtttgttcagagttgcctgttagtagaatctggactgtccatcccagccacatcccacctactggacagtaggggtagagatgccaccagactacaggtgaccagattggcctgaaacatggtgtccagtaaaaacggggaggaataagtccatgactgccggagagcttggtggtaggaggagggtgaaggagggtgagggggcctctcatgggtcagaaacctccagggacatccctcagctggtaactctgctgttgtccggagggttcaggcttggtgtgccttcttctgtttgtctgacttttggctcctatggttcatctcctgccctgcccaccacagaaaaggatgctgctgcacagcttctccaatgtaccagtcattgaggccagcgcgcagcacttttaatgtttttagtgctagtaactgtgttttaactctccaggaataagctgggaggttagaaaacaagaaaaaagggggaaaaaaaaacctctccacccactttccttttttacagttacagaccctgttgagaaaaagaagcacccagatgggtgatggtgatagggcttgtggtggacacagggttgtggtaagattcctcagtgcttcggcgagcacctaagactattaccctggaactgactgctttctagagcttgattcatgcctctaagccagtggttctcaaagtgtggcccctagaccagtagcatcagcatcatcggggacctcattagaatgcagattctcagccccctcccagacatggtgaagtcagaagctctcagggagggactcagcaaatgattctaaagcgcatcaagtttgagaaccaccctaagccaatgagtctcccttttacttcccattagtcctccctcaccagatgattcctaggactcatggtgcaacatacaggagccaggctttagggaggggaggaaaggagcctggcggcaggggtctctgcaatggcaagaaagtgagtgaatccagcgctgccacctggttatccccttctcgttgaaaatagcagcgcgggtgcaaattcctaaacacaggctgcctgcactcggtgttacctcgggctgaggcatgataatattttattttttaaagctgtgaggaaatgaaagtgaggctttggttggggcgaggcagttgtgaaagaaattaaaataaaagaccctttgtaaatgcagacttagaagaaatactgaatttgtgtcagaagttctccagtgtttgtgttaatcgtgtggtgataatcctgtcctccttttaaagcgaattctctactgaaaggtctgctctgcttaaggagctacaaactgctctcaaaagaatgaaatactgagttccaattcagtgaggcacagtgttggactatggcacatttagttggagtcggggggaggtcaggaatatgatcagataatggattttataccttagagcaaaatctattagtctctctcagtttatcaatttaaatggctttaggcttatagggggtgtaaactttaagaatataattctcccattcaagtttacagcaaacatctagccaccttcaaaacaaagaagatacagaccatcatttagcaatactaatacatgattttccttggggatggcaggtttgagaatcctttagcaacaggacatacttcccctaaattacagtgaattatttataacgagataaagctttcaggtacaagctgaaggtggggtgtctaacaactaaaaactatcactaaatctcaaagagaaagttcttgcaaaatatgtaaagttcacaaggtgcagacattttccttctttaggcttttatctaaggaagggctatgaaactgggcccatctgtatacaggctcaaatttacgtttttaaaggaagaatctatgcagctgaggcttattgcaggaaatacttcatttgtatgtaaatattattgtaaataaataggaggctgtatatttttgaagttgttgatccgcactgaaatagaagtctctaggatctgcatataaacaataaatgtttcctagaaattagtggtttgtttgggaattagaaaaatttacattctctcccaggtaacatagttctctcaatgtaaacttggaacctgaaaccctacttaatttagagaaagaaatgtctgagaaatagttcccttgatttcttatgctggcattaagatcaattatttaacagatagtcctctgagatacaagtaaggaatatttagacacaaatccttgtcctatagaaacagatatacccaaatgacaaattgtttcttcataatgatcttccatttttaacactgataccactacacagtacatatgaaaacagaagctggggagaagaatgtttttttcacaattgaattgctgcatttctcaaactttgggatctatgaaagcggggagagggaacctgaatattaattatgagcacaaatttgaaggaaattattttagtgttgacgccaacatagactgtctaaggtatttttttccccaaacacttgaatcttggtcgttggtatgtaatccactctctagagtccagtgtactttagacttcatctgagtccaatacatgtaccacactactgttttattaatgtaaaaaccttgtaaatgaatttcagatgggtgatttaagtgagtcacaagtcacaaaactttgctattcatagttaatcaaatagaactgggttttttttttcagagtgtggtgtaaataaagaaatataagaagttctgttctataactgctctgttaacatagtttttaaacattaaaaaatgtgaactaaaagta

SEQ ID NO: 448203 - DNA, 8022 bp, Homo sapiens
  misc_feature (7785)..(7785): n is a, c, g, or t
ccaaaatgcaggccccagcggaacgcacagccctcctgtcctccgccggtgcccctttagccgccccacccccatccctaagggctctcattctccagctgcagccgcagctgggttccgaacacgccgccgggccccgggagggagaggggcaggtgccagggcggcgcgcagcctctgctcccggtgccagcttcagtgcgccgggcacacgcgcgccccgcaacccctccctcaccctttccccgttgctcaatctccgccagccgcggtcgctgcatcgtcagagagctgcaagagggaggcagcaaggtgcggccgccagcagtgacaccatgtgaccggcacggctcactgacacgcagctttggttaaagagcgggcgcacaggaggggaggagaccgcgcgcgggacggggaggaatggcctgtccgcgttaaaccatcacaagccatggttgcggaagggccacgcgtcccccagtaggagaatgactccgattcgtgaccctcagcgccggtgcatgtcgatatatttattgagtgtctactgtgtgccaggcactatatctatgtgcatagaaaaaccctggaaggccatacaacaatatatatagagtgatcgtctctgcttgctgagctaacaggggtgtcaagcttccattttggtatctacttctaaatacactcagaacaggagaaatttggactaattttcaaactacagacactttctaatcatgatgcatttcaaaagtggactcgaattaactgagttgcaaaacatgacagtgcccgaggatgataacattagcaatgactccaatgatttcaccgaagtagaaaatggtcagataaatagcaagtttatttctgatcgtgaaagtagaagaagtctcacaaacagccatttggaaaaaaagaagtgtgatgagtatattccaggtacaacctccttaggcatgtctgtttttaacctaagcaacgccattatgggcagtgggattttgggactcgcctttgccctggcaaacactggaatcctactttttctggtacttttgacttcagtgacattgctgtctatatattcaataaacctcctattgatctgttcaaaagaaacaggctgcatggtgtatgaaaagctgggggaacaagtctttggcaccacagggaagttcgtaatctttggagccacctctctacagaacactggagcaatgctgagctacctcttcatcgtaaaaaatgaactaccctctgccataaagtttctaatgggaaaggaagagacattttcagcctggtacgtggatggccgcgttctggtggtgatagttacctttggcataattctccctctgtgtctcttgaagaacttagggtatcttggctatactagtggattttccttgagctgtatggtttttttcctaattgtggttatttacaagaaatttcaaattccctgcattgttccagagctaaattcaacaataagtgctaattcaacaaatgctgacacgtgtacgccaaaatatgttaccttcaattcaaagaccgtgtatgctttacccaccattgcatttgcatttgtttgccacccgtcagtcctgccaatttacagtgagcttaaagaccgatcacagaaaaaaatgcagatggtttcaaacatctcctttttcgccatgtttgttatgtacttcttgactgccatttttggctacttgacattctatgacaacgtgcagtccgacctccttcacaaatatcagagtaaagatgacattctcatcctgacagtgcggctggctgtcattgttgctgtgatcctcacagtgccggtgttatttttcacggttcgttcatctttatttgaactggctaagaaaacaaagtttaatttatgtcgtcataccgtggttacctgcatactcttggttgttatcaacttgttggtgatcttcataccctccatgaaggatatttttggagtcgtaggagttacatctgctaacatgcttattttcattcttccttcatctctttatttaaaaatcacagaccaggatggagataaaggaactcaaagaatttgggctgcccttttcttgggcctgggggtgttgttctccttggtcagcattcccttggtcatctatgactgggcctgctcatcgagtagtgacgaaggccactgaaacccgccgagaaaaagaaacatccctgttgtctgctcagtcaagtccccacacatcagcaatctctcaccacttcttttgcaagtttacagaagcaaacagaaatgtacaggatacttaaaatggaataactttttggttgcaaaacagagacatggttctataatgcttcatgtccctccaagatttgagatcaatttagggattgtgaaatttttttttcaaatttcatacaatcatatttcccagtacttttcacaatcattttttacccatctaactctatgttttgtggcttcccggtctcttagaactttgaaaacatgatatacaataatgtttatttattatacatccagattctgaaataattttcctactgatgttcagctcacactatctgtacctttttagaagagaaaagaatcttgaattgtatatatttattttgctttacagaaaaaaatggtttcgtaaataatttgcctattttggttaacatagcacatggagataatcatctgaaagttatagggcactgccactgctgaatcagagcatgcccaatatttgaggtggctctgatttcctggcagctgaactcgggtagtccagtggcctagctggtaccacatctattcccatccagagacattctctggcaagtgttctcagctgaaaagtggttggggatgattcttaccttggtaattaaatgaagctacacatttgggtaatctagcaaatgaagtattttttccctcttggcaacttgtgtcagagttactctggtctgagtcaactttcgctggggaaaacctatggaacctactgcaaaaagattgtccaaaatgcctaagaaaatactcctctgatgcatttagccttcaaccctacctgtcttgctgaagggagaaaaatgttttagtacattataggcccagcagcttttattcatgtccaccagctagttgcacagagaatcatgtgtacctaactaaggatgatctaggataagtaactcctgttttatattgagtattttagggaagtctttaaaagacttgttttatatctataaatctaggttattacaaatacaagaattttgtaccttaaataagcctcatttctatttcttcttcattaattctccatctagtcttgtgaaaaaaaaaaaaaaccctcagagatagtctttgtgaagagcttctgacagaatcactgagtaccttccttcccccagatgaggaagacaagggggtctcagtgtctgtgctgtctcctcttctcttccccaaccaaggactgtgccattactgcccgtctcaactgtccatgcaggaggacagagttgcctggtactcttacccttgtccctctcctaaagggagcacaaggaaactgaagagactgaaaaagaagagagtttgtagctgaaaaagaatagggatagcaaggaaacccagaactgcattcccctaagtggggccatcccatgtgattgaattgtccatagcttgcctatggtgagaaatgtgcatgctccgtgagctggtctcttgaaacaggacttatgcttcctctatattctggttaaattttccaaacacataagttcactgagcacagatttcttatccagagacaagtagaatctaaccgcagactgttggcagagtttccaggcacttagccatgttcccttcctgactcaaatccccaaaggccttcactctcactgagaatcacactactgtcccatagataaggcaggcattgaagcacctgtcgtgatcctctaggggggagaatgaaaggttatttcctgcattgcatcatcatagcttttaatataatgctacagaatcatatccacattaggttagagttcagatatttggatatgaatacctaacctagccatatccatggccatctctgttcttttcagcaatgttttccatattatattagcaatgacagaaacagaacaagccaagatccagtcagttcttgggagcttgtctagagcaccaagtaatgaaatagccaggtagtgggatgactgtacctttaaaaatacataatttagtttgcaagctatattatgctactttctattttccttgttactttatagcaattcattttaccctcacaaagtcaatttagaaccttatcattaactgggatgtgtagtgatatttttgggcctctgggtttcatgtgtcaatacaaggaatatttatttaaaatagatttatttagaggaggcacagtgttgttgatctgtgtgacaccacccatatttttaaaaacctttgtatgtttctctaaatttgttgttgactgaatataatagaccctaccataattcgtcaaatatcactgattagttacatcctttgtgtgagattagctgtaaagtatactgctcttattcttattcagaatagttaattggtagccaaaaatacatgtatcacagatgttaggtcgaatttaaacagcacagtcaagtgctatggaagtttttctgctaaattagtagattaaagaatactataccctaggcatggggagcagcacgttttcctttggtaggtaggatctctatactagtgaacagtgccagttccacactttggacttagaactgttctctagttattgtaacacagaatactgtcaatccctaatttacttaatgttacttattggaagtggggctgatgaaatacgcacaggagggaaatctactgtgtttaggcacaggcagccccagtgtataaggagatcatattccaaaaggttgtcagttggttgtttgcaacctggaatgtattttcctttagagaccaggttatccatggtggttaggcccctagagcagctggaaaagatgatcaaaccaataggttagctgacatcgaataatgtaataggtttgctaaagaatctaaccatcaaatataatattgtttccagggagggtgtttgttcagagttgcctgttagtagaatctggactgtccatcccagccacatcccacctactggacagtaggggtagagatgccaccagactacaggtgaccagattggcctgaaacatggtgtccagtaaaaacggggaggaataagtccatgactgccggagagcttggtggtaggaggagggtgaaggagggtgagggggcctctcatgggtcagaaacctccagggacatccctcagctggtaactctgctgttgtccggagggttcaggcttggtgtgccttcttctgtttgtctgacttttggctcctatggttcatctcctgccctgcccaccacagaaaaggatgctgctgcacagcttctccaatgtaccagtcattgaggccagcgcgcagcacttttaatgtttttagtgctagtaactgtgttttaactctccaggaataagctgggaggttagaaaacaagaaaaaagggggaaaaaaaaacctctccacccactttccttttttacagttacagaccctgttgagaaaaagaagcacccagatgggtgatggtgatagggcttgtggtggacacagggttgtggtaagattcctcagtgcttcggcgagcacctaagactattaccctggaactgactgctttctagagcttgattcatgcctctaagccagtggttctcaaagtgtggcccctagaccagtagcatcagcatcatcggggacctcattagaatgcagattctcagccccctcccagacatggtgaagtcagaagctctcagggagggactcagcaaatgattctaaagcgcatcaagtttgagaaccaccctaagccaatgagtctcccttttacttcccattagtcctccctcaccagatgattcctaggactcatggtgcaacatacaggagccaggctttagggaggggaggaaaggagcctggcggcaggggtctctgcaatggcaagaaagtgagtgaatccagcgctgccacctggttatccccttctcgttgaaaatagcagcgcgggtgcaaattcctaaacacaggctgcctgcactcggtgttacctcgggctgaggcatgataatattttattttttaaagctgtgaggaaatgaaagtgaggctttggttggggcgaggcagttgtgaaagaaattaaaataaaagaccctttgtaaatgcagacttagaagaaatactgaatttgtgtcagaagttctccagtgtttgtgttaatcgtgtggtgataatcctgtcctccttttaaagcgaattctctactgaaaggtctgctctgcttaaggagctacaaactgctctcaaaagaatgaaatactgagttccaattcagtgaggcacagtgttggactatggcacatttagttggagtcggggggaggtcaggaatatgatcagataatggattttataccttagagcaaaatctattagtctctctcagtttatcaatttaaatggctttaggcttatagggggtgtaaactttaagaatataattctcccattcaagtttacagcaaacatctagccaccttcaaaacaaagaagatacagaccatcatttagcaatactaatacatgattttccttggggatggcaggtttgagaatcctttagcaacaggacatacttcccctaaattacagtgaattatttataacgagataaagctttcaggtacaagctgaaggtggggtgtctaacaactaaaaactatcactaaatctcaaagagaaagttcttgcaaaatatgtaaagttcacaaggtgcagacattttccttctttaggcttttatctaaggaagggctatgaaactgggcccatctgtatacaggctcaaatttacgtttttaaaggaagaatctatgcagctgaggcttattgcaggaaatacttcatttgtatgtaaatattattgtaaataaataggaggctgtatatttttgaagttgttgatccgcactgaaatagaagtctctaggatctgcatataaacaataaatgtttcctagaaattagtggtttgtttgggaattagaaaaatttacattctctcccaggtaacatagttctctcaatgtaaacttggaacctgaaaccctacttaatttagagaaagaaatgtctgagaaatagttcccttgatttcttatgctggcattaagatcaattatttaacagatagtcctctgagatacaagtaaggaatatttagacacaaatccttgtcctatagaaacagatatacccaaatgacaaattgtttcttcataatgatcttccatttttaacactgataccactacacagtacatatgaaaacagaagctggggagaagaatgtttttttcacaattgaattgctgcatttctcaaactttgggatctatgaaagcggggagagggaacctgaatattaattatgagcacaaatttgaaggaaaaaaaaaaaaaaactcgagctcgtgccgaattcggcacgaggtgagactctgtctcaaaaaaaaaaaactttattccaagaggctgttngagtgtgtgtctgcctaagcctccttatagcctatttttctacttgctgagagagtaatattaaaggaacagtgagggagttgaaggagagcctagttagagcgttcccattctggccttttgggtttgcactgtgcggaagatgctctttcatcactttgaagcccatcctgtgcagaggtgggactctgtggctgtccactggcaccagggcagactgtacctaacagacttggt

SEQ ID NO: 448204 - DNA, 4635 bp, Homo sapiens
  misc_feature (25)..(26): n is a, c, g, or t
  misc_feature (31)..(32): n is a, c, g, or t
cctgactcttgaggatccccccggnncatgnnaaccaaggactgtgccattactgcccgtctcaactgtccatgcaggaggacagagttgcctggtactcttacccttgtccctctcctaaagggagcacaaggaaactgaagagactgaaaaagaagagagtttgtagctgaaaaagaatagggatagcaaggaaacccagaactgcattcccctaagtggggccatcccatgtgattgaattgtccatagcttgcctatggtgagaaatgtgcatgctccgtgagctggtctcttgaaacaggacttatgcttcctctatattctggttaaattttccaaacacataagttcactgagcacagatttcttatccagagacaagtagaatctaaccgcagactgttggcagagtttccaggcacttagccatgttcccttcctgactcaaatccccaaaggccttcactctcactgagaatcacactactgtcccatagataaggcaggcattgaagcacctgtcgtgatcctctaggggggagaatgaaaggttatttcctgcattgcatcatcatagcttttaatataatgctacagaatcatatccacattaggttagagttcagatatttggatatgaatacctaacctagccatatccatggccatctctgttcttttcagcaatgttttccatattatattagcaatgacagaaacagaacaagccaagatccagtcagttcttgggagcttgtctagagcaccaagtaatgaaatagccaggtagtgggatgactgtacctttaaaaatacataatttagtttgcaagctatattatgctactttctattttccttgttactttatagcaattcattttaccctcacaaagtcaatttagaaccttatcattaactgggatgtgtagtgatatttttgggcctctgggtttcatgtgtcaatacaaggaatatttatttaaaatagatttatttagaggaggcacagtgttgttgatctgtgtgacaccacccatatttttaaaaacctttgtatgtttctctaaatttgttgttgactgaatataatagaccctaccataattcgtcaaatatcactgattagttacatcctttgtgtgagattagctgtaaagtatactgctcttattcttattcagaatagttaattggtagccaaaaatacatgtatcacagatgttaggtcgaatttaaacagcacagtcaagtgctatggaagtttttctgctaaattagtagattaaagaatactataccctaggcatggggagcagcacgttttcctttggtaggtaggatctctatactagtgaacagtgccagttccacactttggacttagaactgttctctagttattgtaacacagaatactgtcaatccctaatttacttaatgttacttattggaagtggggctgatgaaatacgcacaggagggaaatctactgtgtttaggcacaggcagccccagtgtataaggagatcatattccaaaaggttgtcagttggttgtttgcaacctggaatgtattttcctttagagaccaggttatccatggtggttaggcccctagagcagctggaaaagatgatcaaaccaataggttagctgacatcgaataatgtaataggtttgctaaagaatctaaccatcaaatataatattgtttccagggagggtgtttgttcagagttgcctgttagtagaatctggactgtccatcccagccacatcccacctactggacagtaggggtagagatgccaccagactacaggtgaccagattggcctgaaacatggtgtccagtaaaaacggggaggaataagtccatgactgccggagagcttggtggtaggaggagggtgaaggagggtgagggggcctctcatgggtcagaaacctccagggacatccctcagctggtaactctgctgttgtccggagggttcaggcttggtgtgccttcttctgtttgtctgacttttggctcctatggttcatctcctgccctgcccaccacagaaaaggatgctgctgcacagcttctccaatgtaccagtcattgaggccagcgcgcagcacttttaatgtttttagtgctagtaactgtgttttaactctccaggaataagctgggaggttagaaaacaagaaaaaagggggaaaaaaaaacctctccacccactttccttttttacagttacagaccctgttgagaaaaagaagcacccagatgggtgatggtgatagggcttgtggtggacacagggttgtggtaagattcctcagtgcttcggcgagcacctaagactattaccctggaactgactgctttctagagcttgattcatgcctctaagccagtggttctcaaagtgtggcccctagaccagtagcatcagcatcatcggggacctcattagaatgcagattctcagccccctcccagacatggtgaagtcagaagctctcagggagggactcagcaaatgattctaaagcgcatcaagtttgagaaccaccctaagccaatgagtctcccttttacttcccattagtcctccctcaccagatgattcctaggactcatggtgcaacatacaggagccaggctttagggaggggaggaaaggagcctggcggcaggggtctctgcaatggcaagaaagtgagtgaatccagcgctgccacctggttatccccttctcgttgaaaatagcagcgcgggtgcaaattcctaaacacaggctgcctgcactcggtgttacctcgggctgaggcatgataatattttattttttaaagctgtgaggaaatgaaagtgaggctttggttggggcgaggcagttgtgaaagaaattaaaataaaagaccctttgtaaatgcagacttagaagaaatactgaatttgtgtcagaagttctccagtgtttgtgttaatcgtgtggtgataatcctgtcctccttttaaagcgaattctctactgaaaggtctgctctgcttaaggagctacaaactgctctcaaaagaatgaaatactgagttccaattcagtgaggcacagtgttggactatggcacatttagttggagtcggggggaggtcaggaatatgatcagataatggattttataccttagagcaaaatctattagtctctctcagtttatcaatttaaatggctttaggcttatagggggtgtaaactttaagaatataattctcccattcaagtttacagcaaacatctagccaccttcaaaacaaagaagatacagaccatcatttagcaatactaatacatgattttccttggggatggcaggtttgagaatcctttagcaacaggacatacttcccctaaattacagtgaattatttataacgagataaagctttcaggtacaagctgaaggtggggtgtctaacaactaaaaactatcactaaatctcaaagagaaagttcttgcaaaatatgtaaagttcacaaggtgcagacattttccttctttaggcttttatctaaggaagggctatgaaactgggcccatctgtatacaggctcaaatttacgtttttaaaggaagaatctatgcagctgaggcttattgcaggaaatacttcatttgtatgtaaatattattgtaaataaataggaggctgtatatttttgaagttgttgatccgcactgaaatagaagtctctaggatctgcatataaacaataaatgtttcctagaaattagtggtttgtttgggaattagaaaaatttacattctctcccaggtaacatagttctctcaatgtaaacttggaacctgaaaccctacttaatttagagaaagaaatgtctgagaaatagttcccttgatttcttatgctggcattaagatcaattatttaacagatagtcctctgagatacaagtaaggaatatttagacacaaatccttgtcctatagaaacagatatacccaaatgacaaattgtttcttcataatgatcttccatttttaacactgataccactacacagtacatatgaaaacagaagctggggagaagaatgtttttttcacaattgaattgctgcatttctcaaactttgggatctatgaaagcggggagagggaacctgaatattaattatgagcacaaatttgaaggaaagaaaacaaagaaccattatctaatcaagctttgaaagtcctgcatgtttgccttttattttagtgttgacgccaacatagactgtctaaggtatttttttccccaaacacttgaatcttggtcgttggtatgtaatccactctctagagtccagtgtactttagacttcatctgagtccaatacatgtaccacactactgttttattaatgtaaaaaccttgtaaatgaatttcagatgggtgatttaagtgagtcacaagtcacaaaactttgctattcatagttaatcaaatagaactgggttttttttttcagagtgtggtgtaaataaagaaatataagaagttctgttctataactgctctgttaacatagtttttaaacattaaaaaatgtgaactaaaagta

SEQ ID NO: 448205 - DNA, 7714 bp, Homo sapiens
  misc_feature (7339)..(7339): n is a, c, g, or t
  misc_feature (7421)..(7421): n is a, c, g, or t
ccaaaatgcaggccccagcggaacgcacagccctcctgtcctccgccggtgcccctttagccgccccacccccatccctaagggctctcattctccagctgcagccgcagctgggttccgaacacgccgccgggccccgggagggagaggggcaggtgccagggcggcgcgcagcctctgctcccggtgccagcttcagtgcgccgggcacacgcgcgccccgcaacccctccctcaccctttccccgttgctcaatctccgccagccgcggtcgctgcatcgtcagagagctgcaagagggaggcagcaaggtgcggccgccagcagtgacaccatgtgaccggcacggctcactgacacgcagctttggttaaagagcgggcgcacaggaggggaggagaccgcgcgcgggacggggaggaatggcctgtccgcgttaaaccatcacaagccatggttgcggaagggccacgcgtcccccagtaggagaatgactccgattcgtgaccctcagcgccggtgcatgtcgatatatttattgagtgtctactgtgtgccaggcactatatctatgtgcatagaaaaaccctggaaggccatacaacaatatatatagagtgatcgtctctgcttgctgagctaacaggggtgtcaagcttccattttggtatctacttctaaatacactcagaacaggagaaatttggactaattttcaaactacagacactttctaatcatgatgcatttcaaaagtggactcgaattaactgagttgcaaaacatgacagtgcccgaggatgataacattagcaatgactccaatgatttcaccgaagtagaaaatggtcagataaatagcaagtttatttctgatcgtgaaagtagaagaagtctcacaaacagccatttggaaaaaaagaagtgtgatgagtatattccaggtacaacctccttaggcatgtctgtttttaacctaagcaacgccattatgggcagtgggattttgggactcgcctttgccctggcaaacactggaatcctactttttctggtacttttgacttcagtgacattgctgtctatatattcaataaacctcctattgatctgttcaaaagaaacaggctgcatggtgtatgaaaagctgggggaacaagtctttggcaccacagggaagttcgtaatctttggagccacctctctacagaacactggagcaatgctgagctacctcttcatcgtaaaaaatgaactaccctctgccataaagtttctaatgggaaaggaagagacattttcagcctggtacgtggatggccgcgttctggtggtgatagttacctttggcataattctccctctgtgtctcttgaagaacttagggtatcttggctatactagtggattttccttgagctgtatggtttttttcctaattgtggttatttacaagaaatttcaaattccctgcattgttccagagctaaattcaacaataagtgctaattcaacaaatgctgacacgtgtacgccaaaatatgttaccttcaattcaaagaccgtgtatgctttacccaccattgcatttgcatttgtttgccacccgtcagtcctgccaatttacagtgagcttaaagaccgatcacagaaaaaaatgcagatggtttcaaacatctcctttttcgccatgtttgttatgtacttcttgactgccatttttggctacttgacattctatgacaacgtgcagtccgacctccttcacaaatatcagagtaaagatgacattctcatcctgacagtgcggctggctgtcattgttgctgtgatcctcacagtgccggtgttatttttcacggttcgttcatctttatttgaactggctaagaaaacaaagtttaatttatgtcgtcataccgtggttacctgcatactcttggttgttatcaacttgttggtgatcttcataccctccatgaaggatatttttggagtcgtaggagttacatctgctaacatgcttattttcattcttccttcatctctttatttaaaaatcacagaccaggatggagataaaggaactcaaagaatttgggctgcccttttcttgggcctgggggtgttgttctccttggtcagcattcccttggtcatctatgactgggcctgctcatcgagtagtgacgaaggccactgaaacccgccgagaaaaagaaacatccctgttgtctgctcagtcaagtccccacacatcagcaatctctcaccacttcttttgcaagtttacagaagcaaacagaaatgtacaggatacttaaaatggaataactttttggttgcaaaacagagacatggttctataatgcttcatgtccctccaagatttgagatcaatttagggattgtgaaatttttttttcaaatttcatacaatcatatttcccagtacttttcacaatcattttttacccatctaactctatgttttgtggcttcccggtctcttagaactttgaaaacatgatatacaataatgtttatttattatacatccagattctgaaataattttcctactgatgttcagctcacactatctgtacctttttagaagagaaaagaatcttgaattgtatatatttattttgctttacagaaaaaaatggtttcgtaaataatttgcctattttggttaacatagcacatggagataatcatctgaaagttatagggcactgccactgctgaatcagagcatgcccaatatttgaggtggctctgatttcctggcagctgaactcgggtagtccagtggcctagctggtaccacatctattcccatccagagacattctctggcaagtgttctcagctgaaaagtggttggggatgattcttaccttggtaattaaatgaagctacacatttgggtaatctagcaaatgaagtattttttccctcttggcaacttgtgtcagagttactctggtctgagtcaactttcgctggggaaaacctatggaacctactgcaaaaagattgtccaaaatgcctaagaaaatactcctctgatgcatttagccttcaaccctacctgtcttgctgaagggagaaaaatgttttagtacattataggcccagcagcttttattcatgtccaccagctagttgcacagagaatcatgtgtacctaactaaggatgatctaggataagtaactcctgttttatattgagtattttagggaagtctttaaaagacttgttttatatctataaatctaggttattacaaatacaagaattttgtaccttaaataagcctcatttctatttcttcttcattaattctccatctagtcttgtgaaaaaaaaaaaaaaccctcagagatagtctttgtgaagagcttctgacagaatcactgagtaccttccttcccccagatgaggaagacaagggggtctcagtgtctgtgctgtctcctcttctcttccccaaccaaggactgtgccattactgcccgtctcaactgtccatgcaggaggacagagttgcctggtactcttacccttgtccctctcctaaagggagcacaaggaaactgaagagactgaaaaagaagagagtttgtagctgaaaaagaatagggatagcaaggaaacccagaactgcattcccctaagtggggccatcccatgtgattgaattgtccatagcttgcctatggtgagaaatgtgcatgctccgtgagctggtctcttgaaacaggacttatgcttcctctatattctggttaaattttccaaacacataagttcactgagcacagatttcttatccagagacaagtagaatctaaccgcagactgttggcagagtttccaggcacttagccatgttcccttcctgactcaaatccccaaaggccttcactctcactgagaatcacactactgtcccatagataaggcaggcattgaagcacctgtcgtgatcctctaggggggagaatgaaaggttatttcctgcattgcatcatcatagcttttaatataatgctacagaatcatatccacattaggttagagttcagatatttggatatgaatacctaacctagccatatccatggccatctctgttcttttcagcaatgttttccatattatattagcaatgacagaaacagaacaagccaagatccagtcagttcttgggagcttgtctagagcaccaagtaatgaaatagccaggtagtgggatgactgtacctttaaaaatacataatttagtttgcaagctatattatgctactttctattttccttgttactttatagcaattcattttaccctcacaaagtcaatttagaaccttatcattaactgggatgtgtagtgatatttttgggcctctgggtttcatgtgtcaatacaaggaatatttatttaaaatagatttatttagaggaggcacagtgttgttgatctgtgtgacaccacccatatttttaaaaacctttgtatgtttctctaaatttgttgttgactgaatataatagaccctaccataattcgtcaaatatcactgattagttacatcctttgtgtgagattagctgtaaagtatactgctcttattcttattcagaatagttaattggtagccaaaaatacatgtatcacagatgttaggtcgaatttaaacagcacagtcaagtgctatggaagtttttctgctaaattagtagattaaagaatactataccctaggcatggggagcagcacgttttcctttggtaggtaggatctctatactagtgaacagtgccagttccacactttggacttagaactgttctctagttattgtaacacagaatactgtcaatccctaatttacttaatgttacttattggaagtggggctgatgaaatacgcacaggagggaaatctactgtgtttaggcacaggcagccccagtgtataaggagatcatattccaaaaggttgtcagttggttgtttgcaacctggaatgtattttcctttagagaccaggttatccatggtggttaggcccctagagcagctggaaaagatgatcaaaccaataggttagctgacatcgaataatgtaataggtttgctaaagaatctaaccatcaaatataatattgtttccagggagggtgtttgttcagagttgcctgttagtagaatctggactgtccatcccagccacatcccacctactggacagtaggggtagagatgccaccagactacaggtgaccagattggcctgaaacatggtgtccagtaaaaacggggaggaataagtccatgactgccggagagcttggtggtaggaggagggtgaaggagggtgagggggcctctcatgggtcagaaacctccagggacatccctcagctggtaactctgctgttgtccggagggttcaggcttggtgtgccttcttctgtttgtctgacttttggctcctatggttcatctcctgccctgcccaccacagaaaaggatgctgctgcacagcttctccaatgtaccagtcattgaggccagcgcgcagcacttttaatgtttttagtgctagtaactgtgttttaactctccaggaataagctgggaggttagaaaacaagaaaaaagggggaaaaaaaaacctctccacccactttccttttttacagttacagaccctgttgagaaaaagaagcacccagatgggtgatggtgatagggcttgtggtggacacagggttgtggtaagattcctcagtgcttcggcgagcacctaagactattaccctggaactgactgctttctagagcttgattcatgcctctaagccagtggttctcaaagtgtggcccctagaccagtagcatcagcatcatcggggacctcattagaatgcagattctcagccccctcccagacatggtgaagtcagaagctctcagggagggactcagcaaatgattctaaagcgcatcaagtttgagaaccaccctaagccaatgagtctcccttttacttcccattagtcctccctcaccagatgattcctaggactcatggtgcaacatacaggagccaggctttagggaggggaggaaaggagcctggcggcaggggtctctgcaatggcaagaaagtgagtgaatccagcgctgccacctggttatccccttctcgttgaaaatagcagcgcgggtgcaaattcctaaacacaggctgcctgcactcggtgttacctcgggctgaggcatgataatattttattttttaaagctgtgaggaaatgaaagtgaggctttggttggggcgaggcagttgtgaaagaaattaaaataaaagaccctttgtaaatgcagacttagaagaaatactgaatttgtgtcagaagttctccagtgtttgtgttaatcgtgtggtgataatcctgtcctccttttaaagcgaattctctactgaaaggtctgctctgcttaaggagctacaaactgctctcaaaagaatgaaatactgagttccaattcagtgaggcacagtgttggactatggcacatttagttggagtcggggggaggtcaggaatatgatcagataatggattttataccttagagcaaaatctattagtctctctcagtttatcaatttaaatggctttaggcttatagggggtgtaaactttaagaatataattctcccattcaagtttacagcaaacatctagccaccttcaaaacaaagaagatacagaccatcatttagcaatactaatacatgattttccttggggatggcaggtttgagaatcctttagcaacaggacatacttcccctaaattacagtgaattatttataacgagataaagctttcaggtacaagctgaaggtggggtgtctaacaactaaaaactatcactaaatctcaaagagaaagttcttgcaaaatatgtaaagttcacaaggtgcagacattttccttctttaggcttttatctaaggaagggctatgaaactgggcccatctgtatacaggctcaaatttacgtttttaaaggaagaatctatgcagctgaggcttattgcaggaaatacttcatttgtatgtaaatattattgtaaataaataggaggctgtatatttttgaagttgttgatccgcactgaaatagaagtctctaggatctgcatataaacaataaatgtttcctagaaattagtggtttgtttgggaattagaaaaatttacattctctcccaggtaacataggcttcttcctccaaaanttgctttaaaaaaaaccctttttggggggggggaaaaaaaaacccccccctttggggaaaaaaaaaaaaacccaccctttanaaaaacttttttttttcaaaaaaacaacgtttttgcttttttcataaaaaccgggggccaaaaaaggcggcgggcaacaaccaacacaacaaaacagggggggggcaaaaaaacaaaacacacaccaacattttttgttgggggggggggtgttctttaccccccttttttttgggggggcggggcaaacaaacagggggggggaaaaacaacacacacaacactacgacaaacagttttttcttctaacacaaaagagcgagagggggggggaggtcattatattatataac

SEQ ID NO: 448206 - DNA, 7222 bp, Homo sapiens
ccaaaatgcaggccccagcggaacgcacagccctcctgtcctccgccggtgcccctttagccgccccacccccatccctaagggctctcattctccagctgcagccgcagctgggttccgaacacgccgccgggccccgggagggagaggggcaggtgccagggcggcgcgcagcctctgctcccggtgccagcttcagtgcgccgggcacacgcgcgccccgcaacccctccctcaccctttccccgttgctcaatctccgccagccgcggtcgctgcatcgtcagagagctgcaagagggaggcagcaaggtgcggccgccagcagtgacaccatgtgaccggcacggctcactgacacgcagctttggttaaagagcgggcgcacaggaggggaggagaccgcgcgcgggacggggaggaatggcctgtccgcgttaaaccatcacaagccatggttgcggaagggccacgcgtcccccagtaggagaatgactccgattcgtgaccctcagcgccggtgcatgtcgatatatttattgagtgtctactgtgtgccaggcactatatctatgtgcatagaaaaaccctggaaggccatacaacaatatatatagagtgatcgtctctgcttgctgagctaacaggggtgtcaagcttccattttggtatctacttctaaatacactcagaacaggagaaatttggactaattttcaaactacagacactttctaatcatgatgcatttcaaaagtggactcgaattaactgagttgcaaaacatgacagtgcccgaggatgataacattagcaatgactccaatgatttcaccgaagtagaaaatggtcagataaatagcaagtttatttctgatcgtgaaagtagaagaagtctcacaaacagccatttggaaaaaaagaagtgtgatgagtatattccaggtacaacctccttaggcatgtctgtttttaacctaagcaacgccattatgggcagtgggattttgggactcgcctttgccctggcaaacactggaatcctactttttctggtacttttgacttcagtgacattgctgtctatatattcaataaacctcctattgatctgttcaaaagaaacaggctgcatggtgtatgaaaagctgggggaacaagtctttggcaccacagggaagttcgtaatctttggagccacctctctacagaacactggagcaatgctgagctacctcttcatcgtaaaaaatgaactaccctctgccataaagtttctaatgggaaaggaagagacattttcagcctggtacgtggatggccgcgttctggtggtgatagttacctttggcataattctccctctgtgtctcttgaagaacttagggtatcttggctatactagtggattttccttgagctgtatggtttttttcctaattgtggttatttacaagaaatttcaaattccctgcattgttccagagctaaattcaacaataagtgctaattcaacaaatgctgacacgtgtacgccaaaatatgttaccttcaattcaaagaccgtgtatgctttacccaccattgcatttgcatttgtttgccacccgtcagtcctgccaatttacagtgagcttaaagaccgatcacagaaaaaaatgcagatggtttcaaacatctcctttttcgccatgtttgttatgtacttcttgactgccatttttggctacttgacattctatgacaacgtgcagtccgacctccttcacaaatatcagagtaaagatgacattctcatcctgacagtgcggctggctgtcattgttgctgtgatcctcacagtgccggtgttatttttcacggttcgttcatctttatttgaactggctaagaaaacaaagtttaatttatgtcgtcataccgtggttacctgcatactcttggttgttatcaacttgttggtgatcttcataccctccatgaaggatatttttggagtcgtaggagttacatctgctaacatgcttattttcattcttccttcatctctttatttaaaaatcacagaccaggatggagataaaggaactcaaagaatttgggctgcccttttcttgggcctgggggtgttgttctccttggtcagcattcccttggtcatctatgactgggcctgctcatcgagtagtgacgaaggccactgaaacccgccgagaaaaagaaacatccctgttgtctgctcagtcaagtccccacacatcagcaatctctcaccacttcttttgcaagtttacagaagcaaacagaaatgtacaggatacttaaaatggaataactttttggttgcaaaacagagacatggttctataatgcttcatgtccctccaagatttgagatcaatttagggattgtgaaatttttttttcaaatttcatacaatcatatttcccagtacttttcacaatcattttttacccatctaactctatgttttgtggcttcccggtctcttagaactttgaaaacatgatatacaataatgtttatttattatacatccagattctgaaataattttcctactgatgttcagctcacactatctgtacctttttagaagagaaaagaatcttgaattgtatatatttattttgctttacagaaaaaaatggtttcgtaaataatttgcctattttggttaacatagcacatggagataatcatctgaaagttatagggcactgccactgctgaatcagagcatgcccaatatttgaggtggctctgatttcctggcagctgaactcgggtagtccagtggcctagctggtaccacatctattcccatccagagacattctctggcaagtgttctcagctgaaaagtggttggggatgattcttaccttggtaattaaatgaagctacacatttgggtaatctagcaaatgaagtattttttccctcttggcaacttgtgtcagagttactctggtctgagtcaactttcgctggggaaaacctatggaacctactgcaaaaagattgtccaaaatgcctaagaaaatactcctctgatgcatttagccttcaaccctacctgtcttgctgaagggagaaaaatgttttagtacattataggcccagcagcttttattcatgtccaccagctagttgcacagagaatcatgtgtacctaactaaggatgatctaggataagtaactcctgttttatattgagtattttagggaagtctttaaaagacttgttttatatctataaatctaggttattacaaatacaagaattttgtaccttaaataagcctcatttctatttcttcttcattaattctccatctagtcttgtgaaaaaaaaaaaaaaccctcagagatagtctttgtgaagagcttctgacagaatcactgagtaccttccttcccccagatgaggaagacaagggggtctcagtgtctgtgctgtctcctcttctcttccccaaccaaggactgtgccattactgcccgtctcaactgtccatgcaggaggacagagttgcctggtactcttacccttgtccctctcctaaagggagcacaaggaaactgaagagactgaaaaagaagagagtttgtagctgaaaaagaatagggatagcaaggaaacccagaactgcattcccctaagtggggccatcccatgtgattgaattgtccatagcttgcctatggtgagaaatgtgcatgctccgtgagctggtctcttgaaacaggacttatgcttcctctatattctggttaaattttccaaacacataagttcactgagcacagatttcttatccagagacaagtagaatctaaccgcagactgttggcagagtttccaggcacttagccatgttcccttcctgactcaaatccccaaaggccttcactctcactgagaatcacactactgtcccatagataaggcaggcattgaagcacctgtcgtgatcctctaggggggagaatgaaaggttatttcctgcattgcatcatcatagcttttaatataatgctacagaatcatatccacattaggttagagttcagatatttggatatgaatacctaacctagccatatccatggccatctctgttcttttcagcaatgttttccatattatattagcaatgacagaaacagaacaagccaagatccagtcagttcttgggagcttgtctagagcaccaagtaatgaaatagccaggtagtgggatgactgtacctttaaaaatacataatttagtttgcaagctatattatgctactttctattttccttgttactttatagcaattcattttaccctcacaaagtcaatttagaaccttatcattaactgggatgtgtagtgatatttttgggcctctgggtttcatgtgtcaatacaaggaatatttatttaaaatagatttatttagaggaggcacagtgttgttgatctgtgtgacaccacccatatttttaaaaacctttgtatgtttctctaaatttgttgttgactgaatataatagaccctaccataattcgtcaaatatcactgattagttacatcctttgtgtgagattagctgtaaagtatactgctcttattcttattcagaatagttaattggtagccaaaaatacatgtatcacagatgttaggtcgaatttaaacagcacagtcaagtgctatggaagtttttctgctaaattagtagattaaagaatactataccctaggcatggggagcagcacgttttcctttggtaggtaggatctctatactagtgaacagtgccagttccacactttggacttagaactgttctctagttattgtaacacagaatactgtcaatccctaatttacttaatgttacttattggaagtggggctgatgaaatacgcacaggagggaaatctactgtgtttaggcacaggcagccccagtgtataaggagatcatattccaaaaggttgtcagttggttgtttgcaacctggaatgtattttcctttagagaccaggttatccatggtggttaggcccctagagcagctggaaaagatgatcaaaccaataggttagctgacatcgaataatgtaataggtttgctaaagaatctaaccatcaaatataatattgtttccagggagggtgtttgttcagagttgcctgttagtagaatctggactgtccatcccagccacatcccacctactggacagtaggggtagagatgccaccagactacaggtgaccagattggcctgaaacatggtgtccagtaaaaacggggaggaataagtccatgactgccggagagcttggtggtaggaggagggtgaaggagggtgagggggcctctcatgggtcagaaacctccagggacatccctcagctggtaactctgctgttgtccggagggttcaggcttggtgtgccttcttctgtttgtctgacttttggctcctatggttcatctcctgccctgcccaccacagaaaaggatgctgctgcacagcttctccaatgtaccagtcattgaggccagcgcgcagcacttttaatgtttttagtgctagtaactgtgttttaactctccaggaataagctgggaggttagaaaacaagaaaaaagggggaaaaaaaaacctctccacccactttccttttttacagttacagaccctgttgagaaaaagaagcacccagatgggtgatggtgatagggcttgtggtggacacagggttgtggtaagattcctcagtgcttcggcgagcacctaagactattaccctggaactgactgctttctagagcttgattcatgcctctaagccagtggttctcaaagtgtggcccctagaccagtagcatcagcatcatcggggacctcattagaatgcagattctcagccccctcccagacatggtgaagtcagaagctctcagggagggactcagcaaatgattctaaagcgcatcaagtttgagaaccaccctaagccaatgagtctcccttttacttcccattagtcctccctcaccagatgattcctaggactcatggtgcaacatacaggagccaggctttagggaggggaggaaaggagcctggcggcaggggtctctgcaatggcaagaaagtgagtgaatccagcgctgccacctggttatccccttctcgttgaaaatagcagcgcgggtgcaaattcctaaacacaggctgcctgcactcggtgttacctcgggctgaggcatgataatattttattttttaaagctgtgaggaaatgaaagtgaggctttggttggggcgaggcagttgtgaaagaaattaaaataaaagaccctttgtaaatgcagacttagaagaaatactgaatttgtgtcagaagttctccagtgtttgtgttaatcgtgtggtgataatcctgtcctccttttaaagcgaattctctactgaaaggtctgctctgcttaaggagctacaaactgctctcaaaagaatgaaatactgagttccaattcagtgaggcacagtgttggactatggcacatttagttggagtcggggggaggtcaggaatatgatcagataatggattttataccttagagcaaaatctattagtctctctcagtttatcaatttaaatggctttaggcttatagggggtgtaaactttaagaatataattctcccattcaagtttacagcaaacatctagccaccttcaaaacaaagaagatacagaccatcatttagcaatactaatacatgattttccttggggatggcaggtttgagaatcctttagcaacaggacatacttcccctaaattacagtgaattatttataacgagataaagctttcaggtacaagctgaaggtggggtgtctaacaactaaaaactatcactaatgtgctgttcagccatttagtttttaatcatgcattttaatttccttttaatctcttggtcttctataatctctatctgtacagctttgtcaccatttttttttatttcctcactggaagtagtcccagaaaaaaacacaaaacctcaaaacggttaacttgagcttataatttcctttctctttctttcttactttctttgcctttctttcacacaggtaagacctataacaacaaatggacaattt

SEQ ID NO: 448207 - DNA, 2619 bp, Homo sapiens
  misc_feature (178)..(178): n is a, c, g, or t
gtaaataaaataccaaagactaattttatttcaggggtcagaactattcatcctttatctttttatttgaaaccacatttcaccatataaaaattagagcctaggtgtgttgttgcacacctgtggtctcatctactctggaggctgaagcgggaggagtgcttgagcccagcctggnaacatagcaagattccatctcagaaaaaaaaacctctccacccactttccttttttacagttacagaccctgttgagaaaaagaagcacccagatgggtgatggtgatagggcttgtggtggacacagggttgtggtaagattcctcagtgcttcggcgagcacctaagactattaccctggaactgactgctttctagagcttgattcatgcctctaagccagtggttctcaaagtgtggcccctagaccagtagcatcagcatcatcggggacctcattagaatgcagattctcagccccctcccagacatggtgaagtcagaagctctcagggagggactcagcaaatgattctaaagcgcatcaagtttgagaaccaccctaagccaatgagtctcccttttacttcccattagtcctccctcaccagatgattcctaggactcatggtgcaacatacaggagccaggctttagggaggggaggaaaggagcctggcggcaggggtctctgcaatggcaagaaagtgagtgaatccagcgctgccacctggttatccccttctcgttgaaaatagcagcgcgggtgcaaattcctaaacacaggctgcctgcactcggtgttacctcgggctgaggcatgataatattttattttttaaagctgtgaggaaatgaaagtgaggctttggttggggcgaggcagttgtgaaagaaattaaaataaaagaccctttgtaaatgcagacttagaagaaatactgaatttgtgtcagaagttctccagtgtttgtgttaatcgtgtggtgataatcctgtcctccttttaaagcgaattctctactgaaaggtctgctctgcttaaggagctacaaactgctctcaaaagaatgaaatactgagttccaattcagtgaggcacagtgttggactatggcacatttagttggagtcggggggaggtcaggaatatgatcagataatggattttataccttagagcaaaatctattagtctctctcagtttatcaatttaaatggctttaggcttatagggggtgtaaactttaagaatataattctcccattcaagtttacagcaaacatctagccaccttcaaaacaaagaagatacagaccatcatttagcaatactaatacatgattttccttggggatggcaggtttgagaatcctttagcaacaggacatacttcccctaaattacagtgaattatttataacgagataaagctttcaggtacaagctgaaggtggggtgtctaacaactaaaaactatcactaaatctcaaagagaaagttcttgcaaaatatgtaaagttcacaaggtgcagacattttccttctttaggcttttatctaaggaagggctatgaaactgggcccatctgtatacaggctcaaatttacgtttttaaaggaagaatctatgcagctgaggcttattgcaggaaatacttcatttgtatgtaaatattattgtaaataaataggaggctgtatatttttgaagttgttgatccgcactgaaatagaagtctctaggatctgcatataaacaataaatgtttcctagaaattagtggtttgtttgggaattagaaaaatttacattctctcccaggtaacatagttctctcaatgtaaacttggaacctgaaaccctacttaatttagagaaagaaatgtctgagaaatagttcccttgatttcttatgctggcattaagatcaattatttaacagatagtcctctgagatacaagtaaggaatatttagacacaaatccttgtcctatagaaacagatatacccaaatgacaaattgtttcttcataatgatcttccatttttaacactgataccactacacagtacatatgaaaacagaagctggggagaagaatgtttttttcacaattgaattgctgcatttctcaaactttgggatctatgaaagcggggagagggaacctgaatattaattatgagcacaaatttgaaggaaagaaaacaaagaaccattatctaatcaagctttgaaagtcctgcatgtttgccttttattttagtgttgacgccaacatagactgtctaaggtatttttttccccaaacacttgaatcttggtcgttggtatgtaatccactctctagagtccagtgtactttagacttcatctgagtccaatacatgtaccacactactgttttattaatgtaaaaaccttgtaaatgaatttcagatgggtgatttaagtgagtcacaagtcacaaaactttgctattcatagttaatcaaatagaactgggttttttttttcagagtgtggtgtaaataaagaaatataagaagttctgttctataactgctctgttaacatagtttttaaacattaaaaaatgtgaactaaaagta

SEQ ID NO: 448208 - DNA, 1750 bp, Homo sapiens
ggctaccagtattcgatctgatagtgaggcttggttggggcgaggcactgtgagataaattagaagaaatactgaatttgtgtcagaagttctccagtgtttgtgttaatcgtgtggtgataatcctgtcctccttttaaagcgaattctctactgaaaggtctgctctgcttaaggagctacaaactgctctcaaaagaatgaaatactgagttccaattcagtgaggcacagtgttggactatggcacatttagttggagtcggggggaggtcaggaatatgatcagataatggattttataccttagagcaaaatctattagtctctctcagtttatcaatttaaatggctttaggcttatagggggtgtaaactttaagaatataattctcccattcaagtttacagcaaacatctagccaccttcaaaacaaagaagatacagaccatcatttagcaatactaatacatgattttccttggggatggcaggtttgagaatcctttagcaacaggacatacttcccctaaattacagtgaattatttataacgagataaagctttcaggtacaagctgaaggtggggtgtctaacaactaaaaactatcactaaatctcaaagagaaagttcttgcaaaatatgtaaagttcacaaggtgcagacattttccttctttaggcttttatctaaggaagggctatgaaactgggcccatctgtatacaggctcaaatttacgtttttaaaggaagaatctatgcagctgaggcttattgcaggaaatacttcatttgtatgtaaatattattgtaaataaataggaggctgtatatttttgaagttgttgatccgcactgaaatagaagtctctaggatctgcatataaacaataaatgtttcctagaaattagtggtttgtttgggaattagaaaaatttacattctctcccaggtaacatagttctctcaatgtaaacttggaacctgaaaccctacttaatttagagaaagaaatgtctgagaaatagttcccttgatttcttatgctggcattaagatcaattatttaacagatagtcctctgagatacaagtaaggaatatttagacacaaatccttgtcctatagaaacagatatacccaaatgacaaattgtttcttcataatgatcttccatttttaacactgataccactacacagtacatatgaaaacagaagctggggagaagaatgtttttttcacaattgaattgctgcatttctcaaactttgggatctatgaaagcggggagagggaacctgaatattaattatgagcacaaatttgaaggaaagaaaacaaagaaccattatctaatcaagctttgaaagtcctgcatgtttgccttttattttagtgttgacgccaacatagactgtctaaggtatttttttccccaaacacttgaatcttggtcgttggtatgtaatccactctctagagtccagtgtactttagacttcatctgagtccaatacatgtaccacactactgttttattaatgtaaaaaccttgtaaatgaatttcagatgggtgatttaagtgagtcacaagtcacaaaactttgctattcatagttaatcaaatagaactgggttttttttttcagagtgtggtgtaaataaagaaatataagaagttctgttctataactgctctgttaacatagtttttaaacattaaaaaatgtgaactaaaagta

SEQ ID NO: 448209 - DNA, 1535 bp, Homo sapiens
ggtgcgtgcgttcagaggatcccttcagcacgcacatttagttggagtcggggggaggtcaggaatatgatcagataatggattttataccttagagcaaaatctattagtctctctcagtttatcaatttaaatggctttaggcttatagggggtgtaaactttaagaatataattctcccattcaagtttacagcaaacatctagccaccttcaaaacaaagaagatacagaccatcatttagcaatactaatacatgattttccttggggatggcaggtttgagaatcctttagcaacaggacatacttcccctaaattacagtgaattatttataacgagataaagctttcaggtacaagctgaaggtggggtgtctaacaactaaaaactatcactaaatctcaaagagaaagttcttgcaaaatatgtaaagttcacaaggtgcagacattttccttctttaggcttttatctaaggaagggctatgaaactgggcccatctgtatacaggctcaaatttacgtttttaaaggaagaatctatgcagctgaggcttattgcaggaaatacttcatttgtatgtaaatattattgtaaataaataggaggctgtatatttttgaagttgttgatccgcactgaaatagaagtctctaggatctgcatataaacaataaatgtttcctagaaattagtggtttgtttgggaattagaaaaatttacattctctcccaggtaacatagttctctcaatgtaaacttggaacctgaaaccctacttaatttagagaaagaaatgtctgagaaatagttcccttgatttcttatgctggcattaagatcaattatttaacagatagtcctctgagatacaagtaaggaatatttagacacaaatccttgtcctatagaaacagatatacccaaatgacaaattgtttcttcataatgatcttccatttttaacactgataccactacacagtacatatgaaaacagaagctggggagaagaatgtttttttcacaattgaattgctgcatttctcaaactttgggatctatgaaagcggggagagggaacctgaatattaattatgagcacaaatttgaaggaaagaaaacaaagaaccattatctaatcaagctttgaaagtcctgcatgtttgccttttattttagtgttgacgccaacatagactgtctaaggtatttttttccccaaacacttgaatcttggtcgttggtatgtaatccactctctagagtccagtgtactttagacttcatctgagtccaatacatgtaccacactactgttttattaatgtaaaaaccttgtaaatgaatttcagatgggtgatttaagtgagtcacaagtcacaaaactttgctattcatagttaatcaaatagaactgggttttttttttcagagtgtggtgtaaataaagaaatataagaagttctgttctataactgctctgttaacatagtttttaaacattaaaaaatgtgaactaaaagta

SEQ ID NO: 448210 - DNA, 5217 bp, Homo sapiens
ccaaaatgcaggccccagcggaacgcacagccctcctgtcctccgccggtgcccctttagccgccccacccccatccctaagggctctcattctccagctgcagccgcagctgggttccgaacacgccgccgggccccgggagggagaggggcaggtgccagggcggcgcgcagcctctgctcccggtgccagcttcagtgcgccgggcacacgcgcgccccgcaacccctccctcaccctttccccgttgctcaatctccgccagccgcggtcgctgcatcgtcagagagctgcaagagggaggcagcaaggtgcggccgccagcagtgacaccatgtgaccggcacggctcactgacacgcagctttggttaaagagcgggcgcacaggaggggaggagaccgcgcgcgggacggggaggaatggcctgtccgcgttaaaccatcacaagccatggttgcggaagggccacgcgtcccccagtaggagaatgactccgattcgtgaccctcagcgccggtgcatgtcgatatatttattgagtgtctactgtgtgccaggcactatatctatgtgcatagaaaaaccctggaaggccatacaacaatatatatagagtgatcgtctctgcttgctgagctaacaggggtgtcaagcttccattttggtatctacttctaaatacactcagaacaggagaaatttggactaattttcaaactacagacactttctaatcatgatgcatttcaaaagtggactcgaattaactgagttgcaaaacatgacagtgcccgaggatgataacattagcaatgactccaatgatttcaccgaagtagaaaatggtcagataaatagcaagtttatttctgatcgtgaaagtagaagaagtctcacaaacagccatttggaaaaaaagaagtgtgatgagtatattccaggtacaacctccttaggcatgtctgtttttaacctaagcaacgccattatgggcagtgggattttgggactcgcctttgccctggcaaacactggaatcctactttttctggtacttttgacttcagtgacattgctgtctatatattcaataaacctcctattgatctgttcaaaagaaacaggctgcatggtgtatgaaaagctgggggaacaagtctttggcaccacagggaagttcgtaatctttggagccacctctctacagaacactggagcaatgctgagctacctcttcatcgtaaaaaatgaactaccctctgccataaagtttctaatgggaaaggaagagacattttcagcctggtacgtggatggccgcgttctggtggtgatagttacctttggcataattctccctctgtgtctcttgaagaacttagggtatcttggctatactagtggattttccttgagctgtatggtttttttcctaattgtggttatttacaagaaatttcaaattccctgcattgttccagagctaaattcaacaataagtgctaattcaacaaatgctgacacgtgtacgccaaaatatgttaccttcaattcaaagaccgtgtatgctttacccaccattgcatttgcatttgtttgccacccgtcagtcctgccaatttacagtgagcttaaagaccgatcacagaaaaaaatgcagatggtttcaaacatctcctttttcgccatgtttgttatgtacttcttgactgccatttttggctacttgacattctatgacaacgtgcagtccgacctccttcacaaatatcagagtaaagatgacattctcatcctgacagtgcggctggctgtcattgttgctgtgatcctcacagtgccggtgttatttttcacggttcgttcatctttatttgaactggctaagaaaacaaagtttaatttatgtcgtcataccgtggttacctgcatactcttggttgttatcaacttgttggtgatcttcataccctccatgaaggatatttttggagtcgtaggagttacatctgctaacatgcttattttcattcttccttcatctctttatttaaaaatcacagaccaggatggagataaaggaactcaaagaatttgggctgcccttttcttgggcctgggggtgttgttctccttggtcagcattcccttggtcatctatgactgggcctgctcatcgagtagtgacgaaggccactgaaacccgccgagaaaaagaaacatccctgttgtctgctcagtcaagtccccacacatcagcaatctctcaccacttcttttgcaagtttacagaagcaaacagaaatgtacaggatacttaaaatggaataactttttggttgcaaaacagagacatggttctataatgcttcatgtccctccaagatttgagatcaatttagggattgtgaaatttttttttcaaatttcatacaatcatatttcccagtacttttcacaatcattttttacccatctaactctatgttttgtggcttcccggtctcttagaactttgaaaacatgatatacaataatgtttatttattatacatccagattctgaaataattttcctactgatgttcagctcacactatctgtacctttttagaagagaaaagaatcttgaattgtatatatttattttgctttacagaaaaaaatggtttcgtaaataatttgcctattttggttaacatagcacatggagataatcatctgaaagttatagggcactgccactgctgaatcagagcatgcccaatatttgaggtggctctgatttcctggcagctgaactcgggtagtccagtggcctagctggtaccacatctattcccatccagagacattctctggcaagtgttctcagctgaaaagtggttggggatgattcttaccttggtaattaaatgaagctacacatttgggtaatctagcaaatgaagtattttttccctcttggcaacttgtgtcagagttactctggtctgagtcaactttcgctggggaaaacctatggaacctactgcaaaaagattgtccaaaatgcctaagaaaatactcctctgatgcatttagccttcaaccctacctgtcttgctgaagggagaaaaatgttttagtacattataggcccagcagcttttattcatgtccaccagctagttgcacagagaatcatgtgtacctaactaaggatgatctaggataagtaactcctgttttatattgagtattttagggaagtctttaaaagacttgttttatatctataaatctaggttattacaaatacaagaattttgtaccttaaataagcctcatttctatttcttcttcattaattctccatctagtcttgtgaaaaaaaaaaaaaaccctcagagatagtctttgtgaagagcttctgacagaatcactgagtaccttccttcccccagatgaggaagacaagggggtctcagtgtctgtgctgtctcctcttctcttccccaaccaaggactgtgccattactgcccgtctcaactgtccatgcaggaggacagagttgcctggtactcttacccttgtccctctcctaaagggagcacaaggaaactgaagagactgaaaaagaagagagtttgtagctgaaaaagaatagggatagcaaggaaacccagaactgcattcccctaagtggggccatcccatgtgattgaattgtccatagcttgcctatggtgagaaatgtgcatgctccgtgagctggtctcttgaaacaggacttatgcttcctctatattctggttaaattttccaaacacataagttcactgagcacagatttcttatccagagacaagtagaatctaaccgcagactgttggcagagtttccaggcacttagccatgttcccttcctgactcaaatccccaaaggccttcactctcactgagaatcacactactgtcccatagataaggcaggcattgaagcacctgtcgtgatcctctaggggggagaatgaaaggttatttcctgcattgcatcatcatagcttttaatataatgctacagaatcatatccacattaggttagagttcagatatttggatatgaatacctaacctagccatatccatggccatctctgttcttttcagcaatgttttccatattatattagcaatgacagaaacagaacaagccaagatccagtcagttcttgggagcttgtctagagcaccaagtaatgaaatagccaggtagtgggatgactgtacctttaaaaatacataatttagtttgcaagctatattatgctactttctattttccttgttactttatagcaattcattttaccctcacaaagtcaatttagaaccttatcattaactgggatgtgtagtgatatttttgggcctctgggtttcatgtgtcaatacaaggaatatttatttaaaatagatttatttagaggaggcacagtgttgttgatctgtgtgacaccacccatatttttaaaaacctttgtatgtttctctaaatttgttgttgactgaatataatagaccctaccataattcgtcaaatatcactgattagttacatcctttgtgtgagattagctgtaaagtatactgctcttattcttattcagaatagttaattggtagccaaaaatacatgtatcacagatgttaggtcgaatttaaacagcacagtcaagtgctatggaagtttttctgctaaattagtagattaaagaatactataccctaggcatggggagcagcacgttttcctttggtaggtaggatctctatactagtgaacagtgccagttccacactttggacttagaactgttctctagttattgtaacacagaatactgtcaatccctaatttacttaatgttacttattggaagtggggctgatgaaatacgcacaggagggaaatctactgtgtttaggcacaggcagccccagtgtataaggagatcatattccaaaaggttgtcagttggttgtttgcaacctggaatgtattttcctttagagaccaggttatccatggtggttaggcccctagagcagctggaaaagatgatcaaaccaataggttagctgacatcgaataatgtaataggtttgctgtaatagtttatgctgtaatagtttatgctgtaatagtttatgctgtaatagtttatg

SEQ ID NO: 448211 - DNA, 666 bp, Homo sapiens
  misc_feature (23)..(23): n is a, c, g, or t
gactctcaggacccaggattcgnagatgacacaaatccttgtcctatagaaacagatatacccaaatgacaaattgtttcttcataatgatcttccatttttaacactgataccactacacagtacatatgaaaacagaagctggggagaagaatgtttttttcacaattgaattgctgcatttctcaaactttgggatctatgaaagcggggagagggaacctgaatattaattatgagcacaaatttgaaggaaagaaaacaaagaaccattatctaatcaagctttgaaagtcctgcatgtttgccttttattttagtgttgacgccaacatagactgtctaaggtatttttttccccaaacacttgaatcttggtcgttggtatgtaatccactctctagagtccagtgtactttagacttcatctgagtccaatacatgtaccacactactgttttattaatgtaaaaaccttgtaaatgaatttcagatgggtgatttaagtgagtcacaagtcacaaaactttgctattcatagttaatcaaatagaactgggttttttttttcagagtgtggtgtaaataaagaaatataagaagttctgttctataactgctctgttaacatagtttttaaacattaaaaaatgtgaactaaaagta

SEQ ID NO: 448212 - DNA, 1949 bp, Homo sapiens
ccaaaatgcaggccccagcggaacgcacagccctcctgtcctccgccggtgcccctttagccgccccacccccatccctaagggctctcattctccagctgcagccgcagctgggttccgaacacgccgccgggccccgggagggagaggggcaggtgccagggcggcgcgcagcctctgctcccggtgccagcttcagtgcgccgggcacacgcgcgccccgcaacccctccctcaccctttccccgttgctcaatctccgccagccgcggtcgctgcatcgtcagagagctgcaagagggaggcagcaaggtgcggccgccagcagtgacaccatgtgaccggcacggctcactgacacgcagctttggttaaagagcgggcgcacaggaggggaggagaccgcgcgcgggacggggaggaatggcctgtccgcgttaaaccatcacaagccatggttgcggaagggccacgcgtcccccagtaggagaatgactccgattcgtgaccctcagcgccggtgcatgtcgatgtaagtgcgaggccggcgagcagagtgtgagtgggggttggtggtgaggggagattctgatgcaatcggcccggaaaggaggagagccaggcgagcgcggactggggcggccacgccactccgccagaaggtcgccaggagcctccgcccttcaccttcctccgaaatccgccaggccacgccaagctccctgcccaacccttactgacgggggccacattttcccggcctccgcagccagaccttgacacaaaggacatcaaactgccgagggtaaaaaccccggaagggcggacacctccacatcgccttttgccacctttccctttatttccggaggtaaggtgattatccgttcccggggagggctgggcgagcggcaaggggagatttagatgtcggaggaggaggtaacgtagaaatcatctctgcgggcgtgaaagcagagagagctcggctgtgcccgatgctttcggatgttgcttttaggagaggaaaagtccaggtctcctgtgcttcccgaacgcacgcggcagcgggaggaagcgccagggcccccgagttcacctttgcgtgggctgtggcttactttttggtttgttttcctgtgactttggtgtgttttcctgtggctgtggcagagtgtggtaccagatctggttccatttttacgagagccaggaaccacgcacgtctggagggagagcgcagctgacccgagggcgcgaccgtgttctgggagtgtttgaatccccggcctttggtgaaaatttcctgtgtccgcaaggcccagaggagatcgtgtgatgtccggggggtgctgcgtgcggccggctgggtagcggccgcggaccaccactaaaccggggcatgtttgccgtccttcctggtgctctgcccctctgtaacgcggggaagtaggagggcgcggggagaaattactaaaggatgcttgcagtgactcactgtcctttcctgccctgaagaggattttctaaaatgcagagggtggcaggggacagaggtagtgttttttcgagagccgggatgtgctggagccagcgaacaaaaggccacctcttgcgcggtcttgggcgcagactgctctcgcttccagtcccacctcctccccaacccccggcacctagttcgcgtccctaaacgttgccgcagaggcctttaaacgcgtgggtcggtgccgggaggagagcgcatcttcgcccttgtgcgagccccttgccccctaaattatccacctcctggcgcatggggctccccagcacccactgggacccagtaggttacccggctgcctgggcaccgtttgcctgccaaatcgcccgcctgaggtttgtgctgaactgtagttagagaaggcacaagtgcatatggcagcaaaaggaatttcgcggtaccc

SEQ ID NO: 448213 - DNA, 447 bp, Homo sapiens
gtacatgtggaaaaattttgctgcactgaaaataacccttgcctttctcttgctccaggctgcccttttcttgggcctgggggtgttgttctccttggtcagcattcccttggtcatctatgactgggcctgctcatcgagtagtgacgaaggccactgaaacccgccgagaaaaagaaacatccctgttgtctgctcagtcaagtccccacacatcagcaatctctcaccacttcttttgcaagtttacagaagcaaacagaaatgtacaggatacttaaaatggaataactttttggttgcaaaacagagacatggttctataatgcttcatgtccctccaagatttgagatcaatttagggattgtgaaatttttttttcaaatttcatacaatcatatttcccagtacttttcacaatcattttttacccatctaactctatg

SEQ ID NO: 448214 - DNA, 375 bp, Homo sapiens
aatggttggtttggttttgtgatagtacaatggcatgtaataattattcattggctttactaaagtccatattgcttctactatacttcttaataccaggttatttacaagaaatttcaaattccctgcattgttccagagctaaattcaacaataagtgctaattcaacaaatgctgacacgtgtacgccaaaatatgttaccttcaattcaaaggtaagtttcctgatcctttgcagatgaaacaagcatttttattaaggacattctatttctcatgcttgtaattgcactggtttgaatgtattagttctcaaaagaacacatgataccattgcttccagattacacatctatgtagagatccttgagaaa

SEQ ID NO: 448215 - DNA, 424 bp, Homo sapiens
aaaaataagccttatgacctaataggttaattgtaatgctctggtagccaacttgaaaaaggagaaatgatggttgcatctcacattttaaaatgttaagaatttgttttgtaatgaggataccttaacccctgaaggccaaaatgactatttgtgtgagtttgagaaaggcacatagtaacttggggaacagtcaatagaatgacaaaatcttgactattttaactttctgaaccctgtcatttcttgtgttctcaaatttgatttttaaataggctgcatggtgtatgaaaagctgggggaacaagtctttggcaccacagggaagttcgtaatctttggagccacctctctacagaacactggaggtaaaaagaacatgcttttctttacataacttgaaactaattctggtggatgagcg

SEQ ID NO: 448216 - DNA, 7624 bp, Homo sapiens
ataattgagggaagaaggccagcggaaggaacaggaagaaggaacagcaaatatttattgagtgtctactgtgtgccaggcactatatctatgtgcatagaaaaaccctggaaggccatacaacaatatatatagagtgatcgtctctgcttgctgagctaacaggggtgtcaagcttccattttggtatctacttctaaatacactcagaacaggagaaatttggactaattttcaaactacagacactttctaatcatgatgcatttcaaaagtggactcgaattaactgagttgcaaaacatgacagtgcccgaggatgataacattagcaatgactccaatgatttcaccgaagtagaaaatggtcagataaatagcaagtttatttctgatcgtgaaagtagaagaagtctcacaaacagccatttggaaaaaaagaagtgtgatgagtatattccaggtacaacctccttaggcatgtctgtttttaacctaagcaacgccattatgggcagtgggattttgggactcgcctttgccctggcaaacactggaatcctactttttctggtacttttgacttcagtgacattgctgtctatatattcaataaacctcctattgatctgttcaaaagaaacaggctgcatggtgtatgaaaagctgggggaacaagtctttggcaccacagggaagttcgtaatctttggagccacctctctacagaacactggagcaatgctgagctacctcttcatcgtaaaaaatgaactaccctctgccataaagtttctaatgggaaaggaagagacattttcagcctggtacgtggatggccgcgttctggtggtgatagttacctttggcataattctccctctgtgtctcttgaagaacttagggtatcttggctatactagtggattttccttgagctgtatggtttttttcctaattgtggttatttacaagaaatttcaaattccctgcattgttccagagctaaattcaacaataagtgctaattcaacaaatgctgacacgtgtacgccaaaatatgttaccttcaattcaaagaccgtgtatgctttacccaccattgcatttgcatttgtttgccacccgtcagtcctgccaatttacagtgagcttaaagaccgatcacagaaaaaaatgcagatggtttcaaacatctcctttttcgccatgtttgttatgtacttcttgactgccatttttggctacttgacattctatgacaacgtgcagtccgacctccttcacaaatatcagagtaaagatgacattctcatcctgacagtgcggctggctgtcattgttgctgtgatcctcacagtgccggtgttatttttcacggttcgttcatctttatttgaactggctaagaaaacaaagtttaatttatgtcgtcataccgtggttacctgcatactcttggttgttatcaacttgttggtgatcttcataccctccatgaaggatatttttggagtcgtaggagttacatctgctaacatgcttattttcattcttccttcatctctttatttaaaaatcacagaccaggatggagataaaggaactcaaagaatttgggctgcccttttcttgggcctgggggtgttgttctccttggtcagcattcccttggtcatctatgactgggcctgctcatcgagtagtgacgaaggccactgaaacccgccgagaaaaagaaacatccctgttgtctgctcagtcaagtccccacacatcagcaatctctcaccacttcttttgcaagtttacagaagcaaacagaaatgtacaggatacttaaaatggaataactttttggttgcaaaacagagacatggttctataatgcttcatgtccctccaagatttgagatcaatttagggattgtgaaatttttttttcaaatttcatacaatcatatttcccagtacttttcacaatcattttttacccatctaactctatgttttgtggcttcccggtctcttagaactttgaaaacatgatatacaataatgtttatttattatacatccagattctgaaataattttcctactgatgttcagctcacactatctgtacctttttagaagagaaaagaatcttgaattgtatatatttattttgctttacagaaaaaaatggtttcgtaaataatttgcctattttggttaacatagcacatggagataatcatctgaaagttatagggcactgccactgctgaatcagagcatgcccaatatttgaggtggctctgatttcctggcagctgaactcgggtagtccagtggcctagctggtaccacatctattcccatccagagacattctctggcaagtgttctcagctgaaaagtggttggggatgattcttaccttggtaattaaatgaagctacacatttgggtaatctagcaaatgaagtattttttccctcttggcaacttgtgtcagagttactctggtctgagtcaactttcgctggggaaaacctatggaacctactgcaaaaagattgtccaaaatgcctaagaaaatactcctctgatgcatttagccttcaaccctacctgtcttgctgaagggagaaaaatgttttagtacattataggcccagcagcttttattcatgtccaccagctagttgcacagagaatcatgtgtacctaactaaggatgatctaggataagtaactcctgttttatattgagtattttagggaagtctttaaaagacttgttttatatctataaatctaggttattacaaatacaagaattttgtaccttaaataagcctcatttctatttcttcttcattaattctccatctagtcttgtgaaaaaaaaaaaaaaccctcagagatagtctttgtgaagagcttctgacagaatcactgagtaccttccttcccccagatgaggaagacaagggggtctcagtgtctgtgctgtctcctcttctcttccccaaccaaggactgtgccattactgcccgtctcaactgtccatgcaggaggacagagttgcctggtactcttacccttgtccctctcctaaagggagcacaaggaaactgaagagactgaaaaagaagagagtttgtagctgaaaaagaatagggatagcaaggaaacccagaactgcattcccctaagtggggccatcccatgtgattgaattgtccatagcttgcctatggtgagaaatgtgcatgctccgtgagctggtctcttgaaacaggacttatgcttcctctatattctggttaaattttccaaacacataagttcactgagcacagatttcttatccagagacaagtagaatctaaccgcagactgttggcagagtttccaggcacttagccatgttcccttcctgactcaaatccccaaaggccttcactctcactgagaatcacactactgtcccatagataaggcaggcattgaagcacctgtcgtgatcctctaggggggagaatgaaaggttatttcctgcattgcatcatcatagcttttaatataatgctacagaatcatatccacattaggttagagttcagatatttggatatgaatacctaacctagccatatccatggccatctctgttcttttcagcaatgttttccatattatattagcaatgacagaaacagaacaagccaagatccagtcagttcttgggagcttgtctagagcaccaagtaatgaaatagccaggtagtgggatgactgtacctttaaaaatacataatttagtttgcaagctatattatgctactttctattttccttgttactttatagcaattcattttaccctcacaaagtcaatttagaaccttatcattaactgggatgtgtagtgatatttttgggcctctgggtttcatgtgtcaatacaaggaatatttatttaaaatagatttatttagaggaggcacagtgttgttgatctgtgtgacaccacccatatttttaaaaacctttgtatgtttctctaaatttgttgttgactgaatataatagaccctaccataattcgtcaaatatcactgattagttacatcctttgtgtgagattagctgtaaagtatactgctcttattcttattcagaatagttaattggtagccaaaaatacatgtatcacagatgttaggtcgaatttaaacagcacagtcaagtgctatggaagtttttctgctaaattagtagattaaagaatactataccctaggcatggggagcagcacgttttcctttggtaggtaggatctctatactagtgaacagtgccagttccacactttggacttagaactgttctctagttattgtaacacagaatactgtcaatccctaatttacttaatgttacttattggaagtggggctgatgaaatacgcacaggagggaaatctactgtgtttaggcacaggcagccccagtgtataaggagatcatattccaaaaggttgtcagttggttgtttgcaacctggaatgtattttcctttagagaccaggttatccatggtggttaggcccctagagcagctggaaaagatgatcaaaccaataggttagctgacatcgaataatgtaataggtttgctaaagaatctaaccatcaaatataatattgtttccagggagggtgtttgttcagagttgcctgttagtagaatctggactgtccatcccagccacatcccacctactggacagtaggggtagagatgccaccagactacaggtgaccagattggcctgaaacatggtgtccagtaaaaacggggaggaataagtccatgactgccggagagcttggtggtaggaggagggtgaaggagggtgagggggcctctcatgggtcagaaacctccagggacatccctcagctggtaactctgctgttgtccggagggttcaggcttggtgtgccttcttctgtttgtctgacttttggctcctatggttcatctcctgccctgcccaccacagaaaaggatgctgctgcacagcttctccaatgtaccagtcattgaggccagcgcgcagcacttttaatgtttttagtgctagtaactgtgttttaactctccaggaataagctgggaggttagaaaacaagaaaaaagggggaaaaaaaaacctctccacccactttccttttttacagttacagaccctgttgagaaaaagaagcacccagatgggtgatggtgatagggcttgtggtggacacagggttgtggtaagattcctcagtgcttcggcgagcacctaagactattaccctggaactgactgctttctagagcttgattcatgcctctaagccagtggttctcaaagtgtggcccctagaccagtagcatcagcatcatcggggacctcattagaatgcagattctcagccccctcccagacatggtgaagtcagaagctctcagggagggactcagcaaatgattctaaagcgcatcaagtttgagaaccaccctaagccaatgagtctcccttttacttcccattagtcctccctcaccagatgattcctaggactcatggtgcaacatacaggagccaggctttagggaggggaggaaaggagcctggcggcaggggtctctgcaatggcaagaaagtgagtgaatccagcgctgccacctggttatccccttctcgttgaaaatagcagcgcgggtgcaaattcctaaacacaggctgcctgcactcggtgttacctcgggctgaggcatgataatattttattttttaaagctgtgaggaaatgaaagtgaggctttggttggggcgaggcagttgtgaaagaaattaaaataaaagaccctttgtaaatgcagacttagaagaaatactgaatttgtgtcagaagttctccagtgtttgtgttaatcgtgtggtgataatcctgtcctccttttaaagcgaattctctactgaaaggtctgctctgcttaaggagctacaaactgctctcaaaagaatgaaatactgagttccaattcagtgaggcacagtgttggactatggcacatttagttggagtcggggggaggtcaggaatatgatcagataatggattttataccttagagcaaaatctattagtctctctcagtttatcaatttaaatggctttaggcttatagggggtgtaaactttaagaatataattctcccattcaagtttacagcaaacatctagccaccttcaaaacaaagaagatacagaccatcatttagcaatactaatacatgattttccttggggatggcaggtttgagaatcctttagcaacaggacatacttcccctaaattacagtgaattatttataacgagataaagctttcaggtacaagctgaaggtggggtgtctaacaactaaaaactatcactaaatctcaaagagaaagttcttgcaaaatatgtaaagttcacaaggtgcagacattttccttctttaggcttttatctaaggaagggctatgaaactgggcccatctgtatacaggctcaaatttacgtttttaaaggaagaatctatgcagctgaggcttattgcaggaaatacttcatttgtatgtaaatattattgtaaataaataggaggctgtatatttttgaagttgttgatccgcactgaaatagaagtctctaggatctgcatataaacaataaatgtttcctagaaattagtggtttgtttgggaattagaaaaatttacattctctcccaggtaacatagttctctcaatgtaaacttggaacctgaaaccctacttaatttagagaaagaaatgtctgagaaatagttcccttgatttcttatgctggcattaagatcaattatttaacagatagtcctctgagatacaagtaaggaatatttagacacaaatccttgtcctatagaaacagatatacccaaatgacaaattgtttcttcataatgatcttccatttttaacactgataccactacacagtacatatgaaaacagaagctggggagaagaatgtttttttcacaattgaattgctgcatttctcaaactttgggatctatgaaagcggggagagggaacctgaatattaattatgagcacaaatttgaaggaaagaaaacaaagaaccattatctaatcaagctttgaaagtcctgcatgtttgccttttattttagtgttgacgccaacatagactgtctaaggtatttttttccccaaacacttgaatcttggtcgttggtatgtaatccactctctagagtccagtgtactttagacttcatctgagtccaatacatgtaccacactactgttttattaatgtaaaaaccttgtaaatgaatttcagatgggtgatttaagtgagtcacaagtcacaaaactttgctattcatagttaatcaaatagaactgggttttttttttcagagtgtggtgtaaataaagaaatataagaagttctgttctataactgctctgttaacatagtttttaaacattaaaaaatgtgaactaaaagta

SEQ ID NO: 448217 - DNA, 7011 bp, Homo sapiens
  misc_feature (6980)..(6980): n is a, c, g, or t
  misc_feature (6983)..(6983): n is a, c, g, or t
ccaaaatgcaggccccagcggaacgcacagccctcctgtcctccgccggtgcccctttagccgccccacccccatccctaagggctctcattctccagctgcagccgcagctgggttccgaacacgccgccgggccccgggagggagaggggcaggtgccagggcggcgcgcagcctctgctcccggtgccagcttcagtgcgccgggcacacgcgcgccccgcaacccctccctcaccctttccccgttgctcaatctccgccagccgcggtcgctgcatcgtcagagagctgcaagagggaggcagcaaggtgcggccgccagcagtgacaccatgtgaccggcacggctcactgacacgcagctttggttaaagagcgggcgcacaggaggggaggagaccgcgcgcgggacggggaggaatggcctgtccgcgttaaaccatcacaagccatggttgcggaagggccacgcgtcccccagtaggagaatgactccgattcgtgaccctcagcgccggtgcatgtcgatatatttattgagtgtctactgtgtgccaggcactatatctatgtgcatagaaaaaccctggaaggccatacaacaatatatatagagtgatcgtctctgcttgctgagctaacaggggtgtcaagcttccattttggtatctacttctaaatacactcagaacaggagaaatttggactaattttcaaactacagacactttctaatcatgatgcatttcaaaagtggactcgaattaactgagttgcaaaacatgacagtgcccgaggatgataacattagcaatgactccaatgatttcaccgaagtagaaaatggtcagataaatagcaagtttatttctgatcgtgaaagtagaagaagtctcacaaacagccatttggaaaaaaagaagtgtgatgagtatattccaggtacaacctccttaggcatgtctgtttttaacctaagcaacgccattatgggcagtgggattttgggactcgcctttgccctggcaaacactggaatcctactttttctggtacttttgacttcagtgacattgctgtctatatattcaataaacctcctattgatctgttcaaaagaaacaggctgcatggtgtatgaaaagctgggggaacaagtctttggcaccacagggaagttcgtaatctttggagccacctctctacagaacactggagcaatgctgagctacctcttcatcgtaaaaaatgaactaccctctgccataaagtttctaatgggaaaggaagagacattttcagcctggtacgtggatggccgcgttctggtggtgatagttacctttggcataattctccctctgtgtctcttgaagaacttagggtatcttggctatactagtggattttccttgagctgtatggtttttttcctaattgtggttatttacaagaaatttcaaattccctgcattgttccagagctaaattcaacaataagtgctaattcaacaaatgctgacacgtgtacgccaaaatatgttaccttcaattcaaagaccgtgtatgctttacccaccattgcatttgcatttgtttgccacccgtcagtcctgccaatttacagtgagcttaaagaccgatcacagaaaaaaatgcagatggtttcaaacatctcctttttcgccatgtttgttatgtacttcttgactgccatttttggctacttgacattctatgacaacgtgcagtccgacctccttcacaaatatcagagtaaagatgacattctcatcctgacagtgcggctggctgtcattgttgctgtgatcctcacagtgccggtgttatttttcacggttcgttcatctttatttgaactggctaagaaaacaaagtttaatttatgtcgtcataccgtggttacctgcatactcttggttgttatcaacttgttggtgatcttcataccctccatgaaggatatttttggagtcgtaggagttacatctgctaacatgcttattttcattcttccttcatctctttatttaaaaatcacagaccaggatggagataaaggaactcaaagaatttgggctgcccttttcttgggcctgggggtgttgttctccttggtcagcattcccttggtcatctatgactgggcctgctcatcgagtagtgacgaaggccactgaaacccgccgagaaaaagaaacatccctgttgtctgctcagtcaagtccccacacatcagcaatctctcaccacttcttttgcaagtttacagaagcaaacagaaatgtacaggatacttaaaatggaataactttttggttgcaaaacagagacatggttctataatgcttcatgtccctccaagatttgagatcaatttagggattgtgaaatttttttttcaaatttcatacaatcatatttcccagtacttttcacaatcattttttacccatctaactctatgttttgtggcttcccggtctcttagaactttgaaaacatgatatacaataatgtttatttattatacatccagattctgaaataattttcctactgatgttcagctcacactatctgtacctttttagaagagaaaagaatcttgaattgtatatatttattttgctttacagaaaaaaatggtttcgtaaataatttgcctattttggttaacatagcacatggagataatcatctgaaagttatagggcactgccactgctgaatcagagcatgcccaatatttgaggtggctctgatttcctggcagctgaactcgggtagtccagtggcctagctggtaccacatctattcccatccagagacattctctggcaagtgttctcagctgaaaagtggttggggatgattcttaccttggtaattaaatgaagctacacatttgggtaatctagcaaatgaagtattttttccctcttggcaacttgtgtcagagttactctggtctgagtcaactttcgctggggaaaacctatggaacctactgcaaaaagattgtccaaaatgcctaagaaaatactcctctgatgcatttagccttcaaccctacctgtcttgctgaagggagaaaaatgttttagtacattataggcccagcagcttttattcatgtccaccagctagttgcacagagaatcatgtgtacctaactaaggatgatctaggataagtaactcctgttttatattgagtattttagggaagtctttaaaagacttgttttatatctataaatctaggttattacaaatacaagaattttgtaccttaaataagcctcatttctatttcttcttcattaattctccatctagtcttgtgaaaaaaaaaaaaaaccctcagagatagtctttgtgaagagcttctgacagaatcactgagtaccttccttcccccagatgaggaagacaagggggtctcagtgtctgtgctgtctcctcttctcttccccaaccaaggactgtgccattactgcccgtctcaactgtccatgcaggaggacagagttgcctggtactcttacccttgtccctctcctaaagggagcacaaggaaactgaagagactgaaaaagaagagagtttgtagctgaaaaagaatagggatagcaaggaaacccagaactgcattcccctaagtggggccatcccatgtgattgaattgtccatagcttgcctatggtgagaaatgtgcatgctccgtgagctggtctcttgaaacaggacttatgcttcctctatattctggttaaattttccaaacacataagttcactgagcacagatttcttatccagagacaagtagaatctaaccgcagactgttggcagagtttccaggcacttagccatgttcccttcctgactcaaatccccaaaggccttcactctcactgagaatcacactactgtcccatagataaggcaggcattgaagcacctgtcgtgatcctctaggggggagaatgaaaggttatttcctgcattgcatcatcatagcttttaatataatgctacagaatcatatccacattaggttagagttcagatatttggatatgaatacctaacctagccatatccatggccatctctgttcttttcagcaatgttttccatattatattagcaatgacagaaacagaacaagccaagatccagtcagttcttgggagcttgtctagagcaccaagtaatgaaatagccaggtagtgggatgactgtacctttaaaaatacataatttagtttgcaagctatattatgctactttctattttccttgttactttatagcaattcattttaccctcacaaagtcaatttagaaccttatcattaactgggatgtgtagtgatatttttgggcctctgggtttcatgtgtcaatacaaggaatatttatttaaaatagatttatttagaggaggcacagtgttgttgatctgtgtgacaccacccatatttttaaaaacctttgtatgtttctctaaatttgttgttgactgaatataatagaccctaccataattcgtcaaatatcactgattagttacatcctttgtgtgagattagctgtaaagtatactgctcttattcttattcagaatagttaattggtagccaaaaatacatgtatcacagatgttaggtcgaatttaaacagcacagtcaagtgctatggaagtttttctgctaaattagtagattaaagaatactataccctaggcatggggagcagcacgttttcctttggtaggtaggatctctatactagtgaacagtgccagttccacactttggacttagaactgttctctagttattgtaacacagaatactgtcaatccctaatttacttaatgttacttattggaagtggggctgatgaaatacgcacaggagggaaatctactgtgtttaggcacaggcagccccagtgtataaggagatcatattccaaaaggttgtcagttggttgtttgcaacctggaatgtattttcctttagagaccaggttatccatggtggttaggcccctagagcagctggaaaagatgatcaaaccaataggttagctgacatcgaataatgtaataggtttgctaaagaatctaaccatcaaatataatattgtttccagggagggtgtttgttcagagttgcctgttagtagaatctggactgtccatcccagccacatcccacctactggacagtaggggtagagatgccaccagactacaggtgaccagattggcctgaaacatggtgtccagtaaaaacggggaggaataagtccatgactgccggagagcttggtggtaggaggagggtgaaggagggtgagggggcctctcatgggtcagaaacctccagggacatccctcagctggtaactctgctgttgtccggagggttcaggcttggtgtgccttcttctgtttgtctgacttttggctcctatggttcatctcctgccctgcccaccacagaaaaggatgctgctgcacagcttctccaatgtaccagtcattgaggccagcgcgcagcacttttaatgtttttagtgctagtaactgtgttttaactctccaggaataagctgggaggttagaaaacaagaaaaaagggggaaaaaaaaacctctccacccactttccttttttacagttacagaccctgttgagaaaaagaagcacccagatgggtgatggtgatagggcttgtggtggacacagggttgtggtaagattcctcagtgcttcggcgagcacctaagactattaccctggaactgactgctttctagagcttgattcatgcctctaagccagtggttctcaaagtgtggcccctagaccagtagcatcagcatcatcggggacctcattagaatgcagattctcagccccctcccagacatggtgaagtcagaagctctcagggagggactcagcaaatgattctaaagcgcatcaagtttgagaaccaccctaagccaatgagtctcccttttacttcccattagtcctccctcaccagatgattcctaggactcatggtgcaacatacaggagccaggctttagggaggggaggaaaggagcctggcggcaggggtctctgcaatggcaagaaagtgagtgaatccagcgctgccacctggttatccccttctcgttgaaaatagcagcgcgggtgcaaattcctaaacacaggctgcctgcactcggtgttacctcgggctgaggcatgataatattttattttttaaagctgtgaggaaatgaaagtgaggctttggttggggcgaggcagttgtgaaagaaattaaaataaaagaccctttgtaaatgcagacttagaagaaatactgaatttgtgtcagaagttctccagtgtttgtgttaatcgtgtggtgataatcctgtcctccttttaaagcgaattctctactgaaaggtctgctctgcttaaggagctacaaactgctctcaaaagaatgaaatactgagttccaattcagtgaggcacagtgttggactatggcacatttagttggagtcggggggaggtcaggaatatgatcagataatggattttataccttagagcaaaatctattagtctctctcagtttatcaatttaaatggctttaggcttatagggggtgtaaactttaagaatataattctcccattcaagtttacagcaaacatctagccaccttcaaaacaaagaagatacagaccatcatttagcaatactaatacatgattttccttggggatggcaggtttgagaatcctttagcaacaggacatacttcccctaaattacagtgaattatttataacgagataaagctttcaggtacaagctgaaggtggggtgtctaacaactaaaaactatcactaaggtgcngangggatcctctgatcagcagcagccaaca

SEQ ID NO: 448218 - DNA, 8445 bp, Homo sapiens
ccaaaatgcaggccccagcggaacgcacagccctcctgtcctccgccggtgcccctttagccgccccacccccatccctaagggctctcattctccagctgcagccgcagctgggttccgaacacgccgccgggccccgggagggagaggggcaggtgccagggcggcgcgcagcctctgctcccggtgccagcttcagtgcgccgggcacacgcgcgccccgcaacccctccctcaccctttccccgttgctcaatctccgccagccgcggtcgctgcatcgtcagagagctgcaagagggaggcagcaaggtgcggccgccagcagtgacaccatgtgaccggcacggctcactgacacgcagctttggttaaagagcgggcgcacaggaggggaggagaccgcgcgcgggacggggaggaatggcctgtccgcgttaaaccatcacaagccatggttgcggaagggccacgcgtcccccagtaggagaatgactccgattcgtgaccctcagcgccggtgcatgtcgatgtaagtgcgaggccggcgagcagagtgtgagtgggggttggtggtgaggggagattctgatgcaatcggcccggaaaggaggagagccaggcgagcgcggactggggcggccacgccactccgccagaaggtcgccaggagcctccgcccttcaccttcctccgaaatccgccaggccacgccaagctccctgcccaacccttactgacgggggccacattttcccggcctccgcagccagaccttgacacaaaggacatcaaactgccgagggtaaaaaccccggaagggcggacacctccacatcgccttttgccacctttccctttatttccggagatatttattgagtgtctactgtgtgccaggcactatatctatgtgcatagaaaaaccctggaaggccatacaacaatatatatagagtgatcgtctctgcttgctgagctaacaggggtgtcaagcttccattttggtatctacttctaaatacactcagaacaggagaaatttggactaattttcaaactacagacactttctaatcatgatgcatttcaaaagtggactcgaattaactgagttgcaaaacatgacagtgcccgaggatgataacattagcaatgactccaatgatttcaccgaagtagaaaatggtcagataaatagcaagtttatttctgatcgtgaaagtagaagaagtctcacaaacagccatttggaaaaaaagaagtgtgatgagtatattccaggtacaacctccttaggcatgtctgtttttaacctaagcaacgccattatgggcagtgggattttgggactcgcctttgccctggcaaacactggaatcctactttttctggtacttttgacttcagtgacattgctgtctatatattcaataaacctcctattgatctgttcaaaagaaacaggctgcatggtgtatgaaaagctgggggaacaagtctttggcaccacagggaagttcgtaatctttggagccacctctctacagaacactggagcaatgctgagctacctcttcatcgtaaaaaatgaactaccctctgccataaagtttctaatgggaaaggaagagacattttcagcctggtacgtggatggccgcgttctggtggtgatagttacctttggcataattctccctctgtgtctcttgaagaacttagggtatcttggctatactagtggattttccttgagctgtatggtttttttcctaattgtggttatttacaagaaatttcaaattccctgcattgttccagagctaaattcaacaataagtgctaattcaacaaatgctgacacgtgtacgccaaaatatgttaccttcaattcaaagaccgtgtatgctttacccaccattgcatttgcatttgtttgccacccgtcagtcctgccaatttacagtgagcttaaagaccgatcacagaaaaaaatgcagatggtttcaaacatctcctttttcgccatgtttgttatgtacttcttgactgccatttttggctacttgacattctatgacaacgtgcagtccgacctccttcacaaatatcagagtaaagatgacattctcatcctgacagtgcggctggctgtcattgttgctgtgatcctcacagtgccggtgttatttttcacggttcgttcatctttatttgaactggctaagaaaacaaagtttaatttatgtcgtcataccgtggttacctgcatactcttggttgttatcaacttgttggtgatcttcataccctccatgaaggatatttttggagtcgtaggagttacatctgctaacatgcttattttcattcttccttcatctctttatttaaaaatcacagaccaggatggagataaaggaactcaaagaatttgggctgcccttttcttgggcctgggggtgttgttctccttggtcagcattcccttggtcatctatgactgggcctgctcatcgagtagtgacgaaggccactgaaacccgccgagaaaaagaaacatccctgttgtctgctcagtcaagtccccacacatcagcaatctctcaccacttcttttgcaagtttacagaagcaaacagaaatgtacaggatacttaaaatggaataactttttggttgcaaaacagagacatggttctataatgcttcatgtccctccaagatttgagatcaatttagggattgtgaaatttttttttcaaatttcatacaatcatatttcccagtacttttcacaatcattttttacccatctaactctatgttttgtggcttcccggtctcttagaactttgaaaacatgatatacaataatgtttatttattatacatccagattctgaaataattttcctactgatgttcagctcacactatctgtacctttttagaagagaaaagaatcttgaattgtatatatttattttgctttacagaaaaaaatggtttcgtaaataatttgcctattttggttaacatagcacatggagataatcatctgaaagttatagggcactgccactgctgaatcagagcatgcccaatatttgaggtggctctgatttcctggcagctgaactcgggtagtccagtggcctagctggtaccacatctattcccatccagagacattctctggcaagtgttctcagctgaaaagtggttggggatgattcttaccttggtaattaaatgaagctacacatttgggtaatctagcaaatgaagtattttttccctcttggcaacttgtgtcagagttactctggtctgagtcaactttcgctggggaaaacctatggaacctactgcaaaaagattgtccaaaatgcctaagaaaatactcctctgatgcatttagccttcaaccctacctgtcttgctgaagggagaaaaatgttttagtacattataggcccagcagcttttattcatgtccaccagctagttgcacagagaatcatgtgtacctaactaaggatgatctaggataagtaactcctgttttatattgagtattttagggaagtctttaaaagacttgttttatatctataaatctaggttattacaaatacaagaattttgtaccttaaataagcctcatttctatttcttcttcattaattctccatctagtcttgtgaaaaaaaaaaaaaaccctcagagatagtctttgtgaagagcttctgacagaatcactgagtaccttccttcccccagatgaggaagacaagggggtctcagtgtctgtgctgtctcctcttctcttccccaaccaaggactgtgccattactgcccgtctcaactgtccatgcaggaggacagagttgcctggtactcttacccttgtccctctcctaaagggagcacaaggaaactgaagagactgaaaaagaagagagtttgtagctgaaaaagaatagggatagcaaggaaacccagaactgcattcccctaagtggggccatcccatgtgattgaattgtccatagcttgcctatggtgagaaatgtgcatgctccgtgagctggtctcttgaaacaggacttatgcttcctctatattctggttaaattttccaaacacataagttcactgagcacagatttcttatccagagacaagtagaatctaaccgcagactgttggcagagtttccaggcacttagccatgttcccttcctgactcaaatccccaaaggccttcactctcactgagaatcacactactgtcccatagataaggcaggcattgaagcacctgtcgtgatcctctaggggggagaatgaaaggttatttcctgcattgcatcatcatagcttttaatataatgctacagaatcatatccacattaggttagagttcagatatttggatatgaatacctaacctagccatatccatggccatctctgttcttttcagcaatgttttccatattatattagcaatgacagaaacagaacaagccaagatccagtcagttcttgggagcttgtctagagcaccaagtaatgaaatagccaggtagtgggatgactgtacctttaaaaatacataatttagtttgcaagctatattatgctactttctattttccttgttactttatagcaattcattttaccctcacaaagtcaatttagaaccttatcattaactgggatgtgtagtgatatttttgggcctctgggtttcatgtgtcaatacaaggaatatttatttaaaatagatttatttagaggaggcacagtgttgttgatctgtgtgacaccacccatatttttaaaaacctttgtatgtttctctaaatttgttgttgactgaatataatagaccctaccataattcgtcaaatatcactgattagttacatcctttgtgtgagattagctgtaaagtatactgctcttattcttattcagaatagttaattggtagccaaaaatacatgtatcacagatgttaggtcgaatttaaacagcacagtcaagtgctatggaagtttttctgctaaattagtagattaaagaatactataccctaggcatggggagcagcacgttttcctttggtaggtaggatctctatactagtgaacagtgccagttccacactttggacttagaactgttctctagttattgtaacacagaatactgtcaatccctaatttacttaatgttacttattggaagtggggctgatgaaatacgcacaggagggaaatctactgtgtttaggcacaggcagccccagtgtataaggagatcatattccaaaaggttgtcagttggttgtttgcaacctggaatgtattttcctttagagaccaggttatccatggtggttaggcccctagagcagctggaaaagatgatcaaaccaataggttagctgacatcgaataatgtaataggtttgctaaagaatctaaccatcaaatataatattgtttccagggagggtgtttgttcagagttgcctgttagtagaatctggactgtccatcccagccacatcccacctactggacagtaggggtagagatgccaccagactacaggtgaccagattggcctgaaacatggtgtccagtaaaaacggggaggaataagtccatgactgccggagagcttggtggtaggaggagggtgaaggagggtgagggggcctctcatgggtcagaaacctccagggacatccctcagctggtaactctgctgttgtccggagggttcaggcttggtgtgccttcttctgtttgtctgacttttggctcctatggttcatctcctgccctgcccaccacagaaaaggatgctgctgcacagcttctccaatgtaccagtcattgaggccagcgcgcagcacttttaatgtttttagtgctagtaactgtgttttaactctccaggaataagctgggaggttagaaaacaagaaaaaagggggaaaaaaaaacctctccacccactttccttttttacagttacagaccctgttgagaaaaagaagcacccagatgggtgatggtgatagggcttgtggtggacacagggttgtggtaagattcctcagtgcttcggcgagcacctaagactattaccctggaactgactgctttctagagcttgattcatgcctctaagccagtggttctcaaagtgtggcccctagaccagtagcatcagcatcatcggggacctcattagaatgcagattctcagccccctcccagacatggtgaagtcagaagctctcagggagggactcagcaaatgattctaaagcgcatcaagtttgagaaccaccctaagccaatgagtctcccttttacttcccattagtcctccctcaccagatgattcctaggactcatggtgcaacatacaggagccaggctttagggaggggaggaaaggagcctggcggcaggggtctctgcaatggcaagaaagtgagtgaatccagcgctgccacctggttatccccttctcgttgaaaatagcagcgcgggtgcaaattcctaaacacaggctgcctgcactcggtgttacctcgggctgaggcatgataatattttattttttaaagctgtgaggaaatgaaagtgaggctttggttggggcgaggcagttgtgaaagaaattaaaataaaagaccctttgtaaatgcagacttagaagaaatactgaatttgtgtcagaagttctccagtgtttgtgttaatcgtgtggtgataatcctgtcctccttttaaagcgaattctctactgaaaggtctgctctgcttaaggagctacaaactgctctcaaaagaatgaaatactgagttccaattcagtgaggcacagtgttggactatggcacatttagttggagtcggggggaggtcaggaatatgatcagataatggattttataccttagagcaaaatctattagtctctctcagtttatcaatttaaatggctttaggcttatagggggtgtaaactttaagaatataattctcccattcaagtttacagcaaacatctagccaccttcaaaacaaagaagatacagaccatcatttagcaatactaatacatgattttccttggggatggcaggtttgagaatcctttagcaacaggacatacttcccctaaattacagtgaattatttataacgagataaagctttcaggtacaagctgaaggtggggtgtctaacaactaaaaactatcactaaatctcaaagagaaagttcttgcaaaatatgtaaagttcacaaggtgcagacattttccttctttaggcttttatctaaggaagggctatgaaactgggcccatctgtatacaggctcaaatttacgtttttaaaggaagaatctatgcagctgaggcttattgcaggaaatacttcatttgtatgtaaatattattgtaaataaataggaggctgtatatttttgaagttgttgatccgcactgaaatagaagtctctaggatctgcatataaacaataaatgtttcctagaaattagtggtttgtttgggaattagaaaaatttacattctctcccaggtaacatagttctctcaatgtaaacttggaacctgaaaccctacttaatttagagaaagaaatgtctgagaaatagttcccttgatttcttatgctggcattaagatcaattatttaacagatagtcctctgagatacaagtaaggaatatttagacacaaatccttgtcctatagaaacagatatacccaaatgacaaattgtttcttcataatgatcttccatttttaacactgataccactacacagtacatatgaaaacagaagctggggagaagaatgtttttttcacaattgaattgctgcatttctcaaactttgggatctatgaaagcggggagagggaacctgaatattaattatgagcacaaatttgaaggaaagaaaacaaagaaccattatctaatcaagctttgaaagtcctgcatgtttgccttttattttagtgttgacgccaacatagactgtctaaggtatttttttccccaaacacttgaatcttggtcgttggtatgtaatccactctctagagtccagtgtactttagacttcatctgagtccaatacatgtaccacactactgttttattaatgtaaaaaccttgtaaatgaatttcagatgggtgatttaagtgagtcacaagtcacaaaactttgctattcatagttaatcaaatagaactgggttttttttttcagagtgtggtgtaaataaagaaatataagaagttctgttctataactgctctgttaacatagtttttaaacattaaaaaatgtgaactaaaagta

SEQ ID NO: 448219 - DNA, 526 bp, Homo sapiens
  misc_feature (3)..(3): n is a, c, g, or t
ggngatctcttgagacttcacttcagcttcactgacttctggattctcctcttgagtaaaaggactcagccaactatgaagttttttgtttttgctttaatcttggctctcatgctttccatgactggagctgattcacatgcaaagagacatcatgggtataaaagaaaattccatgaaaagcatcattcacatcgaggctatagatcaaattatctgtatgacaattgatatcttcagtaatcatggggcatgattatggaggtttgactggcaaattcgctttggactcgtgtattctcatttgtcataccgcatcacactaccactgctttttgaagaattatcataaggcaatgcagaataaaagaaataccatgatttagtgaattctgtgtttcaggatacttcccttcctaattatcatttgattagatacttgcaatttaaatgttaagctgttttcactgctgtttctgagtaatagaaattcattcctctccaaaagcaataaaattcaagcaca

SEQ ID NO: 448220 - DNA, 488 bp, Homo sapiens
aggacgcctaccaggaggacctgggactcagccaactatgaagttttttgtttttgctttaatcttggctctcatgctttccatgactggagctgattcacatgcaaagagacatcatgggtataaaagaaaattccatgaaaagcatcattcacatcgaggctatagatcaaattatctgtatgacaattgatatcttcagtaatcatggggcatgattatggaggtttgactggcaaattcgctttggactcgtgtattctcatttgtcataccgcatcacactaccactgctttttgaagaattatcataaggcaatgcagaataaaagaaataccatgatttagtgaattctgtgtttcaggatacttcccttcctaattatcatttgattagatacttgcaatttaaatgttaagctgttttcactgctgtttctgagtaatagaaattcattcctctccaaaagcaataaaattcaagcaca

SEQ ID NO: 448221 - DNA, 495 bp, Homo sapiens
tcgtgccgaattcggcacgagctgacttctggattctcctcttgagtaaaaggactcagccaactatgaagttttttgtttttgctttaatcttggctctcatgctttccatgactagacatcatgggtataaaagaaaattccatgaaaagcatcattcacatcgaggctatagatcaaattatctgtatgacaattgatatcttcagtaatcatggggcatgattatggaggtttgactggcaaattcgctttggactcgtgtattctcatttgtcataccgcatcacactaccactgctttttgaagaattatcataaggcaatgcagaataaaagaaataccatgatttagtgaattctgtgtttcaggatacttcccttcctaattatcatttgattagatacttgcaatttaaatgttaagctgttttcactgctgtttctgagtaatagaaattcattcctctccaaaagcaataaaattcaagcaca

SEQ ID NO: 448222 - DNA, 1119 bp, Homo sapiens
  misc_feature (3)..(3): n is a, c, g, or t
ggngatctcttgagacttcacttcagcttcactgacttctggattctcctcttgagtaaaaggactcagccaactatgaagttttttgtttttgctttaatcttggctctcatgctttccatgactggagctgattcacatgcaaagagacatcatgggtataaaagaaaattccatgaaaagcatcattcacatcgaggctatagatcaaattatctgtatgacaattgatatcttcagtaatcatggggcatgattatggaggtttgactggcaaattcgctttggactcgtgtattctcatttgtcataccgcatcacactaccactgctttttgaagaattatcataaggcaatgcagaataaaagaaataccatgatttagtgaattctgtgtttcaggatacttcccttcctaattatcatttgattagatacttgcaatttaaatgttaagctgttttcactgctgtttctgagtaatagaaattcattcctctccaaaagcaataaaattcaagcacaccaaaaacacaatcaccgataacgatcgagacgaacacctttttggcgcgcgcttgggcccctgaaaaagctcctccaaaaacaccgcgagggagcccggcgcacccaagagtgaaggagaacggggcctaaacaaggcccagagaaaacccggaccgaaaaaagtgcggagaatcccccaagtaaaaacacagggagtcccacagggtcggcaacatcacgaaggcggatccggcgaccccacggggctcaccaaccgggggccacgagaacgcggaataaaaccagccgcaccggcgtgcgggaaacacgcgactagcgacccaacagacagccacgccgagcacaccacgcacagccacacagcccgcacaagaaagcagcgcagcagaacgcaccagaacgacctcacgccacccaagacaaaccgctgcaagcaaggacagcaccacgcatgagctagcacgaatcaacaccagccagacagaacgccacgacgacacgaggcgcatccaagtccacaatagcaacaaactcatcaccatagcaagcaacgcacagctagacaacgtacaaatcaggacaagagacaa

SEQ ID NO: 448223 - DNA, 1739 bp, Homo sapiens
attcgtgaacttcccggggggcggcgggagcttccgggagggcggctcgcaggcaccatgactcctgtgaggatgcagcactccctggcaggtcagacctatgccgtgcccctcatccagccagacctgcggcgagaggaggccgtccagcagatggcggatgccctgcagtacctgcagaaggtctctggagacatcttcagcaggtagagcagagccggagccaggtgcaggccattggagagaaggtctccttggcccaggccaagattgagaagatcaagggcagcaagaaggccatcaaggtgttctccagtgccaagtaccctgctccagggcgcctgcaggaatatggctccatcttcacgggcgcccaggaccctggcctgcagagacgcccccgccacaggatccagagcaagcaccgccccctggacgagcgggccctgcaggagaagctgaaggactttcctgtgtgcgtgagcaccaagccggagcccgaggacgatgcagaagagggacttgggggtcttcccagcaacatcagctctgtcagctccttgctgctcttcaacaccaccgagaacctgtagaagaagtatgtcttcctggaccccctggctggtgctgtaacaaagacccatgtgatgctgggggcagagacagaggagaagctgtttgatgcccccttgtccatcagcaagagagagcagctggaacagcaggtcccagagaactacttctatgtgccagacctgggccaggtgcctgagattgatgttccatcctacctgcctgacctgcccggcattgccaacgacctcatgtacattgccgacctgggccccggcattgccccctctgcccctggcaccattccagaactgcccaccttccacactgaggtagccgagcctctcaaggcagacctacaagatggggtactaacaccacccccaccgcccccaccaccacccccagctcctgaggtgctggccagtgcacccccactcccaccctcaaccgcggcccctgtaggccaaggcgccaggcaggacgacagcagcagcagcgcgtctccttcagtccagggagctcccagggaagtggttgacccctccggtggctgggccactctgctagagtccatccgccaagctgggggcatcggcaaggccaagctgcgcagcatgaaggagcgaaagctggagaagaagaagcagaaggagcaggagcaagtgagagccacgagccaaggtgggcacttgatgtcggatctcttcaacaagctggtcatgaggcgcaagggcatctctgggaaaggacctggggctggtgaggggcccggaggagcctttgcccgcgtgtcagactccatccctcctctgccgccaccgcagcagccacaggcagaggaggacgaggacgactgggaatcctagggggctccatgacaccttcccccccagacccagacttgggccgttgctctgacatggacacagccaggacaagctgctcagacctacttccttgggagggggtgacggaaccagcactgtgtggagaccagcttcaaggagcggaaggctggcttgaggccacacagctggggcggggacttctgtctgcctgtgctccatggggggacggctccacccagcctgcgccactgtgttcttctcttaagaggcttccagagaaaacggcacaccaatcaataaagaactgagcagaaa

SEQ ID NO: 448224 - DNA, 4829 bp, Homo sapiens
  misc_feature (812)..(812): n is a, c, g, or t
  misc_feature (969)..(969): n is a, c, g, or t
  misc_feature (1063)..(1063): n is a, c, g, or t
  misc_feature (1234)..(1234): n is a, c, g, or t
  misc_feature (1873)..(1873): n is a, c, g, or t
  misc_feature (2231)..(2231): n is a, c, g, or t
  misc_feature (2786)..(2786): n is a, c, g, or t
  misc_feature (4316)..(4316): n is a, c, g, or t
attcgtgaacttcccggggggcggcgggagcttccgggagggcggctcgcaggcaccatgactcctgtgaggatgcagcactccctggcaggtcagacctatgccgtgcccctcatccagccagacctgcggcgagaggaggccgtccagcagatggcggatgccctgcagtacctgcagaaggtctctggagacatcttcagcaggtgggtgctgccactcacccccacctgatgagagggccatccctgtcctgggcaatcccagcaacacaccctctgggagcagcccccttggggaatcccggtcctggggaacccatctggcttccctgtgtgggaggggctgaagtgagagcccaacttggaagcttttactcctgggagtccgagagctcactcccttccaccccacttagcctcctggtttcctgtggtggctctgctctcacaactcatgcttttcctcccattggagggcctattccttcacgttttcctgcagccaacaaatatttacccagcagtgctcgtgtgcaaggcagtgtgggaatctctatatatccagccacggataaggcaacatacctctccacctggagcgcacattctggcaggagagaaagacctaaataagcaatagatgattagttcttcaataacagttgtgacaaggtctattgataatattttgtaatcactaatattcatataaaccgtgcacaaccattgatttgagtgcattaactcacacttcatgagcaggcactgccgtcatctcattttatagatgaggaaactgaggcacagaanggctgagagacctggcctagtgacagagccaggattcaaagccatagatcatggccccgggttatgtaggttattactgcatctgttcaggggagatggggtactgtgaggctcgtcatgggaagcctggcttggtctcaggtcagggaaggcagangtgaggaaatgacatttatggtaaagtctgagggttgagtgggtaggttgggaagaacattccagaaagaagcacatgaactacagcctggagntggaggacctaaaaggaagccagcatggctggagcacggagtggccattgagggaggcgagctggagggctgcagcttcttgtattggcagtgctgacctcgcacagtccttgggctccagtgacttcactcagtgtttatctaacatgagtgagtgaatggtgtttgctntttttttggtaaaggtcccaggggttgtcgggtacacaggtcctgtctttggccataagcaaactgaaatgaggcttggtctccttcccaggatcccacaccatgcctcacatggtagaccccagtgggaagtatgtgactgcctgactcaggtgcctctcgtggtccaagccatccctgccctgtcccttccctggttgtcgccagacctggagcccctgctccttcactttgcagcctcctcttctgtcaccaactgggaacccacctcttcctgaaagtcctcccccactgactcaccggcttgccccgagtttgtcaagaatgtcccagtaaccaggggacacacagtgaagtgactgaggggttaccttggagttgatgccttggctcagatccagctcccctgttttcttcctctgtaaccttgggcaacccaacccctctaagcctcggtgttctcatttgtgaagttgtggtaataatggtagcttcctggtagaattattttaaatattaaattaatcaaaacatgcaaaggaatggaacagtgcctggcacctaggaagccttcaggaaatgctatctcttccctgttgataatcttgacccgtacactgcctttggttgccattcatnaacctgccaccaatagtaacaaagtgctggatgcaccttttgtgcttatctttgtgctaaatgtgcccgagggacacctagggaagaggatgcaggtctttaagagccatcagctccagattatggccaccccatgtccagcacttagaatggaggccaaaaccattccctcggaaattgtgtttccttgccaagatggggactgcgtggttgcccttctctgagggcagcgctggatttttggcgtctttcctttcctgtcctggtacttggcaccttgtagacagttgcatgtcccctgcccagggatgggatgaggagagggcaggaaggcatttcctgggtagtggagtgctgngttcattgagtgtgggttctccaagctgctggcacagcgcagggagggccagatgcctctcaggagccttgggcctgagtcctggctccctcactcctgggttccaggtcactgcatctgtctctccaccatgtgctccacctcgtgctggaccttaagagataccaattatgtggctgccactgtgtcctagaggctggaatgggaacacatagggcgagattgattgttaattgctagcatgaaccgcgtgggcttctcagggtctagagtggagagaaatcggtaagaattggtggcacgcctgtcagaactccccagaccaagctaagcaaaaattaaccaatcagtagagcagccttcggagtaagggctaaaatgatgtcctcagggcctggttttgctttccttccatgtcagtttgcttctttgggtctggctgcattcccagacaggccatgctctcgtggtagcaaggtgacatgacacagggtcaggtccagcaggaaagaatgctgtcctgtgtccccacttcctccagaagccacactcacncatcccacctggcttggtcctcatgtctatcccagaatccattaatggggccaggggactatgacacaccacttggcttagactgaggagctctgtgggcagccccacctgaagctctgggactaagcctgcgagagagatggattccccaagggaaatggggccattgcttgagtaaaaaggaaatagttgctgaagaggaaaaccacgtgcttactccacatagggcagactcctggaagaggggggcagggtagggaggtggatatgcaggttgccctggcagggtctggaaatgggggctgcaggcttggagggaggcctcagtgtggcttggaacgtggtgtatggtggtctgccgcgaaggccggcctgcacaggggtgggaggggggtgcttctgcatgggaagcacagacagcgctgcctctcccttgcactcagctctcggggcatgagaggctgactttccgtgagcctgtgggccaggcctctttgaatggggctgagggagctttgccctggttcctttgtgtccccacggtgccacgggaggctccctggcagggtgtggggcaaggcagtgagtgaagagttgggatgagtgagttagggcccacggattactcaagacaggacttcaagttgattcaggcgtgttagggagctgtgattggattttgagcagggcagggatgggacagaagagtttggggaaggttcctcaggcatccgtcacggaagggacaagaagggagagagagtggatgccagggacacccagaagctgttattgtagtcaggatacgacaggggtgaggctacagacaggggacttgcaagcagggagggcagggtgagacattcagaggaaacgacgacaggaaatggtgacagatagggaacgaggatgaagggaagggagagccagtgacgactggcagtggagtggggagcaccgccacctctcctcctccacttgcccctcctgtggcactggacaagctagtgggcttttcgttgtccatgggctttttcggtggggatgtgaccagctttgaacccgtccccttaaacatgctcctcctgcacggaagagacaggggcaggggagagactctctccccaccacccagctcaggccccagcacagcccggcctctggcctcactggcgtctgtgcccagtgacgcaggcaggtgagctcctggcaaattagcattgcaggctgtgctctctcctcctgctctgctgcagctgggagtgtgcagagactggaggggatgacagtcaccctctgttttctgtggtggctctgttttctgtggtgctggatgcacctctgttttctgtggtggctccaagagagtgcacggtccctgctgattgaaagaaggatgaagggcagaagaggggcggggagctgtgtgccctaagatctcattgcctttttatgccgattaacatgcttttagcccctactgagcttatagttaacagaagtttccaggtctttcttcacctgaactgngtctaaagcaagttccctccaccttctgtatttatacgcttgatttttaaaacctaaatgttgggcttcacatttgttccttgtaaatttcatcttggtgattgcagtctaccctctggcctttaaaaattgtctgagccttgattcgatcatgaaaccagcttacccttcccctgtgtgctggccccagttttctaaccaggtgttgaatgaactggatggactctgccagatccctccgtgcaaggctggaatcagtccattgttcaactgtgccctttggggctgtggttcatttggctctgatttttcctatatgttctctcctccaacccccatagctccatcttgtctacaagattttgttagaagccgtcaaaatcctgctgactcgagatgcatctgcctgtgctccatggggggacggctccacccagcctgcgccactgtgttcttctcttaagaggcttccagagaaaacggcacaccaatcaataaagaactgagcagaaa

SEQ ID NO: 448225 - DNA, 2229 bp, Homo sapiens
  misc_feature (1226)..(1226): n is a, c, g, or t
ggacgcgtgggtcggagcttccggtgagggcggctcggtagagcagagccggagccaggtgcaggccattggagagaaggtctccttggcccaggccaagattgagaagatcaagggcagcaagaaggccatcaaggtgttctccagtgccaagtaccctgctccagggcgcctgcaggaatatggctccatcttcacgggcgcccaggaccctggcctgcagagacgcccccgccacaggatccagagcaagcaccgccccctggacgagcgggccctgcaggagaagctgaaggactttcctgtgtgcgtgagcaccaagccggagcccgaggacgatgcagaagagggacttgggggtcttcccagcaacatcagctctgtcagctccttgctgctcttcaacaccaccgagaacctgtagaagaagtatgtcttcctggaccccctggctggtgctgtaacaaagacccatgtgatgctgggggcagagacagaggagaagctgtttgatgcccccttgtccatcagcaagagagagcagctggaacagcaggtcccagagaactacttctatgtgccagacctgggccaggtgcctgagattgatgttccatcctacctgcctgacctgcccggcattgccaacgacctcatgtacattgccgacctgggccccggcattgccccctctgcccctggcaccattccagaactgcccaccttccacactgaggtagccgagcctctcaaggcagacctacaagatggggtactaacaccacccccaccgcccccaccaccacccccagctcctgaggtgctggccagtgcacccccactcccaccctcaaccgcggcccctgtaggccaaggcgccaggcaggacgacagcagcagcagcgcgtctccttcaggtgggagcagctctttgaggccacctgatttctggcgtgctcagtgcactcgggtggattttctgtgggtttgttaagtggtcagaaattctcaattttttgaatagtttccatttcaaatatcttgttctacttggttcataaaatagtggttttcaaactgtagagctctggacttctcacttctagggcagagggagcctgaacaagtgaggctctgggttccccattcctaattaaaccaatggaaagaaggggtctaataacaaactacagcaacacatttttcatttcagcttcactgctgtntctcccagtgtaaccctagcatccagaagtggcacaaaacccctctgctggctcgtgtgtgcaactgagactgtcagagcatggctagctcaggggtccagctctgcagggtgggggctagagaggaagcagggagtatctgcacacaggatgcccgcgctcaggtggttgcagaagtcagtgcccaggcccccacacacagtctccaaaggtccggcctccccagcgcagggctcctcgtttgaggggaggtgacttccctcccagcaggctcttggacacagtaagcttccccagccctgcctgagcagcctttcctccttgccctgttccccacctcccggctccagtccagggagctcccagggaagtggttgacccctccggtggctgggccactctgctagagtccatccgccaagctgggggcatcggcaaggccaagctgcgcagcatgaaggagcgaaagctggagaagaagaagcagaaggagcaggagcaagtgagagccacgagccaaggtgggcacttgatgtcggatctcttcaacaagctggtcatgaggcgcaagggcatctctgggaaaggacctggggctggtgaggggcccggaggagcctttgcccgcgtgtcagactccatccctcctctgccgccaccgcagcagccacaggcagaggaggacgaggacgactgggaatcctagggggctccatgacaccttcccccccagacccagacttgggccgttgctctgacatggacacagccaggacaagctgctcagacctacttccttgggagggggtgacggaaccagcactgtgtggagaccagcttcaaggagcggaaggctggcttgaggccacacagctggggcggggacttctgtctgcctgtgctccatggggggacggctccacccagcctgcgccactgtgttcttctcttaagaggcttccagagaaaacggcacaccaatcaataaagaactgagcagaaa

SEQ ID NO: 448226 - DNA, 2569 bp, Homo sapiens
  misc_feature (1566)..(1566): n is a, c, g, or t
attcgtgaacttcccggggggcggcgggagcttccgggagggcggctcgcaggcaccatgactcctgtgaggatgcagcactccctggcaggtcagacctatgccgtgcccctcatccagccagacctgcggcgagaggaggccgtccagcagatggcggatgccctgcagtacctgcagaaggtctctggagacatcttcagcaggtagagcagagccggagccaggtgcaggccattggagagaaggtctccttggcccaggccaagattgagaagatcaagggcagcaagaaggccatcaaggtgttctccagtgccaagtaccctgctccagggcgcctgcaggaatatggctccatcttcacgggcgcccaggaccctggcctgcagagacgcccccgccacaggatccagagcaagcaccgccccctggacgagcgggccctgcaggtctgctggccgcgcatatagcctgtcacacaccaggaggactggatactggggaggagccggggccaccatagggttctgtcccccagaggaggctgactgggatgggatggcagctgattaggcccagcaccaaatattcaccatcccttggccatcctggccctctcagagaagctgaaggactttcctgtgtgcgtgagcaccaagccggagcccgaggacgatgcagaagagggacttgggggtcttcccagcaacatcagctctgtcagctccttgctgctcttcaacaccaccgagaacctgtagaagaagtatgtcttcctggaccccctggctggtgctgtaacaaagacccatgtgatgctgggggcagagacagaggagaagctgtttgatgcccccttgtccatcagcaagagagagcagctggaacagcaggtcccagagaactacttctatgtgccagacctgggccaggtgcctgagattgatgttccatcctacctgcctgacctgcccggcattgccaacgacctcatgtacattgccgacctgggccccggcattgccccctctgcccctggcaccattccagaactgcccaccttccacactgaggtagccgagcctctcaaggcagacctacaagatggggtactaacaccacccccaccgcccccaccaccacccccagctcctgaggtgctggccagtgcacccccactcccaccctcaaccgcggcccctgtaggccaaggcgccaggcaggacgacagcagcagcagcgcgtctccttcaggtgggagcagctctttgaggccacctgatttctggcgtgctcagtgcactcgggtggattttctgtgggtttgttaagtggtcagaaattctcaattttttgaatagtttccatttcaaatatcttgttctacttggttcataaaatagtggttttcaaactgtagagctctggacttctcacttctagggcagagggagcctgaacaagtgaggctctgggttccccattcctaattaaaccaatggaaagaaggggtctaataacaaactacagcaacacatttttcatttcagcttcactgctgtntctcccagtgtaaccctagcatccagaagtggcacaaaacccctctgctggctcgtgtgtgcaactgagactgtcagagcatggctagctcaggggtccagctctgcagggtgggggctagagaggaagcagggagtatctgcacacaggatgcccgcgctcaggtggttgcagaagtcagtgcccaggcccccacacacagtctccaaaggtccggcctccccagcgcagggctcctcgtttgaggggaggtgacttccctcccagcaggctcttggacacagtaagcttccccagccctgcctgagcagcctttcctccttgccctgttccccacctcccggctccagtccagggagctcccagggaagtggttgacccctccggtggctgggccactctgctagagtccatccgccaagctgggggcatcggcaaggccaagctgcgcagcatgaaggagcgaaagctggagaagaagaagcagaaggagcaggagcaagtgagagccacgagccaaggtgggcacttgatgtcggatctcttcaacaagctggtcatgaggcgcaagggcatctctgggaaaggacctggggctggtgaggggcccggaggagcctttgcccgcgtgtcagactccatccctcctctgccgccaccgcagcagccacaggcagaggaggacgaggacgactgggaatcctagggggctccatgacaccttcccccccagacccagacttgggccgttgctctgacatggacacagccaggacaagctgctcagacctacttccttgggagggggtgacggaaccagcactgtgtggagaccagcttcaaggagcggaaggctggcttgaggccacacagctggggcggggacttctgtctgcctgtgctccatggggggacggctccacccagcctgcgccactgtgttcttctcttaagaggcttccagagaaaacggcacaccaatcaataaagaactgagcagaaa

SEQ ID NO: 448227 - DNA, 2808 bp, Homo sapiens
  misc_feature (1805)..(1805): n is a, c, g, or t
attcgtgaacttcccggggggcggcgggagcttccgggagggcggctcgcaggcaccatgactcctgtgaggatgcagcactccctggcaggtcagacctatgccgtgcccctcatccagccagacctgcggcgagaggaggccgtccagcagatggcggatgccctgcagtacctgcagaaggtctctggagacatcttcagcaggtagagcagagccggagccaggtgcaggccattggagagaaggtctccttggcccaggccaagattgagaagatcaagggcagcaagaaggccatcaaggtgttctccagtgccaagtaccctgctccagggcgcctgcaggaatatggctccatcttcacgggcgcccaggaccctggcctgcagagacgcccccgccacaggatccagagcaagcaccgccccctggacgagcgggccctgcaggtctgctggccgcgcatatagcctgtcacacaccaggaggactggatactggggaggagccggggccaccatagggttctgtcccccagaggaggctgactgggatgggatggcagctgattaggcccagcaccaaatattcaccatcccttggccatcctggccctctcagagaagctgaaggactttcctgtgtgcgtgagcaccaagccggagcccgaggacgatgcagaagagggacttgggggtcttcccagcaacatcagctctgtcagctccttgctgctcttcaacaccaccgagaacctgtatggccagagggcagggccgaggggtgtgggcgggaggcccggcctggcttagtggggacccagggcatcagacacaggtacagcacataggccaggagccagggggtgactggggtggctcggctcgggaggcctgggaccccacagtgcacgctgtgcccctgatgatgtgggagaggaacatgggctcaggacagcgggtgtcagcttgcctgacccccatgtcgcctctgtaggtagaagaagtatgtcttcctggaccccctggctggtgctgtaacaaagacccatgtgatgctgggggcagagacagaggagaagctgtttgatgcccccttgtccatcagcaagagagagcagctggaacagcaggtcccagagaactacttctatgtgccagacctgggccaggtgcctgagattgatgttccatcctacctgcctgacctgcccggcattgccaacgacctcatgtacattgccgacctgggccccggcattgccccctctgcccctggcaccattccagaactgcccaccttccacactgaggtagccgagcctctcaaggcagacctacaagatggggtactaacaccacccccaccgcccccaccaccacccccagctcctgaggtgctggccagtgcacccccactcccaccctcaaccgcggcccctgtaggccaaggcgccaggcaggacgacagcagcagcagcgcgtctccttcaggtgggagcagctctttgaggccacctgatttctggcgtgctcagtgcactcgggtggattttctgtgggtttgttaagtggtcagaaattctcaattttttgaatagtttccatttcaaatatcttgttctacttggttcataaaatagtggttttcaaactgtagagctctggacttctcacttctagggcagagggagcctgaacaagtgaggctctgggttccccattcctaattaaaccaatggaaagaaggggtctaataacaaactacagcaacacatttttcatttcagcttcactgctgtntctcccagtgtaaccctagcatccagaagtggcacaaaacccctctgctggctcgtgtgtgcaactgagactgtcagagcatggctagctcaggggtccagctctgcagggtgggggctagagaggaagcagggagtatctgcacacaggatgcccgcgctcaggtggttgcagaagtcagtgcccaggcccccacacacagtctccaaaggtccggcctccccagcgcagggctcctcgtttgaggggaggtgacttccctcccagcaggctcttggacacagtaagcttccccagccctgcctgagcagcctttcctccttgccctgttccccacctcccggctccagtccagggagctcccagggaagtggttgacccctccggtggctgggccactctgctagagtccatccgccaagctgggggcatcggcaaggccaagctgcgcagcatgaaggagcgaaagctggagaagaagaagcagaaggagcaggagcaagtgagagccacgagccaaggtgggcacttgatgtcggatctcttcaacaagctggtcatgaggcgcaagggcatctctgggaaaggacctggggctggtgaggggcccggaggagcctttgcccgcgtgtcagactccatccctcctctgccgccaccgcagcagccacaggcagaggaggacgaggacgactgggaatcctagggggctccatgacaccttcccccccagacccagacttgggccgttgctctgacatggacacagccaggacaagctgctcagacctacttccttgggagggggtgacggaaccagcactgtgtggagaccagcttcaaggagcggaaggctggcttgaggccacacagctggggcggggacttctgtctgcctgtgctccatggggggacggctccacccagcctgcgccactgtgttcttctcttaagaggcttccagagaaaacggcacaccaatcaataaagaactgagcagaaa

SEQ ID NO: 448228 - DNA, 2985 bp, Homo sapiens
  misc_feature (1982)..(1982): n is a, c, g, or t
attcgtgaacttcccggggggcggcgggagcttccgggagggcggctcgcaggcaccatgactcctgtgaggatgcagcactccctggcaggtcagacctatgccgtgcccctcatccagccagacctgcggcgagaggaggccgtccagcagatggcggatgccctgcagtacctgcagaaggtctctggagacatcttcagcaggtagagcagagccggagccaggtgcaggccattggagagaaggtctccttggcccaggccaagattgagaagatcaagggcagcaagaaggccatcaaggtgttctccagtgccaagtaccctgctccagggcgcctgcaggaatatggctccatcttcacgggcgcccaggaccctggcctgcagagacgcccccgccacaggatccagagcaagcaccgccccctggacgagcgggccctgcaggtctgctggccgcgcatatagcctgtcacacaccaggaggactggatactggggaggagccggggccaccatagggttctgtcccccagaggaggctgactgggatgggatggcagctgattaggcccagcaccaaatattcaccatcccttggccatcctggccctctcagagaagctgaaggactttcctgtgtgcgtgagcaccaagccggagcccgaggacgatgcagaagagggacttgggggtcttcccagcaacatcagctctgtcagctccttgctgctcttcaacaccaccgagaacctgtatggccagagggcagggccgaggggtgtgggcgggaggcccggcctggcttagtggggacccagggcatcagacacaggtacagcacataggccaggagccagggggtgactggggtggctcggctcgggaggcctgggaccccacagtgcacgctgtgcccctgatgatgtgggagaggaacatgggctcaggacagcgggtgtcagcttgcctgacccccatgtcgcctctgtaggtagaagaagtatgtcttcctggaccccctggctggtgctgtaacaaagacccatgtgatgctgggggcagagacagaggagaagctgtttgatgcccccttgtccatcagcaagagagagcagctggaacagcaggtgggaggggtgggacagaggtggagacaggtgcagtggcccagggccttgccagagctcctctccagtcaaggctgttgggccccttattccacccatgggaggtgcacacaaggtcttgttggctgcccctgcaggtccctgtcacctctcacatgtccctgcctaatcttgcaggtcccagagaactacttctatgtgccagacctgggccaggtgcctgagattgatgttccatcctacctgcctgacctgcccggcattgccaacgacctcatgtacattgccgacctgggccccggcattgccccctctgcccctggcaccattccagaactgcccaccttccacactgaggtagccgagcctctcaaggcagacctacaagatggggtactaacaccacccccaccgcccccaccaccacccccagctcctgaggtgctggccagtgcacccccactcccaccctcaaccgcggcccctgtaggccaaggcgccaggcaggacgacagcagcagcagcgcgtctccttcaggtgggagcagctctttgaggccacctgatttctggcgtgctcagtgcactcgggtggattttctgtgggtttgttaagtggtcagaaattctcaattttttgaatagtttccatttcaaatatcttgttctacttggttcataaaatagtggttttcaaactgtagagctctggacttctcacttctagggcagagggagcctgaacaagtgaggctctgggttccccattcctaattaaaccaatggaaagaaggggtctaataacaaactacagcaacacatttttcatttcagcttcactgctgtntctcccagtgtaaccctagcatccagaagtggcacaaaacccctctgctggctcgtgtgtgcaactgagactgtcagagcatggctagctcaggggtccagctctgcagggtgggggctagagaggaagcagggagtatctgcacacaggatgcccgcgctcaggtggttgcagaagtcagtgcccaggcccccacacacagtctccaaaggtccggcctccccagcgcagggctcctcgtttgaggggaggtgacttccctcccagcaggctcttggacacagtaagcttccccagccctgcctgagcagcctttcctccttgccctgttccccacctcccggctccagtccagggagctcccagggaagtggttgacccctccggtggctgggccactctgctagagtccatccgccaagctgggggcatcggcaaggccaagctgcgcagcatgaaggagcgaaagctggagaagaagaagcagaaggagcaggagcaagtgagagccacgagccaaggtgggcacttgatgtcggatctcttcaacaagctggtcatgaggcgcaagggcatctctgggaaaggacctggggctggtgaggggcccggaggagcctttgcccgcgtgtcagactccatccctcctctgccgccaccgcagcagccacaggcagaggaggacgaggacgactgggaatcctagggggctccatgacaccttcccccccagacccagacttgggccgttgctctgacatggacacagccaggacaagctgctcagacctacttccttgggagggggtgacggaaccagcactgtgtggagaccagcttcaaggagcggaaggctggcttgaggccacacagctggggcggggacttctgtctgcctgtgctccatggggggacggctccacccagcctgcgccactgtgttcttctcttaagaggcttccagagaaaacggcacaccaatcaataaagaactgagcagaaa

SEQ ID NO: 448229 - DNA, 2987 bp, Homo sapiens
  misc_feature (1226)..(1226): n is a, c, g, or t
ggacgcgtgggtcggagcttccggtgagggcggctcggtagagcagagccggagccaggtgcaggccattggagagaaggtctccttggcccaggccaagattgagaagatcaagggcagcaagaaggccatcaaggtgttctccagtgccaagtaccctgctccagggcgcctgcaggaatatggctccatcttcacgggcgcccaggaccctggcctgcagagacgcccccgccacaggatccagagcaagcaccgccccctggacgagcgggccctgcaggagaagctgaaggactttcctgtgtgcgtgagcaccaagccggagcccgaggacgatgcagaagagggacttgggggtcttcccagcaacatcagctctgtcagctccttgctgctcttcaacaccaccgagaacctgtagaagaagtatgtcttcctggaccccctggctggtgctgtaacaaagacccatgtgatgctgggggcagagacagaggagaagctgtttgatgcccccttgtccatcagcaagagagagcagctggaacagcaggtcccagagaactacttctatgtgccagacctgggccaggtgcctgagattgatgttccatcctacctgcctgacctgcccggcattgccaacgacctcatgtacattgccgacctgggccccggcattgccccctctgcccctggcaccattccagaactgcccaccttccacactgaggtagccgagcctctcaaggcagacctacaagatggggtactaacaccacccccaccgcccccaccaccacccccagctcctgaggtgctggccagtgcacccccactcccaccctcaaccgcggcccctgtaggccaaggcgccaggcaggacgacagcagcagcagcgcgtctccttcaggtgggagcagctctttgaggccacctgatttctggcgtgctcagtgcactcgggtggattttctgtgggtttgttaagtggtcagaaattctcaattttttgaatagtttccatttcaaatatcttgttctacttggttcataaaatagtggttttcaaactgtagagctctggacttctcacttctagggcagagggagcctgaacaagtgaggctctgggttccccattcctaattaaaccaatggaaagaaggggtctaataacaaactacagcaacacatttttcatttcagcttcactgctgtntctcccagtgtaaccctagcatccagaagtggcacaaaacccctctgctggctcgtgtgtgcaactgagactgtcagagcatggctagctcaggggtccagctctgcagggtgggggctagagaggaagcagggagtatctgcacacaggatgcccgcgctcaggtggttgcagaagtcagtgcccaggcccccacacacagtctccaaaggtccggcctccccagcgcagggctcctcgtttgaggggaggtgacttccctcccagcaggctcttggacacagtaagcttccccagccctgcctgagcagcctttcctccttgccctgttccccacctcccggctccagtccagggagctcccagggaagtggttgacccctccggtggctgggccactctgctagagtccatccgccaagctgggggcatcggcaaggccaagctgcgcagcatgaaggagcgaaagctggagaagaagaagcagaaggagcaggagcaaggtgagcgggccctggagcttgcagtcggagggccttgggcaagatcgcctcctcccctccagccctgagtccaccgggtgctttctgcccaccccctgctcttgccagctggcccctgcttcccctagggcacatgctggaagccctgggccgccaccagaggtcctcagccctcctgcctgggctatggctccttcctggtttgggagccatagtggagctttcctctctaagctcacccagctcaaactgacaggagaatcttcttcgactgccaagagcggtccaaggcaatggtcagccactgcagcctcctgagatatttttagagactggacctgaggcctccggaggctactgatgatgcctgctgtgaacgcagacactggtgtgatgcgatgcctgcgcctgcagcggcagtgccctgggcactatggttttgagcttgtacccagcgctgcttttgccttgctctgtgaccccaggcaagctgcctcacctctctgggccagtttccccatagtacagtggtgctgcacaccctggccctggccccgaggtggctgggaggtggctcctcaaacagccgctgtctcatcagtgcccggtgctgggtcagggatcgactgaggctctgagctaactgggaaacacagtggccttggagggctggggagtgtcatgggggtggggacagggagtcaccggtcgcatgtgactgaactcttcaccccagtctgtggctttcccgttgcagttgagagccacgagccaaggtgggcacttgatgtcggatctcttcaacaagctggtcatgaggcgcaagggcatctctgggaaaggacctggggctggtgaggggcccggaggagcctttgcccgcgtgtcagactccatccctcctctgccgccaccgcagcagccacaggcagaggaggacgaggacgactgggaatcctagggggctccatgacaccttcccccccagacccagacttgggccgttgctctgacatggacacagccaggacaagctgctcagacctacttccttgggagggggtgacggaaccagcactgtgtggagaccagcttcaaggagcggaaggctggcttgaggccacacagctggggcggggacttctgtctgcctgtgctccatggggggacggctccacccagcctgcgccactgtgttcttctcttaagaggcttccagagaaaacggcacaccaatcaataaagaactgagcagaaa

SEQ ID NO: 448230 - DNA, 2328 bp, Homo sapiens
ggacgcgtgggtcggagcttccggtgagggcggctcggtagagcagagccggagccaggtgcaggccattggagagaaggtctccttggcccaggccaagattgagaagatcaagggcagcaagaaggccatcaaggtgttctccagtgccaagtaccctgctccagggcgcctgcaggaatatggctccatcttcacgggcgcccaggaccctggcctgcagagacgcccccgccacaggatccagagcaagcaccgccccctggacgagcgggccctgcaggagaagctgaaggactttcctgtgtgcgtgagcaccaagccggagcccgaggacgatgcagaagagggacttgggggtcttcccagcaacatcagctctgtcagctccttgctgctcttcaacaccaccgagaacctgtagaagaagtatgtcttcctggaccccctggctggtgctgtaacaaagacccatgtgatgctgggggcagagacagaggagaagctgtttgatgcccccttgtccatcagcaagagagagcagctggaacagcaggtcccagagaactacttctatgtgccagacctgggccaggtgcctgagattgatgttccatcctacctgcctgacctgcccggcattgccaacgacctcatgtacattgccgacctgggccccggcattgccccctctgcccctggcaccattccagaactgcccaccttccacactgaggtagccgagcctctcaaggcagacctacaagatggggtactaacaccacccccaccgcccccaccaccacccccagctcctgaggtgctggccagtgcacccccactcccaccctcaaccgcggcccctgtaggccaaggcgccaggcaggacgacagcagcagcagcgcgtctccttcagtccagggagctcccagggaagtggttgacccctccggtggctgggccactctgctagagtccatccgccaagctgggggcatcggcaaggccaagctgcgcagcatgaaggagcgaaagctggagaagaagaagcagaaggagcaggagcaaggtgagcgggccctggagcttgcagtcggagggccttgggcaagatcgcctcctcccctccagccctgagtccaccgggtgctttctgcccaccccctgctcttgccagctggcccctgcttcccctagggcacatgctggaagccctgggccgccaccagaggtcctcagccctcctgcctgggctatggctccttcctggtttgggagccatagtggagctttcctctctaagctcacccagctcaaactgacaggagaatcttcttcgactgccaagagcggtccaaggcaatggtcagccactgcagcctcctgagatatttttagagactggacctgaggcctccggaggctactgatgatgcctgctgtgaacgcagacactggtgtgatgcgatgcctgcgcctgcagcggcagtgccctgggcactatggttttgagcttgtacccagcgctgcttttgccttgctctgtgaccccaggcaagctgcctcacctctctgggccagtttccccatagtacagtggtgctgcacaccctggccctggccccgaggtggctgggaggtggctcctcaaacagccgctgtctcatcagtgcccggtgctgggtcagggatcgactgaggctctgagctaactgggaaacacagtggccttggagggctggggagtgtcatgggggtggggacagggagtcaccggtcgcatgtgactgaactcttcaccccagtctgtggctttcccgttgcagttgagagccacgagccaaggtgggcacttgatgtcggatctcttcaacaagctggtcatgaggcgcaagggcatctctgggaaaggacctggggctggtgaggggcccggaggagcctttgcccgcgtgtcagactccatccctcctctgccgccaccgcagcagccacaggcagaggaggacgaggacgactgggaatcctagggggctccatgacaccttcccccccagacccagacttgggccgttgctctgacatggacacagccaggacaagctgctcagacctacttccttgggagggggtgacggaaccagcactgtgtggagaccagcttcaaggagcggaaggctggcttgaggccacacagctggggcggggacttctgtctgcctgtgctccatggggggacggctccacccagcctgcgccactgtgttcttctcttaagaggcttccagagaaaacggcacaccaatcaataaagaactgagcagaaa

SEQ ID NO: 448231 - DNA, 1417 bp, Homo sapiens
ggacgcgtgggtcggagcttccggtgagggcggctcggtagagcagagccggagccaggtgcaggccattggagagaaggtctccttggcccaggccaagattgagaagatcaagggcagcaagaaggccatcaaggtgttctccagtgccaagtaccctgctccagggcgcctgcaggaatatggctccatcttcacgggcgcccaggaccctggcctgcagagacgcccccgccacaggatccagagcaagcaccgccccctggacgagcgggccctgcaggagaagctgaaggactttcctgtgtgcgtgagcaccaagccggagcccgaggacgatgcagaagagggacttgggggtcttcccagcaacatcagctctgtcagctccttgctgctcttcaacaccaccgagaacctgtagaagaagtatgtcttcctggaccccctggctggtgctgtaacaaagacccatgtgatgctgggggcagagacagaggagaagctgtttgatgcccccttgtccatcagcaagagagagcagctggaacagcaggtcccagagaactacttctatgtgccagacctgggccaggtgcctgagattgatgttccatcctacctgcctgacctgcccggcattgccaacgacctcatgtacattgccgacctgggccccggcattgccccctctgcccctggcaccattccagaactgcccaccttccacactgaggtagccgagcctctcaaggcagacctacaagatggggtactaacaccacccccaccgcccccaccaccacccccagctcctgaggtgctggccagtgcacccccactcccaccctcaaccgcggcccctgtaggccaaggcgccaggcaggacgacagcagcagcagcgcgtctccttcagtgagagccacgagccaaggtgggcacttgatgtcggatctcttcaacaagctggtcatgaggcgcaagggcatctctgggaaaggacctggggctggtgaggggcccggaggagcctttgcccgcgtgtcagactccatccctcctctgccgccaccgcagcagccacaggcagaggaggacgaggacgactgggaatcctagggggctccatgacaccttcccccccagacccagacttgggccgttgctctgacatggacacagccaggacaagctgctcagacctacttccttgggagggggtgacggaaccagcactgtgtggagaccagcttcaaggagcggaaggctggcttgaggccacacagctggggcggggacttctgtctgcctgtgctccatggggggacggctccacccagcctgcgccactgtgttcttctcttaagaggcttccagagaaaacggcacaccaatcaataaagaactgagcagaaa

SEQ ID NO: 448232 - DNA, 3127 bp, Homo sapiens
  misc_feature (1226)..(1226): n is a, c, g, or t
ggacgcgtgggtcggagcttccggtgagggcggctcggtagagcagagccggagccaggtgcaggccattggagagaaggtctccttggcccaggccaagattgagaagatcaagggcagcaagaaggccatcaaggtgttctccagtgccaagtaccctgctccagggcgcctgcaggaatatggctccatcttcacgggcgcccaggaccctggcctgcagagacgcccccgccacaggatccagagcaagcaccgccccctggacgagcgggccctgcaggagaagctgaaggactttcctgtgtgcgtgagcaccaagccggagcccgaggacgatgcagaagagggacttgggggtcttcccagcaacatcagctctgtcagctccttgctgctcttcaacaccaccgagaacctgtagaagaagtatgtcttcctggaccccctggctggtgctgtaacaaagacccatgtgatgctgggggcagagacagaggagaagctgtttgatgcccccttgtccatcagcaagagagagcagctggaacagcaggtcccagagaactacttctatgtgccagacctgggccaggtgcctgagattgatgttccatcctacctgcctgacctgcccggcattgccaacgacctcatgtacattgccgacctgggccccggcattgccccctctgcccctggcaccattccagaactgcccaccttccacactgaggtagccgagcctctcaaggcagacctacaagatggggtactaacaccacccccaccgcccccaccaccacccccagctcctgaggtgctggccagtgcacccccactcccaccctcaaccgcggcccctgtaggccaaggcgccaggcaggacgacagcagcagcagcgcgtctccttcaggtgggagcagctctttgaggccacctgatttctggcgtgctcagtgcactcgggtggattttctgtgggtttgttaagtggtcagaaattctcaattttttgaatagtttccatttcaaatatcttgttctacttggttcataaaatagtggttttcaaactgtagagctctggacttctcacttctagggcagagggagcctgaacaagtgaggctctgggttccccattcctaattaaaccaatggaaagaaggggtctaataacaaactacagcaacacatttttcatttcagcttcactgctgtntctcccagtgtaaccctagcatccagaagtggcacaaaacccctctgctggctcgtgtgtgcaactgagactgtcagagcatggctagctcaggggtccagctctgcagggtgggggctagagaggaagcagggagtatctgcacacaggatgcccgcgctcaggtggttgcagaagtcagtgcccaggcccccacacacagtctccaaaggtccggcctccccagcgcagggctcctcgtttgaggggaggtgacttccctcccagcaggctcttggacacagtaagcttccccagccctgcctgagcagcctttcctccttgccctgttccccacctcccggctccagtccagggagctcccagggaagtggttgacccctccggtggctgggccactctgctagagtccatccgccaagctgggggcatcggcaaggccaagctgcgcagcatgaaggagcgaaagctggagaagaagaagcagaaggagcaggagcaaggtgagcgggccctggagcttgcagtcggagggccttgggcaagatcgcctcctcccctccagccctgagtccaccgggtgctttctgcccaccccctgctcttgccagctggcccctgcttcccctagggcacatgctggaagccctgggccgccaccagaggtcctcagccctcctgcctgggctatggctccttcctggtttgggagccatagtggagctttcctctctaagctcacccagctcaaactgacaggagaatcttcttcgactgccaagagcggtccaaggcaatggtcagccactgcagcctcctgagatatttttagagactggacctgaggcctccggaggctactgatgatgcctgctgtgaacgcagacactggtgtgatgcgatgcctgcgcctgcagcggcagtgccctgggcactatggttttgagcttgtacccagcgctgcttttgccttgctctgtgaccccaggcaagctgcctcacctctctgggccagtttccccatagtacagtggtgctgcacaccctggccctggccccgaggtggctgggaggtggctcctcaaacagccgctgtctcatcagtgcccggtgctgggtcagggatcgactgaggctctgagctaactgggaaacacagtggccttggagggctggggagtgtcatgggggtggggacagggagtcaccggtcgcatgtgactgaactcttcaccccagtctgtggctttcccgttgcagttgagagccacgagccaaggtgggcacttgatgtcggatctcttcaacaagctggtcatgaggcgcaagggtaggaggcagggccgctgcccgccctgggccagcaccttgtaattctgtcctgcctttttcttcctgtatttaagtctccgggggctgggggaaccagggtttcccaccaaccaccctcactcagccttttccctccaggcatctctgggaaaggacctggggctggtgaggggcccggaggagcctttgcccgcgtgtcagactccatccctcctctgccgccaccgcagcagccacaggcagaggaggacgaggacgactgggaatcctagggggctccatgacaccttcccccccagacccagacttgggccgttgctctgacatggacacagccaggacaagctgctcagacctacttccttgggagggggtgacggaaccagcactgtgtggagaccagcttcaaggagcggaaggctggcttgaggccacacagctggggcggggacttctgtctgcctgtgctccatggggggacggctccacccagcctgcgccactgtgttcttctcttaagaggcttccagagaaaacggcacaccaatcaataaagaactgagcagaaa

SEQ ID NO: 448233 - DNA, 1501 bp, Homo sapiens
ggacgcgtgggtcggagcttccggtgagggcggctcggtagagcagagccggagccaggtgcaggccattggagagaaggtctccttggcccaggccaagattgagaagatcaagggcagcaagaaggccatcaaggtgttctccagtgccaagtaccctgctccagggcgcctgcaggaatatggctccatcttcacgggcgcccaggaccctggcctgcagagacgcccccgccacaggatccagagcaagcaccgccccctggacgagcgggccctgcaggagaagctgaaggactttcctgtgtgcgtgagcaccaagccggagcccgaggacgatgcagaagagggacttgggggtcttcccagcaacatcagctctgtcagctccttgctgctcttcaacaccaccgagaacctgtagaagaagtatgtcttcctggaccccctggctggtgctgtaacaaagacccatgtgatgctgggggcagagacagaggagaagctgtttgatgcccccttgtccatcagcaagagagagcagctggaacagcaggtcccagagaactacttctatgtgccagacctgggccaggtgcctgagattgatgttccatcctacctgcctgacctgcccggcattgccaacgacctcatgtacattgccgacctgggccccggcattgccccctctgcccctggcaccattccagaactgcccaccttccacactgaggtagccgagcctctcaaggcagacctacaagatggggtactaacaccacccccaccgcccccaccaccacccccagctcctgaggtgctggccagtgcacccccactcccaccctcaaccgcggcccctgtaggccaaggcgccaggcaggacgacagcagcagcagcgcgtctccttcagtccagggagctcccagggaagtggttgacccctccggtggctgggccactctgctagagtccatccgccaagctgggggcatcggcaaggccaagctgcgcagcatgaaggagcgaaagctggagaagaagaagcagaaggagcaggagcaaggcatctctgggaaaggacctggggctggtgaggggcccggaggagcctttgcccgcgtgtcagactccatccctcctctgccgccaccgcagcagccacaggcagaggaggacgaggacgactgggaatcctagggggctccatgacaccttcccccccagacccagacttgggccgttgctctgacatggacacagccaggacaagctgctcagacctacttccttgggagggggtgacggaaccagcactgtgtggagaccagcttcaaggagcggaaggctggcttgaggccacacagctggggcggggacttctgtctgcctgtgctccatggggggacggctccacccagcctgcgccactgtgttcttctcttaagaggcttccagagaaaacggcacaccaatcaataaagaactgagcagaaa

SEQ ID NO: 448234 - DNA, 2099 bp, Homo sapiens
  misc_feature (1226)..(1226): n is a, c, g, or t
ggacgcgtgggtcggagcttccggtgagggcggctcggtagagcagagccggagccaggtgcaggccattggagagaaggtctccttggcccaggccaagattgagaagatcaagggcagcaagaaggccatcaaggtgttctccagtgccaagtaccctgctccagggcgcctgcaggaatatggctccatcttcacgggcgcccaggaccctggcctgcagagacgcccccgccacaggatccagagcaagcaccgccccctggacgagcgggccctgcaggagaagctgaaggactttcctgtgtgcgtgagcaccaagccggagcccgaggacgatgcagaagagggacttgggggtcttcccagcaacatcagctctgtcagctccttgctgctcttcaacaccaccgagaacctgtagaagaagtatgtcttcctggaccccctggctggtgctgtaacaaagacccatgtgatgctgggggcagagacagaggagaagctgtttgatgcccccttgtccatcagcaagagagagcagctggaacagcaggtcccagagaactacttctatgtgccagacctgggccaggtgcctgagattgatgttccatcctacctgcctgacctgcccggcattgccaacgacctcatgtacattgccgacctgggccccggcattgccccctctgcccctggcaccattccagaactgcccaccttccacactgaggtagccgagcctctcaaggcagacctacaagatggggtactaacaccacccccaccgcccccaccaccacccccagctcctgaggtgctggccagtgcacccccactcccaccctcaaccgcggcccctgtaggccaaggcgccaggcaggacgacagcagcagcagcgcgtctccttcaggtgggagcagctctttgaggccacctgatttctggcgtgctcagtgcactcgggtggattttctgtgggtttgttaagtggtcagaaattctcaattttttgaatagtttccatttcaaatatcttgttctacttggttcataaaatagtggttttcaaactgtagagctctggacttctcacttctagggcagagggagcctgaacaagtgaggctctgggttccccattcctaattaaaccaatggaaagaaggggtctaataacaaactacagcaacacatttttcatttcagcttcactgctgtntctcccagtgtaaccctagcatccagaagtggcacaaaacccctctgctggctcgtgtgtgcaactgagactgtcagagcatggctagctcaggggtccagctctgcagggtgggggctagagaggaagcagggagtatctgcacacaggatgcccgcgctcaggtggttgcagaagtcagtgcccaggcccccacacacagtctccaaaggtccggcctccccagcgcagggctcctcgtttgaggggaggtgacttccctcccagcaggctcttggacacagtaagcttccccagccctgcctgagcagcctttcctccttgccctgttccccacctcccggctccagtccagggagctcccagggaagtggttgacccctccggtggctgggccactctgctagagtccatccgccaagctgggggcatcggcaaggccaagctgcgcagcatgaaggagcgaaagctggagaagaagaagcagaaggagcaggagcaagtgagagccacgagccaaggtgggcacttgatgtcggatctcttcaacaagctggtcatgaggcgcaagggcatctctgggaaaggacctggggctggtgaggggcccggaggagcctttgcccgcgtgtcagactccatccctcctctgccgccaccgcagcagccacaggcagaggaggacgaggacgactgggaatcctagggggctccatgacaccttcccccccagacccagacttgggccgttgctctgacatggacacagccaggacaagctgctcagacctacttccttgggagggggtgacggaaccagcactgtgtggagaccagcttcaaggagcgtgagcaattatgtgtacgagctta

SEQ ID NO: 448235 - DNA, 2836 bp, Homo sapiens
  misc_feature (1226)..(1226): n is a, c, g, or t
ggacgcgtgggtcggagcttccggtgagggcggctcggtagagcagagccggagccaggtgcaggccattggagagaaggtctccttggcccaggccaagattgagaagatcaagggcagcaagaaggccatcaaggtgttctccagtgccaagtaccctgctccagggcgcctgcaggaatatggctccatcttcacgggcgcccaggaccctggcctgcagagacgcccccgccacaggatccagagcaagcaccgccccctggacgagcgggccctgcaggagaagctgaaggactttcctgtgtgcgtgagcaccaagccggagcccgaggacgatgcagaagagggacttgggggtcttcccagcaacatcagctctgtcagctccttgctgctcttcaacaccaccgagaacctgtagaagaagtatgtcttcctggaccccctggctggtgctgtaacaaagacccatgtgatgctgggggcagagacagaggagaagctgtttgatgcccccttgtccatcagcaagagagagcagctggaacagcaggtcccagagaactacttctatgtgccagacctgggccaggtgcctgagattgatgttccatcctacctgcctgacctgcccggcattgccaacgacctcatgtacattgccgacctgggccccggcattgccccctctgcccctggcaccattccagaactgcccaccttccacactgaggtagccgagcctctcaaggcagacctacaagatggggtactaacaccacccccaccgcccccaccaccacccccagctcctgaggtgctggccagtgcacccccactcccaccctcaaccgcggcccctgtaggccaaggcgccaggcaggacgacagcagcagcagcgcgtctccttcaggtgggagcagctctttgaggccacctgatttctggcgtgctcagtgcactcgggtggattttctgtgggtttgttaagtggtcagaaattctcaattttttgaatagtttccatttcaaatatcttgttctacttggttcataaaatagtggttttcaaactgtagagctctggacttctcacttctagggcagagggagcctgaacaagtgaggctctgggttccccattcctaattaaaccaatggaaagaaggggtctaataacaaactacagcaacacatttttcatttcagcttcactgctgtntctcccagtgtaaccctagcatccagaagtggcacaaaacccctctgctggctcgtgtgtgcaactgagactgtcagagcatggctagctcaggggtccagctctgcagggtgggggctagagaggaagcagggagtatctgcacacaggatgcccgcgctcaggtggttgcagaagtcagtgcccaggcccccacacacagtctccaaaggtccggcctccccagcgcagggctcctcgtttgaggggaggtgacttccctcccagcaggctcttggacacagtaagcttccccagccctgcctgagcagcctttcctccttgccctgttccccacctcccggctccagtccagggagctcccagggaagtggttgacccctccggtggctgggccactctgctagagtccatccgccaagctgggggcatcggcaaggccaagctgcgcagcatgaaggagcgaaagctggagaagaagaagcagaaggagcaggagcaaggtgagcgggccctggagcttgcagtcggagggccttgggcaagatcgcctcctcccctccagccctgagtccaccgggtgctttctgcccaccccctgctcttgccagctggcccctgcttcccctagggcacatgctggaagccctgggccgccaccagaggtcctcagccctcctgcctgggctatggctccttcctggtttgggagccatagtggagctttcctctctaagctcacccagctcaaactgacaggagaatcttcttcgactgccaagagcggtccaaggcaatggtcagccactgcagcctcctgagatatttttagagactggacctgaggcctccggaggctactgatgatgcctgctgtgaacgcagacactggtgtgatgcgatgcctgcgcctgcagcggcagtgccctgggcactatggttttgagcttgtacccagcgctgcttttgccttgctctgtgaccccaggcaagctgcctcacctctctgggccagtttccccatagtacagtggtgctgcacaccctggccctggccccgaggtggctgggaggtggctcctcaaacagccgctgtctcatcagtgcccggtgctgggtcagggatcgactgaggctctgagctaactgggaaacacagtggccttggagggctggggagtgtcatgggggtggggacagggagtcaccggtcgcatgtgactgaactcttcaccccagtctgtggctttcccgttgcagttgagagccacgagccaaggtgggcacttgatgtcggatctcttcaacaagctggtcatgaggcgcaagggcatctctgggaaaggacctggggctggtgaggggcccggaggagcctttgcccgcgtgtcagactccatccctcctctgccgccaccgcagcagccacaggcagaggaggacgaggacgactgggaatcctagggggctccatgacaccttcccccccagacccagatctgcctgtgctccatggggggacggctccacccagcctgcgccactgtgttcttctcttaagaggcttccagagaaaacggcacaccaatcaataaagaactgagcagaaa

SEQ ID NO: 448236 - DNA, 3561 bp, Homo sapiens
  misc_feature (812)..(812): n is a, c, g, or t
  misc_feature (969)..(969): n is a, c, g, or t
  misc_feature (1063)..(1063): n is a, c, g, or t
  misc_feature (1234)..(1234): n is a, c, g, or t
  misc_feature (1873)..(1873): n is a, c, g, or t
  misc_feature (2231)..(2231): n is a, c, g, or t
  misc_feature (2786)..(2786): n is a, c, g, or t
attcgtgaacttcccggggggcggcgggagcttccgggagggcggctcgcaggcaccatgactcctgtgaggatgcagcactccctggcaggtcagacctatgccgtgcccctcatccagccagacctgcggcgagaggaggccgtccagcagatggcggatgccctgcagtacctgcagaaggtctctggagacatcttcagcaggtgggtgctgccactcacccccacctgatgagagggccatccctgtcctgggcaatcccagcaacacaccctctgggagcagcccccttggggaatcccggtcctggggaacccatctggcttccctgtgtgggaggggctgaagtgagagcccaacttggaagcttttactcctgggagtccgagagctcactcccttccaccccacttagcctcctggtttcctgtggtggctctgctctcacaactcatgcttttcctcccattggagggcctattccttcacgttttcctgcagccaacaaatatttacccagcagtgctcgtgtgcaaggcagtgtgggaatctctatatatccagccacggataaggcaacatacctctccacctggagcgcacattctggcaggagagaaagacctaaataagcaatagatgattagttcttcaataacagttgtgacaaggtctattgataatattttgtaatcactaatattcatataaaccgtgcacaaccattgatttgagtgcattaactcacacttcatgagcaggcactgccgtcatctcattttatagatgaggaaactgaggcacagaanggctgagagacctggcctagtgacagagccaggattcaaagccatagatcatggccccgggttatgtaggttattactgcatctgttcaggggagatggggtactgtgaggctcgtcatgggaagcctggcttggtctcaggtcagggaaggcagangtgaggaaatgacatttatggtaaagtctgagggttgagtgggtaggttgggaagaacattccagaaagaagcacatgaactacagcctggagntggaggacctaaaaggaagccagcatggctggagcacggagtggccattgagggaggcgagctggagggctgcagcttcttgtattggcagtgctgacctcgcacagtccttgggctccagtgacttcactcagtgtttatctaacatgagtgagtgaatggtgtttgctntttttttggtaaaggtcccaggggttgtcgggtacacaggtcctgtctttggccataagcaaactgaaatgaggcttggtctccttcccaggatcccacaccatgcctcacatggtagaccccagtgggaagtatgtgactgcctgactcaggtgcctctcgtggtccaagccatccctgccctgtcccttccctggttgtcgccagacctggagcccctgctccttcactttgcagcctcctcttctgtcaccaactgggaacccacctcttcctgaaagtcctcccccactgactcaccggcttgccccgagtttgtcaagaatgtcccagtaaccaggggacacacagtgaagtgactgaggggttaccttggagttgatgccttggctcagatccagctcccctgttttcttcctctgtaaccttgggcaacccaacccctctaagcctcggtgttctcatttgtgaagttgtggtaataatggtagcttcctggtagaattattttaaatattaaattaatcaaaacatgcaaaggaatggaacagtgcctggcacctaggaagccttcaggaaatgctatctcttccctgttgataatcttgacccgtacactgcctttggttgccattcatnaacctgccaccaatagtaacaaagtgctggatgcaccttttgtgcttatctttgtgctaaatgtgcccgagggacacctagggaagaggatgcaggtctttaagagccatcagctccagattatggccaccccatgtccagcacttagaatggaggccaaaaccattccctcggaaattgtgtttccttgccaagatggggactgcgtggttgcccttctctgagggcagcgctggatttttggcgtctttcctttcctgtcctggtacttggcaccttgtagacagttgcatgtcccctgcccagggatgggatgaggagagggcaggaaggcatttcctgggtagtggagtgctgngttcattgagtgtgggttctccaagctgctggcacagcgcagggagggccagatgcctctcaggagccttgggcctgagtcctggctccctcactcctgggttccaggtcactgcatctgtctctccaccatgtgctccacctcgtgctggaccttaagagataccaattatgtggctgccactgtgtcctagaggctggaatgggaacacatagggcgagattgattgttaattgctagcatgaaccgcgtgggcttctcagggtctagagtggagagaaatcggtaagaattggtggcacgcctgtcagaactccccagaccaagctaagcaaaaattaaccaatcagtagagcagccttcggagtaagggctaaaatgatgtcctcagggcctggttttgctttccttccatgtcagtttgcttctttgggtctggctgcattcccagacaggccatgctctcgtggtagcaaggtgacatgacacagggtcaggtccagcaggaaagaatgctgtcctgtgtccccacttcctccagaagccacactcacncatcccacctggcttggtcctcatgtctatcccagaatccattaatggggccaggggactatgacacaccacttggcttagactgaggagctctgtgggcagccccacctgaagctctgggactaagcctgcgagagagatggattccccaagggaaatggggccattgcttgagtaaaaaggaaatagttgctgaagaggaaaaccacgtgcttactccacatagggcagactcctggaagaggggggcagggtagggaggtggatatgcaggttgccctggcagggtctggaaatgggggctgcaggcttggagggaggcctcagtgtggcttggaacgtggtgtatggtggtctgccgcgaaggccggcctgcacaggggtgggaggggggtgcttctgcatgggaagcacagacagcgctgcctctcccttgcactcagctctcggggcatgagaggctgactttccgtgagcctgtgggccaggcctctttgaatggggctgagggagctttgccctggttcctttgtgtccccacggtgccacgggaggctccctggcagggtgtggggcaaggcagtgagtgaagagttgggatgagtgagttagggcccacggattactcaagacaggacttcaagttgattcaggcgtgttagggagctgtgattggattttgagcagggcagggatgggacagaagagtttggggaaggttcctcaggcatccgtcacggaagggacaagtatcccctctgcaatagtcgccagg

SEQ ID NO: 448237 - DNA, 1356 bp, Homo sapiens
attcgtgaacttcccggggggcggcgggagcttccgggagggcggctcgcaggcaccatgactcctgtgaggatgcagcactccctggcaggtcagacctatgccgtgcccctcatccagccagacctgcggcgagaggaggccgtccagcagatggcggatgccctgcagtacctgcagaaggtctctggagacatcttcagcaggtagagcagagccggagccaggtgcaggccattggagagaaggtctccttggcccaggccaagattgagaagatcaagggcagcaagaaggccatcaaggtgttctccagtgccaagtaccctgctccagggcgcctgcaggaatatggctccatcttcacgggcgcccaggaccctggcctgcagagacgcccccgccacaggatccagagcaagcaccgccccctggacgagcgggccctgcaggtctgctggccgcgcatatagcctgtcacacaccaggaggactggatactggggaggagccggggccaccatagggttctgtcccccagaggaggctgactgggatgggatggcagctgattaggcccagcaccaaatattcaccatcccttggccatcctggccctctcagagaagctgaaggactttcctgtgtgcgtgagcaccaagccggagcccgaggacgatgcagaagagggacttgggggtcttcccagcaacatcagctctgtcagctccttgctgctcttcaacaccaccgagaacctgtatggccagagggcagggccgaggggtgtgggcgggaggcccggcctggcttagtggggacccagggcatcagacacaggtagaagaagtatgtcttcctggaccccctggctggtgctgtaacaaagacccatgtgatgctgggggcagagacagaggagaagctgtttgatgcccccttgtccatcagcaagagagagcagctggaacagcaggtcccagagaactacttctatgtgccagacctgggccaggtgcctgagattgatgttccatcctacctgcctgacctgcccggcattgccaacgacctcatgtacattgccgacctgggccccggcattgccccctctgcccctggcaccattccagaactgcccaccttccacactgaggtagccgagcctctcaaggccttacaagatggggggtacttaaacaggccaacccgggacgcgccaaagagacgcgcgacggcaacacgcgccagcgacgccacggggcgcaccgcacacaaccggccgccacaggacggcccgccgggacaccggcagccaccagaccgtccacaccacacccgcccaccaagcatccc

SEQ ID NO: 448238 - DNA, 4247 bp, Homo sapiens
  misc_feature (572)..(572): n is a, c, g, or t
  misc_feature (2346)..(2346): n is a, c, g, or t
cgtgatcatgaggggttgtgaagtgcttgccccatcagtagccatgtgtgcatgtgtaaataccatcctctgtgtgccctggaggctgtccttcagatagcatgtacaggtggcagcatagggcctgtccctactgagagtgcagggaactcagcaccgtcaactcctcgaccctgcaggtcagattatccttgtagaggccccctggatggcaccaagatcggccctggcaagtaggtgaccctgacttcagagcccttgcctgagggcctggcctggcagctctgctgttagaagcaggaggtgtgcagagggtggggagcagcccagcctctgtgatcttctccatggcaggatctcccagcgtagagcagagccggagccaggtgcaggccattggagagaaggtctccttggcccaggccaagattgagaagatcaagggcagcaagaaggccatcaaggtagtccccatacccctgtgtcctgaggctactgggcagtccctccatttccccgtgcctctgaggctgcccagtctctgccctgctgcccacctgtaccttgagctntcttctcgcccaggcttccaactccaccctctcctgccaagcaatcctagccctctgagcctcttggggccccctcagacttgtccctgtgtccacagtgttctccagtgccaagtaccctgctccagggcgcctgcaggaatatggctccatcttcacgggcgcccaggaccctggcctgcagagacgcccccgccacaggatccagagcaagcaccgccccctggacgagcgggccctgcaggtctgctggccgcgcatatagcctgtcacacaccaggaggactggatactggggaggagccggggccaccatagggttctgtcccccagaggaggctgactgggatgggatggcagctgattaggcccagcaccaaatattcaccatcccttggccatcctggccctctcagagaagctgaaggactttcctgtgtgcgtgagcaccaagccggagcccgaggacgatgcagaagagggacttgggggtcttcccagcaacatcagctctgtcagctccttgctgctcttcaacaccaccgagaacctgtatggccagagggcagggccgaggggtgtgggcgggaggcccggcctggcttagtggggacccagggcatcagacacaggtacagcacataggccaggagccagggggtgactggggtggctcggctcgggaggcctgggaccccacagtgcacgctgtgcccctgatgatgtgggagaggaacatgggctcaggacagcgggtgtcagcttgcctgacccccatgtcgcctctgtaggtagaagaagtatgtcttcctggaccccctggctggtgctgtaacaaagacccatgtgatgctgggggcagagacagaggagaagctgtttgatgcccccttgtccatcagcaagagagagcagctggaacagcaggtgggaggggtgggacagaggtggagacaggtgcagtggcccagggccttgccagagctcctctccagtcaaggctgttgggccccttattccacccatgggaggtgcacacaaggtcttgttggctgcccctgcaggtccctgtcacctctcacatgtccctgcctaatcttgcaggtcccagagaactacttctatgtgccagacctgggccaggtgcctgagattgatgttccatcctacctgcctgacctgcccggcattgccaacgacctcatgtacattgccgacctgggccccggcattgccccctctgcccctggcaccattccagaactgcccaccttccacactgaggtagccgagcctctcaaggcagacctacaagatggggtactaacaccacccccaccgcccccaccaccacccccagctcctgaggtgctggccagtgcacccccactcccaccctcaaccgcggcccctgtaggccaaggcgccaggcaggacgacagcagcagcagcgcgtctccttcaggtgggagcagctctttgaggccacctgatttctggcgtgctcagtgcactcgggtggattttctgtgggtttgttaagtggtcagaaattctcaattttttgaatagtttccatttcaaatatcttgttctacttggttcataaaatagtggttttcaaactgtagagctctggacttctcacttctagggcagagggagcctgaacaagtgaggctctgggttccccattcctaattaaaccaatggaaagaaggggtctaataacaaactacagcaacacatttttcatttcagcttcactgctgtntctcccagtgtaaccctagcatccagaagtggcacaaaacccctctgctggctcgtgtgtgcaactgagactgtcagagcatggctagctcaggggtccagctctgcagggtgggggctagagaggaagcagggagtatctgcacacaggatgcccgcgctcaggtggttgcagaagtcagtgcccaggcccccacacacagtctccaaaggtccggcctccccagcgcagggctcctcgtttgaggggaggtgacttccctcccagcaggctcttggacacagtaagcttccccagccctgcctgagcagcctttcctccttgccctgttccccacctcccggctccagtccagggagctcccagggaagtggttgacccctccggtggctgggccactctgctagagtccatccgccaagctgggggcatcggcaaggccaagctgcgcagcatgaaggagcgaaagctggagaagaagaagcagaaggagcaggagcaaggtgagcgggccctggagcttgcagtcggagggccttgggcaagatcgcctcctcccctccagccctgagtccaccgggtgctttctgcccaccccctgctcttgccagctggcccctgcttcccctagggcacatgctggaagccctgggccgccaccagaggtcctcagccctcctgcctgggctatggctccttcctggtttgggagccatagtggagctttcctctctaagctcacccagctcaaactgacaggagaatcttcttcgactgccaagagcggtccaaggcaatggtcagccactgcagcctcctgagatatttttagagactggacctgaggcctccggaggctactgatgatgcctgctgtgaacgcagacactggtgtgatgcgatgcctgcgcctgcagcggcagtgccctgggcactatggttttgagcttgtacccagcgctgcttttgccttgctctgtgaccccaggcaagctgcctcacctctctgggccagtttccccatagtacagtggtgctgcacaccctggccctggccccgaggtggctgggaggtggctcctcaaacagccgctgtctcatcagtgcccggtgctgggtcagggatcgactgaggctctgagctaactgggaaacacagtggccttggagggctggggagtgtcatgggggtggggacagggagtcaccggtcgcatgtgactgaactcttcaccccagtctgtggctttcccgttgcagttgagagccacgagccaaggtgggcacttgatgtcggatctcttcaacaagctggtcatgaggcgcaagggtaggaggcagggccgctgcccgccctgggccagcaccttgtaattctgtcctgcctttttcttcctgtatttaagtctccgggggctgggggaaccagggtttcccaccaaccaccctcactcagccttttccctccaggcatctctgggaaaggacctggggctggtgaggggcccggaggagcctttgcccgcgtgtcagactccatccctcctctgccgccaccgcagcagccacaggcagaggaggacgaggacgactgggaatcctagggggctccatgacaccttcccccccagacccagacttgggccgttgctctgacatggacacagccaggacaagctgctcagacctacttccttgggagggggtgacggaaccagcactgtgtggagaccagcttcaaggagcggaaggctggcttgaggccacacagctggggcggggacttctgtctgcctgtgctccatggggggacggctccacccagcctgcgccactgtgttcttctcttaagaggcttccagagaaaacggcacaccaatcaataaagaactgagcagaaa

SEQ ID NO: 448239 - DNA, 4943 bp, Homo sapiens
  misc_feature (812)..(812): n is a, c, g, or t
  misc_feature (969)..(969): n is a, c, g, or t
  misc_feature (1063)..(1063): n is a, c, g, or t
  misc_feature (1234)..(1234): n is a, c, g, or t
  misc_feature (1873)..(1873): n is a, c, g, or t
  misc_feature (2231)..(2231): n is a, c, g, or t
  misc_feature (2786)..(2786): n is a, c, g, or t
  misc_feature (4316)..(4316): n is a, c, g, or t
attcgtgaacttcccggggggcggcgggagcttccgggagggcggctcgcaggcaccatgactcctgtgaggatgcagcactccctggcaggtcagacctatgccgtgcccctcatccagccagacctgcggcgagaggaggccgtccagcagatggcggatgccctgcagtacctgcagaaggtctctggagacatcttcagcaggtgggtgctgccactcacccccacctgatgagagggccatccctgtcctgggcaatcccagcaacacaccctctgggagcagcccccttggggaatcccggtcctggggaacccatctggcttccctgtgtgggaggggctgaagtgagagcccaacttggaagcttttactcctgggagtccgagagctcactcccttccaccccacttagcctcctggtttcctgtggtggctctgctctcacaactcatgcttttcctcccattggagggcctattccttcacgttttcctgcagccaacaaatatttacccagcagtgctcgtgtgcaaggcagtgtgggaatctctatatatccagccacggataaggcaacatacctctccacctggagcgcacattctggcaggagagaaagacctaaataagcaatagatgattagttcttcaataacagttgtgacaaggtctattgataatattttgtaatcactaatattcatataaaccgtgcacaaccattgatttgagtgcattaactcacacttcatgagcaggcactgccgtcatctcattttatagatgaggaaactgaggcacagaanggctgagagacctggcctagtgacagagccaggattcaaagccatagatcatggccccgggttatgtaggttattactgcatctgttcaggggagatggggtactgtgaggctcgtcatgggaagcctggcttggtctcaggtcagggaaggcagangtgaggaaatgacatttatggtaaagtctgagggttgagtgggtaggttgggaagaacattccagaaagaagcacatgaactacagcctggagntggaggacctaaaaggaagccagcatggctggagcacggagtggccattgagggaggcgagctggagggctgcagcttcttgtattggcagtgctgacctcgcacagtccttgggctccagtgacttcactcagtgtttatctaacatgagtgagtgaatggtgtttgctntttttttggtaaaggtcccaggggttgtcgggtacacaggtcctgtctttggccataagcaaactgaaatgaggcttggtctccttcccaggatcccacaccatgcctcacatggtagaccccagtgggaagtatgtgactgcctgactcaggtgcctctcgtggtccaagccatccctgccctgtcccttccctggttgtcgccagacctggagcccctgctccttcactttgcagcctcctcttctgtcaccaactgggaacccacctcttcctgaaagtcctcccccactgactcaccggcttgccccgagtttgtcaagaatgtcccagtaaccaggggacacacagtgaagtgactgaggggttaccttggagttgatgccttggctcagatccagctcccctgttttcttcctctgtaaccttgggcaacccaacccctctaagcctcggtgttctcatttgtgaagttgtggtaataatggtagcttcctggtagaattattttaaatattaaattaatcaaaacatgcaaaggaatggaacagtgcctggcacctaggaagccttcaggaaatgctatctcttccctgttgataatcttgacccgtacactgcctttggttgccattcatnaacctgccaccaatagtaacaaagtgctggatgcaccttttgtgcttatctttgtgctaaatgtgcccgagggacacctagggaagaggatgcaggtctttaagagccatcagctccagattatggccaccccatgtccagcacttagaatggaggccaaaaccattccctcggaaattgtgtttccttgccaagatggggactgcgtggttgcccttctctgagggcagcgctggatttttggcgtctttcctttcctgtcctggtacttggcaccttgtagacagttgcatgtcccctgcccagggatgggatgaggagagggcaggaaggcatttcctgggtagtggagtgctgngttcattgagtgtgggttctccaagctgctggcacagcgcagggagggccagatgcctctcaggagccttgggcctgagtcctggctccctcactcctgggttccaggtcactgcatctgtctctccaccatgtgctccacctcgtgctggaccttaagagataccaattatgtggctgccactgtgtcctagaggctggaatgggaacacatagggcgagattgattgttaattgctagcatgaaccgcgtgggcttctcagggtctagagtggagagaaatcggtaagaattggtggcacgcctgtcagaactccccagaccaagctaagcaaaaattaaccaatcagtagagcagccttcggagtaagggctaaaatgatgtcctcagggcctggttttgctttccttccatgtcagtttgcttctttgggtctggctgcattcccagacaggccatgctctcgtggtagcaaggtgacatgacacagggtcaggtccagcaggaaagaatgctgtcctgtgtccccacttcctccagaagccacactcacncatcccacctggcttggtcctcatgtctatcccagaatccattaatggggccaggggactatgacacaccacttggcttagactgaggagctctgtgggcagccccacctgaagctctgggactaagcctgcgagagagatggattccccaagggaaatggggccattgcttgagtaaaaaggaaatagttgctgaagaggaaaaccacgtgcttactccacatagggcagactcctggaagaggggggcagggtagggaggtggatatgcaggttgccctggcagggtctggaaatgggggctgcaggcttggagggaggcctcagtgtggcttggaacgtggtgtatggtggtctgccgcgaaggccggcctgcacaggggtgggaggggggtgcttctgcatgggaagcacagacagcgctgcctctcccttgcactcagctctcggggcatgagaggctgactttccgtgagcctgtgggccaggcctctttgaatggggctgagggagctttgccctggttcctttgtgtccccacggtgccacgggaggctccctggcagggtgtggggcaaggcagtgagtgaagagttgggatgagtgagttagggcccacggattactcaagacaggacttcaagttgattcaggcgtgttagggagctgtgattggattttgagcagggcagggatgggacagaagagtttggggaaggttcctcaggcatccgtcacggaagggacaagaagggagagagagtggatgccagggacacccagaagctgttattgtagtcaggatacgacaggggtgaggctacagacaggggacttgcaagcagggagggcagggtgagacattcagaggaaacgacgacaggaaatggtgacagatagggaacgaggatgaagggaagggagagccagtgacgactggcagtggagtggggagcaccgccacctctcctcctccacttgcccctcctgtggcactggacaagctagtgggcttttcgttgtccatgggctttttcggtggggatgtgaccagctttgaacccgtccccttaaacatgctcctcctgcacggaagagacaggggcaggggagagactctctccccaccacccagctcaggccccagcacagcccggcctctggcctcactggcgtctgtgcccagtgacgcaggcaggtgagctcctggcaaattagcattgcaggctgtgctctctcctcctgctctgctgcagctgggagtgtgcagagactggaggggatgacagtcaccctctgttttctgtggtggctctgttttctgtggtgctggatgcacctctgttttctgtggtggctccaagagagtgcacggtccctgctgattgaaagaaggatgaagggcagaagaggggcggggagctgtgtgccctaagatctcattgcctttttatgccgattaacatgcttttagcccctactgagcttatagttaacagaagtttccaggtctttcttcacctgaactgngtctaaagcaagttccctccaccttctgtatttatacgcttgatttttaaaacctaaatgttgggcttcacatttgttccttgtaaatttcatcttggtgattgcagtctaccctctggcctttaaaaattgtctgagccttgattcgatcatgaaaccagcttacccttcccctgtgtgctggccccagttttctaaccaggtgttgaatgaactggatggactctgccagatccctccgtgcaaggctggaatcagtccattgttcaactgtgccctttggggctgtggttcatttggctctgatttttcctatatgttctctcctccaacccccatagctccatcttgtctacaagattttgttagaagccgtcaaaatcctgctgactcgagatgcactgtgctgcatgttttccccgggcacagcaggctaataatcctgttacaaagagaaatgctgtacatttcgagcagtgctggcccctgggactcaccgcggccttttctaagtgcttacagactctctgtttaataatccattccagaaattttccagggctcattgttgagcttggtgttcgcaactttgagtgatcagcccttctcctttgtgggagcaccagg

SEQ ID NO: 448240 - DNA, 1570 bp, Homo sapiens
ggacgcgtgggtcggagcttccggtgagggcggctcggtagagcagagccggagccaggtgcaggccattggagagaaggtctccttggcccaggccaagattgagaagatcaagggcagcaagaaggccatcaaggtgttctccagtgccaagtaccctgctccagggcgcctgcaggaatatggctccatcttcacgggcgcccaggaccctggcctgcagagacgcccccgccacaggatccagagcaagcaccgccccctggacgagcgggccctgcaggagaagctgaaggactttcctgtgtgcgtgagcaccaagccggagcccgaggacgatgcagaagagggacttgggggtcttcccagcaacatcagctctgtcagctccttgctgctcttcaacaccaccgagaacctgtagaagaagtatgtcttcctggaccccctggctggtgctgtaacaaagacccatgtgatgctgggggcagagacagaggagaagctgtttgatgcccccttgtccatcagcaagagagagcagctggaacagcaggtcccagagaactacttctatgtgccagacctgggccaggtgcctgagattgatgttccatcctacctgcctgacctgcccggcattgccaacgacctcatgtacattgccgacctgggccccggcattgccccctctgcccctggcaccattccagaactgcccaccttccacactgaggtagccgagcctctcaaggcagacctacaagatggggtactaacaccacccccaccgcccccaccaccacccccagctcctgaggtgctggccagtgcacccccactcccaccctcaaccgcggcccctgtaggccaaggcgccaggcaggacgacagcagcagcagcgcgtctccttcagtccagggagctcccagggaagtggttgacccctccggtggctgggccactctgctagagtccatccgccaagctgggggcatcggcaaggccaagctgcgcagcatgaaggagcgaaagctggagaagaagaagcagaaggagcaggagcaagtgagagccacgagccaaggtgggcacttgatgtcggatctcttcaacaagctggtcatgaggcgcaagggcatctctgggaaaggacctggggctggtgaggggcccggaggagcctttgcccgcgtgtcagactccatccctcctctgccgccaccgcagcagccacaggcagaggaggacgaggacgactgggaatcctagggggctccatgacaccttcccccccagacccagacttgggccgttgctctgacatggacacagccaggacaagctgctcagacctacttccttgggagggggtgacggaaccagcactgtgtggagaccagcttcaaggagcggaaggctggcttgaggccacacagctggggcggggacttctgtctgcctgtgctccatggggggacggctccacccagcctgcgccactgtgttcttctcttaagaggcttccagagaaaacggcacaccaatcaataaagaactgagcagaaa

SEQ ID NO: 448241 - DNA, 2842 bp, Homo sapiens
  misc_feature (413)..(413): n is a, c, g, or t
  misc_feature (1839)..(1839): n is a, c, g, or t
attcgtgaacttcccggggggcggcgggagcttccgggagggcggctcgcaggcaccatgactcctgtgaggatgcagcactccctggcaggtcagacctatgccgtgcccctcatccagccagacctgcggcgagaggaggccgtccagcagatggcggatgccctgcagtacctgcagaaggtctctggagacatcttcagcaggtagagcagagccggagccaggtgcaggccattggagagaaggtctccttggcccaggccaagattgagaagatcaagggcagcaagaaggccatcaaggtagtccccatacccctgtgtcctgaggctactgggcagtccctccatttccccgtgcctctgaggctgcccagtctctgccctgctgcccacctgtaccttgagctntcttctcgcccaggcttccaactccaccctctcctgccaagcaatcctagccctctgagcctcttggggccccctcagacttgtccctgtgtccacagtgttctccagtgccaagtaccctgctccagggcgcctgcaggaatatggctccatcttcacgggcgcccaggaccctggcctgcagagacgcccccgccacaggatccagagcaagcaccgccccctggacgagcgggccctgcaggagaagctgaaggactttcctgtgtgcgtgagcaccaagccggagcccgaggacgatgcagaagagggacttgggggtcttcccagcaacatcagctctgtcagctccttgctgctcttcaacaccaccgagaacctgtatggccagagggcagggccgaggggtgtgggcgggaggcccggcctggcttagtggggacccagggcatcagacacaggtacagcacataggccaggagccagggggtgactggggtggctcggctcgggaggcctgggaccccacagtgcacgctgtgcccctgatgatgtgggagaggaacatgggctcaggacagcgggtgtcagcttgcctgacccccatgtcgcctctgtaggtagaagaagtatgtcttcctggaccccctggctggtgctgtaacaaagacccatgtgatgctgggggcagagacagaggagaagctgtttgatgcccccttgtccatcagcaagagagagcagctggaacagcaggtcccagagaactacttctatgtgccagacctgggccaggtgcctgagattgatgttccatcctacctgcctgacctgcccggcattgccaacgacctcatgtacattgccgacctgggccccggcattgccccctctgcccctggcaccattccagaactgcccaccttccacactgaggtagccgagcctctcaaggcagacctacaagatggggtactaacaccacccccaccgcccccaccaccacccccagctcctgaggtgctggccagtgcacccccactcccaccctcaaccgcggcccctgtaggccaaggcgccaggcaggacgacagcagcagcagcgcgtctccttcaggtgggagcagctctttgaggccacctgatttctggcgtgctcagtgcactcgggtggattttctgtgggtttgttaagtggtcagaaattctcaattttttgaatagtttccatttcaaatatcttgttctacttggttcataaaatagtggttttcaaactgtagagctctggacttctcacttctagggcagagggagcctgaacaagtgaggctctgggttccccattcctaattaaaccaatggaaagaaggggtctaataacaaactacagcaacacatttttcatttcagcttcactgctgtntctcccagtgtaaccctagcatccagaagtggcacaaaacccctctgctggctcgtgtgtgcaactgagactgtcagagcatggctagctcaggggtccagctctgcagggtgggggctagagaggaagcagggagtatctgcacacaggatgcccgcgctcaggtggttgcagaagtcagtgcccaggcccccacacacagtctccaaaggtccggcctccccagcgcagggctcctcgtttgaggggaggtgacttccctcccagcaggctcttggacacagtaagcttccccagccctgcctgagcagcctttcctccttgccctgttccccacctcccggctccagtccagggagctcccagggaagtggttgacccctccggtggctgggccactctgctagagtccatccgccaagctgggggcatcggcaaggccaagctgcgcagcatgaaggagcgaaagctggagaagaagaagcagaaggagcaggagcaagtgagagccacgagccaaggtgggcacttgatgtcggatctcttcaacaagctggtcatgaggcgcaagggcatctctgggaaaggacctggggctggtgaggggcccggaggagcctttgcccgcgtgtcagactccatccctcctctgccgccaccgcagcagccacaggcagaggaggacgaggacgactgggaatcctagggggctccatgacaccttcccccccagacccagacttgggccgttgctctgacatggacacagccaggacaagctgctcagacctacttccttgggagggggtgacggaaccagcactgtgtggagaccagcttcaaggagcggaaggctggcttgaggccacacagctggggcggggacttctgtctgcctgtgctccatggggggacggctccacccagcctgcgccactgtgttcttctcttaagaggcttccagagaaaacggcacaccaatcaataaagaactgagcagaaa

SEQ ID NO: 448242 - DNA, 2467 bp, Homo sapiens
  misc_feature (413)..(413): n is a, c, g, or t
  misc_feature (1464)..(1464): n is a, c, g, or t
attcgtgaacttcccggggggcggcgggagcttccgggagggcggctcgcaggcaccatgactcctgtgaggatgcagcactccctggcaggtcagacctatgccgtgcccctcatccagccagacctgcggcgagaggaggccgtccagcagatggcggatgccctgcagtacctgcagaaggtctctggagacatcttcagcaggtagagcagagccggagccaggtgcaggccattggagagaaggtctccttggcccaggccaagattgagaagatcaagggcagcaagaaggccatcaaggtagtccccatacccctgtgtcctgaggctactgggcagtccctccatttccccgtgcctctgaggctgcccagtctctgccctgctgcccacctgtaccttgagctntcttctcgcccaggcttccaactccaccctctcctgccaagcaatcctagccctctgagcctcttggggccccctcagacttgtccctgtgtccacagtgttctccagtgccaagtaccctgctccagggcgcctgcaggaatatggctccatcttcacgggcgcccaggaccctggcctgcagagacgcccccgccacaggatccagagcaagcaccgccccctggacgagcgggccctgcaggagaagctgaaggactttcctgtgtgcgtgagcaccaagccggagcccgaggacgatgcagaagagggacttgggggtcttcccagcaacatcagctctgtcagctccttgctgctcttcaacaccaccgagaacctgtcccagagaactacttctatgtgccagacctgggccaggtgcctgagattgatgttccatcctacctgcctgacctgcccggcattgccaacgacctcatgtacattgccgacctgggccccggcattgccccctctgcccctggcaccattccagaactgcccaccttccacactgaggtagccgagcctctcaaggcagacctacaagatggggtactaacaccacccccaccgcccccaccaccacccccagctcctgaggtgctggccagtgcacccccactcccaccctcaaccgcggcccctgtaggccaaggcgccaggcaggacgacagcagcagcagcgcgtctccttcaggtgggagcagctctttgaggccacctgatttctggcgtgctcagtgcactcgggtggattttctgtgggtttgttaagtggtcagaaattctcaattttttgaatagtttccatttcaaatatcttgttctacttggttcataaaatagtggttttcaaactgtagagctctggacttctcacttctagggcagagggagcctgaacaagtgaggctctgggttccccattcctaattaaaccaatggaaagaaggggtctaataacaaactacagcaacacatttttcatttcagcttcactgctgtntctcccagtgtaaccctagcatccagaagtggcacaaaacccctctgctggctcgtgtgtgcaactgagactgtcagagcatggctagctcaggggtccagctctgcagggtgggggctagagaggaagcagggagtatctgcacacaggatgcccgcgctcaggtggttgcagaagtcagtgcccaggcccccacacacagtctccaaaggtccggcctccccagcgcagggctcctcgtttgaggggaggtgacttccctcccagcaggctcttggacacagtaagcttccccagccctgcctgagcagcctttcctccttgccctgttccccacctcccggctccagtccagggagctcccagggaagtggttgacccctccggtggctgggccactctgctagagtccatccgccaagctgggggcatcggcaaggccaagctgcgcagcatgaaggagcgaaagctggagaagaagaagcagaaggagcaggagcaagtgagagccacgagccaaggtgggcacttgatgtcggatctcttcaacaagctggtcatgaggcgcaagggcatctctgggaaaggacctggggctggtgaggggcccggaggagcctttgcccgcgtgtcagactccatccctcctctgccgccaccgcagcagccacaggcagaggaggacgaggacgactgggaatcctagggggctccatgacaccttcccccccagacccagacttgggccgttgctctgacatggacacagccaggacaagctgctcagacctacttccttgggagggggtgacggaaccagcactgtgtggagaccagcttcaaggagcggaaggctggcttgaggccacacagctggggcggggacttctgtctgcctgtgctccatggggggacggctccacccagcctgcgccactgtgttcttctcttaagaggcttccagagaaaacggcacaccaatcaataaagaactgagcagaaa

SEQ ID NO: 448243 - DNA, 2077 bp, Homo sapiens
  misc_feature (413)..(413): n is a, c, g, or t
  misc_feature (1074)..(1074): n is a, c, g, or t
attcgtgaacttcccggggggcggcgggagcttccgggagggcggctcgcaggcaccatgactcctgtgaggatgcagcactccctggcaggtcagacctatgccgtgcccctcatccagccagacctgcggcgagaggaggccgtccagcagatggcggatgccctgcagtacctgcagaaggtctctggagacatcttcagcaggtagagcagagccggagccaggtgcaggccattggagagaaggtctccttggcccaggccaagattgagaagatcaagggcagcaagaaggccatcaaggtagtccccatacccctgtgtcctgaggctactgggcagtccctccatttccccgtgcctctgaggctgcccagtctctgccctgctgcccacctgtaccttgagctntcttctcgcccaggcttccaactccaccctctcctgccaagcaatcctagccctctgagcctcttggggccccctcagacttgtccctgtgtccacagtgttctccagtgccaagtaccctgctccagggcgcctgcaggaatatggctccatcttcacgggcgcccaggaccctggcctgcagagacgcccccgccacaggatccagagcaagcaccgccccctggacgagcgggccctgcaggagaagctgaaggactttcctgtgtgcgtgagcaccaagccggagcccgaggacgatgcagaagagggacttgggggtcttcccacagcagcagcgcgtctccttcaggtgggagcagctctttgaggccacctgatttctggcgtgctcagtgcactcgggtggattttctgtgggtttgttaagtggtcagaaattctcaattttttgaatagtttccatttcaaatatcttgttctacttggttcataaaatagtggttttcaaactgtagagctctggacttctcacttctagggcagagggagcctgaacaagtgaggctctgggttccccattcctaattaaaccaatggaaagaaggggtctaataacaaactacagcaacacatttttcatttcagcttcactgctgtntctcccagtgtaaccctagcatccagaagtggcacaaaacccctctgctggctcgtgtgtgcaactgagactgtcagagcatggctagctcaggggtccagctctgcagggtgggggctagagaggaagcagggagtatctgcacacaggatgcccgcgctcaggtggttgcagaagtcagtgcccaggcccccacacacagtctccaaaggtccggcctccccagcgcagggctcctcgtttgaggggaggtgacttccctcccagcaggctcttggacacagtaagcttccccagccctgcctgagcagcctttcctccttgccctgttccccacctcccggctccagtccagggagctcccagggaagtggttgacccctccggtggctgggccactctgctagagtccatccgccaagctgggggcatcggcaaggccaagctgcgcagcatgaaggagcgaaagctggagaagaagaagcagaaggagcaggagcaagtgagagccacgagccaaggtgggcacttgatgtcggatctcttcaacaagctggtcatgaggcgcaagggcatctctgggaaaggacctggggctggtgaggggcccggaggagcctttgcccgcgtgtcagactccatccctcctctgccgccaccgcagcagccacaggcagaggaggacgaggacgactgggaatcctagggggctccatgacaccttcccccccagacccagacttgggccgttgctctgacatggacacagccaggacaagctgctcagacctacttccttgggagggggtgacggaaccagcactgtgtggagaccagcttcaaggagcggaaggctggcttgaggccacacagctggggcggggacttctgtctgcctgtgctccatggggggacggctccacccagcctgcgccactgtgttcttctcttaagaggcttccagagaaaacggcacaccaatcaataaagaactgagcagaaa

SEQ ID NO: 448244 - DNA, 2270 bp, Homo sapiens
  misc_feature (1226)..(1226): n is a, c, g, or t
ggacgcgtgggtcggagcttccggtgagggcggctcggtagagcagagccggagccaggtgcaggccattggagagaaggtctccttggcccaggccaagattgagaagatcaagggcagcaagaaggccatcaaggtgttctccagtgccaagtaccctgctccagggcgcctgcaggaatatggctccatcttcacgggcgcccaggaccctggcctgcagagacgcccccgccacaggatccagagcaagcaccgccccctggacgagcgggccctgcaggagaagctgaaggactttcctgtgtgcgtgagcaccaagccggagcccgaggacgatgcagaagagggacttgggggtcttcccagcaacatcagctctgtcagctccttgctgctcttcaacaccaccgagaacctgtagaagaagtatgtcttcctggaccccctggctggtgctgtaacaaagacccatgtgatgctgggggcagagacagaggagaagctgtttgatgcccccttgtccatcagcaagagagagcagctggaacagcaggtcccagagaactacttctatgtgccagacctgggccaggtgcctgagattgatgttccatcctacctgcctgacctgcccggcattgccaacgacctcatgtacattgccgacctgggccccggcattgccccctctgcccctggcaccattccagaactgcccaccttccacactgaggtagccgagcctctcaaggcagacctacaagatggggtactaacaccacccccaccgcccccaccaccacccccagctcctgaggtgctggccagtgcacccccactcccaccctcaaccgcggcccctgtaggccaaggcgccaggcaggacgacagcagcagcagcgcgtctccttcaggtgggagcagctctttgaggccacctgatttctggcgtgctcagtgcactcgggtggattttctgtgggtttgttaagtggtcagaaattctcaattttttgaatagtttccatttcaaatatcttgttctacttggttcataaaatagtggttttcaaactgtagagctctggacttctcacttctagggcagagggagcctgaacaagtgaggctctgggttccccattcctaattaaaccaatggaaagaaggggtctaataacaaactacagcaacacatttttcatttcagcttcactgctgtntctcccagtgtaaccctagcatccagaagtggcacaaaacccctctgctggctcgtgtgtgcaactgagactgtcagagcatggctagctcaggggtccagctctgcagggtgggggctagagaggaagcagggagtatctgcacacaggatgcccgcgctcaggtggttgcagaagtcagtgcccaggcccccacacacagtctccaaaggtccggcctccccagcgcagggctcctcgtttgaggggaggtgacttccctcccagcaggctcttggacacagtaagcttccccagccctgcctgagcagcctttcctccttgccctgttccccacctcccggctccagtccagggagctcccagggaagtggttgacccctccggtggctgggccactctgctagagtccatccgccaagctgggggcatcggcaaggccaagctgcgcagcatgaaggagcgaaagctggagaagaagaagcagaaggagcaggagcaagtgagagccacgagccaaggtgggcacttgatgtcggatctcttcaacaagctggtcatgaggcgcaagggcatctctgggaaaggacctggggctggtgaggggcccggaggagcctttgcccgcgtgtcagactccatccctcctctgccgccaccgcagcagccacaggcagaggaggacgaggacgactgggaatcctagggggctccatgacaccttcccccccagacccagacttgggccgttgctctgacatggacacagccaggacaagctgctcagacctacttccttgggagggggtgacggaaccagcactgtgtggagaccagcttcaaggagcggaaggctggcttgaggccacacagctggggcggggacttctgtctgcctgtgctccatggggggacggctccacccagcctgcgccactgtgttcttctcttaagaggcttccagagaaaacggcacaccaatcaataaagaactgagcagaaaccaacagtgtgcttttaataaaggatctctagctgtgcagg

SEQ ID NO: 448245 - DNA, 3068 bp, Homo sapiens
  misc_feature (1226)..(1226): n is a, c, g, or t
ggacgcgtgggtcggagcttccggtgagggcggctcggtagagcagagccggagccaggtgcaggccattggagagaaggtctccttggcccaggccaagattgagaagatcaagggcagcaagaaggccatcaaggtgttctccagtgccaagtaccctgctccagggcgcctgcaggaatatggctccatcttcacgggcgcccaggaccctggcctgcagagacgcccccgccacaggatccagagcaagcaccgccccctggacgagcgggccctgcaggagaagctgaaggactttcctgtgtgcgtgagcaccaagccggagcccgaggacgatgcagaagagggacttgggggtcttcccagcaacatcagctctgtcagctccttgctgctcttcaacaccaccgagaacctgtagaagaagtatgtcttcctggaccccctggctggtgctgtaacaaagacccatgtgatgctgggggcagagacagaggagaagctgtttgatgcccccttgtccatcagcaagagagagcagctggaacagcaggtcccagagaactacttctatgtgccagacctgggccaggtgcctgagattgatgttccatcctacctgcctgacctgcccggcattgccaacgacctcatgtacattgccgacctgggccccggcattgccccctctgcccctggcaccattccagaactgcccaccttccacactgaggtagccgagcctctcaaggcagacctacaagatggggtactaacaccacccccaccgcccccaccaccacccccagctcctgaggtgctggccagtgcacccccactcccaccctcaaccgcggcccctgtaggccaaggcgccaggcaggacgacagcagcagcagcgcgtctccttcaggtgggagcagctctttgaggccacctgatttctggcgtgctcagtgcactcgggtggattttctgtgggtttgttaagtggtcagaaattctcaattttttgaatagtttccatttcaaatatcttgttctacttggttcataaaatagtggttttcaaactgtagagctctggacttctcacttctagggcagagggagcctgaacaagtgaggctctgggttccccattcctaattaaaccaatggaaagaaggggtctaataacaaactacagcaacacatttttcatttcagcttcactgctgtntctcccagtgtaaccctagcatccagaagtggcacaaaacccctctgctggctcgtgtgtgcaactgagactgtcagagcatggctagctcaggggtccagctctgcagggtgggggctagagaggaagcagggagtatctgcacacaggatgcccgcgctcaggtggttgcagaagtcagtgcccaggcccccacacacagtctccaaaggtccggcctccccagcgcagggctcctcgtttgaggggaggtgacttccctcccagcaggctcttggacacagtaagcttccccagccctgcctgagcagcctttcctccttgccctgttccccacctcccggctccagtccagggagctcccagggaagtggttgacccctccggtggctgggccactctgctagagtccatccgccaagctgggggcatcggcaaggccaagctgcgcagcatgaaggagcgaaagctggagaagaagaagcagaaggagcaggagcaaggtgagcgggccctggagcttgcagtcggagggccttgggcaagatcgcctcctcccctccagccctgagtccaccgggtgctttctgcccaccccctgctcttgccagctggcccctgcttcccctagggcacatgctggaagccctgggccgccaccagaggtcctcagccctcctgcctgggctatggctccttcctggtttgggagccatagtggagctttcctctctaagctcacccagctcaaactgacaggagaatcttcttcgactgccaagagcggtccaaggcaatggtcagccactgcagcctcctgagatatttttagagactggacctgaggcctccggaggctactgatgatgcctgctgtgaacgcagacactggtgtgatgcgatgcctgcgcctgcagcggcagtgccctgggcactatggttttgagcttgtacccagcgctgcttttgccttgctctgtgaccccaggcaagctgcctcacctctctgggccagtttccccatagtacagtggtgctgcacaccctggccctggccccgaggtggctgggaggtggctcctcaaacagccgctgtctcatcagtgcccggtgctgggtcagggatcgactgaggctctgagctaactgggaaacacagtggctgaactcttcaccccagtctgtggctttcccgttgcagttgagagccacgagccaaggtgggcacttgatgtcggatctcttcaacaagctggtcatgaggcgcaagggtaggaggcagggccgctgcccgccctgggccagcaccttgtaattctgtcctgcctttttcttcctgtatttaagtctccgggggctgggggaaccagggtttcccaccaaccaccctcactcagccttttccctccaggcatctctgggaaaggacctggggctggtgaggggcccggaggagcctttgcccgcgtgtcagactccatccctcctctgccgccaccgcagcagccacaggcagaggaggacgaggacgactgggaatcctagggggctccatgacaccttcccccccagacccagacttgggccgttgctctgacatggacacagccaggacaagctgctcagacctacttccttgggagggggtgacggaaccagcactgtgtggagaccagcttcaaggagcggaaggctggcttgaggccacacagctggggcggggacttctgtctgcctgtgctccatggggggacggctccacccagcctgcgccactgtgttcttctcttaagaggcttccagagaaaacggcacaccaatcaataaagaactgagcagaaa

SEQ ID NO: 448246 - DNA, 552 bp, Homo sapiens
tactactactactagggggtttttagaagacgacagaaggggcaggagcaagtgagagccacgagccaaggtgggcacttgatgtcggatctcttcaacaagctggtcatgaggcgcaagggcatctctgggaaaggacctggggctggtgaggggcccggaggagcctttgcccgcgtgtcagactccatccctcctctgccgccaccgcagcagccacaggcagaggaggacgaggacgactgggaatcctagggggctccatgacaccttcccccccagacccagacttgggccgttgctctgacatggacacagccaggacaagctgctcagacctacttccttgggagggggtgacggaaccagcactgtgtggagaccagcttcaaggagcggaaggctggcttgaggccacacagctggggcggggacttctgtctgcctgtgctccatggggggacggctccacccagcctgcgccactgtgttcttctcttaagaggcttccagagaaaacggcacaccaatcaataaagaactgagcagaaa

SEQ ID NO: 448247 - DNA, 3679 bp, Homo sapiens
  misc_feature (812)..(812): n is a, c, g, or t
  misc_feature (969)..(969): n is a, c, g, or t
  misc_feature (1063)..(1063): n is a, c, g, or t
  misc_feature (1234)..(1234): n is a, c, g, or t
  misc_feature (1873)..(1873): n is a, c, g, or t
  misc_feature (2231)..(2231): n is a, c, g, or t
  misc_feature (2786)..(2786): n is a, c, g, or t
attcgtgaacttcccggggggcggcgggagcttccgggagggcggctcgcaggcaccatgactcctgtgaggatgcagcactccctggcaggtcagacctatgccgtgcccctcatccagccagacctgcggcgagaggaggccgtccagcagatggcggatgccctgcagtacctgcagaaggtctctggagacatcttcagcaggtgggtgctgccactcacccccacctgatgagagggccatccctgtcctgggcaatcccagcaacacaccctctgggagcagcccccttggggaatcccggtcctggggaacccatctggcttccctgtgtgggaggggctgaagtgagagcccaacttggaagcttttactcctgggagtccgagagctcactcccttccaccccacttagcctcctggtttcctgtggtggctctgctctcacaactcatgcttttcctcccattggagggcctattccttcacgttttcctgcagccaacaaatatttacccagcagtgctcgtgtgcaaggcagtgtgggaatctctatatatccagccacggataaggcaacatacctctccacctggagcgcacattctggcaggagagaaagacctaaataagcaatagatgattagttcttcaataacagttgtgacaaggtctattgataatattttgtaatcactaatattcatataaaccgtgcacaaccattgatttgagtgcattaactcacacttcatgagcaggcactgccgtcatctcattttatagatgaggaaactgaggcacagaanggctgagagacctggcctagtgacagagccaggattcaaagccatagatcatggccccgggttatgtaggttattactgcatctgttcaggggagatggggtactgtgaggctcgtcatgggaagcctggcttggtctcaggtcagggaaggcagangtgaggaaatgacatttatggtaaagtctgagggttgagtgggtaggttgggaagaacattccagaaagaagcacatgaactacagcctggagntggaggacctaaaaggaagccagcatggctggagcacggagtggccattgagggaggcgagctggagggctgcagcttcttgtattggcagtgctgacctcgcacagtccttgggctccagtgacttcactcagtgtttatctaacatgagtgagtgaatggtgtttgctntttttttggtaaaggtcccaggggttgtcgggtacacaggtcctgtctttggccataagcaaactgaaatgaggcttggtctccttcccaggatcccacaccatgcctcacatggtagaccccagtgggaagtatgtgactgcctgactcaggtgcctctcgtggtccaagccatccctgccctgtcccttccctggttgtcgccagacctggagcccctgctccttcactttgcagcctcctcttctgtcaccaactgggaacccacctcttcctgaaagtcctcccccactgactcaccggcttgccccgagtttgtcaagaatgtcccagtaaccaggggacacacagtgaagtgactgaggggttaccttggagttgatgccttggctcagatccagctcccctgttttcttcctctgtaaccttgggcaacccaacccctctaagcctcggtgttctcatttgtgaagttgtggtaataatggtagcttcctggtagaattattttaaatattaaattaatcaaaacatgcaaaggaatggaacagtgcctggcacctaggaagccttcaggaaatgctatctcttccctgttgataatcttgacccgtacactgcctttggttgccattcatnaacctgccaccaatagtaacaaagtgctggatgcaccttttgtgcttatctttgtgctaaatgtgcccgagggacacctagggaagaggatgcaggtctttaagagccatcagctccagattatggccaccccatgtccagcacttagaatggaggccaaaaccattccctcggaaattgtgtttccttgccaagatggggactgcgtggttgcccttctctgagggcagcgctggatttttggcgtctttcctttcctgtcctggtacttggcaccttgtagacagttgcatgtcccctgcccagggatgggatgaggagagggcaggaaggcatttcctgggtagtggagtgctgngttcattgagtgtgggttctccaagctgctggcacagcgcagggagggccagatgcctctcaggagccttgggcctgagtcctggctccctcactcctgggttccaggtcactgcatctgtctctccaccatgtgctccacctcgtgctggaccttaagagataccaattatgtggctgccactgtgtcctagaggctggaatgggaacacatagggcgagattgattgttaattgctagcatgaaccgcgtgggcttctcagggtctagagtggagagaaatcggtaagaattggtggcacgcctgtcagaactccccagaccaagctaagcaaaaattaaccaatcagtagagcagccttcggagtaagggctaaaatgatgtcctcagggcctggttttgctttccttccatgtcagtttgcttctttgggtctggctgcattcccagacaggccatgctctcgtggtagcaaggtgacatgacacagggtcaggtccagcaggaaagaatgctgtcctgtgtccccacttcctccagaagccacactcacncatcccacctggcttggtcctcatgtctatcccagaatccattaatggggccaggggactatgacacaccacttggcttagactgaggagctctgtgggcagccccacctgaagctctgggactaagcctgcgagagagatggattccccaagggaaatggggccattgcttgagtaaaaaggaaatagttgctgaagaggaaaaccacgtgcttactccacatagggcagactcctggaagaggggggcagggtagggaggtggatatgcaggttgccctggcagggtctggaaatgggggctgcaggcttggagggaggcctcagtgtggcttggaacgtggtgtatggtggtctgccgcgaaggccggcctgcacaggggtgggaggggggtgcttctgcatgggaagcacagacagcgctgcctctcccttgcactcagctctcggggcatgagaggctgactttccgtgagcctgtgggccaggcctctttgaatggggctgagggagctttgccctggttcctttgtgtccccacggtgccacgggaggctccctggcagggtgtggggcaaggcagtgagtgaagagttgggatgagtgagttagggcccacggattactcaagacaggacttcaagttgattcaggcgtgttagggagctgtgattggattttgagcagggcagggatgggacagaagagtttggggaaggttcctcaggcatccgtcacggaagggacaagaagggagagagagtggatgccagggacacccagaagctgttattgtagtcaggatacgacaggggtgaggctacagacaggggacttgcaagcagggagggcaggggtcgatgcggccgcgaatttagtagtagtagtcgacc

SEQ ID NO: 448248 - DNA, 843 bp, Homo sapiens
  misc_feature (790)..(790): n is a, c, g, or t
  misc_feature (792)..(794): n is a, c, g, or t
  misc_feature (796)..(796): n is a, c, g, or t
ggacgcgtgggtcggagcttccggtgagggcggctcggtagagcagagccggagccaggtgcaggccattggagagaaggtctccttggcccaggccaagattgagaagatcaagggcagcaagaaggccatcaaggtgttctccagtgccaagtaccctgctccagggcgcctgcaggaatatggctccatcttcacgggcgcccaggaccctggcctgcagagacgcccccgccacaggatccagagcaagcaccgccccctggacgagcgggccctgcaggagaagctgaaggactttcctgtgtgcgtgagcaccaagccggagcccgaggacgatgcagaagagggacttgggggtcttcccagcaacatcagctctgtcagctccttgctgctcttcaacaccaccgagaacctgtagaagaagtatgtcttcctggaccccctggctggtgctgtaacaaagacccatgtgatgctgggggcagagacagaggagaagctgtttgatgcccccttgtccatcagcaagagagagcagctggaacagcaggtcccagagaactacttctatgtgccagacctgggccaggtgcctgagattgatgttccatcctacctgcctgacctgcccggcattgccaacgacctcatgtacattgccgacctgggccccggcattgccccctctgcccctggcaccattccagaactgcccaccttccacactgaggtagccgagcctctcaaggacctacaagatggggtactaacaccagccgacgcnannncnacgtcatgcgtgtggggagggcgtgcaaccagggaggcgggcccgac

SEQ ID NO: 448249 - DNA, 5502 bp, Homo sapiens
ctcctgcacggcgagtgctggagcacgagctaccgctcgctcggtcagggcgccccctccgcccgcctcctgcttcctcctccgctgcctgccgccgccgcctccaccattgtataatgctcggggcgcgcaggcagagaacggcggagtcttagcttcagcctcgcctgctgcccgctccccggcgccaccctcgggcccctggagcggggcactccgcatggagcgggagtagctgaggagtgggcggaaacccctcctgatgcgttagttcccaggtggagctgcatgtgatatatgttgggtaaaggaggaaaacggaagtttgatgagcatgaagatgggctggaaggcaaaatcgtgtctccctgtgacggtccatccaaggtgtcttacaccttacagcgccagactatcttcaacatttcccttatgaaactctataaccacaggcccctgacagagcccagcttgcaaaagaccgttttaattaacaacatgttgaggcggatccaggaggaactcaaacaggaaggcagcctgaggcccatgttcaccccctcctcccagcccaccaccgagcccagcgacagctaccgagaggccccgccggccttcagccacctggcgtccccgtcctcccacccctgcgacctcggaagcactacgcccctggaggcctgcctcaccccggcctcactgctcgaggacgacgatgacacgttttgcacctcccaggccatgcagcccacggctcccaccaaactgtcacctccagccctcttgccagaaaaggacagtttctcctctgccttggacgagatcgaggagctctgtcccacatctacctccacagaggcggccacggctgcgactgacagtgtgaaagggacctccagcgaggctggcacccagaaactcgacggtcctcaagagagccgcgcagatgactcaaaactgatggactctctgcctgggaattttgaaataacgacgtccacgggtttcctgacagacttgaccctggatgacatcctgtttgctgacattgatacgtccatgtatgattttgacccctgcacttcctcatcagggacagcctcaaaaatggcccctgtgtctgccgacgacctcctcaaaactctggctccttacagcagtcagcctgtcaccccaagtcagcctttcaaaatggacctcacagagctggaccacatcatggaggtgcttgttgggtcctaagacccagggacccagcgactatgcccacccagaccccagagcgttcccataaccctgacagttctccacactgtgcatgcacccttgcttgcctttttcagagaaaaagaaaattttacaacaggatcacactagtttttgctttgagcagagttggagtgccttcatccaagtatgaccacttttaatacacttttttgagtggttcctcagagacctactaccctggtataggaaagaatccatttgaagacaatgttgcaatgttgaatgacaaaaataaacagttcaagtgaagcacaaggattaagttggaaaagctgtaaattgcatgtgcatatttgtctattttttctataagttttattgcaagaggtaaagaagaaaactatatatatatatcttatttagataatctcagtaccttttctggcatttttgccctgtataggttgacttggcaattcggcctttttagaggcattaactactcctcgtaagtgttgcatttacatggctgtttagaaaactgctgcccaaatttattttatatttttgtacagattctgcagtttatgatattgtttttctaaaaacaaatgctgtttatacatatgagatagctattttgataggatttgctcacatagttcctgcaaacttcagatgtacaagttgcacttgtacttttatagagttgtaatgttttatatgtgtatggtgcaagagaaaattggatcaaatcaatctgcagttgatgtccccaaatgcaaacacaggcacacacatgcacacacccataaacacacacacagtgctttaagaaagggccaggtgatatcacacccaaatttcacaagcactgaccccctggcaccaacacccgccagtactgtgacttccaaagccagagccacatgtgctcatcaaacttgcattaagcagttggcgggagatggctgtggagctgggggtttaagtgatggttctcttttgctccctcttttgagggtaaagctactgtctttcttaagagtgtatttatgccaagtttgcgcttttaattgtttttattttgttttttaatgaaaacccagatctttcctttttggcataatttttatgatgacctgaaattttacatccgaacaaaattttacatccgaaaagcaaccaacttcttcatggaactcagccctgttgcaatgcttagggcccttaaagaagaaaatctccccagaaggcatccatcatgttgcttaattgtcttctgcagcttcctttccctagagctttccctgtgttgctaagagctgaaaatggcatcttcgtgatcaccacagtgagcttggctcgcctcggccggcccgggatgcactcttacaacatgtgtgactcttgaacctggagttcatcacattacgtcacagcttcccatctggttgctttcctgagtcagctacttcacacttgtcaaggctgttttaccccaaaactcagacaggactttctatgcatgttttccctcctccccccaattccccccccatcaccttatctcccaggacacacttgagaagtagctttttattcctagtggtgtacatttaattttaaaaaggttgcaatgtatcatgcttgttgccgaaactgtttatggccttcttgtttcagttttttcttttcttccaatggtactttagctgttgagtgcaggttacaacctatattgttatgcagatggcttctttaggaataacttttatatttatttaaaaatttttaaattatgggatgttttgttgttgttgttgtctttgttgttggtcatttgtcaatattcagtcaccaattctgctcacttcttgccatggataaaattgggtctttctggctaattaaaaaagacaactttataaagcaaagacgtttgtgatgaaggaactgctcatctaagcaaaagatttgagtatgatatgataaaggctttctacattctaatttactttttccccccacttgaatgtgttttaaaggctaattatcagctcagtagagcagtgagaaactgatcaaattgcacttgttctcctacaagcaacctccacgcagacacctcgtactgctacaggtgtgtcatttcctttaataggaccagggaccatgtaactgaggtgagggttgtagtagatgcttccagtgtcagtatgcctgttaattttaagagcttccctttcttgcagagaacaagtctgcccagattccatgctttctataactggaggacctggcaaacctgccgcatgctgcacacatctacctacgtacacatatacaatagtattgatgattctgaacaataacagggtaaaacagttggtttgccattgttaaaaactgatttacagtaacttacaacaactgtacttttgttggattagcaaatcatgtgtttaaacaaatcccatatgttgggcaacagttcaaataagcacggagaagtgttgcccaaacttggttctctgactcttatgtatttgtaaggctgggcttcaaaatcaaaacaaaaaccccaaaaacagcaggcaaatgctttttaactctgacaccgttgccataaatccctgatactcaaagtctaacaagaaagacatggaaaattagcagcccattttcagaaagatcaaaatgatctagggttctaattgcttttgcatcctattcttacaaagtgatgtcccaacagggaacagtaggagctggagtgggatctccaagtcccagtttgagtgtgggatgtgcttccagcagtgccttccctttatgaaagacatcacatggcatccagggccaggcaggcagcttgaggtgcctttacgagaaaaccgagctggggctgggagaggacagttattgacactgatgtgcaatgaagtgacaagatgagagcagaatcgtaagagctttgaatttgaagtgagtttttttccccccataagttatttattccttttttctgtgtaaatatatttattttactgtggagcgctaacatctggatcgtaacatgtgcagaatgtatggtaggaatgtattctcttgtaggaatgtaaatctgtattaaaagggggtccaagccaggcccccaggtcttctcattgtatgcacagtccgcattcatttttactcttctctaatatgggtctatttgaaatatgcaaaaggtatgaggaatgttttaatacctccaaatttttaagaaaagcatcaaagggttgatattttttaaagtttttttagtagcactttctctggatgacagaaggggcaaccacatgggcacccttgttcataccaaagggtgagcagtggccagagcctcctctgcacctctcgagtgtctttaccaattgagctttttatcgccatagccccttggagtgccccagctgccctgaggtcaatcaaggaaaatttcttaatgaaataagctccaaagagccaaagtatcaacttacagatcgtttttaaagcttaaatttatgaaccacctttgtggtaaacaatgaattatgaataccgcagggcagccttcttaaatgacaaatgtaaaaaaaaaaaaaaaaggactctacttcgtgcagcaattgctactctatacgaattgtcttaatttgaaaaccttgctgttacaaattggacctttatacattttctgaaaacaatgaaaagagtatatttaaccttttctggctgtaaatggttaccttcctgtaactgccccgcacctggaggcatggagttgtgtgcatcctgcttatgtacaattgttttcagtgtttctaagaatgagtctgaatggttcttgaaaattagccaggatcaaatgctattgcagacaaagccaataaaaagttggacttcttttggggataacaagttttggaagagaaatgcaggccatatgtgcgcatgaccgagattttgaaaaaagatgtacatagtgacatgtttggtgcatggtttttgaggagggcttttgtcaaaaaggaggtataacctttcccccacagacctgagagctgtgccttttctatgcaatattacagacgttacatcggaacccagatggctgtattcacatgtaggtttgggctgtaatctaaacaattggacagattaaatgtacatggaaatgagcagtcttacttttgtagttttatattatacaataaacagttaaaagatgaaaaaaaaatg

SEQ ID NO: 448250 - DNA, 5546 bp, Homo sapiens
  misc_feature (5531)..(5531): n is a, c, g, or t
ctcctgcacggcgagtgctggagcacgagctaccgctcgctcggtcagggcgccccctccgcccgcctcctgcttcctcctccgctgcctgccgccgccgcctccaccattgtataatgctcggggcgcgcaggcagagaacggcggagtcttagcttcagcctcgcctgctgcccgctccccggcgccaccctcgggcccctggagcggggcactccgcatggagcgggagtagctgaggagtgggcggaaacccctcctgatgcgttagttcccaggtggagctgcatgtgatatatgttgggtaaaggaggaaaacggaagtttgatgagcatgaagatgggctggaaggcaaaatcgtgtctccctgtgacggtccatccaaggtgtcttacaccttacagcgccagactatcttcaacatttcccttatgaaactctataaccacaggcccctgacagagcccagcttgcaaaagaccgttttaattaacaacatgttgaggcggatccaggaggaactcaaacaggaaggcagcctgaggcccatgttcaccccctcctcccagcccaccaccgagcccagcgacagctaccgagaggccccgccggccttcagccacctggcgtccccgtcctcccacccctgcgacctcggaagcactacgcccctggaggcctgcctcaccccggcctcactgctcgaggacgacgatgacacgttttgcacctcccaggccatgcagcccacggctcccaccaaactgtcacctccagccctcttgccagaaaaggacagtttctcctctgccttggacgagatcgaggagctctgtcccacatctacctccacagaggcggccacggctgcgactgacagtgtgaaagggacctccagcgaggctggcacccagaaactcgacggtcctcaagagagccgcgcagatgactcaaaactgatggactctctgcctgggaattttgaaataacgacgtccacgggtttcctgacagacttgaccctggatgacatcctgtttgctgacattgatacgtccatgtatgattttgacccctgcacttcctcatcagggacagcctcaaaaatggcccctgtgtctgccgacgacctcctcaaaactctggctccttacagcagtcagcctgtcaccccaagtcagcctttcaaaatggacctcacagagctggaccacatcatggaggtgcttgttgggtcctaagacccagggacccagcgactatgcccacccagaccccagagcgttcccataaccctgacagttctccacactgtgcatgcacccttgcttgcctttttcagagaaaaagaaaattttacaacaggatcacactagtttttgctttgagcagagttggagtgccttcatccaagtatgaccacttttaatacacttttttgagtggttcctcagagacctactaccctggtataggaaagaatccatttgaagacaatgttgcaatgttgaatgacaaaaataaacagttcaagtgaagcacaaggattaagttggaaaagctgtaaattgcatgtgcatatttgtctattttttctataagttttattgcaagaggtaaagaagaaaactatatatatatatcttatttagataatctcagtaccttttctggcatttttgccctgtataggttgacttggcaattcggcctttttagaggcattaactactcctcgtaagtgttgcatttacatggctgtttagaaaactgctgcccaaatttattttatatttttgtacagattctgcagtttatgatattgtttttctaaaaacaaatgctgtttatacatatgagatagctattttgataggatttgctcacatagttcctgcaaacttcagatgtacaagttgcacttgtacttttatagagttgtaatgttttatatgtgtatggtgcaagagaaaattggatcaaatcaatctgcagttgatgtccccaaatgcaaacacaggcacacacatgcacacacccataaacacacacacagtgctttaagaaagggccaggtgatatcacacccaaatttcacaagcactgaccccctggcaccaacacccgccagtactgtgacttccaaagccagagccacatgtgctcatcaaacttgcattaagcagttggcgggagatggctgtggagctgggggtttaagtgatggttctcttttgctccctcttttgagggtaaagctactgtctttcttaagagtgtatttatgccaagtttgcgcttttaattgtttttattttgttttttaatgaaaacccagatctttcctttttggcataatttttatgatgacctgaaattttacatccgaacaaaattttacatccgaaaagcaaccaacttcttcatggaactcagccctgttgcaatgcttagggcccttaaagaagaaaatctccccagaaggcatccatcatgttgcttaattgtcttctgcagcttcctttccctagagctttccctgtgttgctaagagctgaaaatggcatcttcgtgatcaccacagtgagcttggctcgcctcggccggcccgggatgcactcttacaacatgtgtgactcttgaacctggagttcatcacattacgtcacagcttcccatctggttgctttcctgagtcagctacttcacacttgtcaaggctgttttaccccaaaactcagacaggactttctatgcatgttttccctcctccccccaattccccccccatcaccttatctcccaggacacacttgagaagtagctttttattcctagtggtgtacatttaattttaaaaaggttgcaatgtatcatgcttgttgccgaaactgtttatggccttcttgtttcagttttttcttttcttccaatggtactttagctgttgagtgcaggttacaacctatattgttatgcagatggcttctttaggaataacttttatatttatttaaaaatttttaaattatgggatgttttgttgttgttgttgtctttgttgttggtcatttgtcaatattcagtcaccaattctgctcacttcttgccatggataaaattgggtctttctggctaattaaaaaagacaactttataaaatggcactttaagcaagccatagttagttttatttttgtaatgcacatggcaaagcaaagacgtttgtgatgaaggaactgctcatctaagcaaaagatttgagtatgatatgataaaggctttctacattctaatttactttttccccccacttgaatgtgttttaaaggctaattatcagctcagtagagcagtgagaaactgatcaaattgcacttgttctcctacaagcaacctccacgcagacacctcgtactgctacaggtgtgtcatttcctttaataggaccagggaccatgtaactgaggtgagggttgtagtagatgcttccagtgtcagtatgcctgttaattttaagagcttccctttcttgcagagaacaagtctgcccagattccatgctttctataactggaggacctggcaaacctgccgcatgctgcacacatctacctacgtacacatatacaatagtattgatgattctgaacaataacagggtaaaacagttggtttgccattgttaaaaactgatttacagtaacttacaacaactgtacttttgttggattagcaaatcatgtgtttaaacaaatcccatatgttgggcaacagttcaaataagcacggagaagtgttgcccaaacttggttctctgactcttatgtatttgtaaggctgggcttcaaaatcaaaacaaaaaccccaaaaacagcaggcaaatgctttttaactctgacaccgttgccataaatccctgatactcaaagtctaacaagaaagacatggaaaattagcagcccattttcagaaagatcaaaatgatctagggttctaattgcttttgcatcctattcttacaaagtgatgtcccaacagggaacagtaggagctggagtgggatctccaagtcccagtttgagtgtgggatgtgcttccagcagtgccttccctttatgaaagacatcacatggcatccagggccaggcaggcagcttgaggtgcctttacgagaaaaccgagctggggctgggagaggacagttattgacactgatgtgcaatgaagtgacaagatgagagcagaatcgtaagagctttgaatttgaagtgagtttttttccccccataagttatttattccttttttctgtgtaaatatatttattttactgtggagcgctaacatctggatcgtaacatgtgcagaatgtatggtaggaatgtattctcttgtaggaatgtaaatctgtattaaaagggggtccaagccaggcccccaggtcttctcattgtatgcacagtccgcattcatttttactcttctctaatatgggtctatttgaaatatgcaaaaggtatgaggaatgttttaatacctccaaatttttaagaaaagcatcaaagggttgatattttttaaagtttttttagtagcactttctctggatgacagaaggggcaaccacatgggcacccttgttcataccaaagggtgagcagtggccagagcctcctctgcacctctcgagtgtctttaccaattgagctttttatcgccatagccccttggagtgccccagctgccctgaggtcaatcaaggaaaatttcttaatgaaataagctccaaagagccaaagtatcaacttacagatcgtttttaaagcttaaatttatgaaccacctttgtggtaaacaatgaattatgaataccgcagggcagccttcttaaatgacaaatgtaaaaaaaaaaaaaaaaggactctacttcgtgcagcaattgctactctatacgaattgtcttaatttgaaaaccttgctgttacaaattggacctttatacattttctgaaaacaatgaaaagagtatatttaaccttttctggctgtaaatggttaccttcctgtaactgccccgcacctggaggcatggagttgtgtgcatcctgcttatgtacaattgttttcagtgtttctaagaatgagtctgaatggttcttgaaaattagccaggatcaaatgctattgcagacaaagccaataaaaagttggacttcttttggggataacaagttttggaagagaaatgcaggccatatgtgcgcatgaccgagattttgaaaaaagatgtacatagtgacatgtttggtgcatggtttttgaggagggcttttgtcaaaaaggaggtataacctttcccccacagacctgagagctgtgccttttctatgcaatattacagacgttacatcggaacccagatggctgtattcacatgtaggtttgggcgtgattttaaccatttggcccatttaaagggcaagggaaattgccctctttcctttgtgggtttatattttacccattnccctgttaaaatgtg

SEQ ID NO: 448251 - DNA, 981 bp, Homo sapiens
gcggccgcctactactactactgctcgaattcaagcttctaacgatgtacggggacatgggcacccttgttcataccaaagggtgagcagtggccagagcctcctctgcacctctcgagtgtctttaccaattgagctttttatcgccatagccccttggagtgccccagctgccctgaggtcaatcaaggaaaatttcttaatgaaataagctccaaagagccaaagtatcaacttacagatcgtttttaaagcttaaatttatgaaccacctttgtggtaaacaatgaattatgaataccgcagggcagccttcttaaatgacaaatgtaaaaaaaaaaaaaaaaggactctacttcgtgcagcaattgctactctatacgaattgtcttaatttgaaaaccttgctgttacaaattggacctttatacattttctgaaaacaatgaaaagagtatatttaaccttttctggctgtaaatggttaccttcctgtaactgccccgcacctggaggcatggagttgtgtgcatcctgcttatgtacaattgttttcagtgtttctaagaatgagtctgaatggttcttgaaaattagccaggatcaaatgctattgcagacaaagccaataaaaagttggacttcttttggggataacaagttttggaagagaaatgcaggccatatgtgcgcatgaccgagattttgaaaaaagatgtacatagtgacatgtttggtgcatggtttttgaggagggcttttgtcaaaaaggaggtataacctttcccccacagacctgagagctgtgccttttctatgcaatattacagacgttacatcggaacccagatggctgtattcacatgtaggtttgggctgtaatctaaacaattggacagattaaatgtacatggaaatgagcagtcttacttttgtagttttatattatacaataaacagttaaaagatgaaaaaaaaatg

SEQ ID NO: 448252 - DNA, 5556 bp, Homo sapiens
ctcctgcacggcgagtgctggagcacgagctaccgctcgctcggtcagggcgccccctccgcccgcctcctgcttcctcctccgctgcctgccgccgccgcctccaccattgtataatgctcggggcgcgcaggcagagaacggcggagtcttagcttcagcctcgcctgctgcccgctccccggcgccaccctcgggcccctggagcggggcactccgcatggagcgggagtagctgaggagtgggcggaaacccctcctgatgcgttagttcccaggtggagctgcatgtgatatatgttgggtaaaggaggaaaacggaagtttgatgagcatgaagatgggctggaaggcaaaatcgtgtctccctgtgacggtccatccaaggtgtcttacaccttacagcgccagactatcttcaacatttcccttatgaaactctataaccacaggcccctgacagagcccagcttgcaaaagaccgttttaattaacaacatgttgaggcggatccaggaggaactcaaacaggaaggcagcctgaggcccatgttcaccccctcctcccagcccaccaccgagcccagcgacagctaccgagaggccccgccggccttcagccacctggcgtccccgtcctcccacccctgcgacctcggaagcactacgcccctggaggcctgcctcaccccggcctcactgctcgaggacgacgatgacacgttttgcacctcccaggccatgcagcccacggctcccaccaaactgtcacctccagccctcttgccagaaaaggacagtttctcctctgccttggacgagatcgaggagctctgtcccacatctacctccacagaggcggccacggctgcgactgacagtgtgaaagggacctccagcgaggctggcacccagaaactcgacggtcctcaagagagccgcgcagatgactcaaaactgatggactctctgcctgggaattttgaaataacgacgtccacgggtttcctgacagacttgaccctggatgacatcctgtttgctgacattgatacgtccatgtatgattttgacccctgcacttcctcatcagggacagcctcaaaaatggcccctgtgtctgccgacgacctcctcaaaactctggctccttacagcagtcagcctgtcaccccaagtcagcctttcaaaatggacctcacagagctggaccacatcatggaggtgcttgttgggtcctaagacccagggacccagcgactatgcccacccagaccccagagcgttcccataaccctgacagttctccacactgtgcatgcacccttgcttgcctttttcagagaaaaagaaaattttacaacaggatcacactagtttttgctttgagcagagttggagtgccttcatccaagtatgaccacttttaatacacttttttgagtggttcctcagagacctactaccctggtataggaaagaatccatttgaagacaatgttgcaatgttgaatgacaaaaataaacagttcaagtgaagcacaaggattaagttggaaaagctgtaaattgcatgtgcatatttgtctattttttctataagttttattgcaagaggtaaagaagaaaactatatatatatatcttatttagataatctcagtaccttttctggcatttttgccctgtataggttgacttggcaattcggcctttttagaggcattaactactcctcgtaagtgttgcatttacatggctgtttagaaaactgctgcccaaatttattttatatttttgtacagattctgcagtttatgatattgtttttctaaaaacaaatgctgtttatacatatgagatagctattttgataggatttgctcacatagttcctgcaaacttcagatgtacaagttgcacttgtacttttatagagttgtaatgttttatatgtgtatggtgcaagagaaaattggatcaaatcaatctgcagttgatgtccccaaatgcaaacacaggcacacacatgcacacacccataaacacacacacagtgctttaagaaagggccaggtgatatcacacccaaatttcacaagcactgaccccctggcaccaacacccgccagtactgtgacttccaaagccagagccacatgtgctcatcaaacttgcattaagcagttggcgggagatggctgtggagctgggggtttaagtgatggttctcttttgctccctcttttgagggtaaagctactgtctttcttaagagtgtatttatgccaagtttgcgcttttaattgtttttattttgttttttaatgaaaacccagatctttcctttttggcataatttttatgatgacctgaaattttacatccgaacaaaattttacatccgaaaagcaaccaacttcttcatggaactcagccctgttgcaatgcttagggcccttaaagaagaaaatctccccagaaggcatccatcatgttgcttaattgtcttctgcagcttcctttccctagagctttccctgtgttgctaagagctgaaaatggcatcttcgtgatcaccacagtgagcttggctcgcctcggccggcccgggatgcactcttacaacatgtgtgactcttgaacctggagttcatcacattacgtcacagcttcccatctggttgctttcctgagtcagctacttcacacttgtcaaggctgttttaccccaaaactcagacaggactttctatgcatgttttccctcctccccccaattccccccccatcaccttatctcccaggacacacttgagaagtagctttttattcctagtggtgtacatttaattttaaaaaggttgcaatgtatcatgcttgttgccgaaactgtttatggccttcttgtttcagttttttcttttcttccaatggtactttagctgttgagtgcaggttacaacctatattgttatgcagatggcttctttaggaataacttttatatttatttaaaaatttttaaattatgggatgttttgttgttgttgttgtctttgttgttggtcatttgtcaatattcagtcaccaattctgctcacttcttgccatggataaaattgggtctttctggctaattaaaaaagacaactttataaaatggcactttaagcaagccatagttagttttatttttgtaatgcacatggcaaagcaaagacgtttgtgatgaaggaactgctcatctaagcaaaagatttgagtatgatatgataaaggctttctacattctaatttactttttccccccacttgaatgtgttttaaaggctaattatcagctcagtagagcagtgagaaactgatcaaattgcacttgttctcctacaagcaacctccacgcagacacctcgtactgctacaggtgtgtcatttcctttaataggaccagggaccatgtaactgaggtgagggttgtagtagatgcttccagtgtcagtatgcctgttaattttaagagcttccctttcttgcagagaacaagtctgcccagattccatgctttctataactggaggacctggcaaacctgccgcatgctgcacacatctacctacgtacacatatacaatagtattgatgattctgaacaataacagggtaaaacagttggtttgccattgttaaaaactgatttacagtaacttacaacaactgtacttttgttggattagcaaatcatgtgtttaaacaaatcccatatgttgggcaacagttcaaataagcacggagaagtgttgcccaaacttggttctctgactcttatgtatttgtaaggctgggcttcaaaatcaaaacaaaaaccccaaaaacagcaggcaaatgctttttaactctgacaccgttgccataaatccctgatactcaaagtctaacaagaaagacatggaaaattagcagcccattttcagaaagatcaaaatgatctagggttctaattgcttttgcatcctattcttacaaagtgatgtcccaacagggaacagtaggagctggagtgggatctccaagtcccagtttgagtgtgggatgtgcttccagcagtgccttccctttatgaaagacatcacatggcatccagggccaggcaggcagcttgaggtgcctttacgagaaaaccgagctggggctgggagaggacagttattgacactgatgtgcaatgaagtgacaagatgagagcagaatcgtaagagctttgaatttgaagtgagtttttttccccccataagttatttattccttttttctgtgtaaatatatttattttactgtggagcgctaacatctggatcgtaacatgtgcagaatgtatggtaggaatgtattctcttgtaggaatgtaaatctgtattaaaagggggtccaagccaggcccccaggtcttctcattgtatgcacagtccgcattcatttttactcttctctaatatgggtctatttgaaatatgcaaaaggtatgaggaatgttttaatacctccaaatttttaagaaaagcatcaaagggttgatattttttaaagtttttttagtagcactttctctggatgacagaaggggcaaccacatgggcacccttgttcataccaaagggtgagcagtggccagagcctcctctgcacctctcgagtgtctttaccaattgagctttttatcgccatagccccttggagtgccccagctgccctgaggtcaatcaaggaaaatttcttaatgaaataagctccaaagagccaaagtatcaacttacagatcgtttttaaagcttaaatttatgaaccacctttgtggtaaacaatgaattatgaataccgcagggcagccttcttaaatgacaaatgtaaaaaaaaaaaaaaaaggactctacttcgtgcagcaattgctactctatacgaattgtcttaatttgaaaaccttgctgttacaaattggacctttatacattttctgaaaacaatgaaaagagtatatttaaccttttctggctgtaaatggttaccttcctgtaactgccccgcacctggaggcatggagttgtgtgcatcctgcttatgtacaattgttttcagtgtttctaagaatgagtctgaatggttcttgaaaattagccaggatcaaatgctattgcagacaaagccaataaaaagttggacttcttttggggataacaagttttggaagagaaatgcaggccatatgtgcgcatgaccgagattttgaaaaaagatgtacatagtgacatgtttggtgcatggtttttgaggagggcttttgtcaaaaaggaggtataacctttcccccacagacctgagagctgtgccttttctatgcaatattacagacgttacatcggaacccagatggctgtattcacatgtaggtttgggctgtaatctaaacaattggacagattaaatgtacatggaaatgagcagtcttacttttgtagttttatattatacaataaacagttaaaagatgaaaaaaaaatg

SEQ ID NO: 448253 - DNA, 5502 bp, Homo sapiens
ctcctgcacggcgagtgctggagcacgagctaccgctcgctcggtcagggcgccccctccgcccgcctcctgcttcctcctccgctgcctgccgccgccgcctccaccattgtataatgctcggggcgcgcaggcagagaacggcggagtcttagcttcagcctcgcctgctgcccgctccccggcgccaccctcgggcccctggagcggggcactccgcatggagcgggagtagctgaggagtgggcggaaacccctcctgatgcgttagttcccaggtggagctgcatgtgatatatgttgggtaaaggaggaaaacggaagtttgatgagcatgaagatgggctggaaggcaaaatcgtgtctccctgtgacggtccatccaaggtgtcttacaccttacagcgccagactatcttcaacatttcccttatgaaactctataaccacaggcccctgacagagcccagcttgcaaaagaccgttttaattaacaacatgttgaggcggatccaggaggaactcaaacaggaaggcagcctgaggcccatgttcaccccctcctcccagcccaccaccgagcccagcgacagctaccgagaggccccgccggccttcagccacctggcgtccccgtcctcccacccctgcgacctcggaagcactacgcccctggaggcctgcctcaccccggcctcactgctcgaggacgacgatgacacgttttgcacctcccaggccatgcagcccacggctcccaccaaactgtcacctccagccctcttgccagaaaaggacagtttctcctctgccttggacgagatcgaggagctctgtcccacatctacctccacagaggcggccacggctgcgactgacagtgtgaaagggacctccagcgaggctggcacccagaaactcgacggtcctcaagagagccgcgcagatgactcaaaactgatggactctctgcctgggaattttgaaataacgacgtccacgggtttcctgacagacttgaccctggatgacatcctgtttgctgacattgatacgtccatgtatgattttgacccctgcacttcctcatcagggacagcctcaaaaatggcccctgtgtctgccgacgacctcctcaaaactctggctccttacagcagtcagcctgtcaccccaagtcagcctttcaaaatggacctcacagagctggaccacatcatggaggtgcttgttgggtcctaagacccagggacccagcgactatgcccacccagaccccagagcgttcccataaccctgacagttctccacactgtgcatgcacccttgcttgcctttttcagagaaaaagaaaattttacaacaggatcacactagtttttgctttgagcagagttggagtgccttcatccaagtatgaccacttttaatacacttttttgagtggttcctcagagacctactaccctggtataggaaagaatccatttgaagacaatgttgcaatgttgaatgacaaaaataaacagttcaagtgaagcacaaggattaagttggaaaagctgtaaattgcatgtgcatatttgtctattttttctataagttttattgcaagaggtaaagaagaaaactatatatatatatcttatttagataatctcagtaccttttctggcatttttgccctgtataggttgacttggcaattcggcctttttagaggcattaactactcctcgtaagtgttgcatttacatggctgtttagaaaactgctgcccaaatttattttatatttttgtacagattctgcagtttatgatattgtttttctaaaaacaaatgctgtttatacatatgagatagctattttgataggatttgctcacatagttcctgcaaacttcagatgtacaagttgcacttgtacttttatagagttgtaatgttttatatgtgtatggtgcaagagaaaattggatcaaatcaatctgcagttgatgtccccaaatgcaaacacaggcacacacatgcacacacccataaacacacacacagtgctttaagaaagggccaggtgatatcacacccaaatttcacaagcactgaccccctggcaccaacacccgccagtactgtgacttccaaagccagagccacatgtgctcatcaaacttgcattaagcagttggcgggagatggctgtggagctgggggtttaagtgatggttctcttttgctccctcttttgagggtaaagctactgtctttcttaagagtgtatttatgccaagtttgcgcttttaattgtttttattttgttttttaatgaaaacccagatctttcctttttggcataatttttatgatgacctgaaattttacatccgaacaaaattttacatccgaaaagcaaccaacttcttcatggaactcagccctgttgcaatgcttagggcccttaaagaagaaaatctccccagaaggcatccatcatgttgcttaattgtcttctgcagcttcctttccctagagctttccctgtgttgctaagagctgaaaatggcatcttcgtgatcaccacagtgagcttggctcgcctcggccggcccgggatgcactcttacaacatgtgtgactcttgaacctggagttcatcacattacgtcacagcttcccatctggttgctttcctgagtcagctacttcacacttgtcaaggctgttttaccccaaaactcagacaggactttctatgcatgttttccctcctccccccaattccccccccatcaccttatctcccaggacacacttgagaagtagctttttattcctagtggtgtacatttaattttaaaaaggttgcaatgtatcatgcttgttgccgaaactgtttatggccttcttgtttcagttttttcttttcttccaatggtactttagctgttgagtgcaggttacaacctatattgttatgcagatggcttctttaggaataacttttatatttatttaaaaatttttaaattatgggatgttttgttgttgttgttgtctttgttgttggtcatttgtcaatattcagtcaccaattctgctcacttcttgccatggataaaattgggtctttctggctaattaaaaaagacaactttataaaatggcactttaagcaagccatagttagttttatttttgtaatgcacatggcaaagcaaagacgtttgtgatgaaggaactgctcatctaagcaaaagatttgagtatgatatgataaaggctttctacattctaatttactttttccccccacttgaatgtgttttaaaggctaattatcagctcagtagagcagtgagaaactgatcaaattgcacttgttctcctacaagcaacctccacgcagacacctcgtactgctacaggtgtgtcatttcctttaataggaccagggaccatgtaactgaggtgagggttgtagtagatgcttccagtgtcagtatgcctgttaattttaagagcttccctttcttgcagagaacaagtctgcccagattccatgctttctataactggaggacctggcaaacctgccgcatgctgcacacatctacctacgtacacatatacaatagtattgatgattctgaacaataacagggtaaaacagttggtttgccattgttaaaaactgatttacagtaacttacaacaactgtacttttgttggattagcaaatcatgtgtttaaacaaatcccatatgttgggcaacagttcaaataagcacggagaagtgttgcccaaacttggttctctgactcttatgtatttgtaaggctgggcttcaaaatcaaaacaaaaaccccaaaaacagcaggcaaatgctttttaactctgacaccgttgccataaatccctgatactcaaagtctaacaagaaagacatggaaaattagcagcccattttcagaaagatcccaacagggaacagtaggagctggagtgggatctccaagtcccagtttgagtgtgggatgtgcttccagcagtgccttccctttatgaaagacatcacatggcatccagggccaggcaggcagcttgaggtgcctttacgagaaaaccgagctggggctgggagaggacagttattgacactgatgtgcaatgaagtgacaagatgagagcagaatcgtaagagctttgaatttgaagtgagtttttttccccccataagttatttattccttttttctgtgtaaatatatttattttactgtggagcgctaacatctggatcgtaacatgtgcagaatgtatggtaggaatgtattctcttgtaggaatgtaaatctgtattaaaagggggtccaagccaggcccccaggtcttctcattgtatgcacagtccgcattcatttttactcttctctaatatgggtctatttgaaatatgcaaaaggtatgaggaatgttttaatacctccaaatttttaagaaaagcatcaaagggttgatattttttaaagtttttttagtagcactttctctggatgacagaaggggcaaccacatgggcacccttgttcataccaaagggtgagcagtggccagagcctcctctgcacctctcgagtgtctttaccaattgagctttttatcgccatagccccttggagtgccccagctgccctgaggtcaatcaaggaaaatttcttaatgaaataagctccaaagagccaaagtatcaacttacagatcgtttttaaagcttaaatttatgaaccacctttgtggtaaacaatgaattatgaataccgcagggcagccttcttaaatgacaaatgtaaaaaaaaaaaaaaaaggactctacttcgtgcagcaattgctactctatacgaattgtcttaatttgaaaaccttgctgttacaaattggacctttatacattttctgaaaacaatgaaaagagtatatttaaccttttctggctgtaaatggttaccttcctgtaactgccccgcacctggaggcatggagttgtgtgcatcctgcttatgtacaattgttttcagtgtttctaagaatgagtctgaatggttcttgaaaattagccaggatcaaatgctattgcagacaaagccaataaaaagttggacttcttttggggataacaagttttggaagagaaatgcaggccatatgtgcgcatgaccgagattttgaaaaaagatgtacatagtgacatgtttggtgcatggtttttgaggagggcttttgtcaaaaaggaggtataacctttcccccacagacctgagagctgtgccttttctatgcaatattacagacgttacatcggaacccagatggctgtattcacatgtaggtttgggctgtaatctaaacaattggacagattaaatgtacatggaaatgagcagtcttacttttgtagttttatattatacaataaacagttaaaagatgaaaaaaaaatg

SEQ ID NO: 448254 - DNA, 4926 bp, Homo sapiens
atcggtaccatcaatatcacacaatactgagatgatctaagaaggttataacaaaatgctcttcagaaatacctaagtgctgagaatttttagtactaaagagcacagctgctcaaagtaaagcctgagcagtgttctcagtaatgtatttgaaggaaaaataccctgatttgaaaccaacagcagatgttgcaaactttcataccactgctggccatggaagcctcttaacaacacactgtcatttaaggctgtgcttgtgctttatacaaagagaaagaggtggtcttaaggggatgcttccaggggggtgagttcatgcctctcctgtattttccagcaagtggggtattgtggtggtattgttttttagaggggcataataatccaggattctaagcatatgctcagctattttaaagaggaaattaaatattataaaagaaatagtaaagataagttatcctcacttaggcaaaagcacaggtcctttccatatcaagtttagcctaccagggttgttttttgttttaaccctgcttaataatgttggtgttttagaagtagatacaggcactgctctgaaaacctggctagccaaggatattctcagaatgttatcacctgtttgtcaaagcttgtttaaattataaaacacttttaattatatatatgaggcaaaagaactaagacttttttcaaactaaattagaaaggagtgtcattatttgactgttaaaccaaaatatttttggtgggtctttttatggaagtttaaagaaaggacatcatcatagatatgatctaacagtatttctaactatatttgatcattaaaagcctcttggaatttgaagcgtgacgtgtttctaatgccccttgagaggtgaaaaataccacataatgatcagtatgctgtgccagcttcatttggggagaaataactagtagaaagttctgggtgtgaggtgtacagcagtctaggtggcatagtgatgaagaaagggatcagagtctgactgtcactcagaatcctgggctcagttgcttgacaaccttgggaaaattgttttatctttgtgcgtctgtttgctgatcttcagcgtgggaataataacagtacctacttgaaaggatcattgtgcggattaaaagaaataatatatgtaaagcactttaacacagcaccaggcccacggaaagtggctaatgttagctactatgaatggtgccagtgaagacactgaaaaataagtgatttcagtaaccttctggaaagctatcagtttcaaataatattttctctgtagtatgagatgaaattaaaagtggatagctttcaggaaagataaagagaacatgcttagaatgtaagctaaacagattttttctgttgctctttgaaaactatgagccctggccagcttaacctggtctgaggtgagactaaacacaaaaacagtagataaatctctccctaaaagatggattcccccacatacccatgctactagtttctctgtctattcacacatatgtacaaatacatgaacacagcctgtctgtgctcagacatagagaagtactacctgacttgagtcaatgcacccaagaagaaaagcttggagtagagcagaagggagggcttgggactcctgtcctttccagcatgccctggggtgcagtggtcagccacctgaagagagagccaatagcatggggtttacaaggcaaagatagtcattcattcaacacatattcatagagctccttctctgtgccagacactgttctggaagatagctagatgaaaatctttgcactcacagagcttacatgccagtgagtgaagatcgatgataaataaagcaaatgcatcatatgttcacatttgataagtatatgccaaaaaatgaagccgggaaggaggacaaggcccatgggtgggtgttgaggtttttaaagtgtggtcaggaaaggccccactgataaggtaacatttgagcaagtctgaaaaaggcaaggggatctttggggctaacttcgggatccctgcactttatgtaagaatgtaaacctggagtctcatttaagaatgatcagcaatacgtttagaacatatgaactgaatgaaatggacattttttcttaatttacgtataaatccatatgattatacataaagttctgatgcattaataaaagcagccaaatagggccaaagagaaaaataacaggactctgtactggacctaactttatcattaattaggtaatattttcctcatttctttactgctgccattttcctcaccagtattccagagatggtcatagctcattactctaccaccaagaacctaaaaggaattagaatacagcagaattggcctcagtgaagagcttaaaattgttctcctcgtagaactggactattgatcattaccacgtgacgttggctctattactttctgttcccaatgtccttctagtggtttgaaaatgttaaaacatccctaaaatctaaatcatataatcagaattctatagtgtcccactctatctgtaaagatcatttggaagactttagactctattaattttaaaaggaatatttattagccatatgcagaatttctaatgatgatattgtacagcttctaattcacttttcagatcagtgtttgaaatggcaattatcagtgttggatttagttccaactacttgatttacaaaaatgtacatttagagaaggttaaaagaaacagtgagaaatgtaaacattcaaaatgataattgaatctctcagttgtgggaataattatcagagacatgcaactgaaaatgtctcacctttcatctttttttcttaattcataaagttatcttgtagaatttgatgagaccctcctagtcattctcaactggggcggtgctgtcaccgaatggtgtttgagagtgttggggctagggcacatttttggttgtcacagcaactggggtggcatttgctgcccagtgccaggaatagtaacattatgaatgccagggacagtgtgctcagtaaagtcttccatccaaaaggggcagggcacggtggctcacgcctgtaatcccagcactttgggaggccaaggtgggcggatcacctgatgtcaggggttcgagaccagcctggccaacatggtgaaaccctgttgctactaaaaatacaaaaattggctgggtgtggtgtcacatgccagtaaccccagctactagggaggctgaggcaggagaatcacttgaacccgggaggcagaggttgcagtgagctgagattgcaccactacactccagcctggatgacagagtgagacttcatctcaaaaaaaaaaaaaaaaaaccaaaaaaaaacaacccggtagcattgtcccttccccactgacaaacttatcaaatccagaagctttagagtttcgtctctaattatttttctcctgaacaaaattacccaagtcaaaacaaaatgtatttttagaattacggcagcatacgacctgaattttgtgagtttcgtggctttatcttaaatcaccatttccctaaaaatggtttctttctccttagaaatgctggtggcaacttgatgaaacagccaaatgcaccagggcaggtcactttcccattacactgattccacaattaaaaaaaaaaaaagaaaaaaaactcattgagatagctacagttctataggttaatttaaagcctcctttttctactcatttttgaaagcaaaattacattttactattttacataaccagtgaaaagacgttgaaagcctacagctcactgtttttggtgctctggaaatgttgagggtgggtttttaaccagtgatttttaacgtgcagtgaatttgttagacttttaaacaccagctaaggtagtcaaacttgatccccattaaaaatcaaggaattaggggtcgggggagggtttaggagtgatccagaatgacctcccagaattactgtgcgtacaactttatttttcagagttttcattggaatggtaagagttttatgaaagacagttttaaaacttattctgagttaaatattaatactttaaaaaattattgtactagacttatcgcagccttttgaaagtagcagagtttcatcataccacatatataacagagcataaattttctataatcaggcaccttttgctgcttttgagtaagactgttttcctgtttaagtgttaagcatcgccagacataaaaatctattctctcctctcgattgtagcatagcctgacagctctagatacagcatttctatgatgaaaaatgagtatccatcaggaaatctagaagactagccgtgttttctcagactccacctttgtttgcactctgttgcctgtgaggagctttctggcatgtgattatttacttcaaaactagagttccaagcacctacattaattattttatattgtgtgcagaatagtatatcttttaatgtcagatatgatacactgcacatattgcttttgcactcttaaaatttttgtactaaataatagaaaatatttatattctttgagtgtgagctttgaatagatggcattatcactttattgtttttttaacaaaaactttttctcaattattctattgcaatgttattctgagcaagtcctatgccaaatatcttgtataatgtttgtatggaagattaaattttactcttgtgtggtaagactatttcagttactgattttatagttggaatttgatattccagcacaaagtccacagtgtattcagaaatccaagttggtgtcatacatttcattttgatgtgaacttttctttgctttcctttgttctaagactccattttgcaataaacgttttgacagtaaa

SEQ ID NO: 448255 - DNA, 4850 bp, Homo sapiens
atcggtaccatcaatatcacacaatactgagatgatctaagaaggttataacaaaatgctcttcagaaatacctaagtgctgagaatttttagtactaaagagcacagctgctcaaagtaaagcctgagcagtgttctcagtaatgtatttgaaggaaaaataccctgatttgaaaccaacagcagatgttgcaaactttcataccactgctggccatggaagcctcttaacaacacactgtcatttaaggctgtgcttgtgctttatacaaagagaaagaggtggtcttaaggggatgcttccaggggggtgagttcatgcctctcctgtattttccagcaagtggggtattgtggtggtattgttttttagaggggcataataatccaggattctaagcatatgctcagctattttaaagaggaaattaaatattataaaagaaatagtaaagataagttatcctcacttaggcaaaagcacaggtcctttccatatcaagtttagcctaccagggttgttttttgttttaaccctgcttaataatgttggtgttttagaagtagatacaggcactgctctgaaaacctggctagccaaggatattctcagaatgttatcacctgtttgtcaaagcttgtttaaattataaaacacttttaattatatatatgaggcaaaagaactaagacttttttcaaactaaattagaaaggagtgtcattatttgactgttaaaccaaaatatttttggtgggtctttttatggaagtttaaagaaaggacatcatcatagatatgatctaacagtatttctaactatatttgatcattaaaagcctcttggaatttgaagcgtgacgtgtttctaatgccccttgagaggtgaaaaataccacataatgatcagtatgctgtgccagcttcatttggggagaaataactagtagaaagttctgggtgtgaggtgtacagcagtctaggtggcatagtgatgaagaaagggatcagagtctgactgtcactcagaatcctgggctcagttgcttgacaaccttgggaaaattgttttatctttgtgcgtctgtttgctgatcttcagcgtgggaataataacagtacctacttgaaaggatcattgtgcggattaaaagaaataatatatgtaaagcactttaacacagcaccaggcccacggaaagtggctaatgttagctactatgaatggtgccagtgaagacactgaaaaataagtgatttcagtaaccttctggaaagctatcagtttcaaataatattttctctgtagtatgagatgaaattaaaagtggatagctttcaggaaagataaagagaacatgcttagaatgtaagctaaacagattttttctgttgctctttgaaaactatgagccctggccagcttaacctggtctgaggtgagactaaacacaaaaacagtagataaatctctccctaaaagatggattcccccacatacccatgctactagtttctctgtctattcacacatatgtacaaatacatgaacacagcctgtctgtgctcagacatagagaagtactacctgacttgagtcaatgcacccaagaagaaaagcttggagtagagcagaagggagggcttgggactcctgtcctttccagcatgccctggggtgcagtggtcagccacctgaagagagagccaatagcatggggtttacaaggcaaagatagtcattcattcaacacatattcatagagctccttctctgtgccagacactgttctggaagatagctagatgaaaatctttgcactcacagagcttacatgccagtgagtgaagatcgatgataaataaagcaaatgcatcatatgttcacatttgataagtatatgccaaaaaatgaagccgggaaggaggacaaggcccatgggtgggtgttgaggtttttaaagtgtggtcaggaaaggccccactgataaggtaacatttgagcaagtctgaaaaaggcaaggggatctttggggctaacttcgggatccctgcactttatgtaagaatgtaaacctggagtctcatttaagaatgatcagcaatacgtttagaacatatgaactgaatgaaatggacattttttcttaatttacgtataaatccatatgattatacataaagttctgatgcattaataaaagcagccaaatagggccaaagagaaaaataacaggactctgtactggacctaactttatcatttactctaccaccaagaacctaaaaggaattagaatacagcagaattggcctcagtgaagagcttaaaattgttctcctcgtagaactggactattgatcattaccacgtgacgttggctctattactttctgttcccaatgtccttctagtggtttgaaaatgttaaaacatccctaaaatctaaatcatataatcagaattctatagtgtcccactctatctgtaaagatcatttggaagactttagactctattaattttaaaaggaatatttattagccatatgcagaatttctaatgatgatattgtacagcttctaattcacttttcagatcagtgtttgaaatggcaattatcagtgttggatttagttccaactacttgatttacaaaaatgtacatttagagaaggttaaaagaaacagtgagaaatgtaaacattcaaaatgataattgaatctctcagttgtgggaataattatcagagacatgcaactgaaaatgtctcacctttcatctttttttcttaattcataaagttatcttgtagaatttgatgagaccctcctagtcattctcaactggggcggtgctgtcaccgaatggtgtttgagagtgttggggctagggcacatttttggttgtcacagcaactggggtggcatttgctgcccagtgccaggaatagtaacattatgaatgccagggacagtgtgctcagtaaagtcttccatccaaaaggggcagggcacggtggctcacgcctgtaatcccagcactttgggaggccaaggtgggcggatcacctgatgtcaggggttcgagaccagcctggccaacatggtgaaaccctgttgctactaaaaatacaaaaattggctgggtgtggtgtcacatgccagtaaccccagctactagggaggctgaggcaggagaatcacttgaacccgggaggcagaggttgcagtgagctgagattgcaccactacactccagcctggatgacagagtgagacttcatctcaaaaaaaaaaaaaaaaaaccaaaaaaaaacaacccggtagcattgtcccttccccactgacaaacttatcaaatccagaagctttagagtttcgtctctaattatttttctcctgaacaaaattacccaagtcaaaacaaaatgtatttttagaattacggcagcatacgacctgaattttgtgagtttcgtggctttatcttaaatcaccatttccctaaaaatggtttctttctccttagaaatgctggtggcaacttgatgaaacagccaaatgcaccagggcaggtcactttcccattacactgattccacaattaaaaaaaaaaaaagaaaaaaaactcattgagatagctacagttctataggttaatttaaagcctcctttttctactcatttttgaaagcaaaattacattttactattttacataaccagtgaaaagacgttgaaagcctacagctcactgtttttggtgctctggaaatgttgagggtgggtttttaaccagtgatttttaacgtgcagtgaatttgttagacttttaaacaccagctaaggtagtcaaacttgatccccattaaaaatcaaggaattaggggtcgggggagggtttaggagtgatccagaatgacctcccagaattactgtgcgtacaactttatttttcagagttttcattggaatggtaagagttttatgaaagacagttttaaaacttattctgagttaaatattaatactttaaaaaattattgtactagacttatcgcagccttttgaaagtagcagagtttcatcataccacatatataacagagcataaattttctataatcaggcaccttttgctgcttttgagtaagactgttttcctgtttaagtgttaagcatcgccagacataaaaatctattctctcctctcgattgtagcatagcctgacagctctagatacagcatttctatgatgaaaaatgagtatccatcaggaaatctagaagactagccgtgttttctcagactccacctttgtttgcactctgttgcctgtgaggagctttctggcatgtgattatttacttcaaaactagagttccaagcacctacattaattattttatattgtgtgcagaatagtatatcttttaatgtcagatatgatacactgcacatattgcttttgcactcttaaaatttttgtactaaataatagaaaatatttatattctttgagtgtgagctttgaatagatggcattatcactttattgtttttttaacaaaaactttttctcaattattctattgcaatgttattctgagcaagtcctatgccaaatatcttgtataatgtttgtatggaagattaaattttactcttgtgtggtaagactatttcagttactgattttatagttggaatttgatattccagcacaaagtccacagtgtattcagaaatccaagttggtgtcatacatttcattttgatgtgaacttttctttgctttcctttgttctaagactccattttgcaataaacgttttgacagtaaa

SEQ ID NO: 448256 - DNA, 5130 bp, Homo sapiens
atcggtaccatcaatatcacacaatactgagatgatctaagaaggttataacaaaatgctcttcagaaatacctaagtgctgagaatttttagtactaaagagcacagctgctcaaagtaaagcctgagcagtgttctcagtaatgtatttgaaggaaaaataccctgatttgaaaccaacagcagatgttgcaaactttcataccactgctggccatggaagcctcttaacaacacactgtcatttaaggctgtgcttgtgctttatacaaagagaaagaggtggtcttaaggggatgcttccaggggggtgagttcatgcctctcctgtattttccagcaagtggggtattgtggtggtattgttttttagaggggcataataatccaggattctaagcatatgctcagctattttaaagaggaaattaaatattataaaagaaatagtaaagataagttatcctcacttaggcaaaagcacaggtcctttccatatcaagtttagcctaccagggttgttttttgttttaaccctgcttaataatgttggtgttttagaagtagatacaggcactgctctgaaaacctggctagccaaggatattctcagaatgttatcacctgtttgtcaaagcttgtttaaattataaaacacttttaattatatatatgaggcaaaagaactaagacttttttcaaactaaattagaaaggagtgtcattatttgactgttaaaccaaaatatttttggtgggtctttttatggaagtttaaagaaaggacatcatcatagatatgatctaacagtatttctaactatatttgatcattaaaagcctcttggaatttgaagcgtgacgtgtttctaatgccccttgagaggtgaaaaataccacataatgatcagtatgctgtgccagcttcatttggggagaaataactagtagaaagttctgggtgtgaggtgtacagcagtctaggtggcatagtgatgaagaaagggatcagagtctgactgtcactcagaatcctgggctcagttgcttgacaaccttgggaaaattgttttatctttgtgcgtctgtttgctgatcttcagcgtgggaataataacagtacctacttgaaaggatcattgtgcggattaaaagaaataatatatgtaaagcactttaacacagcaccaggcccacggaaagtggctaatgttagctactatgaatggtgccagtgaagacactgaaaaataagtgatttcagtaaccttctggaaagctatcagtttcaaataatattttctctgtagtatgagatgaaattaaaagtggatagctttcaggaaagataaagagaacatgcttagaatgtaagctaaacagattttttctgttgctctttgaaaactatgagccctggccagcttaacctggtctgaggtgagactaaacacaaaaacagtagataaatctctccctaaaagatggattcccccacatacccatgctactagtttctctgtctattcacacatatgtacaaatacatgaacacagcctgtctgtgctcagacatagagaagtactacctgacttgagtcaatgcacccaagaagaaaagcttggagtagagcagaagggagggcttgggactcctgtcctttccagcatgccctggggtgcagtggtcagccacctgaagagagagccaatagcatggggtttacaaggcaaagatagtcattcattcaacacatattcatagagctccttctctgtgccagacactgttctggaagatagctagatgaaaatctttgcactcacagagcttacatgccagtgagtgaagatcgatgataaataaagcaaatgcatcatatgttcacatttgataagtatatgccaaaaaatgaagccgggaaggaggacaaggcccatgggtgggtgttgaggtttttaaagtgtggtcaggaaaggccccactgataaggtaacatttgagcaagtctgaaaaaggcaaggggatctttggggctaacttcgggatccctgcactttatgtaagaatgtaaacctggagtctcatttaagaatgatcagcaatacgtttagaacatatgaactgaatgaaatggacattttttcttaatttacgtataaatccatatgattatacataaagttctgatgcattaataaaagcagccaaatagggccaaagagaaaaataacaggactctgtactggacctaactttatcattaattaggtaatattttcctcatttctttactgctgccattttcctcaccagtattccagagatggtcatagctcattactctaccaccaagaacctaaaaggaattagaatacagcagaattggcctcagtgaagagcttaaaattgttctcctcgtagaactggactattgatcattaccacgtgacgttggctctattactttctgttcccaatgtccttctagtggtttgaaaatgttaaaacatccctaaaatctaaatcatataatcagaattctatagtgtcccactctatctgtaaagatcatttggaagactttagactctattaattttaaaaggaatatttattagccatatgcagaatttctaatgatgatattgtacagcttctaattcacttttcagatcagtgtttgaaatggcaattatcagtgttggatttagttccaactacttgatttacaaaaatgtacatttagagaaggttaaaagaaacagtgagaaatgtaaacattcaaaatgataattgaatctctcagttgtgggaataattatcagagacatgcaactgaaaatgtctcacctttcatctttttttcttaattcataaagttatcttgtagaatttgatgagaccctcctagtcattctcaactggggcggtgctgtcaccgaatggtgtttgagagtgttggggctagggcacatttttggttgtcacagcaactggggtggcatttgctgcccagtgccaggaatagtaacattatgaatgccagggacagtgtgctcagtaaagtcttccatccaaaaggggcagggcacggtggctcacgcctgtaatcccagcactttgggaggccaaggtgggcggatcacctgatgtcaggggttcgagaccagcctggccaacatggtgaaaccctgttgctactaaaaatacaaaaattggctgggtgtggtgtcacatgccagtaaccccagctactagggaggctgaggcaggagaatcacttgaacccgggaggcagaggttgcagtgagctgagattgcaccactacactccagcctggatgacagagtgagacttcatctcaaaaaaaaaaaaaaaaaaccaaaaaaaaacaacccggtagcattgtcccttccccactgacaaacttatcaaatccagaagctttagagtttcgtctctaattatttttctcctgaacaaaattacccaagtcaaaacaaaatgtatttttagaattacggcagcatacgacctgaattttgtgagtttcgtggctttatcttaaatcaccatttccctaaaaatggtttctttctccttagaaatgctggtggcaacttgatgaaacagccaaatgcaccagggcaggtcactttcccattacactgattccacaattaaaaaaaaaaaaagaaaaaaaactcattgagatagctacagttctataggttaatttaaagcctcctttttctactcatttttgaaagcaaaattacattttactattttacataaccagtgaaaagacgttgaaagcctacagctcactgtttttggtgctctggaaatgttgagggtgggtttttaaccagtgatttttaacgtgcagtgaatttgttagacttttaaacaccagctaaggtagtcaaacttgatccccattaaaaatcaaggaattaggggtcgggggagggtttaggagtgatccagaatgacctcccagaattactgtgcgtacaactttatttttcagagttttcattggaatggtaagagttttatgaaagacagttttaaaacttattctgagttaaatattaatactttaaaaaattattgtactagacttatcgcagccttttgaaagtagcagagtttcatcataccacatatataacagagcataaattttctataatcaggcaccttttgctgcttttgagtaagactgttttcctgtttaagtgttaagcatcgccagacataaaaatctattctctcctctcgattgtagcatagcctgacagctctagatacagcatttctatgatgaaaaatgagtatccatcaggaaatctagaagactagccgtgttttctcagactccacctttgtttgcactctgttgcctgtgaggagctttctggcatgtgattatttacttcaaaactagagttccaagcacctacattaattattttatattgtgtgcagaatagtatatcttttaatgtcagatatgatacactgcacatattgcttttgcactcttaaaatttttgtactaaataatagaaaatatttatattctttgagtgtgagctttgaatagatggcattatcactttattgtttttttaacaaaaactttttctcaattattctattgcaatgttattctgagcaagtcctatgccaaatatcttgtataatgtttgtatggaagattaaattttactcttgtgtggtaagactatttcagttactgattttatagttggaatttgatattccagcacaaagtccacagtgtattcagaaatccaagttggtgtcatacatttcattttgatgtgaacttttctttgctttcctttgttctaagactccattttgcaataaacgttttgacagtaaaaaaaaaaaaaaaagaaaaaaaaactcattgagatagctacagttctataggttaatttaaagcctccttattctactcatttttgaaagcaaaattacattgtactattttacataatccagtgaaaagacgttgaagcctacagctcactgttttttgtacaggaaggttgtaggggggatcctgctagagcgacctctagca

SEQ ID NO: 448257 - DNA, 4383 bp, Homo sapiens
atcggtaccatcaatatcacacaatactgagatgatctaagaaggttataacaaaatgctcttcagaaatacctaagtgctgagaatttttagtactaaagagcacagctgctcaaagtaaagcctgagcagtgttctcagtaatgtatttgaaggaaaaataccctgatttgaaaccaacagcagatgttgcaaactttcataccactgctggccatggaagcctcttaacaacacactgtcatttaaggctgtgcttgtgctttatacaaagagaaagaggtggtcttaaggggatgcttccaggggggtgagttcatgcctctcctgtattttccagcaagtggggtattgtggtggtattgttttttagaggggcataataatccaggattctaagcatatgctcagctattttaaagaggaaattaaatattataaaagaaatagtaaagataagttatcctcacttaggcaaaagcacaggtcctttccatatcaagtttagcctaccagggttgttttttgttttaaccctgcttaataatgttggtgttttagaagtagatacaggcactgctctgaaaacctggctagccaaggatattctcagaatgttatcacctgtttgtcaaagcttgtttaaattataaaacacttttaattatatatatgaggcaaaagaactaagacttttttcaaactaaattagaaaggagtgtcattatttgactgttaaaccaaaatatttttggtgggtctttttatggaagtttaaagaaaggacatcatcatagatatgatctaacagtatttctaactatatttgatcattaaaagcctcttggaatttgaagcgtgacgtgtttctaatgccccttgagaggtgaaaaataccacataatgatcagtatgctgtgccagcttcatttggggagaaataactagtagaaagttctgggtgtgaggtgtacagcagtctaggtggcatagtgatgaagaaagggatcagagtctgactgtcactcagaatcctgggctcagttgcttgacaaccttgggaaaattgttttatctttgtgcgtctgtttgctgatcttcagcgtgggaataataacagtacctacttgaaaggatcattgtgcggattaaaagaaataatatatgtaaagcactttaacacagcaccaggcccacggaaagtggctaatgttagctactatgaatggtgccagtgaagacactgaaaaataagtgatttcagtaaccttctggaaagctatcagtttcaaataatattttctctgtagtatgagatgaaattaaaagtggatagctttcaggaaagataaagagaacatgcttagaatgtaagctaaacagattttttctgttgctctttgaaaactatgagccctggccagcttaacctggtctgaggtgagactaaacacaaaaacagtagataaatctctccctaaaagatggattcccccacatacccatgctactagtttctctgtctattcacacatatgtacaaatacatgaacacagcctgtctgtgctcagacatagagaagtactacctgacttgagtcaatgcacccaagaagaaaagcttggagtagagcagaagggagggcttgggactcctgtcctttccagcatgccctggggtgcagtggtcagccacctgaagagagagccaatagcatggggtttacaaggcaaagatagtcattcattcaacacatattcatagagctccttctctgtgccagacactgttctggaagatagctagatgaaaatctttgcactcacagagcttacatgccagtgagtgaagatcgatgataaataaagcaaatgcatcatatgttcacatttgataagtatatgccaaaaaatgaagccgggaaggaggacaaggcccatgggtgggtgttgaggtttttaaagtgtggtcaggaaaggccccactgataaggtaacatttgagcaagtctgaaaaaggcaaggggatctttggggctaacttcgggatccctgcactttatgtaagaatgtaaacctggagtctcatttaagaatgatcagcaatacgtttagaacatatgaactgaatgaaatggacattttttcttaatttacgtataaatccatatgattatacataaagttctgatgcattaataaaagcagccaaatagggccaaagagaaaaataacaggactctgtactggacctaactttatcattaattaggtaatattttcctcatttctttactgctgccattttcctcaccagtattccagagatggtcatagctcattactctaccaccaagaacctaaaaggaattagaatacagcagaattggcctcagtgaagagcttaaaattgttctcctcgtagaactggactattgatcattaccacgtgacgttggctctattactttctgttcccaatgtccttctagtggtttgaaaatgttaaaacatccctaaaatctaaatcatataatcagaattctatagtgtcccactctatctgtaaagatcatttggaagactttagactctattaattttaaaaggaatatttattagccatatgcagaatttctaatgatgatattgtacagcttctaattcacttttcagatcagtgtttgaaatggcaattatcagtgttggatttagttccaactacttgatttacaaaaatgtacatttagagaaggttaaaagaaacatgagctgagattgcaccactacactccagcctggatgacagagtgagacttcatctcaaaaaaaaaaaaaaaaaaccaaaaaaaaacaacccggtagcattgtcccttccccactgacaaacttatcaaatccagaagctttagagtttcgtctctaattatttttctcctgaacaaaattacccaagtcaaaacaaaatgtatttttagaattacggcagcatacgacctgaattttgtgagtttcgtggctttatcttaaatcaccatttccctaaaaatggtttctttctccttagaaatgctggtggcaacttgatgaaacagccaaatgcaccagggcaggtcactttcccattacactgattccacaattaaaaaaaaaaaaagaaaaaaaactcattgagatagctacagttctataggttaatttaaagcctcctttttctactcatttttgaaagcaaaattacattttactattttacataaccagtgaaaagacgttgaaagcctacagctcactgtttttggtgctctggaaatgttgagggtgggtttttaaccagtgatttttaacgtgcagtgaatttgttagacttttaaacaccagctaaggtagtcaaacttgatccccattaaaaatcaaggaattaggggtcgggggagggtttaggagtgatccagaatgacctcccagaattactgtgcgtacaactttatttttcagagttttcattggaatggtaagagttttatgaaagacagttttaaaacttattctgagttaaatattaatactttaaaaaattattgtactagacttatcgcagccttttgaaagtagcagagtttcatcataccacatatataacagagcataaattttctataatcaggcaccttttgctgcttttgagtaagactgttttcctgtttaagtgttaagcatcgccagacataaaaatctattctctcctctcgattgtagcatagcctgacagctctagatacagcatttctatgatgaaaaatgagtatccatcaggaaatctagaagactagccgtgttttctcagactccacctttgtttgcactctgttgcctgtgaggagctttctggcatgtgattatttacttcaaaactagagttccaagcacctacattaattattttatattgtgtgcagaatagtatatcttttaatgtcagatatgatacactgcacatattgcttttgcactcttaaaatttttgtactaaataatagaaaatatttatattctttgagtgtgagctttgaatagatggcattatcactttattgtttttttaacaaaaactttttctcaattattctattgcaatgttattctgagcaagtcctatgccaaatatcttgtataatgtttgtatggaagattaaattttactcttgtgtggtaagactatttcagttactgattttatagttggaatttgatattccagcacaaagtccacagtgtattcagaaatccaagttggtgtcatacatttcattttgatgtgaacttttctttgctttcctttgttctaagactccattttgcaataaacgttttgacagtaaa

SEQ ID NO: 448258 - DNA, 4906 bp, Homo sapiens
tagagtatcccggtcatcttgctacacaagctgagatatctattccaagtggcaatgagaaaataatttttagtactaaagagcacagctgctcaaagtaaagcctgagcagtgttctcagtaatgtatttgaaggaaaaataccctgatttgaaaccaacagcagatgttgcaaactttcataccactgctggccatggaagcctcttaacaacacactgtcatttaaggctgtgcttgtgctttatacaaagagaaagaggtggtcttaaggggatgcttccaggggggtgagttcatgcctctcctgtattttccagcaagtggggtattgtggtggtattgttttttagaggggcataataatccaggattctaagcatatgctcagctattttaaagaggaaattaaatattataaaagaaatagtaaagataagttatcctcacttaggcaaaagcacaggtcctttccatatcaagtttagcctaccagggttgttttttgttttaaccctgcttaataatgttggtgttttagaagtagatacaggcactgctctgaaaacctggctagccaaggatattctcagaatgttatcacctgtttgtcaaagcttgtttaaattataaaacacttttaattatatatatgaggcaaaagaactaagacttttttcaaactaaattagaaaggagtgtcattatttgactgttaaaccaaaatatttttggtgggtctttttatggaagtttaaagaaaggacatcatcatagatatgatctaacagtatttctaactatatttgatcattaaaagcctcttggaatttgaagcgtgacgtgtttctaatgccccttgagaggtgaaaaataccacataatgatcagtatgctgtgccagcttcatttggggagaaataactagtagaaagttctgggtgtgaggtgtacagcagtctaggtggcatagtgatgaagaaagggatcagagtctgactgtcactcagaatcctgggctcagttgcttgacaaccttgggaaaattgttttatctttgtgcgtctgtttgctgatcttcagcgtgggaataataacagtacctacttgaaaggatcattgtgcggattaaaagaaataatatatgtaaagcactttaacacagcaccaggcccacggaaagtggctaatgttagctactatgaatggtgccagtgaagacactgaaaaataagtgatttcagtaaccttctggaaagctatcagtttcaaataatattttctctgtagtatgagatgaaattaaaagtggatagctttcaggaaagataaagagaacatgcttagaatgtaagctaaacagattttttctgttgctctttgaaaactatgagccctggccagcttaacctggtctgaggtgagactaaacacaaaaacagtagataaatctctccctaaaagatggattcccccacatacccatgctactagtttctctgtctattcacacatatgtacaaatacatgaacacagcctgtctgtgctcagacatagagaagtactacctgacttgagtcaatgcacccaagaagaaaagcttggagtagagcagaagggagggcttgggactcctgtcctttccagcatgccctggggtgcagtggtcagccacctgaagagagagccaatagcatggggtttacaaggcaaagatagtcattcattcaacacatattcatagagctccttctctgtgccagacactgttctggaagatagctagatgaaaatctttgcactcacagagcttacatgccagtgagtgaagatcgatgataaataaagcaaatgcatcatatgttcacatttgataagtatatgccaaaaaatgaagccgggaaggaggacaaggcccatgggtgggtgttgaggtttttaaagtgtggtcaggaaaggccccactgataaggtaacatttgagcaagtctgaaaaaggcaaggggatctttggggctaacttcgggatccctgcactttatgtaagaatgtaaacctggagtctcatttaagaatgatcagcaatacgtttagaacatatgaactgaatgaaatggacattttttcttaatttacgtataaatccatatgattatacataaagttctgatgcattaataaaagcagccaaatagggccaaagagaaaaataacaggactctgtactggacctaactttatcattaattaggtaatattttcctcatttctttactgctgccattttcctcaccagtattccagagatggtcatagctcattactctaccaccaagaacctaaaaggaattagaatacagcagaattggcctcagtgaagagcttaaaattgttctcctcgtagaactggactattgatcattaccacgtgacgttggctctattactttctgttcccaatgtccttctagtggtttgaaaatgttaaaacatccctaaaatctaaatcatataatcagaattctatagtgtcccactctatctgtaaagatcatttggaagactttagactctattaattttaaaaggaatatttattagccatatgcagaatttctaatgatgatattgtacagcttctaattcacttttcagatcagtgtttgaaatggcaattatcagtgttggatttagttccaactacttgatttacaaaaatgtacatttagagaaggttaaaagaaacagtgagaaatgtaaacattcaaaatgataattgaatctctcagttgtgggaataattatcagagacatgcaactgaaaatgtctcacctttcatctttttttcttaattcataaagttatcttgtagaatttgatgagaccctcctagtcattctcaactggggcggtgctgtcaccgaatggtgtttgagagtgttggggctagggcacatttttggttgtcacagcaactggggtggcatttgctgcccagtgccaggaatagtaacattatgaatgccagggacagtgtgctcagtaaagtcttccatccaaaaggggcagggcacggtggctcacgcctgtaatcccagcactttgggaggccaaggtgggcggatcacctgatgtcaggggttcgagaccagcctggccaacatggtgaaaccctgttgctactaaaaatacaaaaattggctgggtgtggtgtcacatgccagtaaccccagctactagggaggctgaggcaggagaatcacttgaacccgggaggcagaggttgcagtgagctgagattgcaccactacactccagcctggatgacagagtgagacttcatctcaaaaaaaaaaaaaaaaaaccaaaaaaaaacaacccggtagcattgtcccttccccactgacaaacttatcaaatccagaagctttagagtttcgtctctaattatttttctcctgaacaaaattacccaagtcaaaacaaaatgtatttttagaattacggcagcatacgacctgaattttgtgagtttcgtggctttatcttaaatcaccatttccctaaaaatggtttctttctccttagaaatgctggtggcaacttgatgaaacagccaaatgcaccagggcaggtcactttcccattacactgattccacaattaaaaaaaaaaaaagaaaaaaaactcattgagatagctacagttctataggttaatttaaagcctcctttttctactcatttttgaaagcaaaattacattttactattttacataaccagtgaaaagacgttgaaagcctacagctcactgtttttggtgctctggaaatgttgagggtgggtttttaaccagtgatttttaacgtgcagtgaatttgttagacttttaaacaccagctaaggtagtcaaacttgatccccattaaaaatcaaggaattaggggtcgggggagggtttaggagtgatccagaatgacctcccagaattactgtgcgtacaactttatttttcagagttttcattggaatggtaagagttttatgaaagacagttttaaaacttattctgagttaaatattaatactttaaaaaattattgtactagacttatcgcagccttttgaaagtagcagagtttcatcataccacatatataacagagcataaattttctataatcaggcaccttttgctgcttttgagtaagactgttttcctgtttaagtgttaagcatcgccagacataaaaatctattctctcctctcgattgtagcatagcctgacagctctagatacagcatttctatgatgaaaaatgagtatccatcaggaaatctagaagactagccgtgttttctcagactccacctttgtttgcactctgttgcctgtgaggagctttctggcatgtgattatttacttcaaaactagagttccaagcacctacattaattattttatattgtgtgcagaatagtatatcttttaatgtcagatatgatacactgcacatattgcttttgcactcttaaaatttttgtactaaataatagaaaatatttatattctttgagtgtgagctttgaatagatggcattatcactttattgtttttttaacaaaaactttttctcaattattctattgcaatgttattctgagcaagtcctatgccaaatatcttgtataatgtttgtatggaagattaaattttactcttgtgtggtaagactatttcagttactgattttatagttggaatttgatattccagcacaaagtccacagtgtattcagaaatccaagttggtgtcatacatttcattttgatgtgaacttttctttgctttcctttgttctaagactccattttgcaataaacgttttgacagtaaa

SEQ ID NO: 448259 - DNA, 4051 bp, Homo sapiens
atcggtaccatcaatatcacacaatactgagatgatctaagaaggttataacaaaatgctcttcagaaatacctaagtgctgagaatttttagtactaaagagcacagctgctcaaagtaaagcctgagcagtgttctcagtaatgtatttgaaggaaaaataccctgatttgaaaccaacagcagatgttgcaaactttcataccactgctggccatggaagcctcttaacaacacactgtcatttaaggctgtgcttgtgctttatacaaagagaaagaggtggtcttaaggggatgcttccaggggggtgagttcatgcctctcctgtattttccagcaagtggggtattgtggtggtattgttttttagaggggcataataatccaggattctaagcatatgctcagctattttaaagaggaaattaaatattataaaagaaatagtaaagataagttatcctcacttaggcaaaagcacaggtcctttccatatcaagtttagcctaccagggttgttttttgttttaaccctgcttaataatgttggtgttttagaagtagatacaggcactgctctgaaaacctggctagccaaggatattctcagaatgttatcacctgtttgtcaaagcttgtttaaattataaaacacttttaattatatatatgaggcaaaagaactaagacttttttcaaactaaattagaaaggagtgtcattatttgactgttaaaccaaaatatttttggtgggtctttttatggaagtttaaagaaaggacatcatcatagatatgatctaacagtatttctaactatatttgatcattaaaagcctcttggaatttgaagcgtgacgtgtttctaatgccccttgagaggtgaaaaataccacataatgatcagtatgctgtgccagcttcatttggggagaaataactagtagaaagttctgggtgtgaggtgtacagcagtctaggtggcatagtgatgaagaaagggatcagagtctgactgtcactcagaatcctgggctcagttgcttgacaaccttgggaaaattgttttatctttgtgcgtctgtttgctgatcttcagcgtgggaataataacagtacctacttgaaaggatcattgtgcggattaaaagaaataatatatgtaaagcactttaacacagcaccaggcccacggaaagtggctaatgttagctactatgaatggtgccagtgaagacactgaaaaataagtgatttcagtaaccttctggaaagctatcagtttcaaataatattttctctgtagtatgagatgaaattaaaagtggatagctttcaggaaagataaagagaacatgcttagaatgtaagctaaacagattttttctgttgctctttgaaaactatgagccctggccagcttaacctggtctgaggtgagactaaacacaaaaacagtagataaatctctccctaaaagatggattcccccacatacccatgctactagtttctctgtctattcacacatatgtacaaatacatgaacacagcctgtctgtgctcagacatagagaagtactacctgacttgagtcaatgcacccaagaagaaaagcttggagtagagcagaagggagggcttgggactcctgtcctttccagcatgccctggggtgcagtggtcagccacctgaagagagagccaatagcatggggtttacaaggcaaagatagtcattcattcaacacatattcatagagctccttctctgtgccagacactgttctggaagatagctagatgaaaatctttgcactcacagagcttacatgccagtgagtgaagatcgatgataaataaagcaaatgcatcatatgttcacatttgataagtatatgccaaaaaatgaagccgggaaggaggacaaggcccatgggtgggtgttgaggtttttaaagtgtggtcaggaaaggccccactgataaggtaacatttgagcaagtctgaaaaaggcaaggggatctttggggctaacttcgggatccctgcactttatgtaagaatgtaaacctggagtctcatttaagaatgatcagcaatacgtttagaacatatgaactgaatgaaatggacattttttcttaatttacgtataaatccatatgattatacataaagttctgatgcattaataaaagcagccaaatagggccaaagagaaaaataacaggactctgtactggacctaactttatcattaattaggtaatattttcctcatttctttactgctgccattttcctcaccagtattccagagatggtcatagctcattactctaccaccaagaacctaaaaggaattagaatacagcagaattggcctcagtgaagagcttaaaattgttctcctcgtagaactggactattgatcattaccacgtgacgttggctctattactttctgttcccaatgtccttctagtggtttgaaaatgttaaaacaaaaaaaaaacaacccggtagcattgtcccttccccactgacaaacttatcaaatccagaagctttagagtttcgtctctaattatttttctcctgaacaaaattacccaagtcaaaacaaaatgtatttttagaattacggcagcatacgacctgaattttgtgagtttcgtggctttatcttaaatcaccatttccctaaaaatggtttctttctccttagaaatgctggtggcaacttgatgaaacagccaaatgcaccagggcaggtcactttcccattacactgattccacaattaaaaaaaaaaaaagaaaaaaaactcattgagatagctacagttctataggttaatttaaagcctcctttttctactcatttttgaaagcaaaattacattttactattttacataaccagtgaaaagacgttgaaagcctacagctcactgtttttggtgctctggaaatgttgagggtgggtttttaaccagtgatttttaacgtgcagtgaatttgttagacttttaaacaccagctaaggtagtcaaacttgatccccattaaaaatcaaggaattaggggtcgggggagggtttaggagtgatccagaatgacctcccagaattactgtgcgtacaactttatttttcagagttttcattggaatggtaagagttttatgaaagacagttttaaaacttattctgagttaaatattaatactttaaaaaattattgtactagacttatcgcagccttttgaaagtagcagagtttcatcataccacatatataacagagcataaattttctataatcaggcaccttttgctgcttttgagtaagactgttttcctgtttaagtgttaagcatcgccagacataaaaatctattctctcctctcgattgtagcatagcctgacagctctagatacagcatttctatgatgaaaaatgagtatccatcaggaaatctagaagactagccgtgttttctcagactccacctttgtttgcactctgttgcctgtgaggagctttctggcatgtgattatttacttcaaaactagagttccaagcacctacattaattattttatattgtgtgcagaatagtatatcttttaatgtcagatatgatacactgcacatattgcttttgcactcttaaaatttttgtactaaataatagaaaatatttatattctttgagtgtgagctttgaatagatggcattatcactttattgtttttttaacaaaaactttttctcaattattctattgcaatgttattctgagcaagtcctatgccaaatatcttgtataatgtttgtatggaagattaaattttactcttgtgtggtaagactatttcagttactgattttatagttggaatttgatattccagcacaaagtccacagtgtattcagaaatccaagttggtgtcatacatttcattttgatgtgaacttttctttgctttcctttgttctaagactccattttgcaataaacgttttgacagtaaa

SEQ ID NO: 448260 - DNA, 4854 bp, Homo sapiens
atcggtaccatcaatatcacacaatactgagatgatctaagaaggttataacaaaatgctcttcagaaatacctaagtgctgagaatttttagtactaaagagcacagctgctcaaagtaaagcctgagcagtgttctcagtaatgtatttgaaggaaaaataccctgatttgaaaccaacagcagatgttgcaaactttcataccactgctggccatggaagcctcttaacaacacactgtcatttaaggctgtgcttgtgctttatacaaagagaaagaggtggtcttaaggggatgcttccaggggggtgagttcatgcctctcctgtattttccagcaagtggggtattgtggtggtattgttttttagaggggcataataatccaggattctaagcatatgctcagctattttaaagaggaaattaaatattataaaagaaatagtaaagataagttatcctcacttaggcaaaagcacaggtcctttccatatcaagtttagcctaccagggttgttttttgttttaaccctgcttaataatgttggtgttttagaagtagatacaggcactgctctgaaaacctggctagccaaggatattctcagaatgttatcacctgtttgtcaaagcttgtttaaattataaaacacttttaattatatatatgaggcaaaagaactaagacttttttcaaactaaattagaaaggagtgtcattatttgactgttaaaccaaaatatttttggtgggtctttttatggaagtttaaagaaaggacatcatcatagatatgatctaacagtatttctaactatatttgatcattaaaagcctcttggaatttgaagcgtgacgtgtttctaatgccccttgagaggtgaaaaataccacataatgatcagtatgctgtgccagcttcatttggggagaaataactagtagaaagttctgggtgtgaggtgtacagcagtctaggtggcatagtgatgaagaaagggatcagagtctgactgtcactcagaatcctgggctcagttgcttgacaaccttgggaaaattgttttatctttgtgcgtctgtttgctgatcttcagcgtgggaataataacagtacctacttgaaaggatcattgtgcggattaaaagaaataatatatgtaaagcactttaacacagcaccaggcccacggaaagtggctaatgttagctactatgaatggtgccagtgaagacactgaaaaataagtgatttcagtaaccttctggaaagctatcagtttcaaataatattttctctgtagtatgagatgaaattaaaagtggatagctttcaggaaagataaagagaacatgcttagaatgtaagctaaacagattttttctgttgctctttgaaaactatgagccctggccagcttaacctggtctgaggtgagactaaacacaaaaacagtagataaatctctccctaaaagatggattcccccacatacccatgctactagtttctctgtctattcacacatatgtacaaatacatgaacacagcctgtctgtgctcagacatagagaagtactacctgacttgagtcaatgcacccaagaagaaaagcttggagtagagcagaagggagggcttgggactcctgtcctttccagcatgccctggggtgcagtggtcagccacctgaagagagagccaatagcatggggtttacaaggcaaagatagtcattcattcaacacatattcatagagctccttctctgtgccagacactgttctggaagatagctagatgaaaatctttgcactcacagagcttacatgccagtgagtgaagatcgatgataaataaagcaaatgcatcatatgttcacatttgataagtatatgccaaaaaatgaagccgggaaggaggacaaggcccatgggtgggtgttgaggtttttaaagtgtggtcaggaaaggccccactgataaggtaacatttgagcaagtctgaaaaaggcaaggggatctttggggctaacttcgggatccctgcactttatgtaagaatgtaaacctggagtctcatttaagaatgatcagcaatacgtttagaacatatgaactgaatgaaatggacattttttcttaatttacgtataaatccatatgattatacataaagttctgatgcattaataaaagcagccaaatagggccaaagagaaaaataacaggactctgtactggacctaactttatcattaattaggtaatattttcctcatttctttactgctgccattttcctcaccagtattccagagatggtcatagctcattactctaccaccaagaacctaaaaggaattagaatacagcagaattggcctcagtgaagagcttaaaattgttctcctcgtagaactggactattgatcattaccacgtgacgttggctctattactttctgttcccaatgtccttctagtggtttgaaaatgttaaaacatccctaaaatctaaatcatataatcagaattctatagtgtcccactctatctgtaaagatcatttggaagactttagactctattaattttaaaaggaatatttattagccatatgcagaatttctaatgatgatattgtacagcttctaattcacttttcagatcagtgtttgaaatggcaattatcagtgttggatttagttccaactacttgatttacaaaaatgtacatttagagaaggttaaaagaaacagtgagaaatgtaaacattcaaaatgataattgaatctctcagttgtgggaataattatcagagacatgcaactgaaaatgtctcacctttcatctttttttcttaattcataaagttatcttgtagaatttgatgagaccctcctagtcattctcaactggggcggtgctgtcaccgaatggtgtttgagagtgttggggctagggcacatttttggttgtcacagcaactggggtggcatttgctgcccagtgccaggaatagtaacattatgaatgccagggacagtgtgctcagtaaagtcttccatccaaaaggggcagggcacggtggctcacgcctgtaatcccagcactttgggaggccaaggtgggcggatcacctgatgtcaggggttcgagaccagcctggccaacatggtgaaaccctgttgctactaaaaatacaaaaattggctgggtgtggtgtcacatgccagtaaccccagctactagggaggctgaggcaggagaatcacttgaacccgggaggcagaggttgcagtgagctgagattgcaccactacactccagcctggatgacagagtgagacttcatctcaaaaaaaaaaaaaaaaaaccaaaaaaaaacaacccggtagcattgtcccttccccactgacaaacttatcaaatccagaagctttagagtttcgtctctaattatttttctcctgaacaaaattacccaagtcaaaacaaaatgtatttttagaattacggcagcatacgacctgaattttgtgagtttcgtggctttatcttaaatcaccatttccctaaaaatggtttctttctccttagaaatgctggtggcaacttgatgaaacagccaaatgcaccagggcaggtcactttcccattacactgattccacaattaaaaaaaaaaaaagaaaaaaaactcattgagatagctacagttctataggttaatttaaagcctcctttttctactcatttttgaaagcaaaattacattttactattttacataaccagtgaaaagacgttgaaagcctacagctcactgtttttggtgctctggaaatgttgagggtgggtttttaaccagtgatttttaacgtgcagtgaatttgttagacttttaaacaccagctaaggtagtcaaacttgatccccattaaaaatcaaggaattaggggtcgggggagggtttaggagtgatccagaatgacctcccagaattactgtgcgtacaactttatttttcagagttttcattggaatggtaagagttttatgaaagacagttttaaaacttattctgagttaaatattaatactttaaaaaattattgtactagacttatcgcagccttttgaaagtagcagagtttcatcataccacatatataacagagcataaattttctataatcaggcaccttttgctgcttttgagtaagactgttttcctgtttaagtgttaagcatcgccagacataaaaatctattctctcctctcgattgtagcatagcctgacagctctagatacagcatttctatgatgaaaaatgagtatccatcaggaaatctagaagactagccgtgttttctcagactccacctttgtttgcactctgttgcctgtgaggagctttctggcatgtgattatttacttcaaaactagagttccaagcacctacattaattattttatattgtgtgcagaatagtatatcttttaatgtcagatatgatacactgcacatattgcttttgcactcttaaaatttttgtactaaataatagaaaatatttatattctttgagtgtgagctttgaatagatggcattatcactttattgtttttttaacaaaaactttttctcaattattctattgcaatgttattctgagcaagtcctatgccaaatatcttgtataatgtttgtatggaagattaaattttactcttgtgtggtaagactatttctgaatacactgtggactttgtgctggaatatcaaattccaactataaaatcagtaactgaaatagtcttaccacacaaggtcgagc

SEQ ID NO: 448261 - DNA, 4769 bp, Homo sapiens
  misc_feature (4605)..(4607): n is a, c, g, or t
  misc_feature (4618)..(4619): n is a, c, g, or t
  misc_feature (4622)..(4622): n is a, c, g, or t
  misc_feature (4632)..(4632): n is a, c, g, or t
  misc_feature (4639)..(4639): n is a, c, g, or t
  misc_feature (4641)..(4641): n is a, c, g, or t
  misc_feature (4644)..(4644): n is a, c, g, or t
  misc_feature (4658)..(4658): n is a, c, g, or t
  misc_feature (4661)..(4662): n is a, c, g, or t
  misc_feature (4664)..(4664): n is a, c, g, or t
  misc_feature (4666)..(4666): n is a, c, g, or t
  misc_feature (4672)..(4672): n is a, c, g, or t
  misc_feature (4768)..(4768): n is a, c, g, or t
atcggtaccatcaatatcacacaatactgagatgatctaagaaggttataacaaaatgctcttcagaaatacctaagtgctgagaatttttagtactaaagagcacagctgctcaaagtaaagcctgagcagtgttctcagtaatgtatttgaaggaaaaataccctgatttgaaaccaacagcagatgttgcaaactttcataccactgctggccatggaagcctcttaacaacacactgtcatttaaggctgtgcttgtgctttatacaaagagaaagaggtggtcttaaggggatgcttccaggggggtgagttcatgcctctcctgtattttccagcaagtggggtattgtggtggtattgttttttagaggggcataataatccaggattctaagcatatgctcagctattttaaagaggaaattaaatattataaaagaaatagtaaagataagttatcctcacttaggcaaaagcacaggtcctttccatatcaagtttagcctaccagggttgttttttgttttaaccctgcttaataatgttggtgttttagaagtagatacaggcactgctctgaaaacctggctagccaaggatattctcagaatgttatcacctgtttgtcaaagcttgtttaaattataaaacacttttaattatatatatgaggcaaaagaactaagacttttttcaaactaaattagaaaggagtgtcattatttgactgttaaaccaaaatatttttggtgggtctttttatggaagtttaaagaaaggacatcatcatagatatgatctaacagtatttctaactatatttgatcattaaaagcctcttggaatttgaagcgtgacgtgtttctaatgccccttgagaggtgaaaaataccacataatgatcagtatgctgtgccagcttcatttggggagaaataactagtagaaagttctgggtgtgaggtgtacagcagtctaggtggcatagtgatgaagaaagggatcagagtctgactgtcactcagaatcctgggctcagttgcttgacaaccttgggaaaattgttttatctttgtgcgtctgtttgctgatcttcagcgtgggaataataacagtacctacttgaaaggatcattgtgcggattaaaagaaataatatatgtaaagcactttaacacagcaccaggcccacggaaagtggctaatgttagctactatgaatggtgccagtgaagacactgaaaaataagtgatttcagtaaccttctggaaagctatcagtttcaaataatattttctctgtagtatgagatgaaattaaaagtggatagctttcaggaaagataaagagaacatgcttagaatgtaagctaaacagattttttctgttgctctttgaaaactatgagccctggccagcttaacctggtctgaggtgagactaaacacaaaaacagtagataaatctctccctaaaagatggattcccccacatacccatgctactagtttctctgtctattcacacatatgtacaaatacatgaacacagcctgtctgtgctcagacatagagaagtactacctgacttgagtcaatgcacccaagaagaaaagcttggagtagagcagaagggagggcttgggactcctgtcctttccagcatgccctggggtgcagtggtcagccacctgaagagagagccaatagcatggggtttacaaggcaaagatagtcattcattcaacacatattcatagagctccttctctgtgccagacactgttctggaagatagctagatgaaaatctttgcactcacagagcttacatgccagtgagtgaagatcgatgataaataaagcaaatgcatcatatgttcacatttgataagtatatgccaaaaaatgaagccgggaaggaggacaaggcccatgggtgggtgttgaggtttttaaagtgtggtcaggaaaggccccactgataaggtaacatttgagcaagtctgaaaaaggcaaggggatctttggggctaacttcgggatccctgcactttatgtaagaatgtaaacctggagtctcatttaagaatgatcagcaatacgtttagaacatatgaactgaatgaaatggacattttttcttaatttacgtataaatccatatgattatacataaagttctgatgcattaataaaagcagccaaatagggccaaagagaaaaataacaggactctgtactggacctaactttatcattaattaggtaatattttcctcatttctttactgctgccattttcctcaccagtattccagagatggtcatagctcattactctaccaccaagaacctaaaaggaattagaatacagcagaattggcctcagtgaagagcttaaaattgttctcctcgtagaactggactattgatcattaccacgtgacgttggctctattactttctgttcccaatgtccttctagtggtttgaaaatgttaaaacatccctaaaatctaaatcatataatcagaattctatagtgtcccactctatctgtaaagatcatttggaagactttagactctattaattttaaaaggaatatttattagccatatgcagaatttctaatgatgatattgtacagcttctaattcacttttcagatcagtgtttgaaatggcaattatcagtgttggatttagttccaactacttgatttacaaaaatgtacatttagagaaggttaaaagaaacagtgagaaatgtaaacattcaaaatgataattgaatctctcagttgtgggaataattatcagagacatgcaactgaaaatgtctcacctttcatctttttttcttaattcataaagttatcttgtagaatttgatgagaccctcctagtcattctcaactggggcggtgctgtcaccgaatggtgtttgagagtgttggggctagggcacatttttggttgtcacagcaactggggtggcatttgctgcccagtgccaggaatagtaacattatgaatgccagggacagtgtgctcagtaaagtcttccatccaaaaggggcagggcacggtggctcacgcctgtaatcccagcactttgggaggccaaggtgggcggatcacctgatgtcaggggttcgagaccagcctggccaacatggtgaaaccctgttgctactaaaaatacaaaaattggctgggtgtggtgtcacatgccagtaaccccagctactagggaggctgaggcaggagaatcacttgaacccgggaggcagaggttgcagtgagctgagattgcaccactacactccagcctggatgacagagtgagacttcatctcaaaaaaaaaaaaaaaaaaccaaaaaaaaacaacccggtagcattgtcccttccccactgacaaacttatcaaatccagaagctttagagtttcgtctctaattatttttctcctgaacaaaattacccaagtcaaaacaaaatgtatttttagaattacggcagcatacgacctgaattttgtgagtttcgtggctttatcttaaatcaccatttccctaaaaatggtttctttctccttagaaatgctggtggcaacttgatgaaacagccaaatgcaccagggcaggtcactttcccattacactgattccacaattaaaaaaaaaaaaagaaaaaaaactcattgagatagctacagttctataggttaatttaaagcctcctttttctactcatttttgaaagcaaaattacattttactattttacataaccagtgaaaagacgttgaaagcctacagctcactgtttttggtgctctggaaatgttgagggtgggtttttaaccagtgatttttaacgtgcagtgaatttgttagacttttaaacaccagctaaggtagtcaaacttgatccccattaaaaatcaaggaattaggggtcgggggagggtttaggagtgatccagaatgacctcccagaattactgtgcgtacaactttatttttcagagttttcattggaatggtaagagttttatgaaagacagttttaaaacttattctgagttaaatattaatactttaaaaaattattgtactagacttatcgcagccttttgaaagtagcagagtttcatcataccacatatataacagagcataaattttctataatcaggcaccttttgctgcttttgagtaagactgttttcctgtttaagtgttaagcatcgccagacataaaaatctattctctcctctcgattgtagcatagcctgacagctctagatacagcatttctatgatgaaaaatgagtatccatcaggaaatctagaagactagccgtgttttctcagactccacctttgtttgcactctgttgcctgtgaggagctttctggcatgtgattatttacttcaaaactagagttccaagcacctacattaattattttatattgtgtgcagaatagtatatcttttaatgtcagatatgatacactgcacatattgcttttgcactcttaaaatttttgtactaaataatagaaaatatttatcttgggggggnnngaaaaagggtnnacnttggtttacnaaacttntnccnttctggggtcggcngcnncnantgttgngggggggaaaaacgggggggaaaccggttgtgtttccaccgtaacacgggaattgattgtcccctgaaaaaccacgtggtggtggagaggcatgcna

SEQ ID NO: 448262 - DNA, 4667 bp, Homo sapiens
atcggtaccatcaatatcacacaatactgagatgatctaagaaggttataacaaaatgctcttcagaaatacctaagtgctgagaatttttagtactaaagagcacagctgctcaaagtaaagcctgagcagtgttctcagtaatgtatttgaaggaaaaataccctgatttgaaaccaacagcagatgttgcaaactttcataccactgctggccatggaagcctcttaacaacacactgtcatttaaggctgtgcttgtgctttatacaaagagaaagaggtggtcttaaggggatgcttccaggggggtgagttcatgcctctcctgtattttccagcaagtggggtattgtggtggtattgttttttagaggggcataataatccaggattctaagcatatgctcagctattttaaagaggaaattaaatattataaaagaaatagtaaagataagttatcctcacttaggcaaaagcacaggtcctttccatatcaagtttagcctaccagggttgttttttgttttaaccctgcttaataatgttggtgttttagaagtagatacaggcactgctctgaaaacctggctagccaaggatattctcagaatgttatcacctgtttgtcaaagcttgtttaaattataaaacacttttaattatatatatgaggcaaaagaactaagacttttttcaaactaaattagaaaggagtgtcattatttgactgttaaaccaaaatatttttggtgggtctttttatggaagtttaaagaaaggacatcatcatagatatgatctaacagtatttctaactatatttgatcattaaaagcctcttggaatttgaagcgtgacgtgtttctaatgccccttgagaggtgaaaaataccacataatgatcagtatgctgtgccagcttcatttggggagaaataactagtagaaagttctgggtgtgaggtgtacagcagtctaggtggcatagtgatgaagaaagggatcagagtctgactgtcactcagaatcctgggctcagttgcttgacaaccttgggaaaattgttttatctttgtgcgtctgtttgctgatcttcagcgtgggaataataacagtacctacttgaaaggatcattgtgcggattaaaagaaataatatatgtaaagcactttaacacagcaccaggcccacggaaagtggctaatgttagctactatgaatggtgccagtgaagacactgaaaaataagtgatttcagtaaccttctggaaagctatcagtttcaaataatattttctctgtagtatgagatgaaattaaaagtggatagctttcaggaaagataaagagaacatgcttagaatgtaagctaaacagattttttctgttgctctttgaaaactatgagccctggccagcttaacctggtctgaggtgagactaaacacaaaaacagtagataaatctctccctaaaagatggattcccccacatacccatgctactagtttctctgtctattcacacatatgtacaaatacatgaacacagcctgtctgtgctcagacatagagaagtactacctgacttgagtcaatgcacccaagaagaaaagcttggagtagagcagaagggagggcttgggactcctgtcctttccagcatgccctggggtgcagtggtcagccacctgaagagagagccaatagcatggggtttacaaggcaaagatagtcattcattcaacacatattcatagagctccttctctgtgccagacactgttctggaagatagctagatgaaaatctttgcactcacagagcttacatgccagtgagtgaagatcgatgataaataaagcaaatgcatcatatgttcacatttgataagtatatgccaaaaaatgaagccgggaaggaggacaaggcccatgggtgggtgttgaggtttttaaagtgtggtcaggaaaggccccactgataaggtaacatttgagcaagtctgaaaaaggcaaggggatctttggggctaacttcgggatccctgcactttatgtaagaatgtaaacctggagtctcatttaagaatgatcagcaatacgtttagaacatatgaactgaatgaaatggacattttttcttaatttacgtataaatccatatgattatacataaagttctgatgcattaataaaagcagccaaatagggccaaagagaaaaataacaggactctgtactggacctaactttatcattaattaggtaatattttcctcatttctttactgctgccattttcctcaccagtattccagagatggtcatagctcattactctaccaccaagaacctaaaaggaattagaatacagcagaattggcctcagtgaagagcttaaaattgttctcctcgtagaactggactattgatcattaccacgtgacgttggctctattactttctgttcccaatgtccttctagtggtttgaaaatgttaaaacatccctaaaatctaaatcatataatcagaattctatagtgtcccactctatctgtaaagatcatttggaagactttagactctattaattttaaaaggaatatttattagccatatgcagaatttctaatgatgatattgtacagcttctaattcacttttcagatcagtgtttgaaatggcaattatcagtgttggatttagttccaactacttgatttacaaaaatgtacatttagagaaggttaaaagaaacagtgagaaatgtaaacattcaaaatgataattgaatctctcagttgtgggaataattatcagagacatgcaactgaaaatgtctcacctttcatctttttttcttaattcataaagttatcttgtagaatttgatgagaccctcctagtcattctcaactggggcggtgctgtcaccgaatggtgtttgagagtgttggggctagggcacatttttggttgtcacagcaactggggtggcatttgctgcccagtgccaggaatagtaacattatgaatgccagggacagtgtgctcagtaaagtcttccatccaaaaggggcagggcacggtggctcacgcctgtaatcccagcactttgggaggccaaggtgggcggatcacctgatgtcaggggttcgagaccagcctggccaacatggtgaaaccctgttgctactaaaaatacaaaaattggctgggtgtggtgtcacatgccagtaaccccagctactagggaggctgaggcaggagaatcacttgaacccgggaggcagaggttgcagtgagctgagattgcaccactacactccagcctggatgacagagtgagacttcatctcaaaaaaaaaaaaaaaaaaccaaaaaaaaacaacccggtagcattgtcccttccccactgacaaacttatcaaatccagaagctttagagtttcgtctctaattatttttctcctgaacaaaattacccaagtcaaaacaaaatgtatttttagaattacggcagcatacgacctgaattttgtgagtttcgtggctttatcttaaatcaccatttccctaaaaatggtttctttctccttagaaatgctggtggcaacttgatgaaacagccaaatgcaccagggcaggtcactttcccattacactgattccacaattaaaaaaaaaaaaagaaaaaaaactcattgagatagctacagttctataggttaatttaaagcctcctttttctactcatttttgaaagcaaaattacattttactattttacataaccagtgaaaagacgttgaaagcctacagctcactgtttttggtgctctggaaatgttgagggtgggtttttaaccagtgatttttaacgtgcagtgaatttgttagacttttaaacaccagctaaggtagtcaaacttgatccccattaaaaatcaaggaattaggggtcgggggagggtttaggagtgatccagaatgacctcccagaattactgtgcgtacaactttatttttcagagttttcattggaatggtaagagttttatgaaagacagttttaaaacttattctgagttaaatattaatactttaaaaaattattgtactagacttatcgcagccttttgaaagtagcagagtttcatcataccacatatataacagagcataaattttctataatcaggcaccttttgctgcttttgagtaagactgttttcctgtttaagtgttaagcatcgccagacataaaaatctattctctcctctcgattgtagcatagcctgacagctctagatacagcatttctatgatgaaaaatgagtatccatcaggaaatctagaagactagccgtgttttctcagactccacctttgtttgcactctgttgcctgtgaggagctttctggcatgtgattatttacttcaaaactagagttccaagcacctacattaattattttatgtttggaaaacacaaaagtaacttgtttatctcagtctgtacaaaaacagtaaggaggcagaaagccaagcactgcatttttaggccaatcacatttacatgaccgtaatttcttatcaattctacttttatttttgcttacagaaaaacggggggagaattaagccaaagaagta

SEQ ID NO: 448263 - DNA, 4181 bp, Homo sapiens
atcggtaccatcaatatcacacaatactgagatgatctaagaaggttataacaaaatgctcttcagaaatacctaagtgctgagaatttttagtactaaagagcacagctgctcaaagtaaagcctgagcagtgttctcagtaatgtatttgaaggaaaaataccctgatttgaaaccaacagcagatgttgcaaactttcataccactgctggccatggaagcctcttaacaacacactgtcatttaaggctgtgcttgtgctttatacaaagagaaagaggtggtcttaaggggatgcttccaggggggtgagttcatgcctctcctgtattttccagcaagtggggtattgtggtggtattgttttttagaggggcataataatccaggattctaagcatatgctcagctattttaaagaggaaattaaatattataaaagaaatagtaaagataagttatcctcacttaggcaaaagcacaggtcctttccatatcaagtttagcctaccagggttgttttttgttttaaccctgcttaataatgttggtgttttagaagtagatacaggcactgctctgaaaacctggctagccaaggatattctcagaatgttatcacctgtttgtcaaagcttgtttaaattataaaacacttttaattatatatatgaggcaaaagaactaagacttttttcaaactaaattagaaaggagtgtcattatttgactgttaaaccaaaatatttttggtgggtctttttatggaagtttaaagaaaggacatcatcatagatatgatctaacagtatttctaactatatttgatcattaaaagcctcttggaatttgaagcgtgacgtgtttctaatgccccttgagaggtgaaaaataccacataatgatcagtatgctgtgccagcttcatttggggagaaataactagtagaaagttctgggtgtgaggtgtacagcagtctaggtggcatagtgatgaagaaagggatcagagtctgactgtcactcagaatcctgggctcagttgcttgacaaccttgggaaaattgttttatctttgtgcgtctgtttgctgatcttcagcgtgggaataataacagtacctacttgaaaggatcattgtgcggattaaaagaaataatatatgtaaagcactttaacacagcaccaggcccacggaaagtggctaatgttagctactatgaatggtgccagtgaagacactgaaaaataagtgatttcagtaaccttctggaaagctatcagtttcaaataatattttctctgtagtatgagatgaaattaaaagtggatagctttcaggaaagataaagagaacatgcttagaatgtaagctaaacagattttttctgttgctctttgaaaactatgagccctggccagcttaacctggtctgaggtgagactaaacacaaaaacagtagataaatctctccctaaaagatggattcccccacatacccatgctactagtttctctgtctattcacacatatgtacaaatacatgaacacagcctgtctgtgctcagacatagagaagtactacctgacttgagtcaatgcacccaagaagaaaagcttggagtagagcagaagggagggcttgggactcctgtcctttccagcatgccctggggtgcagtggtcagccacctgaagagagagccaatagcatggggtttacaaggcaaagatagtcattcattcaacacatattcatagagctccttctctgtgccagacactgttctggaagatagctagatgaaaatctttgcactcacagagcttacatgccagtgagtgaagatcgatgataaataaagcaaatgcatcatatgttcacatttgataagtatatgccaaaaaatgaagccgggaaggaggacaaggcccatgggtgggtgttgaggtttttaaagtgtggtcaggaaaggccccactgataaggtaacatttgagcaagtctgaaaaaggcaaggggatctttggggctaacttcgggatccctgcactttatgtaagaatgtaaacctggagtctcatttaagaatgatcagcaatacgtttagaacatatgaactgaatgaaatggacattttttcttaatttacgtataaatccatatgattatacataaagttctgatgcattaataaaagcagccaaatagggccaaagagaaaaataacaggactctgtactggacctaactttatcattaattaggtaatattttcctcatttctttactgctgccattttcctcaccagtattccagagatggtcatagctcattactctaccaccaagaacctaaaaggaattagaatacagcagaattggcctcagtgaagagcttaaaattgttctcctcgtagaactggactattgatcattaccacgtgacgttggctctattactttctgttcccaatgtccttctagtggtttgaaaatgttaaaacatccctaaaatctaaatcatataatcagaattctatagtgtcccactctatctgtaaagatcatttggaagactttagactctattaattttaaaaggaatatttattagccatatgcagaatttctaatgatgatattgtacagcttctaattcacttttcagatcagtgtttgaaatggcaattatcagtgttggatttagttccaactacttgatttacaaaaatgtacatttagagaaggttaaaagaaacagtgagaaatgtaaacattcaaaatgataattgaatctctcagttgtgggaataattatcagagacatgcaactgaaaatgtctcacctttcatctttttttcttaattcataaagttatcttgtagaatttgatgagaccctcctagtcattctcaactggggcggtgctgtcaccgaatggtgtttgagagtgttggggctagggcacatttttggttgtcacagcaactggggtggcatttgctgcccagtgccaggaatagtaacattatgaatgccagggacagtgtgctcagtaaagtcttccatccaaaaggggcagggcacggtggctcacgcctgtaatcccagcactttgggaggccaaggtgggcggatcacctgatgtcaggggttcgagaccagcctggccaacatggtgaaaccctgttgctactaaaaatacaaaaattggctgggtgtggtgtcacatgccagtaaccccagctactagggaggctgaggcaggagaatcacttgaacccgggaggcagaggttgcagtgagctgagattgcaccactacactccagcctggatgacagagtgagacttcatctcaaaaaaaaaaaaaaaaaaccaaaaaaaaacaacccggtagcattgtcccttccccactgacaaacttatcaaatccagaagctttagagtttcgtctctaattatttttctcctgaacaaaattacccaagtcaaaacaaaatgtatttttagaattacggcagcatacgacctgaattttgtgagtttcgtggctttatcttaaatcaccatttccctaaaaatggtttctttctccttagaaatgctggtggcaacttgatgaaacagccaaatgcaccagggcaggtcactttcccattacactgattccacaattaaaaaaaaaaaaagaaaaaaaactcattgagatagctacagttctataggttaatttaaagcctcctttttctactcatttttgaaagcaaaattacattttactattttacataaccagtgaaaagacgttgaaagcctacagctcactgtttttggtgctctggaaatgttgagggtgggtttttaaccagtgatttttaacgtgcagtgaatttgttagacttttaaacaccagctaaggtagtcaaacttgatccccattaaaaatcaaggaattaggggtcgggggagggtttaggagtgatccagaatgacctcccagaattactgtgcgtacaactttatttttcagagttttcattcggatcgagctaactctgtgtaccgaaggtgcaaatacttctagtgggccaatatctatccttgatcgtagtcacgtccgaccaagtatcgcagtcttttgttaagcagcttcgttggaatgcctccgct

SEQ ID NO: 448264 - DNA, 2923 bp, Homo sapiens
gggctccggcctcagaggctgtgacaatggactatgactttaaagtgaagctgagcagcgagcgggagcgggtcgaggacctgtttgaatacgagggctgcaaagttggccgaggcacttatggtcacgtctacaaagccaagaggaaagatgggaaggatgataaagactatgctttaaaacaaatagaaggaactgggatctctatgtcggcatgtagagaaatagcattacttcgagagcttaagcatccaaacgtcatttctcttcaaaaggtgtttctgtctcatgctgataggaaggtgtggcttctgtttgactatgctgaacatgacctctggcatataatcaagtttcacagagcttctaaagcaaacaagaagccagttcagttacctcggggaatggtgaagtcactattatatcagatcctagatggtattcactacctgcatgctaactgggtgttgcacagagatttgaaacctgctaatattttagttatgggtgaaggtcctgagcgaggaagagtaaaaattgctgacatgggctttgcccgattatttaattcacctttgaagcctttagcagatttggatccagtggttgttacattctggtaccgagcccctgaactacttcttggagcaaggcattataccaaagctattgatatttgggctatagggtgtatatttgcagaactactaacgtcagaaccaatatttcactgtcgacaagaggacatcaaaactagtaatccttatcaccatgaccagctggacagaatattcaatgtaatgggatttcctgcagataaagattgggaagatataaaaaagatgcctgaacattcaacattaatgaaagatttcagaagaaatacgtataccaactgcagccttatcaagtatatggaaaaacataaagttaaaccagatagtaaagcattccacttgcttcagaagctgcttaccatggacccaataaagcgaattacctcagaacaggctatgcaggacccctatttcttagaagacccacttcctacatcagacgtttttgccggttgtcaaatcccttacccaaaacgagaatttttaacggaagaagaacctgatgacaaaggagacaaaaagaaccagcagcagcagcagggcaataaccacactaatggaactggccacccagggaatcaagacagcagtcacacacagggacccccgttgaagaaagtgagagttgttcctcctaccactacctcaggtggacttatcatgacctcagactatcagcgttccaatccacatgctgcctatcccaaccctggaccaagcacatcacagccgcagagcagcatgggatactcagctacctcccagcagcctccacagtactcacatcagacacatcggtactgagctgcatcggaatcttgtccatgcactgttgcgaatgctgcagggctgactgtgcagctctctgcgggaacctggtatgggccatgagaatgtactgtacaaccacatcttcaaaatgtccagtagccaagttccaccacttttcacagattggggtagtggcttccaagttgtacctattttggagttagacttgaaaagaaagtgctagcacagtttgtgttgtggatttgctacttccatagtttacttgacatggttcagactgaccaatgcatttttttcagtgacagtctgtagcagttgaagctgtgaatgtgctaggggcaagcatttgtctttgtatgtggtgaattttttcagtgtaacaacattatctgaccaatagtacacacacagacacaaagtttaactggtacttgaaacatacagtatatgttaacgaaataaccaagactcgaaatgagattattttggtacacctttctttttagtgtcttatcagtgggctgattcattttctacattaatcagtgttttctgaccaagaatattgcttggatttttttgaaagtacaaaaagccacatagtttttccagaaaggtttcaaaactcccaaagattaacttccaacttataagtttgtttttattttcaatctatgacttgactggtattaaagctgctatttgatagtaattaaatatgttgtcattgatataaacctgtttggttcagcaaacaaactaaaatgattgtcatagacagtgttttatttttcctgttggtgttgctgatttgtgagcatgctttaagatgaaaaaagcatgaatgataacttccttaaaaaggtgcggcatccaattcaaatattttcgtcctgattttaaagctggttggtgtagtgctattaaaatttcgttcagttaattttccttttgaaaacttgttcgcacgttgtttagggtgcccttacttcagcaaaggagaaggagtaggagagccttagaatttttgaggaaaaaaaaacctataacatacaatgtactgtatcaaactattttacatgaatgacacaagtattctgaataaaaaataattgaacattgttaaaaacaaggtgttatgtaataaatttatttttcataaatcaaaaaaaaaaaaaacaaacacactgtcgttgcgcgctcggggcaccgaaaaggttgtaaaaccactcgcttgcgcgcgggcccagtatgtatggtcaaatgtgcaagcggcccaaaggaaccgggcactacaaggccgtggtctccccaataaaaaccgcggggaccggcgcttgcaaactcaaggacctctgcggcatagggcacaaagggaccaggacataatcaccccccgtgggagaccacaacaccagatcagtacagcagccagcgacaaccagcacaagcagcacagagcaccactgcacgacaacgcactgacacaacagcagcaccaaacaacacacaga

SEQ ID NO: 448265 - DNA, 2520 bp, Homo sapiens
gggctccggcctcagaggctgtgacaatggactatgactttaaagtgaagctgagcagcgagcgggagcgggtcgaggacctgtttgaatacgagggctgcaaagttggccgaggcacttatggtcacgtctacaaagccaagaggaaagatgggaaggatgataaagactatgctttaaaacaaatagaaggaactgggatctctatgtcggcatgtagagaaatagcattacttcgagagcttaagcatccaaacgtcatttctcttcaaaaggtgtttctgtctcatgctgataggaaggtgtggcttctgtttgactatgctgaacatgacctctggcatataatcaagtttcacagagcttctaaagcaaacaagaagccagttcagttacctcggggaatggtgaagtcactattatatcagatcctagatggtattcactacctgcatgctaactgggtgttgcacagagatttgctgacatgggctttgcccgattatttaattcacctttgaagcctttagcagatttggatccagtggttgttacattctggtaccgagcccctgaactacttcttggagcaaggcattataccaaagctattgatatttgggctatagggtgtatatttgcagaactactaacgtcagaaccaatatttcactgtcgacaagaggacatcaaaactagtaatccttatcaccatgaccagctggacagaatattcaatgtaatgggatttcctgcagataaagattgggaagatataaaaaagatgcctgaacattcaacattaatgaaagatttcagaagaaatacgtataccaactgcagccttatcaagtatatggaaaaacataaagttaaaccagatagtaaagcattccacttgcttcagaagctgcttaccatggacccaataaagcgaattacctcagaacaggctatgcaggacccctatttcttagaagacccacttcctacatcagacgtttttgccggttgtcaaatcccttacccaaaacgagaatttttaacggaagaagaacctgatgacaaaggagacaaaaagaaccagcagcagcagcagggcaataaccacactaatggaactggccacccagggaatcaagacagcagtcacacacagggacccccgttgaagaaagtgagagttgttcctcctaccactacctcaggtggacttatcatgacctcagactatcagcgttccaatccacatgctgcctatcccaaccctggaccaagcacatcacagccgcagagcagcatgggatactcagctacctcccagcagcctccacagtactcacatcagacacatcggtactgagctgcatcggaatcttgtccatgcactgttgcgaatgctgcagggctgactgtgcagctctctgcgggaacctggtatgggccatgagaatgtactgtacaaccacatcttcaaaatgtccagtagccaagttccaccacttttcacagattggggtagtggcttccaagttgtacctattttggagttagacttgaaaagaaagtgctagcacagtttgtgttgtggatttgctacttccatagtttacttgacatggttcagactgaccaatgcatttttttcagtgacagtctgtagcagttgaagctgtgaatgtgctaggggcaagcatttgtctttgtatgtggtgaattttttcagtgtaacaacattatctgaccaatagtacacacacagacacaaagtttaactggtacttgaaacatacagtatatgttaacgaaataaccaagactcgaaatgagattattttggtacacctttctttttagtgtcttatcagtgggctgattcattttctacattaatcagtgttttctgaccaagaatattgcttggatttttttgaaagtacaaaaagccacatagtttttccagaaaggtttcaaaactcccaaagattaacttccaacttataagtttgtttttattttcaatctatgacttgactggtattaaagctgctatttgatagtaattaaatatgttgtcattgatataaacctgtttggttcagcaaacaaactaaaatgattgtcatagacagtgttttatttttcctgttggtgttgctgatttgtgagcatgctttaagatgaaaaaagcatgaatgataacttccttaaaaaggtgcggcatccaattcaaatattttcgtcctgattttaaagctggttggtgtagtgctattaaaatttcgttcagttaattttccttttgaaaacttgttcgcacgttgtttagggtgcccttacttcagcaaaggagaaggagtaggagagccttagaatttttgaggaaaaaaaaacctataacatacaatgtactgtatcaaactattttacatgaatgacacaagtattctgaataaaaaataattgaacattgttaaaaacaaggtgttatgtaataaatttatttttcataaatcaaaa

SEQ ID NO: 448266 - DNA, 1118 bp, Homo sapiens
gggctccggcctcagaggctgtgacaatggactatgactttaaagtgaagctgagcagcgagcgggagcgggtcgaggacctgtttgaatacgagggctgcaaagttggccgaggcacttatggtcacgtctacaaagccaagaggaaagatgggaaggatgataaagactatgctttaaaacaaatagaaggaactgggatctctatgtcggcatgtagagaaatagcattacttcgagagcttaagcatccaaacgtcatttctcttcaaaaggtgtttctgtctcatgctgataggaaggtgtggcttctgtttgactatgctgaacatgacctctggcatataatcaagtttcacagagcttctaaagcaaacaagaagccagttcagttacctcggggaatggtgaagtcactattatatcagatcctagatggtattcactacctgcatgctaactgggtgttgcacagagatttgctgacatgggctttgcccgattatttaattcacctttgaagcctttagcagatttggatccagtggttgttacattctggtaccgagcccctgaactacttcttggagcaaggcattataccaaagctattgatatttgggctatagggtgtatatttgcagaactactaacgtcagaaccaatatttcactgtcgacaagaggacatcaaaactagtaatccttatcaccatgaccagctggacagaatattcaatgtaatgggatttcctgcagataaagattgggaagatataaaaaagatgcctgaacattcaacattaatgaaagatttcagaagaaatacgtataccaactgcagccttatcaagtatatggaaaaacataaagttaaaccagatagtaaagcattccacttgcttcagaagctgcttaccatggacccaataaagcgaattacctcagaacaggctatgcaggacccctatttcttagaagacccacttcctacatcagacgtttttgccggttgtcaaatcccttacccaaaacgagaatttttaacggattcagaagattatacccatgcttgccccaaacacttggacaccttattaactcatggacaataccctg

SEQ ID NO: 448267 - DNA, 301 bp, Homo sapiens
cgtttttgccggttgtcaaatcccttacccaaaacgagaatttttaacggaagaagaacctgatgacaaaggagacaaagtaagtattaaagtactgttagcagcttcttgtttcgtgaatgcctccataacattttccattgtgggtatattttgttctccctctgagctgaactttttctgtttaaccaattgagaagaaccagcagcagcagcagggcaataaccacactaatggaactggccacccagggaatcaagacagcagtcacacacagggacccccgttgaagaaagtgag

SEQ ID NO: 448268 - DNA, 2578 bp, Homo sapiens
gggctccggcctcagaggctgtgacaatggactatgactttaaagtgaagctgagcagcgagcgggagcgggtcgaggacctgtttgaatacgagggctgcaaagttggccgaggcacttatggtcacgtctacaaagccaagaggaaagatgggaaggatgataaagactatgctttaaaacaaatagaaggaactgggatctctatgtcggcatgtagagaaatagcattacttcgagagcttaagcatccaaacgtcatttctcttcaaaaggtgtttctgtctcatgctgataggaaggtgtggcttctgtttgactatgctgaacatgacctctggcatataatcaagtttcacagagcttctaaagcaaacaagaagccagttcagttacctcggggaatggtgaagtcactattatatcagatcctagatggtattcactacctgcatgctaactgggtgttgcacagagatttgaaacctgctaatattttagttatgggtgaaggtcctgagcgaggaagagtaaaaattgctgacatgggctttgcccgattatttaattcacctttgaagcctttagcagatttggatccagtggttgttacattctggtaccgagcccctgaactacttcttggagcaaggcattataccaaagctattgatatttgggctatagggtgtatatttgcagaactactaacgtcagaaccaatatttcactgtcgacaagaggacatcaaaactagtaatccttatcaccatgaccagctggacagaatattcaatgtaatgggatttcctgcagataaagattgggaagatataaaaaagatgcctgaacattcaacattaatgaaagatttcagaagaaatacgtataccaactgcagccttatcaagtatatggaaaaacataaagttaaaccagatagtaaagcattccacttgcttcagaagctgcttaccatggacccaataaagcgaattacctcagaacaggctatgcaggacccctatttcttagaagacccacttcctacatcagacgtttttgccggttgtcaaatcccttacccaaaacgagaatttttaacggaagaagaacctgatgacaaaggagacaaaaagaaccagcagcagcagcagggcaataaccacactaatggaactggccacccagggaatcaagacagcagtcacacacagggacccccgttgaagaaagtgagagttgttcctcctaccactacctcaggtggacttatcatgacctcagactatcagcgttccaatccacatgctgcctatcccaaccctggaccaagcacatcacagccgcagagcagcatgggatactcagctacctcccagcagcctccacagtactcacatcagacacatcggtactgagctgcatcggaatcttgtccatgcactgttgcgaatgctgcagggctgactgtgcagctctctgcgggaacctggtatgggccatgagaatgtactgtacaaccacatcttcaaaatgtccagtagccaagttccaccacttttcacagattggggtagtggcttccaagttgtacctattttggagttagacttgaaaagaaagtgctagcacagtttgtgttgtggatttgctacttccatagtttacttgacatggttcagactgaccaatgcatttttttcagtgacagtctgtagcagttgaagctgtgaatgtgctaggggcaagcatttgtctttgtatgtggtgaattttttcagtgtaacaacattatctgaccaatagtacacacacagacacaaagtttaactggtacttgaaacatacagtatatgttaacgaaataaccaagactcgaaatgagattattttggtacacctttctttttagtgtcttatcagtgggctgattcattttctacattaatcagtgttttctgaccaagaatattgcttggatttttttgaaagtacaaaaagccacatagtttttccagaaaggtttcaaaactcccaaagattaacttccaacttataagtttgtttttattttcaatctatgacttgactggtattaaagctgctatttgatagtaattaaatatgttgtcattgatataaacctgtttggttcagcaaacaaactaaaatgattgtcatagacagtgttttatttttcctgttggtgttgctgatttgtgagcatgctttaagatgaaaaaagcatgaatgataacttccttaaaaaggtgcggcatccaattcaaatattttcgtcctgattttaaagctggttggtgtagtgctattaaaatttcgttcagttaattttccttttgaaaacttgttcgcacgttgtttagggtgcccttacttcagcaaaggagaaggagtaggagagccttagaatttttgaggaaaaaaaaacctataacatacaatgtactgtatcaaactattttacatgaatgacacaagtattctgaataaaaaataattgaacattgttaaaaacaaggtgttatgtaataaatttatttttcataaatcaaaa

SEQ ID NO: 448269 - DNA, 2434 bp, Homo sapiens
gggctccggcctcagaggctgtgacaatggactatgactttaaagtgaagctgagcagcgagcgggagcgggtcgaggacctgtttgaatacgagggctgcaaagttggccgaggcacttatggtcacgtctacaaagccaagaggaaagatgggaaggatgataaagactatgctttaaaacaaatagaaggaactgggatctctatgtcggcatgtagagaaatagcattacttcgagagcttaagcatccaaacgtcatttctcttcaaaaggtgtttctgtctcatgctgataggaaggtgtggcttctgtttgactatgctgaacatgacctctggcatataatcaagtttcacagagcttctaaagcaaacaagaagccagttcagttacctcggggaatggtgaagtcactattatatcagatcctagatggtattcactacctgcatgctaactgggtgttgcacagagatttgaaacctgctaatattttagttatgggtgaaggtcctgagcgaggaagagtaaaaattgctgacatgggctttgcccgattatttaattcacctttgaagcctttagcagatttggatccagtggttgttacattctggtaccgagcccctgaactacttcttggagcaaggcattataccaaagctattgataaagattgggaagatataaaaaagatgcctgaacattcaacattaatgaaagatttcagaagaaatacgtataccaactgcagccttatcaagtatatggaaaaacataaagttaaaccagatagtaaagcattccacttgcttcagaagctgcttaccatggacccaataaagcgaattacctcagaacaggctatgcaggacccctatttcttagaagacccacttcctacatcagacgtttttgccggttgtcaaatcccttacccaaaacgagaatttttaacggaagaagaacctgatgacaaaggagacaaaaagaaccagcagcagcagcagggcaataaccacactaatggaactggccacccagggaatcaagacagcagtcacacacagggacccccgttgaagaaagtgagagttgttcctcctaccactacctcaggtggacttatcatgacctcagactatcagcgttccaatccacatgctgcctatcccaaccctggaccaagcacatcacagccgcagagcagcatgggatactcagctacctcccagcagcctccacagtactcacatcagacacatcggtactgagctgcatcggaatcttgtccatgcactgttgcgaatgctgcagggctgactgtgcagctctctgcgggaacctggtatgggccatgagaatgtactgtacaaccacatcttcaaaatgtccagtagccaagttccaccacttttcacagattggggtagtggcttccaagttgtacctattttggagttagacttgaaaagaaagtgctagcacagtttgtgttgtggatttgctacttccatagtttacttgacatggttcagactgaccaatgcatttttttcagtgacagtctgtagcagttgaagctgtgaatgtgctaggggcaagcatttgtctttgtatgtggtgaattttttcagtgtaacaacattatctgaccaatagtacacacacagacacaaagtttaactggtacttgaaacatacagtatatgttaacgaaataaccaagactcgaaatgagattattttggtacacctttctttttagtgtcttatcagtgggctgattcattttctacattaatcagtgttttctgaccaagaatattgcttggatttttttgaaagtacaaaaagccacatagtttttccagaaaggtttcaaaactcccaaagattaacttccaacttataagtttgtttttattttcaatctatgacttgactggtattaaagctgctatttgatagtaattaaatatgttgtcattgatataaacctgtttggttcagcaaacaaactaaaatgattgtcatagacagtgttttatttttcctgttggtgttgctgatttgtgagcatgctttaagatgaaaaaagcatgaatgataacttccttaaaaaggtgcggcatccaattcaaatattttcgtcctgattttaaagctggttggtgtagtgctattaaaatttcgttcagttaattttccttttgaaaacttgttcgcacgttgtttagggtgcccttacttcagcaaaggagaaggagtaggagagccttagaatttttgaggaaaaaaaaacctataacatacaatgtactgtatcaaactattttacatgaatgacacaagtattctgaataaaaaataattgaacattgttaaaaacaaggtgttatgtaataaatttatttttcataaatcaaaa

SEQ ID NO: 448270 - DNA, 2303 bp, Homo sapiens
tacacaactttttttccttagtctgtatactttctgctgtcactagcataacagaaaagacgaatggcttttgttttaaactgagggcacttttacaaaagtcatctttccatttatttttctttcagaaaaaagaatttgggttttgagcttttttaaaaaaaaaagacaaacactttccttgactttgagaaataatttaagtcaaagaatctgctctatgctaaccaagagatagagcacagcaaagatctgccagccccaggcctctacctagtggcctggaaattcaagtattcttattggtggaggccatttgtttctgattagaagctgtctaaacctcctactcctcaactcaaaggaaaacacagagcataccatggccaagaaagttgcagtgattggagctggtgtgagtggcctctcctccatcaaatgctgtgtggatgaggacctggagcccacctgctttgagagaagtgatgacattgggggattatggaagtttactgaatcttccaaagatgggatgaccagggtctataagtcattagtgacaaatgtctgtaaggaaatgtcatgttacagtgacttccctttccacgaagattatcctaatttcatgaaccatgaaaaattttgggactatctccaagaatttgctgagcactttgacctcctgaaatacattcagtttaagaccactgtgtgcagcataacgaagcgtccagacttctccgaaactggtcagtgggatgttgtcacagagacagagggcaagcaaaatagagctgtctttgatgctgttatggtttgcactggacatttcctgaatccccatttacctttggaagcctttcctggaattcataagtttaaaggtcagatcctgcatagtcaagagtacaagatcccagaaggctttcagggcaaacgcgtcttggtgattggtcttgggaacactggaggagacattgctgtggaactcagtcgaacggcagctcaggtacttctcagtactagaactggtacctgggttcttgggcgctcttcagattggggctatccttataatatgatggttacaagaagatgctgtagttttattgcacaagttctgccttcacgttttctaaactggattcaagaaaggaagttgaataagagatttaatcatgaggattatggattaagtattaccaaagggaaaaaagcaaaattcattgtgaatgatgagctgccaaactgtatcctctgtggggcaatcactatgaaaaccagcgtgattgaatttacagaaacctctgctgtctttgaagatgggacagtggaagaaaacattgatgttgtgatcttcactacaggatatacattttcttttccattttttgaagaacctcttaaaagcctctgtacaaagaagatatttctatacaagcaagtctttcccttaaacctagagagagcgacattagccatcatcggccttatcggccttaaaggatccatcttatcaggcacagagctccaagcacgatgggtcacaagagtattcaaaggactctgtaagatacctccatcccaaaaattgatgatggaggctactgaaaaggaacagctcattaaaaggggagtgtttaaagacaccagcaaagacaaatttgactacattgcctacatggatgatatcgctgcctgcataggcacaaagcccagcatcccacttctgttcctcaaggatcccagactagcttgggaagttttctttggaccatgtactccttatcagtaccgcctcatgggccctggaaaatgggatggagccagaaatgccatcctgacccagtgggacagaacattgaaacctttaaaaactcgaattgtccctgattcctccaagcctgcctccatgtcacattatttaaaagcctggggggcacctgtcctacttgcctctcttctacttatctgtaaatcttcacttttcttgaaattggtgagagataaactacaggacagaatgtccccttacctagtaagtctttggcgaggatgaacctgattgttacaagggttacacaaagtcatgctaattctatctccaagtatcttgtgcatccctcctctgctctccatcataactgctattagccaaattcaggcccagtcatctcctatctgaattattgtattatcttcttctttgttttcagtaccctctttcttgccaccctttccaatgcatcttctaccctgctacctcagtgattattctaaaataaatatatatgatatggttt

SEQ ID NO: 448271 - DNA, 1908 bp, Homo sapiens
tacacaactttttttccttagtctgtatactttctgctgtcactagcataacagaaaagacgaatggcttttgttttaaactgagggcacttttacaaaagtcatctttccatttatttttctttcagaaaaaagaatttgggttttgagcttttttaaaaaaaaaagacaaacactttccttgactttgagaaataatttaagtcaaagaatctgctctatgctaaccaagagatagagcacagcaaagatctgccagccccaggcctctacctagtggcctggaaattcaagtattcttattggtggaggccatttgtttctgattagaagctgtctaaacctcctactcctcaactcaaaggaaaacacagagcataccatggccaagaaagttgcagtgattggagctggtgtgagtggcctctcctccatcaaatgctgtgtggatgaggacctggagcccacctgctttgagagaagtgatgacattgggggattatggaagtttactgaatcttccaaagatgggatgaccagggtctataagtcattagtgacaaatgtctgtaaggaaatgtcatgttacagtgacttccctttccacgaagattatcctaatttcatgaaccatgaaaaattttgggactatctccaagaatttgctgagcactttgacctcctgaaatacattcagtttaaggactctgtaagatacctccatcccaaaaattgatgatggaggctactgaaaaggaacagctcattaaaaggggagtgtttaaagacaccagcaaagacaaatttgactacattgcctacatggatgatatcgctgcctgcataggcacaaagcccagcatcccacttctgttcctcaaggatcccagactagcttgggaagttttctttggaccatgtactccttatcagtaccgcctcatgggccctggaaaatgggatggagccagaaatgccatcctgacccagtgggacagaacattgaaacctttaaaaactcgaattgtccctgattcctccaagcctgcctccatgtcacattatttaaaagcctggggggcacctgtcctacttgcctctcttctacttatctgtaaatcttcacttttcttgaaattggtgagagataaactacaggacagaatgtccccttacctagtaagtctttggcgaggatgaacctgattgttacaagggttacacaaagtcatgctaattctatctccaagtatcttgtgcatccctcctctgctctccatcataactgctattagccaaattcaggcccagtcatctcctatctgaattattgtattatcttcttctttgttttcagtaccctctttcttgccaccctttccaatgcatcttctaccctgctacctcagtgattattctaaaataaatatatatgatatggtttagctgtgtccccacccaaatctcatcttgaattgtagctcccataattcccacatgccgtgggaggtaggtaattgaatcatgggggcaggtcttctcccatactgttctcatggtagtgaataagtctcactatatctgatggttttataaatgacagttcccctgcacaagctctctcgtgtctaccaccatgtaagacgtgtctttgctccttcttcaccttccaccatgattgtgaggcctccccagccatgtggaactgtgagtctgttaaacctcccttcctttataaattacccagtcttgggtatgtctttattagcagcaatagaacagactaatacaatatggtttattactctaaagtaaatatatggtttataaatatataggaacctctgattcccaggaaggtctcagtaggaacaaaatggcattcaaattaagttgagaaaatttttt

SEQ ID NO: 448272 - DNA, 533 bp, Homo sapiens
tgaagcaactgctttaaaagggcacattcatatggaattcaagatttcctatgtttttaacaaggcagtttgtactaaatccacatctgggctcacagcatcccagggagagggaggttatatgctttttctacttcctgccacaagcagcataagcaaaggactgccatagttgtgggacttccctttttccacagaccctatccctgcgtagtgagaaattataactttagacatttcagactttctgatccttcactcctctcaggaattcataagtttaaaggtcagatcctgcatagtcaagagtacaagatcccagaaggctttcagggcaaacgcgtcttggtgattggtcttgggaacactggaggagacattgctgtggaactcagtcgaacggcagctcaggtacatcatctctgaattaatgcccctaatcccatcatcagttatgatggctggaaagagatattcaaaactatgaagtacattggccaattgctaaattatgcagacacacagtaagtggg

SEQ ID NO: 448273 - DNA, 2767 bp, Homo sapiens
tacacaactttttttccttagtctgtatactttctgctgtcactagcataacagaaaagacgaatggcttttgttttaaactgagggcacttttacaaaagtcatctttccatttatttttctttcagaaaaaagaatttgggttttgagcttttttaaaaaaaaaagacaaacactttccttgactttgagaaataatttaagtcaaagaatctgctctatgctaaccaagagatagagcacagcaaagatctgccagccccaggcctctacctagtggcctggaaattcaagtattcttattggtggaggccatttgtttctgattagaagctgtctaaacctcctactcctcaactcaaaggaaaacacagagcataccatggccaagaaagttgcagtgattggagctggtgtgagtggcctctcctccatcaaatgctgtgtggatgaggacctggagcccacctgctttgagagaagtgatgacattgggggattatggaagtttactgaatcttccaaagatgggatgaccagggtctataagtcattagtgacaaatgtctgtaaggaaatgtcatgttacagtgacttccctttccacgaagattatcctaatttcatgaaccatgaaaaattttgggactatctccaagaatttgctgagcactttgacctcctgaaatacattcagtttaagaccactgtgtgcagcataacgaagcgtccagacttctccgaaactggtcagtgggatgttgtcacagagacagagggcaagcaaaatagagctgtctttgatgctgttatggtttgcactggacatttcctgaatccccatttacctttggaagcctttcctggaattcataagtttaaaggtcagatcctgcatagtcaagagtacaagatcccagaaggctttcagggcaaacgcgtcttggtgattggtcttgggaacactggaggagacattgctgtggaactcagtcgaacggcagctcaggtacttctcagtactagaactggtacctgggttcttgggcgctcttcagattggggctatccttataatatgatggttacaagaagatgctgtagttttattgcacaagttctgccttcacgttttctaaactggattcaagaaaggaagttgaataagagatttaatcatgaggattatggattaagtattaccaaagggaaaaaagcaaaattcattgtgaatgatgagctgccaaactgtatcctctgtggggcaatcactatgaaaaccagcgtgattgaatttacagaaacctctgctgtctttgaagatgggacagtggaagaaaacattgatgttgtgatcttcactacaggatatacattttcttttccattttttgaagaacctcttaaaagcctctgtacaaagaagatatttctatacaagcaagtctttcccttaaacctagagagagcgacattagccatcatcggccttatcggccttaaaggatccatcttatcaggcacagagctccaagcacgatgggtcacaagagtattcaaaggactctgtaagatacctccatcccaaaaattgatgatggaggctactgaaaaggaacagctcattaaaaggggagtgtttaaagacaccagcaaagacaaatttgactacattgcctacatggatgatatcgctgcctgcataggcacaaagcccagcatcccacttctgttcctcaaggatcccagactagcttgggaagttttctttggaccatgtactccttatcagtaccgcctcatgggccctggaaaatgggatggagccagaaatgccatcctgacccagtgggacagaacattgaaacctttaaaaactcgaattgtccctgattcctccaagcctgcctccatgtcacattatttaaaagcctggggggcacctgtcctacttgcctctcttctacttatctgtaaatcttcacttttcttgaaattggtgagagataaactacaggacagaatgtccccttacctagtaagtctttggcgaggatgaacctgattgttacaagggttacacaaagtcatgctaattctatctccaagtatcttgtgcatccctcctctgctctccatcataactgctattagccaaattcaggcccagtcatctcctatctgaattattgtattatcttcttctttgttttcagtaccctctttcttgccaccctttccaatgcatcttctaccctgctacctcagtgattattctaaaataaatatatatgatatggtttagctgtgtccccacccaaatctcatcttgaattgtagctcccataattcccacatgccgtgggaggtaggtaattgaatcatgggggcaggtcttctcccatactgttctcatggtagtgaataagtctcactatatctgatggttttataaatgacagttcccctgcacaagctctctcgtgtctaccaccatgtaagacgtgtctttgctccttcttcaccttccaccatgattgtgaggcctccccagccatgtggaactgtgagtctgttaaacctcccttcctttataaattacccagtcttgggtatgtctttattagcagcaatagaacagactaatacaatatggtttattactctaaagtaaatatatggtttataaatatataggaacctctgattcccaggaaggtctcagtaggaacaaaatggcattcaaattaagttgagaaaatttttt

SEQ ID NO: 448274 - DNA, 1418 bp, Homo sapiens
tacacaactttttttccttagtctgtatactttctgctgtcactagcataacagaaaagacgaatggcttttgttttaaactgagggcacttttacaaaagtcatctttccatttatttttctttcagaaaaaagaatttgggttttgagcttttttaaaaaaaaaagacaaacactttccttgactttgagaaataatttaagtcaaagaatctgctctatgctaaccaagagatagagcacagcaaagatctgccagccccaggcctctacctagtggcctggaaattcaagtattcttattggtggaggccatttgtttctgattagaagctgtctaaacctcctactcctcaactcaaaggaaaacacagagcataccatggccaagaaagttgcagtgattggagctggtgtgagtggcctctcctccatcaaatgctgtgtggatgaggacctggagcccacctgctttgagagaagtgatgacattgggggattatggaagtttactgaatcttccaaagatgggatgaccagggtctataagtcattagtgacaaatgtctgtaaggaaatgtcatgttacagtgacttccctttccacgaagattatcctaatttcatgaaccatgaaaaattttgggactatctccaagaatttgctgagcactttgacctcctgaaatacattcagtttaagaccactgtgtgcagcataacgaagcgtccagacttctccgaaactggtcagtgggatgttgtcacagagacagagggcaagcaaaatagagctgtctttgatgctgttatggtttgcactggacatttcctgaatccccatttacctttggaagcctttcctggaattcataagtttaaaggtcagatcctgcatagtcaagagtacaagatcccagaaggctttcagggcaaacgcgtcttggtgattggtcttgggaacactggaggagacattgctgtggaactcagtcgaacggcagctcaggtacttctcagtactagaactggtacctgggttcttgggcgctcttcagattggggctatccttataatatgatggttacaagaagatgctgtagttttattgcacaagttctgccttcacgttttctaaactggattcaagaaaggaagttgaataagagatttaatcatgaggattatggattaagtattaccaaagggtacttacattttttatttagtagaaaaaatattaaatcaatatttatcattacattttattcagaattcaaaatgttcaataattgtaatattgcctttgtttattctactctaaatccatttccctaaaacactgttcatcaggtaccacagcagtttttaaaatatatgtattctctttctggtggcaaaagtagtgattcatgag

SEQ ID NO: 448275 - DNA, 2514 bp, Homo sapiens
ggctgagccggaccgagccgagaggacccgagtggggccgaggccagtagccccggggccctgagcagaggccgtagcttgcgccgcacccgcggccaggcggagcaaaagatgccggcctctgctgcgcggccccgcccgggtcccgggcagcctacagcctcgcccttcccgctactgctgctggcggtgctgagcggcccggtatccggccgcgtcccccgctcggtgcccagaacctcgcttccaatctctgaggctgactcctgtctcacccggttcgcagtccctcacacatacaattactctgttctccttgtggatcctgcctcccacacactttatgttggcgcccgggacaccatcttcgctttatccctgcccttctcaggggagagaccccgcaggattgactggatggttcctgaggctcacagacagaactgtaggaagaaaggcaagaaagagggggacctcgggggccggaagaccctccagcagagatggacgacgtttttgaaagctgacctgctctgtccagggcctgagcatggccgggcctccagtgtcctgcaggatgttgctgtgcttcgacctgagcttggggcagggactcccatcttttatggcatcttttcttcccagtgggagggggctactatctctgctgtctgtgccttccgaccacaagacattcggacagtgctgaatggtcccttcagagaactaaaacatgactgcaacagaggactgcctgtcgtggacaatgatgtgccccagcccagacctggagagtgcatcaccaacaacatgaagctccggcactttggctcatctctctccctgcctgaccgcgtactcaccttcatccgggaccacccactcatggacaggccagtgtttccagctgatggccaccccctgctggtcactacagatacagcctatctcagagtcgtggcccacagggtgaccagcctctcagggaaagagtatgatgtgctctacctggggacagaggatggacacctccaccgagcagtgcggatcggagctcagctcagcgttcttgaagatctggccttattcccagagccacagccagttgagaacatgaaattgtaccacagctggctcctggttggctcccgtactgaggtgacacaagtgaatacaaccaactgtggccgtctccagagctgctcagagtgcatcctggcccaggacccagtctgtgcctggagcttccggctggatgagtgtgtggcccatgccggggagcaccgagggttggtccaagacatagagtcagcagatgtctcctctttgtgtcctaaagagcctggagaacgtccagtagtgtttgaagttcccgtggctacagctgcgcatgtggtcttgccatgttctccaagctcagcatgggcatcctgtgtgtggcaccagcccagtggagtgactgcactcaccccccggcgggatggactggaggtggtggtgaccccaggggccatgggcgcttatgcctgtgaatgtcaggagggtggggcagcccatgtggtagcagcttacagcttggtatggggcagccagcgagatgctccgagccgggcccacacagtgggggcgggactggctggcttcttcttggggattctcgcagcatccctgactctcattctgattggtcggcgtcagcagcgacggcgacagagggaacttctggctagagacaaggtgggcctggacctgggggctccaccttctgggaccacaagctacagccaagaccctccctccccctctcctgaagatgagcggttgccgctggccctggccaagaggggcagtggctttggtggattctcaccacccttcctgcttgatccttgcccaagcccagcccacattcggctaactggggctcctctagccacatgtgatgaaacatccatctagagctgggcaaatgaccactagtgtataagtgatcactggaacggagtgaccactgagatgctgggggtcactgggcctggaagaccatcccagcctctgagttctctttgagtatgagtgattacttggattttagtatctgttctctctgagcctggatgggcttggggccagacctttgcctgattcctgattcccatgagaaatcagaactgctttctgcagcaaatcagggcttccccctaacatctgaactcctgtaaaccttcatccctggccccctatcttgggcccattagttttggggatggggcacagggcatagctatgactttgctttctggttggagcctggccggaaggaagagccctggaggtggttgggggcaaatgtgccctgagtccttggggtggttctgcttattcttcaagtttatctgaatctgtggggagtgcatgatccccatgttgcaatatggagtctctgccctgagatcttccccatctcagttttccttccatgaaagagtacgtgtaaatacatagtgttcataa

SEQ ID NO: 448276 - DNA, 4062 bp, Homo sapiens
ggctgagccggaccgagccgagaggacccgagtggggccgaggccagtagccccggggccctgagcagaggccgtagcttgcgccgcacccgcggccaggcggagcaaaagatgccggcctctgctgcgcggccccgcccgggtcccgggcagcctacagcctcgcccttcccgctactgctgctggcggtgctgagcggcccggtatccggccgcgtcccccgctcggtgcccagaacctcgcttccaatctctgaggctgactcctgtctcacccggttcgcagtccctcacacatacaattactctgttctccttgtggatcctgcctcccacacactttatgttggcgcccgggacaccatcttcgctttatccctgcccttctcaggggagagaccccgcaggattgactggatggttcctgaggctcacagacagaactgtaggaagaaaggcaagaaagaggacgaatgtcacaattttgtccagattctcgccattgccaatgcctctcacctcctcacttgtggcaccttcgcttttgatccgaagtgcggggttattgatgtgtccaggttccagcaggttgaaagacttgagagtggccgggggaaatgtccttttgagccagctcagcggtcagcagctgtaatggctgggggggtcctctatgctgccactgtgaaaaactacctggggacggagccaattatcaccagagcagtgggtcgtgccgaggactggattcggacagataccttgccttcctggctgaacgccccagcctttgtcgcagccgtggccttgagcccagccgaatggggggatgaagatggagacgacgaaatctacttcttctttacggagacttcccgagcatttgactcatacgagcgcattaaagtcccacgggtggcccgtgtgtgtgcgggggacctcgggggccggaagaccctccagcagagatggacgacgtttttgaaagctgacctgctctgtccagggcctgagcatggccgggcctccagtgtcctgcaggatgttgctgtgcttcgacctgagcttggggcagggactcccatcttttatggcatcttttcttcccagtgggagggggctactatctctgctgtctgtgccttccgaccacaagacattcggacagtgctgaatggtcccttcagagaactaaaacatgactgcaacagaggactgcctgtcgtggacaatgatgtgccccagcccagacctggagagaggatggacacctccaccgagcagtgcggatcggagctcagctcagcgttcttgaagatctggccttattcccagagccacagccagttgagaacatgaaattgtaccacagctggctcctggttggctcccgtactgaggtgacacaagtgaatacaaccaactgtggccgtctccagagctgctcagagtgcatcctggcccaggacccagtctgtgcctggagcttccggctggatgagtgtgtggcccatgccggggagcaccgagggttggtccaagacatagagtcagcagatgtctcctctttgtgtcctaaagagcctggagaacgtccagtagtgtttgaagttcccgtggctacagctgcgcatgtggtcttgccatgttctccaagctcagcatgggcatcctgtgtgtggcaccagcccagtggagtgactgcactcaccccccggcgggatggactggaggtggtggtgaccccaggggccatgggcgcttatgcctgtgaatgtcaggagggtggggcagcccatgtggtagcagcttacagcttggtatggggcagccagcgagatgctccgagccgggcccacacagtgggggcgggactggctggcttcttcttggggattctcgcagcatccctgactctcattctgattggtcggcgtcagcagcgacggcgacagagggaacttctggctagagacaaggtgggcctggacctgggggctccaccttctgggaccacaagctacagccaagaccctccctccccctctcctgaagatgagcggttgccgctggccctggccaagaggggcagtggctttggtggattctcaccacccttcctgcttgatccttgcccaagcccagcccacattcggctaactggggctcctctagccacatgtgatgaaacatccatctagagctgggcaaatgaccactagtgtataagtgatcactggaacggagtgaccactgagatgctgggggtcactgggcctggaagaccatcccagcctctgagttctctttgagtatgagtgattacttggattttagtatctgttctctctgagcctggatgggcttggggccagacctttgcctgattcctgattcccatgagaaatcagaactgctttctgcagcaaatcagggcttccccctaacatctgaactcctgtaaaccttcatccctggccccctatcttgggcccattagttttggggatggggcacagggcatagctatgactttgctttctggttggagcctggccggaaggaagagccctggaggtggttgggggcaaatgtgccctgagtccttggggtggttctgcttattcttcaagtttatctgaatctgtggggagtgcatgatccccatgttgcaatatggagtctctgccctgagatcttccccatctcagttttccttccatgaaagagtacgtgtaaatacatagtgttcataagagacctggccacatgtgcatgaatgactgggccgatgcttaggaatatttatgagggatggggagggagacaattggaatgggggcgttgcctgcagaactttagaccctgtagccatagagggaatggcgttcctttctaaaaggaactgaaacactgcccctctccccattgccccacaaccttactctaaatttgagtagagaaaagctcctaaagtgaccttccgggtgggaagggcagcagtacacatgaccccatccttttctttgtttttaccccctggctgccaccactgccatgtcacagctgctttctctggctggagtgtaggctgtaccccatttccttggctcccattaaaaatcaacaacattctaatgattagggaacaacagaaggggaacagtcataggatatacgagcagtataaagatacgtttgcaatcagtgactactcagggtgacacccttgccctaaagcaggagtcccccctacctggggtccatggactccctgaaattgtatgcaaaatgttgtttgtacatgtgtgtctgtatgtctctgtggggaggttttatggcttttgtcagattttcaaggccttaacaaagttaaaggaccactgccctgaggttactgcactgaggccaagttaggatggcatcactctgtggcagctctccctggacttgccctgcctggaacagggtgatttgctggaatggagttaccactgagatgccaaaggttgctgggtctggaagactgttgtggcctctcagttctctttgagtctgactgactgtggccagtccctggactggtagctgctggaggccttcttgtttctccagtccctggaagctgagctctatgtgtatttgatgacattgtcagctcttaccaaacgtcaagacctcttcctgcttgaccactcgcacatggctctaggcttctcctgctgagtcctggtcttggcctgtgaatgtgcctcgttcatccctggtgcttgagcccctcaagctccagtcaatgatccagtccttcccctttgaagttttctgctctactttccttggcagcagcctgtgaactactcaaaagagtccccttgggtttggaattatcagtggctttgccactagtaaatgtgtgatcttcggcaagtaacctaacctagggacatcagtttactcatctgcgaagtggggataataaaacctacctcagggttgcttcaaggattaaatgagaaaatatgtcaacaataaagacctgtctgtaccaataaaaaaaaaaat

SEQ ID NO: 448277 - DNA, 4540 bp, Homo sapiens
ggctgagccggaccgagccgagaggacccgagtggggccgaggccagtagccccggggccctgagcagaggccgtagcttgcgccgcacccgcggccaggcggagcaaaagatgccggcctctgctgcgcggccccgcccgggtcccgggcagcctacagcctcgcccttcccgctactgctgctggcggtgctgagcggcccggtatccggccgcgtcccccgctcggtgcccagaacctcgcttccaatctctgaggctgactcctgtctcacccggttcgcagtccctcacacatacaattactctgttctccttgtggatcctgcctcccacacactttatgttggcgcccgggacaccatcttcgctttatccctgcccttctcaggggagagaccccgcaggattgactggatggttcctgaggctcacagacagaactgtaggaagaaaggcaagaaagaggacgaatgtcacaattttgtccagattctcgccattgccaatgcctctcacctcctcacttgtggcaccttcgcttttgatccgaagtgcggggttattgatgtgtccaggttccagcaggttgaaagacttgagagtggccgggggaaatgtccttttgagccagctcagcggtcagcagctgtaatggctgggggggtcctctatgctgccactgtgaaaaactacctggggacggagccaattatcaccagagcagtgggtcgtgccgaggactggattcggacagataccttgccttcctggctgaacgccccagcctttgtcgcagccgtggccttgagcccagccgaatggggggatgaagatggagacgacgaaatctacttcttctttacggagacttcccgagcatttgactcatacgagcgcattaaagtcccacgggtggcccgtgtgtgtgcgggggacctcgggggccggaagaccctccagcagagatggacgacgtttttgaaagctgacctgctctgtccagggcctgagcatggccgggcctccagtgtcctgcaggatgttgctgtgcttcgacctgagcttggggcagggactcccatcttttatggcatcttttcttcccagtgggagggggctactatctctgctgtctgtgccttccgaccacaagacattcggacagtgctgaatggtcccttcagagaactaaaacatgactgcaacagaggactgcctgtcgtggacaatgatgtgccccagcccagacctggagagtgcatcaccaacaacatgaagctccggcactttggctcatctctctccctgcctgaccgcgtactcaccttcatccgggaccacccactcatggacaggccagtgtttccagctgatggccaccccctgctggtcactacagatacagcctatctcagagtcgtggcccacagggtgaccagcctctcagggaaagagtatgatgtgctctacctggggacaggtatatttaatggtcaagcaggctgcctacctagtgcatacacattctcgtcacagagagggtactgtaatacatataggtctgagtcccaggcacaggggcaattatgtaattattcttgttcctttcctgtcccctagaggatggacacctccaccgagcagtgcggatcggagctcagctcagcgttcttgaagatctggccttattcccagagccacagccagttgagaacatgaaattgtaccacgtgagttgtagattttggagagtctattggggagacatctgagtccagagccagtttgtgagccctgaggtctgggagatccagtgtattccccttccccactccgtttttatagagctggctcctggttggctcccgtactgaggtgacacaagtgaatacaaccaactgtggccgtctccagagctgctcagagtgcatcctggcccaggacccagtctgtgcctggagcttccggctggatgagtgtgtggcccatgccggggagcaccgagggttggtccaagacatagagtcagcagatgtctcctctttgtgtcctaaagagcctggagaacgtccagtagtgtttgaagttcccgtggctacagctgcgcatgtggtcttgccatgttctccaagctcagcatgggcatcctgtgtgtggcaccagcccagtggagtgactgcactcaccccccggcgggatggactggaggtggtggtgaccccaggggccatgggcgcttatgcctgtgaatgtcaggagggtggggcagcccatgtggtagcagcttacagcttggtatggggcagccagcgagatgctccgagccgggcccacacagtgggggcgggactggctggcttcttcttggggattctcgcagcatccctgactctcattctgattggtcggcgtcagcagcgacggcgacagagggaacttctggctagagacaaggtgggcctggacctgggggctccaccttctgggaccacaagctacagccaagaccctccctccccctctcctgaagatgagcggttgccgctggccctggccaagaggggcagtggctttggtggattctcaccacccttcctgcttgatccttgcccaagcccagcccacattcggctaactggggctcctctagccacatgtgatgaaacatccatctagagctgggcaaatgaccactagtgtataagtgatcactggaacggagtgaccactgagatgctgggggtcactgggcctggaagaccatcccagcctctgagttctctttgagtatgagtgattacttggattttagtatctgttctctctgagcctggatgggcttggggccagacctttgcctgattcctgattcccatgagaaatcagaactgctttctgcagcaaatcagggcttccccctaacatctgaactcctgtaaaccttcatccctggccccctatcttgggcccattagttttggggatggggcacagggcatagctatgactttgctttctggttggagcctggccggaaggaagagccctggaggtggttgggggcaaatgtgccctgagtccttggggtggttctgcttattcttcaagtttatctgaatctgtggggagtgcatgatccccatgttgcaatatggagtctctgccctgagatcttccccatctcagttttccttccatgaaagagtacgtgtaaatacatagtgttcataagagacctggccacatgtgcatgaatgactgggccgatgcttaggaatatttatgagggatggggagggagacaattggaatgggggcgttgcctgcagaactttagaccctgtagccatagagggaatggcgttcctttctaaaaggaactgaaacactgcccctctccccattgccccacaaccttactctaaatttgagtagagaaaagctcctaaagtgaccttccgggtgggaagggcagcagtacacatgaccccatccttttctttgtttttaccccctggctgccaccactgccatgtcacagctgctttctctggctggagtgtaggctgtaccccatttccttggctcccattaaaaatcaacaacattctaatgattagggaacaacagaaggggaacagtcataggatatacgagcagtataaagatacgtttgcaatcagtgactactcagggtgacacccttgccctaaagcaggagtcccccctacctggggtccatggactccctgaaattgtatgcaaaatgttgtttgtacatgtgtgtctgtatgtctctgtggggaggttttatggcttttgtcagattttcaaggccttaacaaagttaaaggaccactgccctgaggttactgcactgaggccaagttaggatggcatcactctgtggcagctctccctggacttgccctgcctggaacagggtgatttgctggaatggagttaccactgagatgccaaaggttgctgggtctggaagactgttgtggcctctcagttctctttgagtctgactgactgtggccagtccctggactggtagctgctggaggccttcttgtttctccagtccctggaagctgagctctatgtgtatttgatgacattgtcagctcttaccaaacgtcaagacctcttcctgcttgaccactcgcacatggctctaggcttctcctgctgagtcctggtcttggcctgtgaatgtgcctcgttcatccctggtgcttgagcccctcaagctccagtcaatgatccagtccttcccctttgaagttttctgctctactttccttggcagcagcctgtgaactactcaaaagagtccccttgggtttggaattatcagtggctttgccactagtaaatgtgtgatcttcggcaagtaacctaacctagggacatcagtttactcatctgcgaagtggggataataaaacctacctcagggttgcttcaaggattaaatgagaaaatatgtcaacaataaagacctgtctgtaccaataaaaaaaaaaat

SEQ ID NO: 448278 - DNA, 4285 bp, Homo sapiens
ggctgagccggaccgagccgagaggacccgagtggggccgaggccagtagccccggggccctgagcagaggccgtagcttgcgccgcacccgcggccaggcggagcaaaagatgccggcctctgctgcgcggccccgcccgggtcccgggcagcctacagcctcgcccttcccgctactgctgctggcggtgctgagcggcccggtatccggccgcgtcccccgctcggtgcccagaacctcgcttccaatctctgaggctgactcctgtctcacccggttcgcagtccctcacacatacaattactctgttctccttgtggatcctgcctcccacacactttatgttggcgcccgggacaccatcttcgctttatccctgcccttctcaggggagagaccccgcaggattgactggatggttcctgaggctcacagacagaactgtaggaagaaaggcaagaaagaggacgaatgtcacaattttgtccagattctcgccattgccaatgcctctcacctcctcacttgtggcaccttcgcttttgatccgaagtgcggggttattgatgtgtccaggttccagcaggttgaaagacttgagagtggccgggggaaatgtccttttgagccagctcagcggtcagcagctgtaatggctgggggggtcctctatgctgccactgtgaaaaactacctggggacggagccaattatcaccagagcagtgggtcgtgccgaggactggattcggacagataccttgccttcctggctgaacgccccagcctttgtcgcagccgtggccttgagcccagccgaatggggggatgaagatggagacgacgaaatctacttcttctttacggagacttcccgagcatttgactcatacgagcgcattaaagtcccacgggtggcccgtgtgtgtgcgggggacctcgggggccggaagaccctccagcagagatggacgacgtttttgaaagctgacctgctctgtccagggcctgagcatggccgggcctccagtgtcctgcaggatgttgctgtgcttcgacctgagcttggggcagggactcccatcttttatggcatcttttcttcccagtgggagggggctactatctctgctgtctgtgccttccgaccacaagacattcggacagtgctgaatggtcccttcagagaactaaaacatgactgcaacagaggactgcctgtcgtggacaatgatgtgccccagcccagacctggagagtgcatcaccaacaacatgaagctccggcactttggctcatctctctccctgcctgaccgcgtactcaccttcatccgggaccacccactcatggacaggccagtgtttccagctgatggccaccccctgctggtcactacagatacagcctatctcagagtcgtggcccacagggtgaccagcctctcagggaaagagtatgatgtgctctacctggggacagaggatggacacctccaccgagcagtgcggatcggagctcagctcagcgttcttgaagatctggccttattcccagagccacagccagttgagaacatgaaattgtaccacagctggctcctggttggctcccgtactgaggtgacacaagtgaatacaaccaactgtggccgtctccagagctgctcagagtgcatcctggcccaggacccagtctgtgcctggagcttccggctggatgagtgtgtggcccatgccggggagcaccgagggttggtccaagacatagagtcagcagatgtctcctctttgtgtcctaaagagcctggagaacgtccagtagtgtttgaagttcccgtggctacagctgcgcatgtggtcttgccatgttctccaagctcagcatgggcatcctgtgtgtggcaccagcccagtggagtgactgcactcaccccccggcgggatggactggaggtggtggtgaccccaggggccatgggcgcttatgcctgtgaatgtcaggagggtggggcagcccatgtggtagcagcttacagcttggtatggggcagccagcgagatgctccgagccgggcccacacagtgggggcgggactggctggcttcttcttggggattctcgcagcatccctgactctcattctgattggtcggcgtcagcagcgacggcgacagagggaacttctggctagagacaaggtgggcctggacctgggggctccaccttctgggaccacaagctacagccaagaccctccctccccctctcctgaagatgagcggttgccgctggccctggccaagaggggcagtggctttggtggattctcaccacccttcctgcttgatccttgcccaagcccagcccacattcggctaactggggctcctctagccacatgtgatgaaacatccatctagagctgggcaaatgaccactagtgtataagtgatcactggaacggagtgaccactgagatgctgggggtcactgggcctggaagaccatcccagcctctgagttctctttgagtatgagtgattacttggattttagtatctgttctctctgagcctggatgggcttggggccagacctttgcctgattcctgattcccatgagaaatcagaactgctttctgcagcaaatcagggcttccccctaacatctgaactcctgtaaaccttcatccctggccccctatcttgggcccattagttttggggatggggcacagggcatagctatgactttgctttctggttggagcctggccggaaggaagagccctggaggtggttgggggcaaatgtgccctgagtccttggggtggttctgcttattcttcaagtttatctgaatctgtggggagtgcatgatccccatgttgcaatatggagtctctgccctgagatcttccccatctcagttttccttccatgaaagagtacgtgtaaatacatagtgttcataagagacctggccacatgtgcatgaatgactgggccgatgcttaggaatatttatgagggatggggagggagacaattggaatgggggcgttgcctgcagaactttagaccctgtagccatagagggaatggcgttcctttctaaaaggaactgaaacactgcccctctccccattgccccacaaccttactctaaatttgagtagagaaaagctcctaaagtgaccttccgggtgggaagggcagcagtacacatgaccccatccttttctttgtttttaccccctggctgccaccactgccatgtcacagctgctttctctggctggagtgtaggctgtaccccatttccttggctcccattaaaaatcaacaacattctaatgattagggaacaacagaaggggaacagtcataggatatacgagcagtataaagatacgtttgcaatcagtgactactcagggtgacacccttgccctaaagcaggagtcccccctacctggggtccatggactccctgaaattgtatgcaaaatgttgtttgtacatgtgtgtctgtatgtctctgtggggaggttttatggcttttgtcagattttcaaggccttaacaaagttaaaggaccactgccctgaggttactgcactgaggccaagttaggatggcatcactctgtggcagctctccctggacttgccctgcctggaacagggtgatttgctggaatggagttaccactgagatgccaaaggttgctgggtctggaagactgttgtggcctctcagttctctttgagtctgactgactgtggccagtccctggactggtagctgctggaggccttcttgtttctccagtccctggaagctgagctctatgtgtatttgatgacattgtcagctcttaccaaacgtcaagacctcttcctgcttgaccactcgcacatggctctaggcttctcctgctgagtcctggtcttggcctgtgaatgtgcctcgttcatccctggtgcttgagcccctcaagctccagtcaatgatccagtccttcccctttgaagttttctgctctactttccttggcagcagcctgtgaactactcaaaagagtccccttgggtttggaattatcagtggctttgccactagtaaatgtgtgatcttcggcaagtaacctaacctagggacatcagtttactcatctgcgaagtggggataataaaacctacctcagggttgcttcaaggattaaatgagaaaatatgtcaacaataaagacctgtctgtaccaataaaaaaaaaaat

SEQ ID NO: 448279 - DNA, 2786 bp, Homo sapiens
ggctgagccggaccgagccgagaggacccgagtggggccgaggccagtagccccggggccctgagcagaggccgtagcttgcgccgcacccgcggccaggcggagcaaaagatgccggcctctgctgcgcggccccgcccgggtcccgggcagcctacagcctcgcccttcccgctactgctgctggcggtgctgagcggcccggtatccggccgcgtcccccgctcggtgcccagaacctcgcttccaatctctgaggctgactcctgtctcacccggttcgcagtccctcacacatacaattactctgttctccttgtggatcctgcctcccacacactttatgttggcgcccgggacaccatcttcgctttatccctgcccttctcaggggagagaccccgcaggattgactggatggttcctgaggctcacagacagaactgtaggaagaaaggcaagaaagagggggggtcctctatgctgccactgtgaaaaactacctggggacggagccaattatcaccagagcagtgggtcgtgccgaggactggattcggacagataccttgccttcctggctgaacgccccagcctttgtcgcagccgtggccttgagcccagccgaatggggggatgaagatggagacgacgaaatctacttcttctttacggagacttcccgagcatttgactcatacgagcgcattaaagtcccacgggtggcccgtgtgtgtgcgggggacctcgggggccggaagaccctccagcagagatggacgacgtttttgaaagctgacctgctctgtccagggcctgagcatggccgggcctccagtgtcctgcaggatgttgctgtgcttcgacctgagcttggggcagggactcccatcttttatggcatcttttcttcccagtgggagggggctactatctctgctgtctgtgccttccgaccacaagacattcggacagtgctgaatggtcccttcagagaactaaaacatgactgcaacagaggactgcctgtcgtggacaatgatgtgccccagcccagacctggagagtgcatcaccaacaacatgaagctccggcactttggctcatctctctccctgcctgaccgcgtactcaccttcatccgggaccacccactcatggacaggccagtgtttccagctgatggccaccccctgctggtcactacagatacagcctatctcagagtcgtggcccacagggtgaccagcctctcagggaaagagtatgatgtgctctacctggggacagaggatggacacctccaccgagcagtgcggatcggagctcagctcagcgttcttgaagatctggccttattcccagagccacagccagttgagaacatgaaattgtaccacagctggctcctggttggctcccgtactgaggtgacacaagtgaatacaaccaactgtggccgtctccagagctgctcagagtgcatcctggcccaggacccagtctgtgcctggagcttccggctggatgagtgtgtggcccatgccggggagcaccgagggttggtccaagacatagagtcagcagatgtctcctctttgtgtcctaaagagcctggagaacgtccagtagtgtttgaagttcccgtggctacagctgcgcatgtggtcttgccatgttctccaagctcagcatgggcatcctgtgtgtggcaccagcccagtggagtgactgcactcaccccccggcgggatggactggaggtggtggtgaccccaggggccatgggcgcttatgcctgtgaatgtcaggagggtggggcagcccatgtggtagcagcttacagcttggtatggggcagccagcgagatgctccgagccgggcccacacagtgggggcgggactggctggcttcttcttggggattctcgcagcatccctgactctcattctgattggtcggcgtcagcagcgacggcgacagagggaacttctggctagagacaaggtgggcctggacctgggggctccaccttctgggaccacaagctacagccaagaccctccctccccctctcctgaagatgagcggttgccgctggccctggccaagaggggcagtggctttggtggattctcaccacccttcctgcttgatccttgcccaagcccagcccacattcggctaactggggctcctctagccacatgtgatgaaacatccatctagagctgggcaaatgaccactagtgtataagtgatcactggaacggagtgaccactgagatgctgggggtcactgggcctggaagaccatcccagcctctgagttctctttgagtatgagtgattacttggattttagtatctgttctctctgagcctggatgggcttggggccagacctttgcctgattcctgattcccatgagaaatcagaactgctttctgcagcaaatcagggcttccccctaacatctgaactcctgtaaaccttcatccctggccccctatcttgggcccattagttttggggatggggcacagggcatagctatgactttgctttctggttggagcctggccggaaggaagagccctggaggtggttgggggcaaatgtgccctgagtccttggggtggttctgcttattcttcaagtttatctgaatctgtggggagtgcatgatccccatgttgcaatatggagtctctgccctgagatcttccccatctcagttttccttccatgaaagagtacgtgtaaatacatagtgttcataa

SEQ ID NO: 448280 - DNA, 974 bp, Homo sapiens
tggagagcataaatcagatctaaattaagaataacttatttagcaatgctgttgctcaccttggggttgagcagtgcattgtggtgtttcagcagttattaatctagttaaatgtagttttgaaatgttagatggtagctttgcatgaaaggaattctagcaatctatcaagtatatattctgaaaacacaagttgtttaaaatgtaggattatttgtggttgtgaaagatgaaggaagttatagcaagataatgtcagatagcctttagggaaacgcacagttttaataactgattaagaaacagctactacattgattatatcaattatagtcatgtcataaagcttatgttttcagaagaatagaaacttcaagtagaatatcagattttaaaaagcattttattatgtattatgaaatatttcaaacataaaaagatgtaaagactatctaccaatgactccccccttaataaaacaaattaacctgaaggctgttttgtgcccctccttgattgtgcattcacctcccaacccctcgctccttgggcaactgttatctttgttatttgtcattgccttaacattagatttttttattactgcttttgtaattctaatgatatcaaatggaaaaaatattttgaatgcaactcctcttttaatttgctccaattttatctgtattttttagtccatgcctgtattataagtattataaatactatctgtatatacttttgctaaagtcgtgtgtatttgttaaactgatgatacagcttcataagattttaggtcagctaatggattgtcaatattttgtttagaatacttaccaggttataaattacaatttgaaacatagatatcctatagtttgagaatttgaacatagatatggattatgttgaaatcgactgcctttttcttagctatgacagtaataaactatataacaacagcaaaaaaaaaa

SEQ ID NO: 448281 - DNA, 4200 bp, Homo sapiens
gagagatgagaacctcaagtttatgaagaatagagatgtatacagtagtgattatttcagttttgttttgtctttagcttcattgaatgctactaaattaaagcatccatattatccttgcatggcaaaggtgagcttacagcttgctattcaattcctttttcaaacttatctacggacaaagaagaaactcagggttgatactgaagaatggattgctaccattgaagcattgctttcaaaaagttttgatgcttgtcagtggttagttgaatattttattagttctgaaggacgagaattgataaagattttcttactggagtgcaatgtgagagaagtacgagttgctgtggccaccattctggagaaaaccctagacagtgccttgttttatcaggataagttaaaaagccttcatcagttactggaggtactacttgctctgttggacaaagacgtcccagaaaattgtaaaaactgtgctcagtactttttcctgttcaacacttttgtacaaaagcaaggaattagggctggagatcttcttctgaggcattcagctctgcggcacatgatcagcttcctcctaggggccagtcggcaaaacaatcagatacgtcgatggagttcagcacaagcacgagaatttgggaatcttcacaatacagtggcgttacttgttttgcattcagatgtctcatcccaaaggaatgttgctcctggcatatttaagcaacgaccacccattagcattgctccctcaagccctctgttgcccctccatgaggaggtagaagccttgttgttcatgtctgaagggaaaccttacctgttagaggtaatgtttgctttgcgggagctgacaggctcgctcttggcactcattgagatggtagtgtactgctgtttctgtaatgagcatttttccttcacaatgctgcatttcattaagaaccaactaggaaacggctccacctcatgagttaaagaatacgttccaactacttcatgaaatattggttattgaagatcctatacaagtagagcgagtcaaatttgtgtttgagacagaaaatggattactagctttgatgcaccacagtaatcatgtggacagtagtcgctgctaccagtgtgtcaaatttcttgtcactcttgctcaaaagtgtcctgcagctaaggagtacttcaaggagaattcccaccactggagctgggctgtgcagtggctacagaagaagatgtcagaacattactggacaccacagagtaatgtctctaatgaaacatcaactggaaaaacctttcagcgaaccatttcagctcaggacacgttagcgtatgccacagctttgttgaatgaaaaagagcaatcaggaagcagtaatgggtcggagagtagtcctgccaatgagaacggagacaggcatctacagcagggttcagaatctcccatgatgattggtgagttgagaagtgaccttgatgatgttgatccctagaggaacatgcccagcctgagaggagtcaagacacaatactggatgctcagcaccttcttggaatcagaatctcgaaccctttggaagagcctggagattggactgggaaagctgctgtgacttgggcggatcgtgtatttctcaaggaaagcatttttaagccactagaaggtttgggagctgtttggcagtgggagaactccggcatgtggatcagctgtcccgggagcgtggtctatatgtggattcacatttctgtggagattttcggaaatagagccagtggcagacttttttgttacacgaacatacaagagtgagcataaagctgttgctttctctacgatgctacaaaagaaattcctttggtttttatattttaagaaaaagcaagctgcttttagatatgtgggggcaaatttttaatcttgcagtaatattaaacaggaatatccaatttaaaatgatgtaaagatgtaataaaattccttttcattgtaaaatagtaattaagtcaatttacacagacctttgtatttaatatgtctccctatttgtatagaatttcagatgggtctagatgagaaccctatgcataagcttggatcttgatgaaaggttaccaggatcaggatcaaaaattgggaaatactaagctcttgaagatatttttctgatataattagattgaaaagagcaattttgaaaatgctgtgttctccagaagtacagggtgcattatttgacatcaattacttaaagaagttatgagttgttccccaaacagattttaaaaacagcaaaataaaagcactttaagatataattttactgagtttaacttcacagaattatctttttaatgcttggagacatattgaataaactgtagtcttaaatcatgtgatctgcaatcgtttgcttttgcttaaaacataattactgaaacccttggtattggttgtatatgaagttaactatttgagttggtacacactgcttgtgagtttcatagttattgtaatgcagagaaggaatttgagaatttgtttctcctcaacatgactaattaacactgaaaagtcagtcaaggtttaagatttattttcccagaaataaatataaagcaattgaataaccatccatttagtcgtatttccaaagtatagcaccattcactcatttataccagctcccttttatggtgtggggggagaggtttacacccacatatttcatatatattttgtacattttgtattttgaattgctcacattttcggccctgttttgcctttagttacaggtcctgccttattttcatctcaccatgcacagaactagggagccttaggaagtgccaggttttcactgtcagatttgccaagtcacagaggcgcacaggccctgaagtgcctgtctggctgctgtggcattgtgtgggcatgtggccaggcagatggcatctcattactgtgctctcgccatggcccagtcttttcattctctggcagtgagggtttctgtgctgtcagacttcattgttattctgtgacttgctggaggttggcagtggcctttgtcaaacacactgagaagatggaagggccagcacttaagagcagaactgtacccttagagaaacggacagaggcgagtggcaaacttcagacggttccaatggtcttgcagtttgaaatgtgatgttctaccattggttttgagtacgtgaatacttcctgtcctactgtttcccctaccctattctcaccttctctccgcccacatcctcaccaagagattgtgtgggacatgaccttgaaatgctggcgatgatccacactgggatatcatcgctggcgactgcactctcaggagcccaaaatcaggagtgaaattgccacttctagtccccttatttcctatggaaacaacgccttccgcacccctagcacctgccgtcctcactgtaaagcttcatcaggatcgtccaccgtgtatattatacgcttcagatcatgttgcttatattgttgctgcaatgaccatcgttttcactttgctggtaaccacttgattgctgacagctacagtcaatgaacctgctgatgactttttttaatgtagtacaacagtgacagttatgacaggcttaccttggaagagttgtcatttttactgccaattttttggatgaagatgtttttataaacctttcaaaatggtctgcaaacagagcaggaattgcacaattaactcaataatgctgtgtgttctcaagaagctcccttagtgaggccgatcttaagatggccgattctgcccgttgaaggcatcctgggaaagaaaacaagcatcccagcgggcatctcaccacgacttctcctggagtcctcacacggtcactgacaactacagtcagttttaggaactagagtgccgtatcatcagacttaccctgtcctgccccaccttccctgctaacatcgaggtgtgtgcagttaccttctgagcttggaacaagcagactggaattttcctctgctacctcttgtgtataaaatcttgtttataaaatttcaaaaggaagtagatacactagggaagaaccttaattctaaatttggttcatgtgtggcaaagttcttagcttctaagagtataaaataaatttttcaaaaacaaaaaaaaaaaa

SEQ ID NO: 448282 - DNA, 3912 bp, Homo sapiens
tacagttgtgagtcatatatcatgggtagtttaagtgacatgcctagagtcatagagtgaaaacttgaacacaggctgattgactgcaaaatgaaggttcttttttttttaattgtggtgaaatgtacataacataaaatttactatttgaaccatttttaagtgtatagttcagtgactttaagtacattcacactgatgtgcaaccatcaccaccatccatctccagaactcttttcatcttctgaaactgaaactctggacctattgaagactgactccctattcctcccttcccccagcccctgggggaaggcaattgtaatttctgtctccatgaatttgactactctaggaaccccatttaagtagaatcacaaatataaagacaactgaattttaatgaaactagcatttacgtttcaaaatgaagcactaggaacaagcaaagaaagaatttggctaataaaaatctcctcggtcatcaggtgtcctgcagctaaggagtacttcaaggagaattcccaccactggagctgggctgtgcagtggctacagaagaagatgtcagaacattactggacaccacagagtaatgtctctaatgaaacatcaactggaaaaacctttcagcgaaccatttcagctcaggtgagagttgtctcttgtttttgcgtggtctaaatcacttatggaggattttcagtgtgtttctcagaaactgcaacctctgagaagagaggtatgagttgaagatgagaacaagcagaagaaacaattggatttctatgaaaagaaaacagattggtgtacacttacacaaatttgtgcagattatttgtctagaaggaaagtcatacaggttgggcagtctggtcacaaaaagggacaggggttgagggggttctggtgactgtgatgaaggcctcactctcaggcctccggtcccactgaaggtcagatgaaaggtagtcttccctggcggttgctgctgccactgaatgggccctaactttgtcgtcttgtgtttgaatcttctgcaggacacgttagcgtatgccacagctttgttgaatgaaaaagagcaatcaggaagcagtaatgggtcggagagtagtcctgccaatgagaacggagacaggcatctacagcagggttcagaatctcccatgatgattggtgagttgagaagtgaccttgatgatgttgatccctagaggaacatgcccagcctgagaggagtcaagacacaatactggatgctcagcaccttcttggaatcagaatctcgaaccctttggaagagcctggagattggactgggaaagctgctgtgacttgggcggatcgtgtatttctcaaggaaagcatttttaagccactagaaggtttgggagctgtttggcagtgggagaactccggcatgtggatcagctgtcccgggagcgtggtctatatgtggattcacatttctgtggagattttcggaaatagagccagtggcagacttttttgttacacgaacatacaagagtgagcataaagctgttgctttctctacgatgctacaaaagaaattcctttggtttttatattttaagaaaaagcaagctgcttttagatatgtgggggcaaatttttaatcttgcagtaatattaaacaggaatatccaatttaaaatgatgtaaagatgtaataaaattccttttcattgtaaaatagtaattaagtcaatttacacagacctttgtatttaatatgtctccctatttgtatagaatttcagatgggtctagatgagaaccctatgcataagcttggatcttgatgaaaggttaccaggatcaggatcaaaaattgggaaatactaagctcttgaagatatttttctgatataattagattgaaaagagcaattttgaaaatgctgtgttctccagaagtacagggtgcattatttgacatcaattacttaaagaagttatgagttgttccccaaacagattttaaaaacagcaaaataaaagcactttaagatataattttactgagtttaacttcacagaattatctttttaatgcttggagacatattgaataaactgtagtcttaaatcatgtgatctgcaatcgtttgcttttgcttaaaacataattactgaaacccttggtattggttgtatatgaagttaactatttgagttggtacacactgcttgtgagtttcatagttattgtaatgcagagaaggaatttgagaatttgtttctcctcaacatgactaattaacactgaaaagtcagtcaaggtttaagatttattttcccagaaataaatataaagcaattgaataaccatccatttagtcgtatttccaaagtatagcaccattcactcatttataccagctcccttttatggtgtggggggagaggtttacacccacatatttcatatatattttgtacattttgtattttgaattgctcacattttcggccctgttttgcctttagttacaggtcctgccttattttcatctcaccatgcacagaactagggagccttaggaagtgccaggttttcactgtcagatttgccaagtcacagaggcgcacaggccctgaagtgcctgtctggctgctgtggcattgtgtgggcatgtggccaggcagatggcatctcattactgtgctctcgccatggcccagtcttttcattctctggcagtgagggtttctgtgctgtcagacttcattgttattctgtgacttgctggaggttggcagtggcctttgtcaaacacactgagaagatggaagggccagcacttaagagcagaactgtacccttagagaaacggacagaggcgagtggcaaacttcagacggttccaatggtcttgcagtttgaaatgtgatgttctaccattggttttgagtacgtgaatacttcctgtcctactgtttcccctaccctattctcaccttctctccgcccacatcctcaccaagagattgtgtgggacatgaccttgaaatgctggcgatgatccacactgggatatcatcgctggcgactgcactctcaggagcccaaaatcaggagtgaaattgccacttctagtccccttatttcctatggaaacaacgccttccgcacccctagcacctgccgtcctcactgtaaagcttcatcaggatcgtccaccgtgtatattatacgcttcagatcatgttgcttatattgttgctgcaatgaccatcgttttcactttgctggtaaccacttgattgctgacagctacagtcaatgaacctgctgatgactttttttaatgtagtacaacagtgacagttatgacaggcttaccttggaagagttgtcatttttactgccaattttttggatgaagatgtttttataaacctttcaaaatggtctgcaaacagagcaggaattgcacaattaactcaataatgctgtgtgttctcaagaagctcccttagtgaggccgatcttaagatggccgattctgcccgttgaaggcatcctgggaaagaaaacaagcatcccagcgggcatctcaccacgacttctcctggagtcctcacacggtcactgacaactacagtcagttttaggaactagagtgccgtatcatcagacttaccctgtcctgccccaccttccctgctaacatcgaggtgtgtgcagttaccttctgagcttggaacaagcagactggaattttcctctgctacctcttgtgtataaaatcttgtttataaaatttcaaaaggaagtagatacactagggaagaaccttaattctaaatttggttcatgtgtggcaaagttcttagcttctaagagtataaaataaatttttcaaaaacaaaaaaaaaaaa

SEQ ID NO: 448283 - DNA, 2844 bp, Homo sapiens
gacatgtttaaattgcagaacacaagtcagcatagaaaaccttttctctaaccgtatgaactttaacttccttttcttttctgcagggttcagaatctcccatgatgattggtgagttgagaagtgaccttgatgatgttgatccctagaggaacatgcccagcctgagaggagtcaagacacaatactggatgctcagcaccttcttggaatcagaatctcgaaccctttggaagagcctggagattggactgggaaagctgctgtgacttgggcggatcgtgtatttctcaaggaaagcatttttaagccactagaaggtttgggagctgtttggcagtgggagaactccggcatgtggatcagctgtcccgggagcgtggtctatatgtggattcacatttctgtggagattttcggaaatagagccagtggcagacttttttgttacacgaacatacaagagtgagcataaagctgttgctttctctacgatgctacaaaagaaattcctttggtttttatattttaagaaaaagcaagctgcttttagatatgtgggggcaaatttttaatcttgcagtaatattaaacaggaatatccaatttaaaatgatgtaaagatgtaataaaattccttttcattgtaaaatagtaattaagtcaatttacacagacctttgtatttaatatgtctccctatttgtatagaatttcagatgggtctagatgagaaccctatgcataagcttggatcttgatgaaaggttaccaggatcaggatcaaaaattgggaaatactaagctcttgaagatatttttctgatataattagattgaaaagagcaattttgaaaatgctgtgttctccagaagtacagggtgcattatttgacatcaattacttaaagaagttatgagttgttccccaaacagattttaaaaacagcaaaataaaagcactttaagatataattttactgagtttaacttcacagaattatctttttaatgcttggagacatattgaataaactgtagtcttaaatcatgtgatctgcaatcgtttgcttttgcttaaaacataattactgaaacccttggtattggttgtatatgaagttaactatttgagttggtacacactgcttgtgagtttcatagttattgtaatgcagagaaggaatttgagaatttgtttctcctcaacatgactaattaacactgaaaagtcagtcaaggtttaagatttattttcccagaaataaatataaagcaattgaataaccatccatttagtcgtatttccaaagtatagcaccattcactcatttataccagctcccttttatggtgtggggggagaggtttacacccacatatttcatatatattttgtacattttgtattttgaattgctcacattttcggccctgttttgcctttagttacaggtcctgccttattttcatctcaccatgcacagaactagggagccttaggaagtgccaggttttcactgtcagatttgccaagtcacagaggcgcacaggccctgaagtgcctgtctggctgctgtggcattgtgtgggcatgtggccaggcagatggcatctcattactgtgctctcgccatggcccagtcttttcattctctggcagtgagggtttctgtgctgtcagacttcattgttattctgtgacttgctggaggttggcagtggcctttgtcaaacacactgagaagatggaagggccagcacttaagagcagaactgtacccttagagaaacggacagaggcgagtggcaaacttcagacggttccaatggtcttgcagtttgaaatgtgatgttctaccattggttttgagtacgtgaatacttcctgtcctactgtttcccctaccctattctcaccttctctccgcccacatcctcaccaagagattgtgtgggacatgaccttgaaatgctggcgatgatccacactgggatatcatcgctggcgactgcactctcaggagcccaaaatcaggagtgaaattgccacttctagtccccttatttcctatggaaacaacgccttccgcacccctagcacctgccgtcctcactgtaaagcttcatcaggatcgtccaccgtgtatattatacgcttcagatcatgttgcttatattgttgctgcaatgaccatcgttttcactttgctggtaaccacttgattgctgacagctacagtcaatgaacctgctgatgactttttttaatgtagtacaacagtgacagttatgacaggcttaccttggaagagttgtcatttttactgccaattttttggatgaagatgtttttataaacctttcaaaatggtctgcaaacagagcaggaattgcacaattaactcaataatgctgtgtgttctcaagaagctcccttagtgaggccgatcttaagatggccgattctgcccgttgaaggcatcctgggaaagaaaacaagcatcccagcgggcatctcaccacgacttctcctggagtcctcacacggtcactgacaactacagtcagttttaggaactagagtgccgtatcatcagacttaccctgtcctgccccaccttccctgctaacatcgaggtgtgtgcagttaccttctgagcttggaacaagcagactggaattttcctctgctacctcttgtgtataaaatcttgtttataaaatttcaaaaggaagtagatacactagggaagaaccttaattctaaatttggttcatgtgtggcaaagttcttagcttctaagagtataaaataaatttttcaaaaacaaaaaaaaaaaa

SEQ ID NO: 448284 - DNA, 2453 bp, Homo sapiens
caggatccagtgaggtccacacatggcctttgctttctgtgtctcttaaggctcttctgaccatcagtcattcctttgtccccctgccccttgtatgctgtgccatttgtttgaggagtagactgtttgctctgtagagctccccatattctggatctgtttgcatcctctaggtattcccttcaagagaattgcagctgagtctgattgtacctctagagctgaacattatgggagtacttcttatcttttaaactttctcatagttgccacatagagtcttagtgaattttgaacagagccttggctggtatgtggcattacagttagcaggaataagcagaagtgaagtgaccttggaaagctccacttggcccataagcgctaacactgtcaggagactctacttttgtttcttggctattagatgggacctatcatgggaaggttgaggttgtggaaatgtatcttgctttttcacaccacctttctctttctttcaggattttcttactggagtgcaatgtgagagaagtacgagttgctgtggccaccattctggagaaaaccctagacagtgccttgttttatcaggataagttaaaaagccttcatcagttactggaggtactacttgctctgttggacaaagacgtcccagaaaattgtaaaaactgtgctcagtactttttcctgttcaacacttttgtacaaaagcaaggaattagggctggagatcttcttctgaggcattcagctctgcggcacatgatcagcttcctcctaggggccagtcggcaaaacaatcagatacgtcgatggagttcagcacaagcacgagaatttgggaatcttcacaatacagtggcgttacttgttttgcattcagatgtctcatcccaaaggaatgttgctcctggcatatttaagcaacgaccacccattagcattgctccctcaagccctctgttgcccctccatgaggaggtagaagccttgttgttcatgtctgaagggaaaccttacctgttagaggtaatgtttgctttgcgggagctgacaggctcgctcttggcactcattgagatggtagtgtactgctgtttctgtaatgagcatttttccttcacaatgctgcatttcattaagaaccaactaggaaacggctccacctcatgagttaaagaatacgttccaactacttcatgaaatattggttattgaagatcctatacaagtagagcgagtcaaatttgtgtttgagacagaaaatggattactagctttgatgcaccacagtaatcatgtggacagtagtcgctgctaccagtgtgtcaaatttcttgtcactcttgctcaaaagtgtcctgcagctaaggagtacttcaaggagaattcccaccactggagctgggctgtgcagtggctacagaagaagatgtcagaacattactggacaccacagagtaatgtctctaatgaaacatcaactggaaaaacctttcagcgaaccatttcagctcaggtgagagttgtctcttgtttttgcgtggtctaaatcacttatggaggattttcagtgtgtttctcagaaactgcaacctctgagaagagaggtatgagttgaagatgagaacaagcagaagaaacaattggatttctatgaaaagaaaacagattggtgtacacttacacaaatttgtgcagattatttgtctagaaggaaagtcatacaggttgggcagtctggtcacaaaaagggacaggggttgagggggttctggtgactgtgatgaaggcctcactctcaggcctccggtcccactgaaggtcagatgaaaggtagtcttccctggcggttgctgctgccactgaatgggccctaactttgtcgtcttgtgtttgaatcttctgcaggacacgttagcgtatgccacagctttgttgaatgaaaaagagcaatcaggaagcagtaatgggtcggagagtagtcctgccaatgagaacggagacaggcatctacagcaggtgttctcaagaagctcccttagtgaggccgatcttaagatggccgattctgcccgttgaaggcatcctgggaaagaaaacaagcatcccagcgggcatctcaccacgacttctcctggagtcctcacacggtcactgacaactacagtcagttttaggaactagagtgccgtatcatcagacttaccctgtcctgccccaccttccctgctaacatcgaggtgtgtgcagttaccttctgagcttggaacaagcagactggaattttcctctgctacctcttgtgtataaaatcttgtttataaaatttcaaaaggaagtagatacactagggaagaaccttaattctaaatttggttcatgtgtggcaaagttcttagcttctaagagtataaaataaatttttcaaaaacaaaaaaaaaaaa

SEQ ID NO: 448285 - DNA, 1187 bp, Homo sapiens
tacagttgtgagtcatatatcatgggtagtttaagtgacatgcctagagtcatagagtgaaaacttgaacacaggctgattgactgcaaaatgaaggttcttttttttttaattgtggtgaaatgtacataacataaaatttactatttgaaccatttttaagtgtatagttcagtgactttaagtacattcacactgatgtgcaaccatcaccaccatccatctccagaactcttttcatcttctgaaactgaaactctggacctattgaagactgactccctattcctcccttcccccagcccctgggggaaggcaattgtaatttctgtctccatgaatttgactactctaggaaccccatttaagtagaatcacaaatataaagacaactgaattttaatgaaactagcatttacgtttcaaaatgaagcactaggaacaagcaaagaaagaatttggctaataaaaatctcctcggtcatcaggtgtcctgcagctaaggagtacttcaaggagaattcccaccactggagctgggctgtgcagtggctacagaagaagatgtcagaacattactggacaccacagagtaatgtctctaatgaaacatcaactggaaaaacctttcagcgaaccatttcagctcaggacacgttagcgtatgccacagctttgttgaatgaaaaagagcaatcaggaagcagtaatgggtcggagagtagtcctgccaatgagaacggagacaggcatctacagcaggtgttctcaagaagctcccttagtgaggccgatcttaagatggccgattctgcccgttgaaggcatcctgggaaagaaaacaagcatcccagcgggcatctcaccacgacttctcctggagtcctcacacggtcactgacaactacagtcagttttaggaactagagtgccgtatcatcagacttaccctgtcctgccccaccttccctgctaacatcgaggtgtgtgcagttaccttctgagcttggaacaagcagactggaattttcctctgctacctcttgtgtataaaatcttgtttataaaatttcaaaaggaagtagatacactagggaagaaccttaattctaaatttggttcatgtgtggcaaagttcttagcttctaagagtataaaataaatttttcaaaaacaaaaaaaaaaaa

SEQ ID NO: 448286 - DNA, 4394 bp, Homo sapiens
caggatccagtgaggtccacacatggcctttgctttctgtgtctcttaaggctcttctgaccatcagtcattcctttgtccccctgccccttgtatgctgtgccatttgtttgaggagtagactgtttgctctgtagagctccccatattctggatctgtttgcatcctctaggtattcccttcaagagaattgcagctgagtctgattgtacctctagagctgaacattatgggagtacttcttatcttttaaactttctcatagttgccacatagagtcttagtgaattttgaacagagccttggctggtatgtggcattacagttagcaggaataagcagaagtgaagtgaccttggaaagctccacttggcccataagcgctaacactgtcaggagactctacttttgtttcttggctattagatgggacctatcatgggaaggttgaggttgtggaaatgtatcttgctttttcacaccacctttctctttctttcaggattttcttactggagtgcaatgtgagagaagtacgagttgctgtggccaccattctggagaaaaccctagacagtgccttgttttatcaggataagttaaaaagccttcatcagttactggaggtactacttgctctgttggacaaagacgtcccagaaaattgtaaaaactgtgctcagtactttttcctgttcaacacttttgtacaaaagcaaggaattagggctggagatcttcttctgaggcattcagctctgcggcacatgatcagcttcctcctaggggccagtcggcaaaacaatcagatacgtcgatggagttcagcacaagcacgagaatttgggaatcttcacaatacagtggcgttacttgttttgcattcagatgtctcatcccaaaggaatgttgctcctggcatatttaagcaacgaccacccattagcattgctccctcaagccctctgttgcccctccatgaggaggtagaagccttgttgttcatgtctgaagggaaaccttacctgttagaggtaatgtttgctttgcgggagctgacaggctcgctcttggcactcattgagatggtagtgtactgctgtttctgtaatgagcatttttccttcacaatgctgcatttcattaagaaccaactaggaaacggctccacctcatgagttaaagaatacgttccaactacttcatgaaatattggttattgaagatcctatacaagtagagcgagtcaaatttgtgtttgagacagaaaatggattactagctttgatgcaccacagtaatcatgtggacagtagtcgctgctaccagtgtgtcaaatttcttgtcactcttgctcaaaagtgtcctgcagctaaggagtacttcaaggagaattcccaccactggagctgggctgtgcagtggctacagaagaagatgtcagaacattactggacaccacagagtaatgtctctaatgaaacatcaactggaaaaacctttcagcgaaccatttcagctcaggacacgttagcgtatgccacagctttgttgaatgaaaaagagcaatcaggaagcagtaatgggtcggagagtagtcctgccaatgagaacggagacaggcatctacagcagggttcagaatctcccatgatgattggtgagttgagaagtgaccttgatgatgttgatccctagaggaacatgcccagcctgagaggagtcaagacacaatactggatgctcagcaccttcttggaatcagaatctcgaaccctttggaagagcctggagattggactgggaaagctgctgtgacttgggcggatcgtgtatttctcaaggaaagcatttttaagccactagaaggtttgggagctgtttggcagtgggagaactccggcatgtggatcagctgtcccgggagcgtggtctatatgtggattcacatttctgtggagattttcggaaatagagccagtggcagacttttttgttacacgaacatacaagagtgagcataaagctgttgctttctctacgatgctacaaaagaaattcctttggtttttatattttaagaaaaagcaagctgcttttagatatgtgggggcaaatttttaatcttgcagtaatattaaacaggaatatccaatttaaaatgatgtaaagatgtaataaaattccttttcattgtaaaatagtaattaagtcaatttacacagacctttgtatttaatatgtctccctatttgtatagaatttcagatgggtctagatgagaaccctatgcataagcttggatcttgatgaaaggttaccaggatcaggatcaaaaattgggaaatactaagctcttgaagatatttttctgatataattagattgaaaagagcaattttgaaaatgctgtgttctccagaagtacagggtgcattatttgacatcaattacttaaagaagttatgagttgttccccaaacagattttaaaaacagcaaaataaaagcactttaagatataattttactgagtttaacttcacagaattatctttttaatgcttggagacatattgaataaactgtagtcttaaatcatgtgatctgcaatcgtttgcttttgcttaaaacataattactgaaacccttggtattggttgtatatgaagttaactatttgagttggtacacactgcttgtgagtttcatagttattgtaatgcagagaaggaatttgagaatttgtttctcctcaacatgactaattaacactgaaaagtcagtcaaggtttaagatttattttcccagaaataaatataaagcaattgaataaccatccatttagtcgtatttccaaagtatagcaccattcactcatttataccagctcccttttatggtgtggggggagaggtttacacccacatatttcatatatattttgtacattttgtattttgaattgctcacattttcggccctgttttgcctttagttacaggtcctgccttattttcatctcaccatgcacagaactagggagccttaggaagtgccaggttttcactgtcagatttgccaagtcacagaggcgcacaggccctgaagtgcctgtctggctgctgtggcattgtgtgggcatgtggccaggcagatggcatctcattactgtgctctcgccatggcccagtcttttcattctctggcagtgagggtttctgtgctgtcagacttcattgttattctgtgacttgctggaggttggcagtggcctttgtcaaacacactgagaagatggaagggccagcacttaagagcagaactgtacccttagagaaacggacagaggcgagtggcaaacttcagacggttccaatggtcttgcagtttgaaatgtgatgttctaccattggttttgagtacgtgaatacttcctgtcctactgtttcccctaccctattctcaccttctctccgcccacatcctcaccaagagattgtgtgggacatgaccttgaaatgctggcgatgatccacactgggatatcatcgctggcgactgcactctcaggagcccaaaatcaggagtgaaattgccacttctagtccccttatttcctatggaaacaacgccttccgcacccctagcacctgccgtcctcactgtaaagcttcatcaggatcgtccaccgtgtatattatacgcttcagatcatgttgcttatattgttgctgcaatgaccatcgttttcactttgctggtaaccacttgattgctgacagctacagtcaatgaacctgctgatgactttttttaatgtagtacaacagtgacagttatgacaggcttaccttggaagagttgtcatttttactgccaattttttggatgaagatgtttttataaacctttcaaaatggtctgcaaacagagcaggaattgcacaattaactcaataatgctgtgtgttctcaagaagctcccttagtgaggccgatcttaagatggccgattctgcccgttgaaggcatcctgggaaagaaaacaagcatcccagcgggcatctcaccacgacttctcctggagtcctcacacggtcactgacaactacagtcagttttaggaactagagtgccgtatcatcagacttaccctgtcctgccccaccttccctgctaacatcgaggtgtgtgcagttaccttctgagcttggaacaagcagactggaattttcctctgctacctcttgtgtataaaatcttgtttataaaatttcaaaaggaagtagatacactagggaagaaccttaattctaaatttggttcatgtgtggcaaagttcttagcttctaagagtataaaataaatttttcaaaaacaaaaaaaaaaaa

SEQ ID NO: 448287 - DNA, 4786 bp, Homo sapiens
caggatccagtgaggtccacacatggcctttgctttctgtgtctcttaaggctcttctgaccatcagtcattcctttgtccccctgccccttgtatgctgtgccatttgtttgaggagtagactgtttgctctgtagagctccccatattctggatctgtttgcatcctctaggtattcccttcaagagaattgcagctgagtctgattgtacctctagagctgaacattatgggagtacttcttatcttttaaactttctcatagttgccacatagagtcttagtgaattttgaacagagccttggctggtatgtggcattacagttagcaggaataagcagaagtgaagtgaccttggaaagctccacttggcccataagcgctaacactgtcaggagactctacttttgtttcttggctattagatgggacctatcatgggaaggttgaggttgtggaaatgtatcttgctttttcacaccacctttctctttctttcaggattttcttactggagtgcaatgtgagagaagtacgagttgctgtggccaccattctggagaaaaccctagacagtgccttgttttatcaggataagttaaaaagccttcatcagttactggaggtactacttgctctgttggacaaagacgtcccagaaaattgtaaaaactgtgctcagtactttttcctgttcaacacttttgtacaaaagcaaggaattagggctggagatcttcttctgaggcattcagctctgcggcacatgatcagcttcctcctaggggccagtcggcaaaacaatcagatacgtcgatggagttcagcacaagcacgagaatttgggaatcttcacaatacagtggcgttacttgttttgcattcagatgtctcatcccaaaggaatgttgctcctggcatatttaagcaacgaccacccattagcattgctccctcaagccctctgttgcccctccatgaggaggtagaagccttgttgttcatgtctgaagggaaaccttacctgttagaggtaatgtttgctttgcgggagctgacaggctcgctcttggcactcattgagatggtagtgtactgctgtttctgtaatgagcatttttccttcacaatgctgcatttcattaagaaccaactaggaaacggctccacctcatgagttaaagaatacgttccaactacttcatgaaatattggttattgaagatcctatacaagtagagcgagtcaaatttgtgtttgagacagaaaatggattactagctttgatgcaccacagtaatcatgtggacagtagtcgctgctaccagtgtgtcaaatttcttgtcactcttgctcaaaagtgtcctgcagctaaggagtacttcaaggagaattcccaccactggagctgggctgtgcagtggctacagaagaagatgtcagaacattactggacaccacagagtaatgtctctaatgaaacatcaactggaaaaacctttcagcgaaccatttcagctcaggtgagagttgtctcttgtttttgcgtggtctaaatcacttatggaggattttcagtgtgtttctcagaaactgcaacctctgagaagagaggtatgagttgaagatgagaacaagcagaagaaacaattggatttctatgaaaagaaaacagattggtgtacacttacacaaatttgtgcagattatttgtctagaaggaaagtcatacaggttgggcagtctggtcacaaaaagggacaggggttgagggggttctggtgactgtgatgaaggcctcactctcaggcctccggtcccactgaaggtcagatgaaaggtagtcttccctggcggttgctgctgccactgaatgggccctaactttgtcgtcttgtgtttgaatcttctgcaggacacgttagcgtatgccacagctttgttgaatgaaaaagagcaatcaggaagcagtaatgggtcggagagtagtcctgccaatgagaacggagacaggcatctacagcagggttcagaatctcccatgatgattggtgagttgagaagtgaccttgatgatgttgatccctagaggaacatgcccagcctgagaggagtcaagacacaatactggatgctcagcaccttcttggaatcagaatctcgaaccctttggaagagcctggagattggactgggaaagctgctgtgacttgggcggatcgtgtatttctcaaggaaagcatttttaagccactagaaggtttgggagctgtttggcagtgggagaactccggcatgtggatcagctgtcccgggagcgtggtctatatgtggattcacatttctgtggagattttcggaaatagagccagtggcagacttttttgttacacgaacatacaagagtgagcataaagctgttgctttctctacgatgctacaaaagaaattcctttggtttttatattttaagaaaaagcaagctgcttttagatatgtgggggcaaatttttaatcttgcagtaatattaaacaggaatatccaatttaaaatgatgtaaagatgtaataaaattccttttcattgtaaaatagtaattaagtcaatttacacagacctttgtatttaatatgtctccctatttgtatagaatttcagatgggtctagatgagaaccctatgcataagcttggatcttgatgaaaggttaccaggatcaggatcaaaaattgggaaatactaagctcttgaagatatttttctgatataattagattgaaaagagcaattttgaaaatgctgtgttctccagaagtacagggtgcattatttgacatcaattacttaaagaagttatgagttgttccccaaacagattttaaaaacagcaaaataaaagcactttaagatataattttactgagtttaacttcacagaattatctttttaatgcttggagacatattgaataaactgtagtcttaaatcatgtgatctgcaatcgtttgcttttgcttaaaacataattactgaaacccttggtattggttgtatatgaagttaactatttgagttggtacacactgcttgtgagtttcatagttattgtaatgcagagaaggaatttgagaatttgtttctcctcaacatgactaattaacactgaaaagtcagtcaaggtttaagatttattttcccagaaataaatataaagcaattgaataaccatccatttagtcgtatttccaaagtatagcaccattcactcatttataccagctcccttttatggtgtggggggagaggtttacacccacatatttcatatatattttgtacattttgtattttgaattgctcacattttcggccctgttttgcctttagttacaggtcctgccttattttcatctcaccatgcacagaactagggagccttaggaagtgccaggttttcactgtcagatttgccaagtcacagaggcgcacaggccctgaagtgcctgtctggctgctgtggcattgtgtgggcatgtggccaggcagatggcatctcattactgtgctctcgccatggcccagtcttttcattctctggcagtgagggtttctgtgctgtcagacttcattgttattctgtgacttgctggaggttggcagtggcctttgtcaaacacactgagaagatggaagggccagcacttaagagcagaactgtacccttagagaaacggacagaggcgagtggcaaacttcagacggttccaatggtcttgcagtttgaaatgtgatgttctaccattggttttgagtacgtgaatacttcctgtcctactgtttcccctaccctattctcaccttctctccgcccacatcctcaccaagagattgtgtgggacatgaccttgaaatgctggcgatgatccacactgggatatcatcgctggcgactgcactctcaggagcccaaaatcaggagtgaaattgccacttctagtccccttatttcctatggaaacaacgccttccgcacccctagcacctgccgtcctcactgtaaagcttcatcaggatcgtccaccgtgtatattatacgcttcagatcatgttgcttatattgttgctgcaatgaccatcgttttcactttgctggtaaccacttgattgctgacagctacagtcaatgaacctgctgatgactttttttaatgtagtacaacagtgacagttatgacaggcttaccttggaagagttgtcatttttactgccaattttttggatgaagatgtttttataaacctttcaaaatggtctgcaaacagagcaggaattgcacaattaactcaataatgctgtgtgttctcaagaagctcccttagtgaggccgatcttaagatggccgattctgcccgttgaaggcatcctgggaaagaaaacaagcatcccagcgggcatctcaccacgacttctcctggagtcctcacacggtcactgacaactacagtcagttttaggaactagagtgccgtatcatcagacttaccctgtcctgccccaccttccctgctaacatcgaggtgtgtgcagttaccttctgagcttggaacaagcagactggaattttcctctgctacctcttgtgtataaaatcttgtttataaaatttcaaaaggaagtagatacactagggaagaaccttaattctaaatttggttcatgtgtggcaaagttcttagcttctaagagtataaaataaatttttcaaaaacaaaaaaaaaaaa

SEQ ID NO: 448288 - DNA, 2490 bp, Homo sapiens
caggatccagtgaggtccacacatggcctttgctttctgtgtctcttaaggctcttctgaccatcagtcattcctttgtccccctgccccttgtatgctgtgccatttgtttgaggagtagactgtttgctctgtagagctccccatattctggatctgtttgcatcctctaggtattcccttcaagagaattgcagctgagtctgattgtacctctagagctgaacattatgggagtacttcttatcttttaaactttctcatagttgccacatagagtcttagtgaattttgaacagagccttggctggtatgtggcattacagttagcaggaataagcagaagtgaagtgaccttggaaagctccacttggcccataagcgctaacactgtcaggagactctacttttgtttcttggctattagatgggacctatcatgggaaggttgaggttgtggaaatgtatcttgctttttcacaccacctttctctttctttcaggattttcttactggagtgcaatgtgagagaagtacgagttgctgtggccaccattctggagaaaaccctagacagtgccttgttttatcaggataagttaaaaagccttcatcagttactggaggtactacttgctctgttggacaaagacgtcccagaaaattgtaaaaactgtgctcagtactttttcctgttcaacacttttgtacaaaagcaaggaattagggctggagatcttcttctgaggcattcagctctgcggcacatgatcagcttcctcctaggggccagtcggcaaaacaatcagatacgtcgatggagttcagcacaagcacgagaatttgggaatcttcacaatacagtggcgttacttgttttgcattcagatgtctcatcccaaaggaatgttgctcctggcatatttaagcaacgaccacccattagcattgctccctcaagccctctgttgcccctccatgaggaggtagaagccttgttgttcatgtctgaagggaaaccttacctgttagaggtaatgtttgctttgcgggagctgacaggctcgctcttggcactcattgagatggtagtgtactgctgtttctgtaatgagcatttttccttcacaatgctgcatttcattaagaaccaactaggaaacggctccacctcatgagttaaagaatacgttccaactacttcatgaaatattggttattgaagatcctatacaagtagagcgagtcaaatttgtgtttgagacagaaaatggattactagctttgatgcaccacagtaatcatgtggacagtagtcgctgctaccagtgtgtcaaatttcttgtcactcttgctcaaaagtgtcctgcagctaaggagtacttcaaggagaattcccaccactggagctgggctgtgcagtggctacagaagaagatgtcagaacattactggacaccacagagtaatgtctctaatgaaacatcaactggaaaaacctttcagcgaaccatttcagctcaggtgagagttgtctcttgtttttgcgtggtctaaatcacttatggaggattttcagtgtgtttctcagaaactgcaacctctgagaagagaggtatgagttgaagatgagaacaagcagaagaaacaattggatttctatgaaaagaaaacagattggtgtacacttacacaaatttgtgcagattatttgtctagaaggaaagtcatacaggttgggcagtctggtcacaaaaagggacaggggttgagggggttctggtgactgtgatgaaggcctcactctcaggcctccggtcccactgaaggtcagatgaaaggtagtcttccctggcggttgctgctgccactgaatgggccctaactttgtcgtcttgtgtttgaatcttctgcaggacacgttagcgtatgccacagctttgttgaatgaaaaagagcaatcaggaagcagtaatgggtcggagagtagtcctgccaatgagaacggagacaggcatctacagcaggtataacggtcagcatgtccttgtgtgcaaagggcagccttgctcttaagctttccaaaaagaatttccacagctgagggaaaacaagatgcttcctctggaatgtgagtccaaagagttaccagcgctgccctctagtgatctcagctcagcatatgcactaaccgtgtgtttacagggctgagtagtgctgcagtgtgaagtgaatggaaggcctcgaggtgtttgtggctggccaccctgatcagcctgcaggtagtcccgatgaagccagggcacagggggattcgttccagcttgttcactttattctgccttgccaggttactgaaagtccctcgtttgctctcaccagccttcctggaaatgtggactcttgaaagaaaagctcccgtgctcttgaagtatacctgcttgccaggggagtccaagaaaattttgacatgtatttttaaaaaaaaa

SEQ ID NO: 448289 - DNA, 1821 bp, Homo sapiens
  misc_feature (26)..(26): n is a, c, g, or t
cggctaggtagcgaggccgggtgttncagcagcatccacatagtctacacagagctccccttgctgcccagacaagctgaaggaccacaggaaaagccatggagacttcagcatcctcctcccagcctcaggacaacagtcaagtccacagagaaacagaagatgtagactgtcctgggcatggggagcctgacgttttgaaggatgagcttcaactctatggagatgctcctggagaggtggtaccctctggggaatcaggactccgaaggagaggctctgacccagcaagtggagaagtggaggcctctcagttaagaagactgaatataaagaaagatgatgagtttttccatttcgtcctcctgtgctttgccatcggggccttgctggtgtgttatcactattacgcagactggttcatgtctcttggggtcggcctgctcaccttcgcctccctggaaaccgttggcatctacttcggactagtgtaccgtatccacagcgtcctccaaggcttcatccccctcttccagaagtttaggctgacagggttcaggaagactgactgaggccacttccaggtgggcagcagaggcaggccccagtgtgaccaccactgcgacccctgagcccacaagggcagagcagcattctgagagacgcacaggagaccaagccagaccaataaacagaacacttttccttccatgtggtctgaatgttggcaccagcccgggcaggggcatctcatttgggcagtactgctgtgcaacccagctgcaaggatggaaggcagagggtgggtgtggggcctgaggcttcacagtacctggaccagcaggaagattctgggaggtcactgctctcagaggacagcaagggaccctgagctctgcaagctgtgatctgtctgggttcatggtttttctcaaatcccaggctatctgcatgcgctctcaggtgctaccgagccatcctgggagagatggatggtccactgctttgaggcagggagccatcgggctggggccccttggtgaacctgatgcaggtaagatgctgaggactaaaaccattttttttgcacccaaaaaaaaaggcaggaaaatgatcatcagaaactaaatggcagccaggcatgggggctcacaactgtaatcctcgcactttgggaggctcaggctaagggtcgcttgaagctgagagttcaagaccaacctgggcaacatagtgagacccccatctctacaatttttttttaatgaccaaatgtggcggtacatacctgtacatacctgcggttccagctactcaagaggctgaggcaggaggactgcttgagcccaggagttcagggctgcagtgaggtacgatcaagccactgcactccagcctgggcgacagagcaagatcgtttctctaaaattaaaaaaaaaaaaaaaagacaaataaaaattgcatgtatttgtagtgtacaacatgttttgaaatatgtggaatggctaaatcaagctaattaacatatgtatccctcacataccctttttttatgatgagaacagtaaaaacctactgtcagcaatttgcaaagtatacaatacattgttattaactatggtcaccatgctatgtgattgatatcctgaacttgaactgagttcttgatggtcacagacatgctgttctcaaaactcagaagggtaacttctgaggttttgatttcaagtacttgtatgtaacctaatttaacgggagcccagagtgcacagatcagatatttattaaacatataaataaaacacagttttcacgatagaa

SEQ ID NO: 448290 - DNA, 530 bp, Homo sapiens
cctctgacccaggaagatatacccaggatattaattctcaatgaggcagggaaaagaaaatcccacctcccgtcctgcatcaaagttaaatattcatctctctcttgttcttaaggagaagtggaggcctctcagttaagaagactgaatataaagaaagatgatgagtttttccatttcgtcctcctgtgctttgccatcggggccttgctggtgtgttatcactattacgcagactggttcatgtctcttggggtcggcctgctcaccttcgcctccctggaaaccgttggcatctacttcggactagtgtaccgtatccacagcgtcctccaaggcttcatccccctcttccagaagtttaggctgacagggttcaggaagactgactgaggccacttccaggtgggcagcagaggcaggccccagtgtgaccaccactgcgacccctgagcccacaagggcagagcagcattctgagagacgcacaggagaccaagccagaccaataaacagaacacttttccttc

SEQ ID NO: 448291 - DNA, 1324 bp, Homo sapiens
acgtggacgagtcgggtaatagtacggcgcagttgctggaatatggcttagggcaggttcaggaagactgactgaggccacttccaggtgggcagcagaggcaggccccagtgtgaccaccactgcgacccctgagcccacaagggcagagcagcattctgagagacgcacaggagaccaagccagaccaataaacagaacacttttccttccatgtggtctgaatgttggcaccagcccgggcaggggcatctcatttgggcagtactgctgtgcaacccagctgcaaggatggaaggcagagggtgggtgtggggcctgaggcttcacagtacctggaccagcaggaagattctgggaggtcactgctctcagaggacagcaagggaccctgagctctgcaagctgtgatctgtctgggttcatggtttttctcaaatcccaggctatctgcatgcgctctcaggtgctaccgagccatcctgggagagatggatggtccactgctttgaggcagggagccatcgggctggggccccttggtgaacctgatgcaggtaagatgctgaggactaaaaccattttttttgcacccaaaaaaaaaggcaggaaaatgatcatcagaaactaaatggcagccaggcatgggggctcacaactgtaatcctcgcactttgggaggctcaggctaagggtcgcttgaagctgagagttcaagaccaacctgggcaacatagtgagacccccatctctacaatttttttttaatgaccaaatgtggcggtacatacctgtacatacctgcggttccagctactcaagaggctgaggcaggaggactgcttgagcccaggagttcagggctgcagtgaggtacgatcaagccactgcactccagcctgggcgacagagcaagatcgtttctctaaaattaaaaaaaaaaaaaaaagacaaataaaaattgcatgtatttgtagtgtacaacatgttttgaaatatgtggaatggctaaatcaagctaattaacatatgtatccctcacataccctttttttatgatgagaacagtaaaaacctactgtcagcaatttgcaaagtatacaatacattgttattaactatggtcaccatgctatgtgattgatatcctgaacttgaactgagttcttgatggtcacagacatgctgttctcaaaactcagaagggtaacttctgaggttttgatttcaagtacttgtatgtaacctaatttaacgggagcccagagtgcacagatcagatatttattaaacatataaataaaacacagttttcacgatagaa

SEQ ID NO: 448292 - DNA, 821 bp, Homo sapiens
gcagaggacccaggtttgagtcctacctctgccagtttactagctctgtgaccctggatgagccgtgtagcctcggtttcctcaactggaaaataggtgtaatacttttctgctgcacaagtgtgttgtgaagatcaagtgaggaatggatgcaaaggcctgaagtgtgaaacagtagaaaaatggtctggttagtcttcattctcttatagaactttacacttccccaaacgctgtcttctccatggctgtacttgcctaatagcaactggggaggtaggctttagcaatgttacacttgaccaataggaaaatgaggctcagagaggtggagtgactcgcccacagtcacacagctttagtggctgggctgggcgaaagcacatcgtctttcttgactaacagctctgtgaccaccttatgcctcagaatggagaggccaagtggctgtgtggctgtgctggggaaatatctgtctcctttaatccatgtaatgaagaaaaagaaaactagctattatgactgtggttcattgagacccatggcttctggggtgactacatcatgccagctgtgaggggtacttgggcatctgaggtgatggtggggatgaagcctggctgccttcagaatcccatgccatcctgtggtctttgccttccagggttcaggaagactgactgaggccacttccaggtgggcagcagaggcaggccccagtgtgaccaccactgcgacccctgagcccacaagggcagagcagcattctgagagacgcacaggagaccaagccagaccaataaacagaacacttttccttc

SEQ ID NO: 448293 - DNA, 927 bp, Homo sapiens
caagcaatggcattttgattcatggagtacaagagttaccaaacttttttttttgtttgagatggagtatcgctctgtcgccaggccggagtgcagtggtgtgatcttggctcactgcagcctctgtctcctgggtttgagcgattatcctgtctcagcctcccgagtagctgggactacaggtgtgtgctaccatgcccagctaatttttgtatttttagtagagacggggtttcaccatcttagccagaatggtctcagtctcttgacctcgtgatccgcccaccttggcctcccaaagtgctggtattacaggcatgagccaccgcgtgcggcccaaactttttcataatggggaagtttacctgaaaacctggcttctctggggaaattgacagacctgtaagagtgggtaggcgttcctacagcagctttctgtggctggtgggtggtggctgcccctttagttggaacaggaaccctccagccggctccattccccacctggccgactccagattaagtgggaagtctccgagcaggatccaccttccctgaagcatgacttctccccccccagaggatcatgggtatatgatcactgatttcctttctgtgcagatgctcctggagaggtggtaccctctggggaatcaggactccgaaggagaggctctgacccagcaagtggagaagtggaggcctctcagttaagaagactgaatataaagaaagatggtaaggaacttggtgtagcagagctgctttttcctgtctggctagatttctaggggtgaaatgcagctggtggcctagcacagcagtaatcatagcccacctctgtcgtgtgccctgcagtttacacattactcagctcagaatcacctcaacagggtgggacaatggttcccattttgcagatatgaa

SEQ ID NO: 448294 - DNA, 847 bp, Homo sapiens
  misc_feature (26)..(26): n is a, c, g, or t
cggctaggtagcgaggccgggtgttncagcagcatccacatagtctacacagagctccccttgctgcccagacaagctgaaggaccacaggaaaagccatggagacttcagcatcctcctcccagcctcaggacaacagtcaagtccacagagaaacagaagatgtagactatggagagacagatttccacaagcaagatgggaaggctggactcttttcccaagaacaatatgagagaaacaagtcttcttcctcctcctcctcttcctcctcatcctcctcatcttcttcatcctcctcctcctcaggtcctgggcatggggagcctgacgttttgaaggatgagcttcaactctatggagatgctcctggagaggtggtaccctctggggaatcaggactccgaaggagaggctctgacccagcaagtggagaagtggaggcctctcagttaagaagactgaatataaagaaagatgatgagtttttccatttcgtcctcctgtgctttgccatcggggccttgctggtgtgttatcactattacgcagactggttcatgtctcttggggtcggcctgctcaccttcgcctccctggaaaccgttggcatctacttcggactagtgtaccgtatccacagcgtcctccaaggcttcatccccctcttccagaagtttaggctgacagggttcaggaagactgactgaggccacttccaggtgggcagcagaggcaggccccagtgtgaccaccactgcgacccctgagcccacaagggcagagcagcattctgagagacgcacaggagaccaagccagaccaataaacagaacacttttccttc

SEQ ID NO: 448295 - DNA, 937 bp, Homo sapiens
  misc_feature (26)..(26): n is a, c, g, or t
cggctaggtagcgaggccgggtgttncagcagcatccacatagtctacacagagctccccttgctgcccagacaagctgaaggaccacaggaaaagccatggagacttcagcatcctcctcccagcctcaggacaacagtcaagtccacagagaaacagaagatgtagactatggagagacagatttccacaagcaagatgggaaggctggactcttttcccaagaacaatatgagagaaacaagtcttcttcctcctcctcctcttcctcctcatcctcctcatcttcttcatcctcctcctcctcagagagcaatgatgaggaccagcaacccagagcaaccggaaaacatcgacggagcctgggggctggatacccccacgggaacggctcacccggtcctgggcatggggagcctgacgttttgaaggatgagcttcaactctatggagatgctcctggagaggtggtaccctctggggaatcaggactccgaaggagaggctctgacccagcaagtggagaagtggaggcctctcagttaagaagactgaatataaagaaagatgatgagtttttccatttcgtcctcctgtgctttgccatcggggccttgctggtgtgttatcactattacgcagactggttcatgtctcttggggtcggcctgctcaccttcgcctccctggaaaccgttggcatctacttcggactagtgtaccgtatccacagcgtcctccaaggcttcatccccctcttccagaagtttaggctgacagggttcaggaagactgactgaggccacttccaggtgggcagcagaggcaggccccagtgtgaccaccactgcgacccctgagcccacaagggcagagcagcattctgagagacgcacaggagaccaagccagaccaataaacagaacacttttccttc

SEQ ID NO: 448296 - DNA, 730 bp, Homo sapiens
  misc_feature (26)..(26): n is a, c, g, or t
cggctaggtagcgaggccgggtgttncagcagcatccacatagtctacacagagctccccttgctgcccagacaagctgaaggaccacaggaaaagccatggagacttcagcatcctcctcccagcctcaggacaacagtcaagtccacagagaaacagaagatgtagactatggagagacagatttccacaagcaagatgggaaggctggactcttttcccaagaacaatatgagagaaacaagtcttcttcctcctcctcctcttcctcctcatcctcctcatcttcttcatcctcctcctcctcaggtcctgggcatggggagcctgacgttttgaaggatgagcttcaactctatggagatgagtttttccatttcgtcctcctgtgctttgccatcggggccttgctggtgtgttatcactattacgcagactggttcatgtctcttggggtcggcctgctcaccttcgcctccctggaaaccgttggcatctacttcggactagtgtaccgtatccacagcgtcctccaaggcttcatccccctcttccagaagtttaggctgacagggttcaggaagactgactgaggccacttccaggtgggcagcagaggcaggccccagtgtgaccaccactgcgacccctgagcccacaagggcagagcagcattctgagagacgcacaggagaccaagccagaccaataaacagaacacttttccttc

SEQ ID NO: 448297 - DNA, 1933 bp, Homo sapiens
gcagaggacccaggtttgagtcctacctctgccagtttactagctctgtgaccctggatgagccgtgtagcctcggtttcctcaactggaaaataggtgtaatacttttctgctgcacaagtgtgttgtgaagatcaagtgaggaatggatgcaaaggcctgaagtgtgaaacagtagaaaaatggtctggttagtcttcattctcttatagaactttacacttccccaaacgctgtcttctccatggctgtacttgcctaatagcaactggggaggtaggctttagcaatgttacacttgaccaataggaaaatgaggctcagagaggtggagtgactcgcccacagtcacacagctttagtggctgggctgggcgaaagcacatcgtctttcttgactaacagctctgtgaccaccttatgcctcagaatggagaggccaagtggctgtgtggctgtgctggggaaatatctgtctcctttaatccatgtaatgaagaaaaagaaaactagctattatgactgtggttcattgagacccatggcttctggggtgactacatcatgccagctgtgaggggtacttgggcatctgaggtgatggtggggatgaagcctggctgccttcagaatcccatgccatcctgtggtctttgccttccagggttcaggaagactgactgaggccacttccaggtgggcagcagaggcaggccccagtgtgaccaccactgcgacccctgagcccacaagggcagagcagcattctgagagacgcacaggagaccaagccagaccaataaacagaacacttttccttccatgtggtctgaatgttggcaccagcccgggcaggggcatctcatttgggcagtactgctgtgcaacccagctgcaaggatggaaggcagagggtgggtgtggggcctgaggcttcacagtacctggaccagcaggaagattctgggaggtcactgctctcagaggacagcaagggaccctgagctctgcaagctgtgatctgtctgggttcatggtttttctcaaatcccaggctatctgcatgcgctctcaggtgctaccgagccatcctgggagagatggatggtccactgctttgaggcagggagccatcgggctggggccccttggtgaacctgatgcaggtaagatgctgaggactaaaaccattttttttgcacccaaaaaaaaaggcaggaaaatgatcatcagaaactaaatggcagccaggcatgggggctcacaactgtaatcctcgcactttgggaggctcaggctaagggtcgcttgaagctgagagttcaagaccaacctgggcaacatagtgagacccccatctctacaatttttttttaatgaccaaatgtggcggtacatacctgtacatacctgcggttccagctactcaagaggctgaggcaggaggactgcttgagcccaggagttcagggctgcagtgaggtacgatcaagccactgcactccagcctgggcgacagagcaagatcgtttctctaaaattaaaaaaaaaaaaaaaagacaaataaaaattgcatgtatttgtagtgtacaacatgttttgaaatatgtggaatggctaaatcaagctaattaacatatgtatccctcacataccctttttttatgatgagaacagtaaaaacctactgtcagcaatttgcaaagtatacaatacattgttattaactatggtcaccatgctatgtgattgatatcctgaacttgaactgagttcttgatggtcacagacatgctgttctcaaaactcagaagggtaacttctgaggttttgatttcaagtacttgtatgtaacctaatttaacgggagcccagagtgcacagatcagatatttattaaacatataaataaaacacagttttcacgatagaa

SEQ ID NO: 448298 - DNA, 411 bp, Homo sapiens
tcccaaagtgctggtattacaggcatgagccaccgcgtgcggcccaaactttttcataatggggaagtttacctgaaaacctggcttctctggggaaattgacagacctgtaagagtgggtaggcgttcctacagcagctttctgtggctggtgggtggtggctgcccctttagttggaacaggaaccctccagccggctccattccccacctggccgactccagattaagtgggaagtctccgagcaggatccaccttccctgaagcatgacttctccccccccagaggatcatgggtatatgatcactgatttcctttctgtgcagatgctcctggagaggtggtaccctctggggaatcaggtgagtgtccagttagaggagagaggtcgttggtgctggtattgagc

SEQ ID NO: 448299 - DNA, 597 bp, Homo sapiens
gatgattggaagatcatacaagtgcctgtctgcccttgaggggaagaagatgacaggctaggagcaaggtcaccagggaactagaacaggcaccaagaaccacatggtgaatgatgctcctggagaggtggtaccctctggggaatcaggactccgaaggagaggctctgacccagcaagtggagaagtggaggcctctcagttaagaagactgaatataaagaaagatgatgagtttttccatttcgtcctcctgtgctttgccatcggggccttgctggtgtgttatcactattacgcagactggttcatgtctcttggggtcggcctgctcaccttcgcctccctggaaaccgttggcatctacttcggactagtgtaccgtatccacagcgtcctccaaggcttcatccccctcttccagaagtttaggctgacagggttcaggaagactgactgaggccacttccaggtgggcagcagaggcaggccccagtgtgaccaccactgcgacccctgagcccacaagggcagagcagcattctgagagacgcacaggagaccaagccagaccaataaacagaacacttttccttc

SEQ ID NO: 448300 - DNA, 1959 bp, Homo sapiens
  misc_feature (26)..(26): n is a, c, g, or t
cggctaggtagcgaggccgggtgttncagcagcatccacatagtctacacagagctccccttgctgcccagacaagctgaaggaccacaggaaaagccatggagacttcagcatcctcctcccagcctcaggacaacagtcaagtccacagagaaacagaagatgtagactatggagagacagatttccacaagcaagatgggaaggctggactcttttcccaagaacaatatgagagaaacaagtcttcttcctcctcctcctcttcctcctcatcctcctcatcttcttcatcctcctcctcctcaggtcctgggcatggggagcctgacgttttgaaggatgagcttcaactctatggagatgctcctggagaggtggtaccctctggggaatcaggactccgaaggagaggctctgacccagcaagtggagaagtggaggcctctcagttaagaagactgaatataaagaaagatgatgagtttttccatttcgtcctcctgtgctttgccatcggggccttgctggtgtgttatcactattacgcagactggttcatgtctcttggggtcggcctgctcaccttcgcctccctggaaaccgttggcatctacttcggactagtgtaccgtatccacagcgtcctccaaggcttcatccccctcttccagaagtttaggctgacagggttcaggaagactgactgaggccacttccaggtgggcagcagaggcaggccccagtgtgaccaccactgcgacccctgagcccacaagggcagagcagcattctgagagacgcacaggagaccaagccagaccaataaacagaacacttttccttccatgtggtctgaatgttggcaccagcccgggcaggggcatctcatttgggcagtactgctgtgcaacccagctgcaaggatggaaggcagagggtgggtgtggggcctgaggcttcacagtacctggaccagcaggaagattctgggaggtcactgctctcagaggacagcaagggaccctgagctctgcaagctgtgatctgtctgggttcatggtttttctcaaatcccaggctatctgcatgcgctctcaggtgctaccgagccatcctgggagagatggatggtccactgctttgaggcagggagccatcgggctggggccccttggtgaacctgatgcaggtaagatgctgaggactaaaaccattttttttgcacccaaaaaaaaaggcaggaaaatgatcatcagaaactaaatggcagccaggcatgggggctcacaactgtaatcctcgcactttgggaggctcaggctaagggtcgcttgaagctgagagttcaagaccaacctgggcaacatagtgagacccccatctctacaatttttttttaatgaccaaatgtggcggtacatacctgtacatacctgcggttccagctactcaagaggctgaggcaggaggactgcttgagcccaggagttcagggctgcagtgaggtacgatcaagccactgcactccagcctgggcgacagagcaagatcgtttctctaaaattaaaaaaaaaaaaaaaagacaaataaaaattgcatgtatttgtagtgtacaacatgttttgaaatatgtggaatggctaaatcaagctaattaacatatgtatccctcacataccctttttttatgatgagaacagtaaaaacctactgtcagcaatttgcaaagtatacaatacattgttattaactatggtcaccatgctatgtgattgatatcctgaacttgaactgagttcttgatggtcacagacatgctgttctcaaaactcagaagggtaacttctgaggttttgatttcaagtacttgtatgtaacctaatttaacgggagcccagagtgcacagatcagatatttattaaacatataaataaaacacagttttcacgatagaa

SEQ ID NO: 448301 - DNA, 934 bp, Homo sapiens
  misc_feature (26)..(26): n is a, c, g, or t
cggctaggtagcgaggccgggtgttncagcagcatccacatagtctacacagagctccccttgctgcccagacaagctgaaggaccacaggaactcaaatacacaggaaacagttgtttcatgtgtcggactcctttccattgctctttccaatgtggtaatgcagctaaactaagagaaaagccatggagacttcagcatcctcctcccagcctcaggacaacagtcaagtccacagagaaacagaagatgtagactatggagagacagatttccacaagcaagatgggaaggctggactcttttcccaagaacaatatgagagaaacaagtcttcttcctcctcctcctcttcctcctcatcctcctcatcttcttcatcctcctcctcctcaggtcctgggcatggggagcctgacgttttgaaggatgagcttcaactctatggagatgctcctggagaggtggtaccctctggggaatcaggactccgaaggagaggctctgacccagcaagtggagaagtggaggcctctcagttaagaagactgaatataaagaaagatgatgagtttttccatttcgtcctcctgtgctttgccatcggggccttgctggtgtgttatcactattacgcagactggttcatgtctcttggggtcggcctgctcaccttcgcctccctggaaaccgttggcatctacttcggactagtgtaccgtatccacagcgtcctccaaggcttcatccccctcttccagaagtttaggctgacagggttcaggaagactgactgaggccacttccaggtgggcagcagaggcaggccccagtgtgaccaccactgcgacccctgagcccacaagggcagagcagcattctgagagacgcacaggagaccaagccagaccaataaacagaacacttttccttc

SEQ ID NO: 448302 - DNA, 3026 bp, Homo sapiens
cctcctcctcctcacaggtgtgtctctagtcctcgtggttgcctgccccactccctgccgagacgcctgccagaaaggtcacctatcctgaaccccagcaagcctgaaacagctcagccaagcaccctgcgatggaagctgcagatgcctccaggagcaacgggtcgagcccagaagccagggatgcccggagcccgtcgggccccagtggcagcctggagaatggcaccaaggctgacggcaaggatgccaagaccaccaacgggcacggcggggaggcagctgagggcaagagcctgggcagcgccctgaagccaggggaaggtaggagcgccctgttcgcgggcaatgagtggcggcgacccatcatccagtttgtcgagtccggggacgacaagaactccaactacttcagcatggactctatggaaggcaagaggtcgccgtacgcagggctccagctgggggctgccaagaagccacccgttacctttgccgaaaagggcgagctgcgcaagtccattttctcggagtcccggaagcccacggtgtccatcatggagcccggggagacccggcggaacagctacccccgggccgacacgggccttttttcacggtccaagtccggctccgaggaggtgctgtgcgactcctgcatcggcaacaagcagaaggcggtcaagtcctgcctggtgtgccaggcctccttctgcgagctgcatctcaagccccacctggagggcgccgccttccgagaccaccagctgctcgagcccatccgggactttgaggcccgcaagtgtcccgtgcatggcaagacgatggagctcttctgccagaccgaccagacctgcatctgctacctttgcatgttccaggagcacaagaatcatagcaccgtgacagtggaggaggccaaggccgagaaggagacggagctgtcactgcaaaaggagcagctgcagctcaagatcattgagattgaggatgaagctgagaagtggcagaaggagaaggaccgcatcaagagcttcaccaccaatgagaaggccatcctggagcagaacttccgggacctggtgcgggacctggagaagcaaaaggaggaagtgagggctgcgctggagcagcgggagcaggatgctgtggaccaagtgaaggtgatcatggatgctctggatgagagagccaaggtgctgcatgaggacaagcagacccgggagcagctgcatagcatcagcgactctgtgttgtttctgcaggaatttggtgcattgatgagcaattactctctccccccacccctgcccacctatcatgtcctgctggagggggagggcctgggacagtcactaggcaacttcaaggacgacctgctcaatgtatgcatgcgccacgttgagaagatgtgcaaggcggacctgagccgtaacttcattgagaggaaccacatggagaacggtggtgaccatcgctatgtgaacaactacacgaacagcttcgggggtgagtggagtgcaccggacaccatgaagagatactccatgtacctgacacccaaaggtggggtccggacatcataccagccctcgtctcctggccgcttcaccaaggagaccacccagaagaatttcaacaatctctatggcaccaaaggtaactacacctcccgggtctgggagtactcctccagcattcagaactctgacaatgacctgcccgtcgtccaaggcagctcctccttctccctgaaaggctatccctccctcatgcggagccaaagccccaaggcccagccccagacttggaaatctggcaagcagactatgctgtctcactaccggccattctacgtcaacaaaggcaacgggattgggtccaacgaagccccatgagctcctggcggaaggaacgaggcgccacacccctgctcttcctcctgaccctgctgctcttgccttctaagctactgtgcttgtctgggtgggagggagcctggtcctgcacctgccctctgcagccctctgccagcctcttgggggcagttccggcctctccgacttccccactggccacactccattcagactcctttcctgccttgtgacctcagatggtcaccatcattcctgtgctcagaggccaacccatcacaggggtgagataggttggggcctgccctaacccgccagcctcctcctctcgggctggatctgggggctagcagtgagtacccgcatggtatcagcctgcctctcccgcccacgccctgctgtctccaggcctatagacgtttctctccaaggccctatcccccaatgttgtcagcagatgcctggacagcacagccacccatctcccattcacatggcccacctcctgcttcccagaggactggccctacgtgctctctctcgtcctacctatcaatgcccagcatggcagaacctgcagcccttggccactgcagatggaaacctctcagtgtcttgacatcaccctacccaggcggtgggtctccaccacagccactttgagtctgtggtccctggagggtggcttctcctgactggcaggatgaccttagccaagatattcctctgttccctctgctgagataaagaattcccttaacatgatataatccacccatgcaaatagctactggcccagctaccatttaccatttgcctacagaatttcattcagtctacactttggcattctctctggcgatggagtgtggctgggctgaccgcaaaaggtgccttacacactgcccccaccctcagccgttgccccatcagaggctgcctcctccttctgattaccccccatgttgcatatcagggtgctcaaggattggagaggagacaaaaccaggagcagcacagtggggacatctcccgtctcaacagccccaggcctatgggggctctggaaggatgggccagcttgcaggggttggggagggagacatccagcttgggctttcccctttggaataaaccattggtctgtca

SEQ ID NO: 448303 - DNA, 2200 bp, Homo sapiens
cctcctcctcctcacaggtgtgtctctagtcctcgtggttgcctgccccactccctgccgagacgcctgccagaaaggtcacctatcctgaaccccagcaagcctgaaacagctcagccaagcaccctgcgatggaagctgcagatgcctccaggagcaacgggtcgagcccagaagccagggatgcccggagcccgtcgggccccagtggcagcctggagaatggcaccaaggctgacggcaaggatgccaagaccaccaacgggcacggcggggaggcagctgagggcaagagcctgggcagcgccctgaagccaggggaaggtaggagcgccctgttcgcgggcaatgagtggcggcgacccatcatccagtttgtcgagtccggggacgacaagaactccaactacttcagcatggactctatggaaggcaagaggtcgccgtacgcagggctccagctgggggctgccaagaagccacccgttacctttgccgaaaagggcgagctgcgcaagtccattttctcggagtcccggaagcccacggtgtccatcatggagcccggggagacccggcggaacagctacccccgggccgacacgggccttttttcacggtccaagtccggctccgaggaggtgctgtgcgactcctgcatcggcaacaagcagaaggcggtcaagtcctgcctggtgtgccaggcctccttctgcgagctgcatctcaagccccacctggagggcgccgccttccgagaccaccagctgctcgagcccatccgggactttgaggcccgcaagtgtcccgtgcatggcaagacgatggagctcttctgccagaccgaccagacctgcatctgctacctttgcatgttccaggagcacaagaatcatagcaccgtgacagtggaggaggccaaggccgagaaggagacggagctgtcactgcaaaaggagcagctgcagctcaagatcattgagattgaggatgaagctgagaagtggcagaaggagaaggaccgcatcaagagcttcaccaccaatgagaaggccatcctggagcagaacttccgggacctggtgcgggacctggagaagcaaaaggaggaagtgagggctgcgctggagcagcgggagcaggatgctgtggaccaagtgaaggtgatcatggatgctctggatgagagagccaaggtgctgcatgaggacaagcagacccgggagcagctgcatagcatcagcgactctgtgttgtttctgcaggaatttggtgcattgatgagcaattactctctccccccacccctgcccacctatcatgtcctgctggagggggagggcctgggacagtcactaggcaacttcaaggacgacctgctcaatgtatgcatgcgccacgttgagaagatgtgcaaggcggacctgagccgtaacttcattgagaggaaccacatggagaacggtggtgaccatcgctatgtgaacaactacacgaacagcttcgggggtgagtggagtgcaccggacaccatgaagagatactccatgtacctgacacccaaaggtggggtccggacatcataccagccctcgtctcctggccgcttcaccaaggagaccacccagaagaatttcaacaatctctatggcaccaaaggtaactacacctcccgggtctgggagtactcctccagcattcagaactctgacaatgacctgcccgtcgtccaaggcagctcctccttctccctgaaaggctatccctccctcatgcggagccaaagccccaaggcccagccccagacttggaaatctggcaagcagactatgctggtggtttaagcaaggtctgagcatccctcaagtcctgctgtggaccacacaaaggcaaggagctgaccaggaggtgtcagttccctgagagacagggccaaaggcagtgtacccttgagtctcactaccggccattctacgtcaacaaaggcaacgggattgggtccaacgaagccccatgagctcctggcgggtgctcaaggattggagaggagacaaaaccaggagcagcacagtggggacatctcccgtctcaacagccccaggcctatgggggctctggaaggatgggccagcttgcaggggttggggagggagacatccagcttgggctttcccctttggaataaaccattggtctgtca

SEQ ID NO: 448304 - DNA, 745 bp, Homo sapiens
  misc_feature (40)..(40): n is a, c, g, or t
cattaagtccccccccccacaattgatctcgctaccacgncgaggcagttgccctttgcgcacagcacagccacccatctcccattcacatggcccacctcctgcttcccagaggactggccctacgtgctctctctcgtcctacctatcaatgcccagcatggcagaacctgcagcccttggccactgcagatggaaacctctcagtgtcttgacatcaccctacccaggcggtgggtctccaccacagccactttgagtctgtggtccctggagggtggcttctcctgactggcaggatgaccttagccaagatattcctctgttccctctgctgagataaagaattcccttaacatgatataatccacccatgcaaatagctactggcccagctaccatttaccatttgcctacagaatttcattcagtctacactttggcattctctctggcgatggagtgtggctgggctgaccgcaaaaggtgccttacacactgcccccaccctcagccgttgccccatcagaggctgcctcctccttctgattaccccccatgttgcatatcagggtgctcaaggattggagaggagacaaaaccaggagcagcacagtggggacatctcccgtctcaacagccccaggcctatgggggctctggaaggatgggccagcttgcaggggttggggagggagacatccagcttgggctttcccctttggaataaaccattggtctgtca

SEQ ID NO: 448305 - DNA, 420 bp, Homo sapiens
  misc_feature (6)..(6): n is a, c, g, or t
acccanagccacttttgagtctgtggttcccctggagggtgcttctcctgactggcaggagaagccacactccatcgccagagagaatgccaaagtgtagactgaatgaaattctgtaggcaaatggtaaatggtagctgggccagtagctatttgcatgggtgccttacacactgcccccaccctcagccgttgccccatcagaggctgcctcctccttctgattaccccccatgttgcatatcagggtgctcaaggattggagaggagacaaaaccaggagcagcacagtggggacatctcccgtctcaacagccccaggcctatgggggctctggaaggatgggccagcttgcaggggttggggagggagacatccagcttgggctttcccctttggaataaaccattggtctgtca

SEQ ID NO: 448306 - DNA, 2495 bp, Homo sapiens
  misc_feature (14)..(14): n is a, c, g, or t
tcctaggattaacncccccccggggtatgggatatcgcgaaccacgccgtcgccaggtccactgaaaagggcaagcaccctgtaaatgagtttccctcctgctcttgctgggtggaggagataggcagaggtttagcccttaaaaagacatggctaggatatccagccctagtggcctgagaatacagcaagatggtatttaacttactgctagatccttggcgactggcatggtgcctggcatatccgaggtcctgatgaatgtttgctgaatgaagagctgaatagatgagtgatgagccctggctgcgagtgtgccccctgagtggagccgctccctggttctctggttctcttccatctcctccccctgacttctccaatcctggactctttctctgcagacggagctgtcactgcaaaaggagcagctgcagctcaagatcattgagattgaggatgaagctgagaagtggcagaaggagaaggaccgcatcaagagcttcaccaccaatgagaaggccatcctggagcagaacttccgggacctggtgcgggacctggagaagcaaaaggaggaagtgagggctgcgctggagcagcgggagcaggatgctgtggaccaagtgaaggtgatcatggatgctctggatgagagagccaaggtgctgcatgaggacaagcagacccgggagcagctgcatagcatcagcgactctgtgttgtttctgcaggaatttggtgcattgatgagcaattactctctccccccacccctgcccacctatcatgtcctgctggagggggagggcctgggacagtcactaggcaacttcaaggacgacctgctcaatgtatgcatgcgccacgttgagaagatgtgcaaggcggacctgagccgtaacttcattgagaggaaccacatggagaacggtggtgaccatcgctatgtgaacaactacacgaacagcttcgggggtgagtggagtgcaccggacaccatgaagagatactccatgtacctgacacccaaaggtggggtccggacatcataccagccctcgtctcctggccgcttcaccaaggagaccacccagaagaatttcaacaatctctatggcaccaaaggtaactacacctcccgggtctgggagtactcctccagcattcagaactctgacaatgacctgcccgtcgtccaaggcagctcctccttctccctgaaaggctatccctccctcatgcggagccaaagccccaaggcccagccccagacttggaaatctggcaagcagactatgctgtctcactaccggccattctacgtcaacaaaggcaacgggattgggtccaacgaagccccatgagctcctggcggaaggaacgaggcgccacacccctgctcttcctcctgaccctgctgctcttgccttctaagctactgtgcttgtctgggtgggagggagcctggtcctgcacctgccctctgcagccctctgccagcctcttgggggcagttccggcctctccgacttccccactggccacactccattcagactcctttcctgccttgtgacctcagatggtcaccatcattcctgtgctcagaggccaacccatcacaggggtgagataggttggggcctgccctaacccgccagcctcctcctctcgggctggatctgggggctagcagtgagtacccgcatggtatcagcctgcctctcccgcccacgccctgctgtctccaggcctatagacgtttctctccaaggccctatcccccaatgttgtcagcagatgcctggacagcacagccacccatctcccattcacatggcccacctcctgcttcccagaggactggccctacgtgctctctctcgtcctacctatcaatgcccagcatggcagaacctgcagcccttggccactgcagatggaaacctctcagtgtcttgacatcaccctacccaggcggtgggtctccaccacagccactttgagtctgtggtccctggagggtggcttctcctgactggcaggatgaccttagccaagatattcctctgttccctctgctgagataaagaattcccttaacatgatataatccacccatgcaaatagctactggcccagctaccatttaccatttgcctacagaatttcattcagtctacactttggcattctctctggcgatggagtgtggctgggctgaccgcaaaaggtgccttacacactgcccccaccctcagccgttgccccatcagaggctgcctcctccttctgattaccccccatgttgcatatcagggtgctcaaggattggagaggagacaaaaccaggagcagcacagtggggacatctcccgtctcaacagccccaggcctatgggggctctggaaggatgggccagcttgcaggggttggggagggagacatccagcttgggctttcccctttggaataaaccattggtctgtca

SEQ ID NO: 448307 - DNA, 3814 bp, Homo sapiens
cctcctcctcctcacaggtgtgtctctagtcctcgtggttgcctgccccactccctgccgagacgcctgccagaaaggtcacctatcctgaaccccagcaagcctgaaacagctcagccaagcaccctgcgatggaagctgcagatgcctccaggagcaacgggtcgagcccagaagccagggatgcccggagcccgtcgggccccagtggcagcctggagaatggcaccaaggctgacggcaaggatgccaagaccaccaacgggcacggcggggaggcagctgagggcaagagcctgggcagcgccctgaagccaggggaaggtaggagcgccctgttcgcgggcaatgagtggcggcgacccatcatccagtttgtcgagtccggggacgacaagaactccaactacttcagcatggactctatggaaggcaagaggtcgccgtacgcagggctccagctgggggctgccaagaagccacccgttacctttgccgaaaagggcgagctgcgcaagtccattttctcggagtcccggaagcccacggtgtccatcatggagcccggggagacccggcggaacagctacccccgggccgacacgggccttttttcacggtccaagtccggctccgaggaggtgctgtgcgactcctgcatcggcaacaagcagaaggcggtcaagtcctgcctggtgtgccaggcctccttctgcgagctgcatctcaagccccacctggagggcgccgccttccgagaccaccagctgctcgagcccatccgggactttgaggcccgcaagtgtcccgtgcatggcaagacgatggagctcttctgccagaccgaccagacctgcatctgctacctttgcatgttccaggagcacaagaatcatagcaccgtgacagtggaggaggccaaggccgagaaggagacggagctgtcactgcaaaaggagcagctgcagctcaagatcattgagattgaggatgaagctgagaagtggcagaaggagaaggaccgcatcaagagcttcaccaccaatgagaaggccatcctggagcagaacttccgggacctggtgcgggacctggagaagcaaaaggaggaagtgagggctgcgctggagcagcgggagcaggatgctgtggaccaagtgaaggtgatcatggatgctctggatgagagagccaaggtgctgcatgaggacaagcagacccgggagcagctgcatagcatcagcgactctgtgttgtttctgcaggaatttggtgcattgatgagcaattactctctccccccacccctgcccacctatcatgtcctgctggagggggagggcctgggacagtcactaggcaacttcaaggacgacctgctcaatgtatgcatgcgccacgttgagaagatgtgcaaggcggacctgagccgtaacttcattgagaggaaccacatggagaacggtggtgaccatcgctatgtgaacaactacacgaacagcttcgggggtgagtggagtgcaccggacaccatgaagagatactccatgtacctgacacccaaaggtggggtccggacatcataccagccctcgtctcctggccgcttcaccaaggagaccacccagaagaatttcaacaatctctatggcaccaaaggtaactacacctcccgggtctgggagtactcctccagcattcagaactctgacaatgacctgcccgtcgtccaaggcagctcctccttctccctgaaaggctatccctccctcatgcggagccaaagccccaaggcccagccccagacttggaaatctggcaagcagactatgctgtctcactaccggccattctacgtcaacaaaggcaacgggattgggtccaacgaagccccatgagctcctggcggaaggaacgaggcgccacacccctgctcttcctcctgaccctgctgctcttgccttctaagctactgtgcttgtctgggtgggagggagcctggtcctgcacctgccctctgcagccctctgccagcctcttgggggcagttccggcctctccgacttccccactggccacactccattcagactcctttcctgccttgtgacctcagatggtcaccatcattcctgtgctcagaggccaacccatcacaggggtgagataggttggggcctgccctaacccgccagcctcctcctctcgggctggatctgggggctagcagtgagtacccgcatggtatcagcctgcctctcccgcccacgccctgctgtctccaggcctatagacgtttctctccaaggccctatcccccaatgttgtcagcagatgcctggacagcacagccacccatctcccattcacatggcccacctcctgcttcccagaggactggccctacgtgctctctctcgtcctacctatcaatgcccagcatggcagaacctgcagcccttggccactgcagatggaaacctctcagtgtcttgacatcaccctacccaggcggtgggtctccaccacagccactttgagtctgtggtccctggagggtggcttctcctgactggcaggatgaccttagccaagatattcctctgttccctctgctgagataaagaattcccttaacatgatataatccacccatgcaaatagctactggcccagctaccatttaccatttgcctacagaatttcattcagtctacactttggcattctctctggcgatggagtgtggctgggctgaccgcaaaaggtgccttacacactgcccccaccctcagccgttgccccatcagaggctgcctcctccttctgattaccccccatgttgcatatcagggtgctcaaggattggagaggagacaaaaccaggagcagcacagtggggacatctcccgtctcaacagccccaggcctatgggggctctggaaggatgggccagcttgcaggggttggggagggagacatccagcttgggctttcccctttggaataaaccattggtctgtcaaaaaaaaaaaaaaaaaaaaaaaaaaaaaaaaaaaaaaaaaaagcgatgacgaaggaaagaaaaaaatactcacatggaagagaaaacagaaagaaaatgagaatacaggaaggatatagtagcaaaagagggggctcccatgagtggaggctatgataattaataggagagacattgcggcgtggttttaaaagacagttgtagtagggagacaaagttggaactggtggagggtaatgttttgtggaaaaaggggagcgcccatttgactttcgtgggggagtgaggacagaacaaattggggagaagatactatatcctaaaacgagagagagagtttaagacgccttgaagaaggggagaaaatcatataaaacattgttgtaagcagggggtgagaaaaatgggttggtaaaaaacaacagagtggacatatgttgtttagagtgagagatgggcgacgaaaaagcagtggggcgccaacacgaagggacgcaaaagtgagcacgtgcaggaggaaacagatattgtgtacacccccaggggagagcgcattcggctactagacgggggaaagacacaatgcggtatatgatattgagagtaaatatcgcaaagaaatagattaaaataacgatacgagggaggacagacatgataaaaatacaaaataggtaagagaagagaaacataagtgtgcaagaaagaggactaggagcacgaagagtacagggataggagaaaaaaaggagagtaacaacaggtagaaaaaaacaacaaacaaagaa

SEQ ID NO: 448308 - DNA, 3128 bp, Homo sapiens
cctcctcctcctcacaggtgtgtctctagtcctcgtggttgcctgccccactccctgccgagacgcctgccagaaaggtcacctatcctgaaccccagcaagcctgaaacagctcagccaagcaccctgcgatggaagctgcagatgcctccaggagcaacgggtcgagcccagaagccagggatgcccggagcccgtcgggccccagtggcagcctggagaatggcaccaaggctgacggcaaggatgccaagaccaccaacgggcacggcggggaggcagctgagggcaagagcctgggcagcgccctgaagccaggggaaggtaggagcgccctgttcgcgggcaatgagtggcggcgacccatcatccagtttgtcgagtccggggacgacaagaactccaactacttcagcatggactctatggaaggcaagaggtcgccgtacgcagggctccagctgggggctgccaagaagccacccgttacctttgccgaaaagggcgagctgcgcaagtccattttctcggagtcccggaagcccacggtgtccatcatggagcccggggagacccggcggaacagctacccccgggccgacacgggccttttttcacggtccaagtccggctccgaggaggtgctgtgcgactcctgcatcggcaacaagcagaaggcggtcaagtcctgcctggtgtgccaggcctccttctgcgagctgcatctcaagccccacctggagggcgccgccttccgagaccaccagctgctcgagcccatccgggactttgaggcccgcaagtgtcccgtgcatggcaagacgatggagctcttctgccagaccgaccagacctgcatctgctacctttgcatgttccaggagcacaagaatcatagcaccgtgacagtggaggaggccaaggccgagaaggagacggagctgtcactgcaaaaggagcagctgcagctcaagatcattgagattgaggatgaagctgagaagtggcagaaggagaaggaccgcatcaagagcttcaccaccaatgagaaggccatcctggagcagaacttccgggacctggtgcgggacctggagaagcaaaaggaggaagtgagggctgcgctggagcagcgggagcaggatgctgtggaccaagtgaaggtgatcatggatgctctggatgagagagccaaggtgctgcatgaggacaagcagacccgggagcagctgcatagcatcagcgactctgtgttgtttctgcaggaatttggtgcattgatgagcaattactctctccccccacccctgcccacctatcatgtcctgctggagggggagggcctgggacagtcactaggcaacttcaaggacgacctgctcaatgtatgcatgcgccacgttgagaagatgtgcaaggcggacctgagccgtaacttcattgagaggaaccacatggagaacggtggtgaccatcgctatgtgaacaactacacgaacagcttcgggggtgagtggagtgcaccggacaccatgaagagatactccatgtacctgacacccaaaggtggggtccggacatcataccagccctcgtctcctggccgcttcaccaaggagaccacccagaagaatttcaacaatctctatggcaccaaaggtaactacacctcccgggtctgggagtactcctccagcattcagaactctgacaatgacctgcccgtcgtccaaggcagctcctccttctccctgaaagcaggcactgggaaaaccccttatcagttcaccaccttgggacaggccactgcagagttttccaaaccactgggtcgcagtgggctgtctaaaaataatcccggctatccctccctcatgcggagccaaagccccaaggcccagccccagacttggaaatctggcaagcagactatgctgtctcactaccggccattctacgtcaacaaaggcaacgggattgggtccaacgaagccccatgagctcctggcggaaggaacgaggcgccacacccctgctcttcctcctgaccctgctgctcttgccttctaagctactgtgcttgtctgggtgggagggagcctggtcctgcacctgccctctgcagccctctgccagcctcttgggggcagttccggcctctccgacttccccactggccacactccattcagactcctttcctgccttgtgacctcagatggtcaccatcattcctgtgctcagaggccaacccatcacaggggtgagataggttggggcctgccctaacccgccagcctcctcctctcgggctggatctgggggctagcagtgagtacccgcatggtatcagcctgcctctcccgcccacgccctgctgtctccaggcctatagacgtttctctccaaggccctatcccccaatgttgtcagcagatgcctggacagcacagccacccatctcccattcacatggcccacctcctgcttcccagaggactggccctacgtgctctctctcgtcctacctatcaatgcccagcatggcagaacctgcagcccttggccactgcagatggaaacctctcagtgtcttgacatcaccctacccaggcggtgggtctccaccacagccactttgagtctgtggtccctggagggtggcttctcctgactggcaggatgaccttagccaagatattcctctgttccctctgctgagataaagaattcccttaacatgatataatccacccatgcaaatagctactggcccagctaccatttaccatttgcctacagaatttcattcagtctacactttggcattctctctggcgatggagtgtggctgggctgaccgcaaaaggtgccttacacactgcccccaccctcagccgttgccccatcagaggctgcctcctccttctgattaccccccatgttgcatatcagggtgctcaaggattggagaggagacaaaaccaggagcagcacagtggggacatctcccgtctcaacagccccaggcctatgggggctctggaaggatgggccagcttgcaggggttggggagggagacatccagcttgggctttcccctttggaataaaccattggtctgtca

SEQ ID NO: 448309 - DNA, 2184 bp, Homo sapiens
  misc_feature (14)..(14): n is a, c, g, or t
tcctaggattaacncccccccggggtatgggatatcgcgaaccacgccgtcgccaggtccactgaaaagggcaagcaccctgtaaatgagtttccctcctgctcttgctgggtggaggagataggcagaggtttagcccttaaaaagacatggctaggatatccagccctagtggcctgagaatacagcaagatgacggagctgtcactgcaaaaggagcagctgcagctcaagatcattgagattgaggatgaagctgagaagtggcagaaggagaaggaccgcatcaagagcttcaccaccaatgagaaggccatcctggagcagaacttccgggacctggtgcgggacctggagaagcaaaaggaggaagtgagggctgcgctggagcagcgggagcaggatgctgtggaccaagtgaaggaatttggtgcattgatgagcaattactctctccccccacccctgcccacctatcatgtcctgctggagggggagggcctgggacagtcactaggcaacttcaaggacgacctgctcaatgtatgcatgcgccacgttgagaagatgtgcaaggcggacctgagccgtaacttcattgagaggaaccacatggagaacggtggtgaccatcgctatgtgaacaactacacgaacagcttcgggggtgagtggagtgcaccggacaccatgaagagatactccatgtacctgacacccaaaggtggggtccggacatcataccagccctcgtctcctggccgcttcaccaaggagaccacccagaagaatttcaacaatctctatggcaccaaaggtaactacacctcccgggtctgggagtactcctccagcattcagaactctgacaatgacctgcccgtcgtccaaggcagctcctccttctccctgaaaggctatccctccctcatgcggagccaaagccccaaggcccagccccagacttggaaatctggcaagcagactatgctgtctcactaccggccattctacgtcaacaaaggcaacgggattgggtccaacgaagccccatgagctcctggcggaaggaacgaggcgccacacccctgctcttcctcctgaccctgctgctcttgccttctaagctactgtgcttgtctgggtgggagggagcctggtcctgcacctgccctctgcagccctctgccagcctcttgggggcagttccggcctctccgacttccccactggccacactccattcagactcctttcctgccttgtgacctcagatggtcaccatcattcctgtgctcagaggccaacccatcacaggggtgagataggttggggcctgccctaacccgccagcctcctcctctcgggctggatctgggggctagcagtgagtacccgcatggtatcagcctgcctctcccgcccacgccctgctgtctccaggcctatagacgtttctctccaaggccctatcccccaatgttgtcagcagatgcctggacagcacagccacccatctcccattcacatggcccacctcctgcttcccagaggactggccctacgtgctctctctcgtcctacctatcaatgcccagcatggcagaacctgcagcccttggccactgcagatggaaacctctcagtgtcttgacatcaccctacccaggcggtgggtctccaccacagccactttgagtctgtggtccctggagggtggcttctcctgactggcaggatgaccttagccaagatattcctctgttccctctgctgagataaagaattcccttaacatgatataatccacccatgcaaatagctactggcccagctaccatttaccatttgcctacagaatttcattcagtctacactttggcattctctctggcgatggagtgtggctgggctgaccgcaaaaggtgccttacacactgcccccaccctcagccgttgccccatcagaggctgcctcctccttctgattaccccccatgttgcatatcagggtgctcaaggattggagaggagacaaaaccaggagcagcacagtggggacatctcccgtctcaacagccccaggcctatgggggctctggaaggatgggccagcttgcaggggttggggagggagacatccagcttgggctttcccctttggaataaaccattggtctgtca

SEQ ID NO: 448310 - DNA, 1881 bp, Homo sapiens
agtagcccacacctgtgcctggggccgtgggggcggctcctctgcctctgtgttgtttttttgtgtggctgctgggagtgtgtctgctctaggaggtggtggccggtgagtcagacagtggagtgaccatccactcctccccgatgctagcctgcccaccagaccagggactcgtccacaccctcaaaggcccctgcgctaagagacaccaggccacttcatcctggactctgtggggcacagggctgggctaacacctaggagggcatttgtttattctttgagtatctgctgtgcaccaggacactgataggcgcaggtggtgaccatcgctatgtgaacaactacacgaacagcttcgggggtgagtggagtgcaccggacaccatgaagagatactccatgtacctgacacccaaaggtggggtccggacatcataccagccctcgtctcctggccgcttcaccaaggagaccacccagaagaatttcaacaatctctatggcaccaaaggtaactacacctcccgggtctgggagtactcctccagcattcagaactctgacaatgacctgcccgtcgtccaaggcagctcctccttctccctgaaaggctatccctccctcatgcggagccaaagccccaaggcccagccccagacttggaaatctggcaagcagactatgctgtctcactaccggccattctacgtcaacaaaggcaacgggattgggtccaacgaagccccatgagctcctggcggaaggaacgaggcgccacacccctgctcttcctcctgaccctgctgctcttgccttctaagctactgtgcttgtctgggtgggagggagcctggtcctgcacctgccctctgcagccctctgccagcctcttgggggcagttccggcctctccgacttccccactggccacactccattcagactcctttcctgccttgtgacctcagatggtcaccatcattcctgtgctcagaggccaacccatcacaggggtgagataggttggggcctgccctaacccgccagcctcctcctctcgggctggatctgggggctagcagtgagtacccgcatggtatcagcctgcctctcccgcccacgccctgctgtctccaggcctatagacgtttctctccaaggccctatcccccaatgttgtcagcagatgcctggacagcacagccacccatctcccattcacatggcccacctcctgcttcccagaggactggccctacgtgctctctctcgtcctacctatcaatgcccagcatggcagaacctgcagcccttggccactgcagatggaaacctctcagtgtcttgacatcaccctacccaggcggtgggtctccaccacagccactttgagtctgtggtccctggagggtggcttctcctgactggcaggatgaccttagccaagatattcctctgttccctctgctgagataaagaattcccttaacatgatataatccacccatgcaaatagctactggcccagctaccatttaccatttgcctacagaatttcattcagtctacactttggcattctctctggcgatggagtgtggctgggctgaccgcaaaaggtgccttacacactgcccccaccctcagccgttgccccatcagaggctgcctcctccttctgattaccccccatgttgcatatcagggtgctcaaggattggagaggagacaaaaccaggagcagcacagtggggacatctcccgtctcaacagccccaggcctatgggggctctggaaggatgggccagcttgcaggggttggggagggagacatccagcttgggctttcccctttggaataaaccattggtctgtca

SEQ ID NO: 448311 - DNA, 2850 bp, Homo sapiens
cctcctcctcctcacaggtgtgtctctagtcctcgtggttgcctgccccactccctgccgagacgcctgccagaaaggtcacctatcctgaaccccagcaagcctgaaacagctcagccaagcaccctgcgatggaagctgcagatgcctccaggagcaacgggtcgagcccagaagccagggatgcccggagcccgtcgggccccagtggcagcctggagaatggcaccaaggctgacggcaaggatgccaagaccaccaacgggcacggcggggaggcagctgagggcaagagcctgggcagcgccctgaagccaggggaaggtaggagcgccctgttcgcgggcaatgagtggcggcgacccatcatccagtttgtcgagtccggggacgacaagaactccaactacttcagcatggactctatggaaggcaagaggtcgccgtacgcagggctccagctgggggctgccaagaagccacccgttacctttgccgaaaagggcgagctgcgcaagtccattttctcggagtcccggaagcccacggtgtccatcatggagcccggggagacccggcggaacagctacccccgggccgacacgggccttttttcacggtccaagtccggctccgaggaggtgctgtgcgactcctgcatcggcaacaagcagaaggcggtcaagtcctgcctggtgtgccaggcctccttctgcgagctgcatctcaagccccacctggagggcgccgccttccgagaccaccagctgctcgagcccatccgggactttgaggcccgcaagtgtcccgtgcatggcaagacgatggagctcttctgccagaccgaccagacctgcatctgctacctttgcatgttccaggagcacaagaatcatagcaccgtgacagtggaggaggccaaggccgagaaggagacggagctgtcactgcaaaaggagcagctgcagctcaagatcattgagattgaggatgaagctgagaagtggcagaaggagaaggaccgcatcaagagcttcaccaccaatgagaaggccatcctggagcagaacttccgggacctggtgcgggacctggagaagcaaaaggaggaagtgagggctgcgctggagcagcgggagcaggatgctgtggaccaagtgaaggtgatcatggatgctctggatgagagagccaaggtgctgcatgaggacaagcagacccgggagcagctgcatagcatcagcgactctgtgttgtttctgcaggaatttggtgcattgatgagcaattactctctccccccacccctgcccacctatcatgtcctgctggagggggagggcctgggacagtcactaggcaacttcaaggacgacctgctcaatgtatgcatgcgccacgttgagaagatgtgcaaggcggacctgagccgtaacttcattgagaggaaccacatggagaacggtggtgaccatcgctatgtgaacaactacacgaacagcttcgggggtgagtggagtgcaccggacaccatgaagagatactccatgtacctgacacccaaaggtggggtccggacatcataccagccctcgtctcctggccgcttcaccaaggagaccacccagaagaatttcaacaatctctatggcaccaaagtctcactaccggccattctacgtcaacaaaggcaacgggattgggtccaacgaagccccatgagctcctggcggaaggaacgaggcgccacacccctgctcttcctcctgaccctgctgctcttgccttctaagctactgtgcttgtctgggtgggagggagcctggtcctgcacctgccctctgcagccctctgccagcctcttgggggcagttccggcctctccgacttccccactggccacactccattcagactcctttcctgccttgtgacctcagatggtcaccatcattcctgtgctcagaggccaacccatcacaggggtgagataggttggggcctgccctaacccgccagcctcctcctctcgggctggatctgggggctagcagtgagtacccgcatggtatcagcctgcctctcccgcccacgccctgctgtctccaggcctatagacgtttctctccaaggccctatcccccaatgttgtcagcagatgcctggacagcacagccacccatctcccattcacatggcccacctcctgcttcccagaggactggccctacgtgctctctctcgtcctacctatcaatgcccagcatggcagaacctgcagcccttggccactgcagatggaaacctctcagtgtcttgacatcaccctacccaggcggtgggtctccaccacagccactttgagtctgtggtccctggagggtggcttctcctgactggcaggatgaccttagccaagatattcctctgttccctctgctgagataaagaattcccttaacatgatataatccacccatgcaaatagctactggcccagctaccatttaccatttgcctacagaatttcattcagtctacactttggcattctctctggcgatggagtgtggctgggctgaccgcaaaaggtgccttacacactgcccccaccctcagccgttgccccatcagaggctgcctcctccttctgattaccccccatgttgcatatcagggtgctcaaggattggagaggagacaaaaccaggagcagcacagtggggacatctcccgtctcaacagccccaggcctatgggggctctggaaggatgggccagcttgcaggggttggggagggagacatccagcttgggctttcccctttggaataaaccattggtctgtca

SEQ ID NO: 448312 - DNA, 1493 bp, Homo sapiens
agaggggcccaaggagggagaggctgtagtcctgccagaagtggagcctggcctcaccgcccgggagcaggaggccaccccccgaccccacccagaagaatttcaacaatctctatggcaccaaaggtaactacacctcccgggtctgggagtactcctccagcattcagaactctgacaatgacctgcccgtcgtccaaggcagctcctccttctccctgaaaggctatccctccctcatgcggagccaaagccccaaggcccagccccagacttggaaatctggcaagcagactatgctgtctcactaccggccattctacgtcaacaaaggcaacgggattgggtccaacgaagccccatgagctcctggcggaaggaacgaggcgccacacccctgctcttcctcctgaccctgctgctcttgccttctaagctactgtgcttgtctgggtgggagggagcctggtcctgcacctgccctctgcagccctctgccagcctcttgggggcagttccggcctctccgacttccccactggccacactccattcagactcctttcctgccttgtgacctcagatggtcaccatcattcctgtgctcagaggccaacccatcacaggggtgagataggttggggcctgccctaacccgccagcctcctcctctcgggctggatctgggggctagcagtgagtacccgcatggtatcagcctgcctctcccgcccacgccctgctgtctccaggcctatagacgtttctctccaaggccctatcccccaatgttgtcagcagatgcctggacagcacagccacccatctcccattcacatggcccacctcctgcttcccagaggactggccctacgtgctctctctcgtcctacctatcaatgcccagcatggcagaacctgcagcccttggccactgcagatggaaacctctcagtgtcttgacatcaccctacccaggcggtgggtctccaccacagccactttgagtctgtggtccctggagggtggcttctcctgactggcaggatgaccttagccaagatattcctctgttccctctgctgagataaagaattcccttaacatgatataatccacccatgcaaatagctactggcccagctaccatttaccatttgcctacagaatttcattcagtctacactttggcattctctctggcgatggagtgtggctgggctgaccgcaaaaggtgccttacacactgcccccaccctcagccgttgccccatcagaggctgcctcctccttctgattaccccccatgttgcatatcagggtgctcaaggattggagaggagacaaaaccaggagcagcacagtggggacatctcccgtctcaacagccccaggcctatgggggctctggaaggatgggccagcttgcaggggttggggagggagacatccagcttgggctttcccctttggaataaaccattggtctgtca

SEQ ID NO: 448313 - DNA, 1409 bp, Homo sapiens
gggatggagctgaaggcacatgcagacgttgggaggtgccatgtaactacacctcccgggtctgggagtactcctccagcattcagaactctgacaatgacctgcccgtcgtccaaggcagctcctccttctccctgaaaggctatccctccctcatgcggagccaaagccccaaggcccagccccagacttggaaatctggcaagcagactatgctgtctcactaccggccattctacgtcaacaaaggcaacgggattgggtccaacgaagccccatgagctcctggcggaaggaacgaggcgccacacccctgctcttcctcctgaccctgctgctcttgccttctaagctactgtgcttgtctgggtgggagggagcctggtcctgcacctgccctctgcagccctctgccagcctcttgggggcagttccggcctctccgacttccccactggccacactccattcagactcctttcctgccttgtgacctcagatggtcaccatcattcctgtgctcagaggccaacccatcacaggggtgagataggttggggcctgccctaacccgccagcctcctcctctcgggctggatctgggggctagcagtgagtacccgcatggtatcagcctgcctctcccgcccacgccctgctgtctccaggcctatagacgtttctctccaaggccctatcccccaatgttgtcagcagatgcctggacagcacagccacccatctcccattcacatggcccacctcctgcttcccagaggactggccctacgtgctctctctcgtcctacctatcaatgcccagcatggcagaacctgcagcccttggccactgcagatggaaacctctcagtgtcttgacatcaccctacccaggcggtgggtctccaccacagccactttgagtctgtggtccctggagggtggcttctcctgactggcaggatgaccttagccaagatattcctctgttccctctgctgagataaagaattcccttaacatgatataatccacccatgcaaatagctactggcccagctaccatttaccatttgcctacagaatttcattcagtctacactttggcattctctctggcgatggagtgtggctgggctgaccgcaaaaggtgccttacacactgcccccaccctcagccgttgccccatcagaggctgcctcctccttctgattaccccccatgttgcatatcagggtgctcaaggattggagaggagacaaaaccaggagcagcacagtggggacatctcccgtctcaacagccccaggcctatgggggctctggaaggatgggccagcttgcaggggttggggagggagacatccagcttgggctttcccctttggaataaaccattggtctgtca

SEQ ID NO: 448314 - DNA, 1695 bp, Homo sapiens
ggggagtccaagtgagcgcctcctgccgggaaactctggcaggccatgcttatgcgtggcgctcctgggctctgggaaggggagggcccgtggtgtaaacctccggggtgggtgagtggaaatccctgcagagcagtgtgatgctgcgctggatgtgggggcaacactcccctgctgcctggtccagcccacctggccggctcctcctccttctgtctgctttgctgcctcctccctttggccagcctccccaggattttcggttgcggcaccctggctgctgcacgcgtgttcagacggctgcatttggtaatgggctggatgatgcttggtggtcactttggagaaggcagctgtgctgctctgggcccgggcacccctggccaccagcgctgctccctttgacctgaatctcttgtcttcccaggctatccctccctcatgcggagccaaagccccaaggcccagccccagacttggaaatctggcaagcagactatgctgtctcactaccggccattctacgtcaacaaaggcaacgggattgggtccaacgaagccccatgagctcctggcggaaggaacgaggcgccacacccctgctcttcctcctgaccctgctgctcttgccttctaagctactgtgcttgtctgggtgggagggagcctggtcctgcacctgccctctgcagccctctgccagcctcttgggggcagttccggcctctccgacttccccactggccacactccattcagactcctttcctgccttgtgacctcagatggtcaccatcattcctgtgctcagaggccaacccatcacaggggtgagataggttggggcctgccctaacccgccagcctcctcctctcgggctggatctgggggctagcagtgagtacccgcatggtatcagcctgcctctcccgcccacgccctgctgtctccaggcctatagacgtttctctccaaggccctatcccccaatgttgtcagcagatgcctggacagcacagccacccatctcccattcacatggcccacctcctgcttcccagaggactggccctacgtgctctctctcgtcctacctatcaatgcccagcatggcagaacctgcagcccttggccactgcagatggaaacctctcagtgtcttgacatcaccctacccaggcggtgggtctccaccacagccactttgagtctgtggtccctggagggtggcttctcctgactggcaggatgaccttagccaagatattcctctgttccctctgctgagataaagaattcccttaacatgatataatccacccatgcaaatagctactggcccagctaccatttaccatttgcctacagaatttcattcagtctacactttggcattctctctggcgatggagtgtggctgggctgaccgcaaaaggtgccttacacactgcccccaccctcagccgttgccccatcagaggctgcctcctccttctgattaccccccatgttgcatatcagggtgctcaaggattggagaggagacaaaaccaggagcagcacagtggggacatctcccgtctcaacagccccaggcctatgggggctctggaaggatgggccagcttgcaggggttggggagggagacatccagcttgggctttcccctttggaataaaccattggtctgtca

SEQ ID NO: 448315 - DNA, 1324 bp, Homo sapiens
gcgtgacgcgtgggtcgacccacgcgattcgggcagctcctcctgctccctgaaaggctatccctccctcatgcggagccaaagccccaaggcccagccccagacttggaaatctggcaagcagactatgctgtctcactaccggccattctacgtcaacaaaggcaacgggattgggtccaacgaagccccatgagctcctggcggaaggaacgaggcgccacacccctgctcttcctcctgaccctgctgctcttgccttctaagctactgtgcttgtctgggtgggagggagcctggtcctgcacctgccctctgcagccctctgccagcctcttgggggcagttccggcctctccgacttccccactggccacactccattcagactcctttcctgccttgtgacctcagatggtcaccatcattcctgtgctcagaggccaacccatcacaggggtgagataggttggggcctgccctaacccgccagcctcctcctctcgggctggatctgggggctagcagtgagtacccgcatggtatcagcctgcctctcccgcccacgccctgctgtctccaggcctatagacgtttctctccaaggccctatcccccaatgttgtcagcagatgcctggacagcacagccacccatctcccattcacatggcccacctcctgcttcccagaggactggccctacgtgctctctctcgtcctacctatcaatgcccagcatggcagaacctgcagcccttggccactgcagatggaaacctctcagtgtcttgacatcaccctacccaggcggtgggtctccaccacagccactttgagtctgtggtccctggagggtggcttctcctgactggcaggatgaccttagccaagatattcctctgttccctctgctgagataaagaattcccttaacatgatataatccacccatgcaaatagctactggcccagctaccatttaccatttgcctacagaatttcattcagtctacactttggcattctctctggcgatggagtgtggctgggctgaccgcaaaaggtgccttacacactgcccccaccctcagccgttgccccatcagaggctgcctcctccttctgattaccccccatgttgcatatcagggtgctcaaggattggagaggagacaaaaccaggagcagcacagtggggacatctcccgtctcaacagccccaggcctatgggggctctggaaggatgggccagcttgcaggggttggggagggagacatccagcttgggctttcccctttggaataaaccattggtctgtca

SEQ ID NO: 448316 - DNA, 2423 bp, Homo sapiens
cctcctcctcctcacaggtgtgtctctagtcctcgtggttgcctgccccactccctgccgagacgcctgccagaaaggtcacctatcctgaaccccagcaagcctgaaacagctcagccaagcaccctgcgatggaagctgcagatgcctccaggagcaacgggtcgagcccagaagccagggatgcccggagcccgtcgggccccagtggcagcctggagaatggcaccaaggctgacggcaaggatgccaagaccaccaacgggcacggcggggaggcagctgagggcaagagcctgggcagcgccctgaagccaggggaaggtaggagcgccctgttcgcgggcaatgagtggcggcgacccatcatccagtttgtcgagtccggggacgacaagaactccaactacttcagcatggactctatggaaggcaagaggtcgccgtacgcagggctccagctgggggctgccaagaagccacccgttacctttgccgaaaagggcgagctgcgcaagtccattttctcggagtcccggaagcccacggtgtccatcatggagcccggggagacccggcggaacagctacccccgggccgacacgggccttttttcacggtccaagtccggctccgaggaggtgctgtgcgactcctgcatcggcaacaagcagaaggcggtcaagtcctgcctggtgtgccaggcctccttctgcgagctgcatctcaagccccacctggagggcgccgccttccgagaccaccagctgctcgagcccatccgggactttgaggcccgcaagtgtcccgtgcatggcaagacgatggagctcttctgccagaccgaccagacctgcatctgctacctttgcatgttccaggagcacaagaatcatagcaccgtgacagtggaggaggccaaggccgagaaggagacggagctgtcactgcaaaaggagcagctgcagctcaagatcattgagattgaggatgaagctgagaagtggcagaaggagaaggaccgcatcaagagcttcaccaccaatgagaaggccatcctggagcagaacttccgggacctggtgcgggacctggagaagcaaaaggaggaagtgagggctgcgctggagcagcgggagcaggatgctgtggaccaagtgaaggtgatcatggatgctctggatgagagagccaaggtgctgcatgaggacaagcagacccgggagcagctgcatagcatcagcgactctgtgttgtttctgcaggaatttggtgcattgatgagcaattactctctccccccacccctgcccacctatcatgtcctgctggagggggagggcctgggacagtcactaggcaacttcaaggacgacctgctcaatgtatgcatgcgccacgttgagaagatgtgcaaggcggacctgagccgtaacttcattgagaggaaccacatggagaacggtggtgaccatcgctatgtgaacaactacacgaacagcttcgggggtgagtggagtgcaccggacaccatgaagagatactccatgtacctgacacccaaaggtggggtccggacatcataccagccctcgtctcctggccgcttcaccaaggagaccacccagaagaatttcaacaatctctatggcaccaaaggtaactacacctcccgggtctgggagtactcctccagcattcagaactctgacaatgacctgcccgtcgtccaaggcagctcctccttctccctgaaaggctatccctccctcatgcggagccaaagccccaaggcccagccccagacttggaaatctggcaagcagactatgctgtctcactaccggccattctacgtcaacaaaggcaacgggattgggtccaacgaagccccatgagctcctggcggcggtgggtctccaccacagccactttgagtctgtggtccctggagggtggcttctcctgactggcaggatgaccttagccaagatattcctctgttccctctgctgagataaagaattcccttaacatgatataatccacccatgcaaatagctactggcccagctaccatttaccatttgcctacagaatttcattcagtctacactttggcattctctctggcgatggagtgtggctgggctgaccgcaaaaggtgccttacacactgcccccaccctcagccgttgccccatcagaggctgcctcctccttctgattaccccccatgttgcatatcagggtgctcaaggattggagaggagacaaaaccaggagcagcacagtggggacatctcccgtctcaacagccccaggcctatgggggctctggaaggatgggccagcttgcaggggttggggagggagacatccagcttgggctttcccctttggaataaaccattggtctgtca

SEQ ID NO: 448317 - DNA, 2401 bp, Homo sapiens
cctcctcctcctcacaggtgtgtctctagtcctcgtggttgcctgccccactccctgccgagacgcctgccagaaaggtcacctatcctgaaccccagcaagcctgaaacagctcagccaagcaccctgcgatggaagctgcagatgcctccaggagcaacgggtcgagcccagaagccagggatgcccggagcccgtcgggccccagtggcagcctggagaatggcaccaaggctgacggcaaggatgccaagaccaccaacgggcacggcggggaggcagctgagggcaagagcctgggcagcgccctgaagccaggggaaggtaggagcgccctgttcgcgggcaatgagtggcggcgacccatcatccagtttgtcgagtccggggacgacaagaactccaactacttcagcatggactctatggaaggcaagaggtcgccgtacgcagggctccagctgggggctgccaagaagccacccgttacctttgccgaaaagggcgagctgcgcaagtccattttctcggagtcccggaagcccacggtgtccatcatggagcccggggagacccggcggaacagctacccccgggccgacacgggccttttttcacggtccaagtccggctccgaggaggtgctgtgcgactcctgcatcggcaacaagcagaaggcggtcaagtcctgcctggtgtgccaggcctccttctgcgagctgcatctcaagccccacctggagggcgccgccttccgagaccaccagctgctcgagcccatccgggactttgaggcccgcaagtgtcccgtgcatggcaagacgatggagctcttctgccagaccgaccagacctgcatctgctacctttgcatgttccaggagcacaagaatcatagcaccgtgacagtggaggaggccaaggccgagaaggagacggagctgtcactgcaaaaggagcagctgcagctcaagatcattgagattgaggatgaagctgagaagtggcagaaggagaaggaccgcatcaagagcttcaccaccaatgagaaggccatcctggagcagaacttccgggacctggtgcgggacctggagaagcaaaaggaggaagtgagggctgcgctggagcagcgggagcaggatgctgtggaccaagtgaaggtgatcatggatgctctggatgagagagccaaggtgctgcatgaggacaagcagacccgggagcagctgcatagcatcagcgactctgtgttgtttctgcaggaatttggtgcattgatgagcaattactctctccccccacccctgcccacctatcatgtcctgctggagggggagggcctgggacagtcactaggcaacttcaaggacgacctgctcaatgtatgcatgcgccacgttgagaagatgtgcaaggcggacctgagccgtaacttcattgagaggaaccacatggagaacggtggtgaccatcgctatgtgaacaactacacgaacagcttcgggggtgagtggagtgcaccggacaccatgaagagatactccatgtacctgacacccaaaggtggggtccggacatcataccagccctcgtctcctggccgcttcaccaaggagaccacccagaagaatttcaacaatctctatggcaccaaaggtaactacacctcccgggtctgggagtactcctccagcattcagaactctgacaatgacctgcccgtcgtccaaggcagctcctccttctccctgaaaggctatccctccctcatgcggagccaaagccccaaggcccagccccagacttggaaatctggcaagcagactatgctgtctcactaccggccattctacgtcaacaaaggcaacgggattgggtccaacgaagccccatgagctcctggcggaaggaacgaggcgccacacccctgctcttcctcctgaccctgctgctcttgccttctaagctactgtgcttgtctgggtgggagggagcctggtcctgcacctgccctctgcagccctctgccagcctcttgggggcagttccggcctctccgacttccccactggccacactccattcagactcctttcctgccttgtgacctcagatggtcaccatcattcctgtgctcagaggccaacccatcacaggggtgagataggttggggcctgccctaacccgcctcctccttctgattaccccccatgttgcatatcagggtgctcaaggattggagaggagacaaaaccaggagcagcacagtggggacatctcccgtctcaacagccccaggcctatgggggctctggaaggatgggccagcttgcaggggttggggagggagacatccagcttgggctttcccctttggaataaaccattggtctgtca

SEQ ID NO: 448318 - DNA, 1055 bp, Homo sapiens
ctgtcgtattgcccgctcggacgggcggtcgcttgtgcgcgtgtcgctctgcccctctgccagcctcttgggggcagttccggcctctccgacttccccactggccacactccattcagactcctttcctgccttgtgacctcagatggtcaccatcattcctgtgctcagaggccaacccatcacaggggtgagataggttggggcctgccctaacccgccagcctcctcctctcgggctggatctgggggctagcagtgagtacccgcatggtatcagcctgcctctcccgcccacgccctgctgtctccaggcctatagacgtttctctccaaggccctatcccccaatgttgtcagcagatgcctggacagcacagccacccatctcccattcacatggcccacctcctgcttcccagaggactggccctacgtgctctctctcgtcctacctatcaatgcccagcatggcagaacctgcagcccttggccactgcagatggaaacctctcagtgtcttgacatcaccctacccaggcggtgggtctccaccacagccactttgagtctgtggtccctggagggtggcttctcctgactggcaggatgaccttagccaagatattcctctgttccctctgctgagataaagaattcccttaacatgatataatccacccatgcaaatagctactggcccagctaccatttaccatttgcctacagaatttcattcagtctacactttggcattctctctggcgatggagtgtggctgggctgaccgcaaaaggtgccttacacactgcccccaccctcagccgttgccccatcagaggctgcctcctccttctgattaccccccatgttgcatatcagggtgctcaaggattggagaggagacaaaaccaggagcagcacagtggggacatctcccgtctcaacagccccaggcctatgggggctctggaaggatgggccagcttgcaggggttggggagggagacatccagcttgggctttcccctttggaataaaccattggtctgtca

SEQ ID NO: 448319 - DNA, 1828 bp, Homo sapiens
cctcctcctcctcacaggtgtgtctctagtcctcgtggttgcctgccccactccctgccgagacgcctgccagaaaggtcacctatcctgaaccccagcaagcctgaaacagctcagccaagcaccctgcgatggaagctgcagatgcctccaggagcaacgggtcgagcccagaagccagggatgcccggagcccgtcgggccccagtggcagcctggagaatggcaccaaggctgacggcaaggatgccaagaccaccaacgggcacggcggggaggcagctgagggcaagagcctgggcagcgccctgaagccaggggaaggtaggagcgccctgttcgcgggcaatgagtggcggcgacccatcatccagtttgtcgagtccggggacgacaagaactccaactacttcagcatggactctatggaaggcaagaggtcgccgtacgcagggctccagctgggggctgccaagaagccacccgttacctttgccgaaaagggcgagctgcgcaagtccattttctcggagtcccggaagcccacggtgtccatcatggagcccggggagacccggcggaacagctacccccgggccgacacgggccttttttcacggtccaagtccggctccgaggaggtgctgtgcgactcctgcatcggcaacaagcagaaggcggtcaagtcctgcctggtgtgccaggcctccttctgcgagctgcatctcaagccccacctggagggcgccgccttccgagaccaccagctgctcgagcccatccgggactttgaggcccgcaagtgtcccgtgcatggcaagacgatggagctcttctgccagaccgaccagacctgcatctgctacctttgcatgttccaggagcacaagaatcatagcaccgtgacagtggaggaggccaaggccgagaaggagacggagctgtcactgcaaaaggagcagctgcagctcaagatcattgagattgaggatgaagctgagaagtggcagaaggagaaggaccgcatcaagagcttcaccaccaatgagaaggccatcctggagcagaacttccgggacctggtgcgggacctggagaagcaaaaggaggaagtgagggctgcgctggagcagcgggagcaggatgctgtggaccaagtgaaggtgatcatggatgctctggatgagagagccaaggtgctgcatgaggacaagcagacccgggagcagctgcatagcatcagcgactctgtgttgtttctgcaggaatttggtgcattgatgagcaattactctctccccccacccctgcccacctatcatgtcctgctggagggggagggcctgggacagtcactaggcaacttcaaggacgacctgctcaatgtatgcatgcgccacgttgagaagatgtgcaaggcggacctgagccgtaacttcattgagaggaaccacatggagaacggtggtgaccatcgctatgtgaacaactacacgaacagcttcgggggtgagtggagtgcaccggacaccatgaagagatactccatgtacctgacacccaaaggtggggtccggacatcataccagccctcgtctcctggccgcttcaccaaggagaccacccagaagaatttcaacaatctctatggcaccaaaggtaactacacctcccgggtctgggagtactcctccagcattcagaactctgacaatgagagagccaaggtgctgcatgaggacaggcagacccgggagcagctgcatagcatcagcgactctgtgttgtttctgcaggaatttggtgcattgatgagcaattactctct

SEQ ID NO: 448320 - DNA, 2252 bp, Homo sapiens
cctcctcctcctcacaggtgtgtctctagtcctcgtggttgcctgccccactccctgccgagacgcctgccagaaaggtcacctatcctgaaccccagcaagcctgaaacagctcagccaagcaccctgcgatggaagctgcagatgcctccaggagcaacgggtcgagcccagaagccagggatgcccggagcccgtcgggccccagtggcagcctggagaatggcaccaaggctgacggcaaggatgccaagaccaccaacgggcacggcggggaggcagctgagggcaagagcctgggcagcgccctgaagccaggggaaggtaggagcgccctgttcgcgggcaatgagtggcggcgacccatcatccagtttgtcgagtccggggacgacaagaactccaactacttcagcatggactctatggaaggcaagaggtcgccgtacgcagggctccagctgggggctgccaagaagccacccgttacctttgccgaaaagggcgagctgcgcaagtccattttctcggagtcccggaagcccacggtgtccatcatggagcccggggagacccggcggaacagctacccccgggccgacacgggccttttttcacggtccaagtccggctccgaggaggtgctgtgcgactcctgcatcggcaacaagcagaaggcggtcaagtcctgcctggtgtgccaggcctccttctgcgagctgcatctcaagccccacctggagggcgccgccttccgagaccaccagctgctcgagcccatccgggactttgaggcccgcaagtgtcccgtgcatggcaagacgatggagctcttctgccagaccgaccagacctgcatctgctacctttgcatgttccaggagcacaagaatcatagcaccgtgacagtggaggaggccaaggccgagaaggagacggagctgtcactgcaaaaggagcagctgcagctcaagatcattgagattgaggatgaagctgagaagtggcagaaggagaaggaccgcatcaagagcttcaccaccaatgagaaggccatcctggagcagaacttccgggacctggtgcgggacctggagaagcaaaaggaggaagtgagggctgcgctggagcagcgggagcaggatgctgtggaccaagtgaaggtgatcatggatgctctggatgagagagccaaggtgctgcatgaggacaagcagacccgggagcagctgcatagcatcagcgactctgtgttgtttctgcaggaatttggtgcattgatgagcaattactctctccccccacccctgcccacctatcataggagcagcacagtggggacatctcccgtctcaacagccccaggcctatgggggctctggaaggatgggccagcttgcaggggttggggagggagacatccagcttgggctttcccctttggaataaaccattggtctgtcaaaaaaaaaaaaaaaaaaaaaaaaaaaaaaaaaaaaaaaaaaagcgatgacgaaggaaagaaaaaaatactcacatggaagagaaaacagaaagaaaatgagaatacaggaaggatatagtagcaaaagagggggctcccatgagtggaggctatgataattaataggagagacattgcggcgtggttttaaaagacagttgtagtagggagacaaagttggaactggtggagggtaatgttttgtggaaaaaggggagcgcccatttgactttcgtgggggagtgaggacagaacaaattggggagaagatactatatcctaaaacgagagagagagtttaagacgccttgaagaaggggagaaaatcatataaaacattgttgtaagcagggggtgagaaaaatgggttggtaaaaaacaacagagtggacatatgttgtttagagtgagagatgggcgacgaaaaagcagtggggcgccaacacgaagggacgcaaaagtgagcacgtgcaggaggaaacagatattgtgtacacccccaggggagagcgcattcggctactagacgggggaaagacacaatgcggtatatgatattgagagtaaatatcgcaaagaaatagattaaaataacgatacgagggaggacagacatgataaaaatacaaaataggtaagagaagagaaacataagtgtgcaagaaagaggactaggagcacgaagagtacagggataggagaaaaaaaggagagtaacaacaggtagaaaaaaacaacaaacaaagaa

SEQ ID NO: 448321 - DNA, 1157 bp, Homo sapiens
cctcctcctcctcacaggtgtgtctctagtcctcgtggttgcctgccccactccctgccgagacgcctgccagaaaggtcacctatcctgaaccccagcaagcctgaaacagctcagccaagcaccctgcgatggaagctgcagatgcctccaggagcaacgggtcgagcccagaagccagggatgcccggagcccgtcgggccccagtggcagcctggagaatggcaccaaggctgacggcaaggatgccaagaccaccaacgggcacggcggggaggcagctgagggcaagagcctgggcagcgccctgaagccaggggaaggtaggagcgccctgttcgcgggcaatgagtggcggcgacccatcatccagtttgtcgagtccggggacgacaagaactccaactacttcagcatggactctatggaaggcaagaggtcgccgtacgcagggctccagctgggggctgccaagaagccacccgttacctttgccgaaaagggcgagctgcgcaagtccattttctcggagtcccggaagcccacggtgtccatcatggagcccggggagacccggcggaacagctacccccgggccgacacgggccttttttcacggtccaagtccggctccgaggaggtgctgtgcgactcctgcatcggcaacaagcagaaggcggtcaagtcctgcctggtgtgccaggcctccttctgcgagctgcatctcaagccccacctggagggcgccgccttccgagaccaccagctgctcgagcccatccgggactttgaggcccgcaagtgtcccgtgcatggcaagacgatggagctcttctgccagaccgaccagacctgcatctgctacctttgcatgttccaggagcacaagaatcatagcaccgtgacagtggaggaggccaaggccgagaaggagacggagctgtcactgcaaaaggagcagctgcagctcaagatcattgagattgaggatgaagctgagaagtggcagaaggagaaggaccgcatcaagtatgataaatgaagcttctaactataacgtgacttcagattatgcacgtgcatcctacgagccctgtaggcaggacttcacgagcttccataaaagttcataacttttggaaagaggtcaactacg

SEQ ID NO: 448322 - DNA, 1415 bp, Homo sapiens
cctcctcctcctcacaggtgtgtctctagtcctcgtggttgcctgccccactccctgccgagacgcctgccagaaaggtcacctatcctgaaccccagcaagcctgaaacagctcagccaagcaccctgcgatggaagctgcagatgcctccaggagcaacgggtcgagcccagaagccagggatgcccggagcccgtcgggccccagtggcagcctggagaatggcaccaaggctgacggcaaggatgccaagaccaccaacgggcacggcggggaggcagctgagggcaagagcctgggcagcgccctgaagccaggggaaggtaggagcgccctgttcgcgggcaatgagtggcggcgacccatcatccagtttgtcgagtccggggacgacaagaactccaactacttcagcatggactctatggaaggcaagaggtcgccgtacgcagggctccagctgggggctgccaagaagccacccgttacctttgccgaaaagggcgagctgcgcaagtccattttctcggagtcccggaagcccacggtgtccatcatggagcccggggagacccggcggaacagctacccccgggccgacacgggccttttttcacggtccaagtccggctccgaggaggtgctgtgcgactcctgcatcggcaacaagcagaaggcggtcaagtcctgcctggtgtgccaggcctccttctgcgagctgcatctcaagccccacctggagggcgccgccttccgagaccaccagctgctcgagcccatccgggactttgaggcccgcaagtgtcccgtgcatggcaagacgatggagctcttctgccagaccgaccagacctgcatctgctacctttgcatgttccaggagcacaagaatcatagcaccgtgacagtggaggaggccaaggccgagaaggagacggagctgtcactgcaaaaggagcagctgcagctcaagatcattgagattgaggatgaagctgagaagtggcagaaggagaaggaccgcatcaagagcttcaccaccaatgagaaggccatcctggagcagaacttccgggacctggtgcgggacctggagaagcaaaaggaggaagtgagggctgcgctggagcagcgggagcaggatgctgtggaccaagtgaaggtgatcatggatgctctggatgagagagccaaggtgctgcatgaggacaagcagacccgggagcagctgcatagcatcagcgactctgtgttgtttctgcaggtaacaagccactcctctgtcactcaagccctcgatttcacaatccactttttgagacccccctccaacatccatccatccacctatccacttatccacctattcgtctatctgttcatccaccatccagccatccaaccatccatccat

SEQ ID NO: 448323 - DNA, 2156 bp, Homo sapiens
tggaactctgtggtttcgctggatagtaggtagggacagtgggggaggccaaggccgagaaggagacggagctgtcactgcaaaaggagcagctgcagctcaagatcattgagattgaggatgaagctgagaagtggcagaaggagaaggaccgcatcaagagcttcaccaccaatgagaaggccatcctggagcagaacttccgggacctggtgcgggacctggagaagcaaaaggaggaagtgagggctgcgctggagcagcgggagcaggatgctgtggaccaagtgaaggtgatcatggatgctctggatgagagagccaaggtgctgcatgaggacaagcagacccgggagcagctgcatagcatcagcgactctgtgttgtttctgcaggaatttggtgcattgatgagcaattactctctccccccacccctgcccacctatcatgtcctgctggagggggagggcctgggacagtcactaggcaacttcaaggacgacctgctcaatgtatgcatgcgccacgttgagaagatgtgcaaggcggacctgagccgtaacttcattgagaggaaccacatggagaacggtggtgaccatcgctatgtgaacaactacacgaacagcttcgggggtgagtggagtgcaccggacaccatgaagagatactccatgtacctgacacccaaaggtggggtccggacatcataccagccctcgtctcctggccgcttcaccaaggagaccacccagaagaatttcaacaatctctatggcaccaaaggtaactacacctcccgggtctgggagtactcctccagcattcagaactctgacaatgacctgcccgtcgtccaaggcagctcctccttctccctgaaaggctatccctccctcatgcggagccaaagccccaaggcccagccccagacttggaaatctggcaagcagactatgctgtctcactaccggccattctacgtcaacaaaggcaacgggattgggtccaacgaagccccatgagctcctggcggaaggaacgaggcgccacacccctgctcttcctcctgaccctgctgctcttgccttctaagctactgtgcttgtctgggtgggagggagcctggtcctgcacctgccctctgcagccctctgccagcctcttgggggcagttccggcctctccgacttccccactggccacactccattcagactcctttcctgccttgtgacctcagatggtcaccatcattcctgtgctcagaggccaacccatcacaggggtgagataggttggggcctgccctaacccgccagcctcctcctctcgggctggatctgggggctagcagtgagtacccgcatggtatcagcctgcctctcccgcccacgccctgctgtctccaggcctatagacgtttctctccaaggccctatcccccaatgttgtcagcagatgcctggacagcacagccacccatctcccattcacatggcccacctcctgcttcccagaggactggccctacgtgctctctctcgtcctacctatcaatgcccagcatggcagaacctgcagcccttggccactgcagatggaaacctctcagtgtcttgacatcaccctacccaggcggtgggtctccaccacagccactttgagtctgtggtccctggagggtggcttctcctgactggcaggatgaccttagccaagatattcctctgttccctctgctgagataaagaattcccttaacatgatataatccacccatgcaaatagctactggcccagctaccatttaccatttgcctacagaatttcattcagtctacactttggcattctctctggcgatggagtgtggctgggctgaccgcaaaaggtgccttacacactgcccccaccctcagccgttgccccatcagaggctgcctcctccttctgattaccccccatgttgcatatcagggtgctcaaggattggagaggagacaaaaccaggagcagcacagtggggacatctcccgtctcaacagccccaggcctatgggggctctggaaggatgggccagcttgcaggggttggggagggagacatccagcttgggctttcccctttggaataaaccattggtctgtca

SEQ ID NO: 448324 - DNA, 3145 bp, Homo sapiens
cctcctcctcctcacaggtgtgtctctagtcctcgtggttgcctgccccactccctgccgagacgcctgccagaaaggtcacctatcctgaaccccagcaagcctgaaacagctcagccaagcaccctgcgatggaagctgcagatgcctccaggagcaacgggtcgagcccagaagccagggatgcccggagcccgtcgggccccagtggcagcctggagaatggcaccaaggctgacggcaaggatgccaagaccaccaacgggcacggcggggaggcagctgagggcaagagcctgggcagcgccctgaagccaggggaaggtaggagcgccctgttcgcgggcaatgagtggcggcgacccatcatccagtttgtcgagtccggggacgacaagaactccaactacttcagcatggactctatggaaggcaagaggtcgccgtacgcagggctccagctgggggctgccaagaagccacccgttacctttgccgaaaagggcgagctgcgcaagtccattttctcggagtcccggaagcccacggtgtccatcatggagcccggggagacccggcggaacagctacccccgggccgacacgggccttttttcacggtccaagtccggctccgaggaggtgctgtgcgactcctgcatcggcaacaagcagaaggcggtcaagtcctgcctggtgtgccaggcctccttctgcgagctgcatctcaagccccacctggagggcgccgccttccgagaccaccagctgctcgagcccatccgggactttgaggcccgcaagtgtcccgtgcatggcaagacgatggagctcttctgccagaccgaccagacctgcatctgctacctttgcatgttccaggagcacaagaatcatagcaccgtgacagtggaggaggccaaggccgagaaggagacggagctgtcactgcaaaaggagcagctgcagctcaagatcattgagattgaggatgaagctgagaagtggcagaaggagaaggaccgcatcaagagcttcaccaccaatgagaaggccatcctggagcagaacttccgggacctggtgcgggacctggagaagcaaaaggaggaagtgagggctgcgctggagcagcgggagcaggatgctgtggaccaagtgaaggtgatcatggatgctctggatgagagagccaaggtgctgcatgaggacaagcagacccgggagcagctgcatagcatcagcgactctgtgttgtttctgcaggaatttggtgcattgatgagcaattactctctccccccacccctgcccacctatcatgtcctgctggagggggagggcctgggacagtcactaggcaacttcaaggacgacctgctcaatgtatgcatgcgccacgttgagaagatgtgcaaggcggacctgagccgtaacttcattgagaggaaccacatggagaacggtggtgaccatcgctatgtgaacaactacacgaacagcttcgggggtgagtggagtgcaccggacaccatgaagagatactccatgtacctgacacccaaaggtggggtccggacatcataccagccctcgtctcctggccgcttcaccaaggagaccacccagaagaatttcaacaatctctatggcaccaaaggtaactacacctcccgggtctgggagtactcctccagcattcagaactctgacaatgacctgcccgtcgtccaaggcagctcctccttctccctgaaaggctatccctccctcatgcggagccaaagccccaaggcccagccccagacttggaaatctggcaagcagactatgctggtggtttaagcaaggtctgagcatccctcaagtcctgctgtggaccacacaaaggcaaggagctgaccaggaggtgtcagttccctgagagacagggccaaaggcagtgtacccttgagtctcactaccggccattctacgtcaacaaaggcaacgggattgggtccaacgaagccccatgagctcctggcggaaggaacgaggcgccacacccctgctcttcctcctgaccctgctgctcttgccttctaagctactgtgcttgtctgggtgggagggagcctggtcctgcacctgccctctgcagccctctgccagcctcttgggggcagttccggcctctccgacttccccactggccacactccattcagactcctttcctgccttgtgacctcagatggtcaccatcattcctgtgctcagaggccaacccatcacaggggtgagataggttggggcctgccctaacccgccagcctcctcctctcgggctggatctgggggctagcagtgagtacccgcatggtatcagcctgcctctcccgcccacgccctgctgtctccaggcctatagacgtttctctccaaggccctatcccccaatgttgtcagcagatgcctggacagcacagccacccatctcccattcacatggcccacctcctgcttcccagaggactggccctacgtgctctctctcgtcctacctatcaatgcccagcatggcagaacctgcagcccttggccactgcagatggaaacctctcagtgtcttgacatcaccctacccaggcggtgggtctccaccacagccactttgagtctgtggtccctggagggtggcttctcctgactggcaggatgaccttagccaagatattcctctgttccctctgctgagataaagaattcccttaacatgatataatccacccatgcaaatagctactggcccagctaccatttaccatttgcctacagaatttcattcagtctacactttggcattctctctggcgatggagtgtggctgggctgaccgcaaaaggtgccttacacactgcccccaccctcagccgttgccccatcagaggctgcctcctccttctgattaccccccatgttgcatatcagggtgctcaaggattggagaggagacaaaaccaggagcagcacagtggggacatctcccgtctcaacagccccaggcctatgggggctctggaaggatgggccagcttgcaggggttggggagggagacatccagcttgggctttcccctttggaataaaccattggtctgtca

SEQ ID NO: 448325 - DNA, 2824 bp, Homo sapiens
cctcctcctcctcacaggtgtgtctctagtcctcgtggttgcctgccccactccctgccgagacgcctgccagaaaggtcacctatcctgaaccccagcaagcctgaaacagctcagccaagcaccctgcgatggaagctgcagatgcctccaggagcaacgggtcgagcccagaagccagggatgcccggagcccgtcgggccccagtggcagcctggagaatggcaccaaggctgacggcaaggatgccaagaccaccaacgggcacggcggggaggcagctgagggcaagagcctgggcagcgccctgaagccaggggaaggtaggagcgccctgttcgcgggcaatgagtggcggcgacccatcatccagtttgtcgagtccggggacgacaagaactccaactacttcagcatggactctatggaaggcaagaggtcgccgtacgcagggctccagctgggggctgccaagaagccacccgttacctttgccgaaaagggcgagctgcgcaagtccattttctcggagtcccggaagcccacggtgtccatcatggagcccggggagacccggcggaacagctacccccgggccgacacgggccttttttcacggtccaagtccggctccgaggaggtgctgtgcgactcctgcatcggcaacaagcagaaggcggtcaagtcctgcctggtgtgccaggcctccttctgcgagctgcatctcaagccccacctggagggcgccgccttccgagaccaccagctgctcgagcccatccgggactttgaggcccgcaagtgtcccgtgcatggcaagacgatggagctcttctgccagaccgaccagacctgcatctgctacctttgcatgttccaggagcacaagaatcatagcaccgtgacagtggaggaggccaaggccgagaaggagacggagctgtcactgcaaaaggagcagctgcagctcaagatcattgagattgaggatgaagctgagaagtggcagaaggagaaggaccgcatcaagagcttcaccaccaatgagaaggccatcctggagcagaacttccgggacctggtgcgggacctggagaagcaaaaggaggaagtgagggctgcgctggagcagcgggagcaggatgctgtggaccaagtgaaggtgatcatggatgctctggatgagagagccaaggtgctgcatgaggacaagcagacccgggagcagctgcatagcatcagcgactctgtgttgtttctgcaggaatttggtgcattgatgagcaattactctctccccccacccctgcccacctatcatgtcctgctggagggggagggcctgggacagtcactaggcaacttcaaggacgacctgctcaatgtatgcatgcgccacgttgagaagatgtgcaaggcggacctgagccgtaacttcattgagaggaaccacatggagaacggtggtgaccatcgctatgtgaacaactacacgaacagcttcgggggtgagtggagtgcaccggacaccatgaagagatactccatgtacctgacacccaaaggtggggtccggacatcataccagccctcgtctcctggccgcttcaccaaggagaccacccagaagaatttcaacaatctctatggcaccaaaggtaactacacctcccgggtctgggagtactcctccagcattcagaactctgacaatgacctgcccgtcgtccaaggcagctcctccttctccctgaaaggctatccctccctcatgcggagccaaagccccaaggcccagccccagacttggaaatctggcaagcagactatgctgtctcactaccggccattctacgtcaacaaaggcaacgggattgggtccaacgaagccccatgagctcctggcggaaggaacgaggcgccacacccctgctcttcctcctgaccctgctgctcttgccttctaagctactgtgcttgtctgggtgggagggagcctggtcctgcacctgccctctgcagccctctgccagcctcttgggggcagttccggcctctccgacttccccactggccacactccattcagactcctttcctgccttgtgacctcagatggtcaccatcattcctgtgctcagaggccaacccatcacaggggtgagataggttggggcctgccctaacccgccagcctcctcctctcgggctggatctgggggctagcagtgagtacccgcatggtatcagcctgcctctcccgcccacgccctgctgtctccaggcctatagacgtttctctccaaggccctatcccccaatgttgtcagcagatgcctggacagcacagccacccatctcccattcacatggcccacctcctgcttcccagaggactggccctacgtgctctctctcgtcctacctatcaatgcccagcatggcagaacctgcagcccttggccactgcagatggaaacctctcagtgtcttgacatcaccctacccaggcggtgggtctccaccacagccactttgagtctgtggtccctggagggtggcttctcctgactggcaggatgaccttagccaagatattcctctgttccctctgctgagataaagaattcccttaacatgatataatccacccatgcaaatagctactggcccagctaccatttaccatttgcctacagaatttcattcagtctacactttggcattctctctggcgatggagtgtggctgggctgaccgcaaaaggtgccttacacactgcccccaccctctgggtagcagtaccccactaggtaacagacc

SEQ ID NO: 448326 - DNA, 1682 bp, Homo sapiens
attgggcaagctgcttctcttacttcctgagtctcaatttccttatctgtctcagggggatacaaccacaattgatgtatggatcaaataagaaatgggcattaatagcaccttgtaaaggtggtgaccatcgctatgtgaacaactacacgaacagcttcgggggtgagtggagtgcaccggacaccatgaagagatactccatgtacctgacacccaaaggtggggtccggacatcataccagccctcgtctcctggccgcttcaccaaggagaccacccagaagaatttcaacaatctctatggcaccaaaggtaactacacctcccgggtctgggagtactcctccagcattcagaactctgacaatgacctgcccgtcgtccaaggcagctcctccttctccctgaaaggctatccctccctcatgcggagccaaagccccaaggcccagccccagacttggaaatctggcaagcagactatgctgtctcactaccggccattctacgtcaacaaaggcaacgggattgggtccaacgaagccccatgagctcctggcggaaggaacgaggcgccacacccctgctcttcctcctgaccctgctgctcttgccttctaagctactgtgcttgtctgggtgggagggagcctggtcctgcacctgccctctgcagccctctgccagcctcttgggggcagttccggcctctccgacttccccactggccacactccattcagactcctttcctgccttgtgacctcagatggtcaccatcattcctgtgctcagaggccaacccatcacaggggtgagataggttggggcctgccctaacccgccagcctcctcctctcgggctggatctgggggctagcagtgagtacccgcatggtatcagcctgcctctcccgcccacgccctgctgtctccaggcctatagacgtttctctccaaggccctatcccccaatgttgtcagcagatgcctggacagcacagccacccatctcccattcacatggcccacctcctgcttcccagaggactggccctacgtgctctctctcgtcctacctatcaatgcccagcatggcagaacctgcagcccttggccactgcagatggaaacctctcagtgtcttgacatcaccctacccaggcggtgggtctccaccacagccactttgagtctgtggtccctggagggtggcttctcctgactggcaggatgaccttagccaagatattcctctgttccctctgctgagataaagaattcccttaacatgatataatccacccatgcaaatagctactggcccagctaccatttaccatttgcctacagaatttcattcagtctacactttggcattctctctggcgatggagtgtggctgggctgaccgcaaaaggtgccttacacactgcccccaccctcagccgttgccccatcagaggctgcctcctccttctgattaccccccatgttgcatatcagggtgctcaaggattggagaggagacaaaaccaggagcagcacagtggggacatctcccgtctcaacagccccaggcctatgggggctctggaaggatgggccagcttgcaggggttggggagggagacatccagcttgggctttcccctttggaataaaccattggtctgtca

SEQ ID NO: 448327 - DNA, 1516 bp, Homo sapiens
tgattgtagcggacggtgagctgtacgcgatgcgcgagtgtatctgagacccatgagtggggtccggacatcataccagccctcgtctcctggccgcttcaccaaggagaccacccagaagaatttcaacaatctctatggcaccaaaggtaactacacctcccgggtctgggagtactcctccagcattcagaactctgacaatgacctgcccgtcgtccaaggcagctcctccttctccctgaaaggctatccctccctcatgcggagccaaagccccaaggcccagccccagacttggaaatctggcaagcagactatgctgtctcactaccggccattctacgtcaacaaaggcaacgggattgggtccaacgaagccccatgagctcctggcggaaggaacgaggcgccacacccctgctcttcctcctgaccctgctgctcttgccttctaagctactgtgcttgtctgggtgggagggagcctggtcctgcacctgccctctgcagccctctgccagcctcttgggggcagttccggcctctccgacttccccactggccacactccattcagactcctttcctgccttgtgacctcagatggtcaccatcattcctgtgctcagaggccaacccatcacaggggtgagataggttggggcctgccctaacccgccagcctcctcctctcgggctggatctgggggctagcagtgagtacccgcatggtatcagcctgcctctcccgcccacgccctgctgtctccaggcctatagacgtttctctccaaggccctatcccccaatgttgtcagcagatgcctggacagcacagccacccatctcccattcacatggcccacctcctgcttcccagaggactggccctacgtgctctctctcgtcctacctatcaatgcccagcatggcagaacctgcagcccttggccactgcagatggaaacctctcagtgtcttgacatcaccctacccaggcggtgggtctccaccacagccactttgagtctgtggtccctggagggtggcttctcctgactggcaggatgaccttagccaagatattcctctgttccctctgctgagataaagaattcccttaacatgatataatccacccatgcaaatagctactggcccagctaccatttaccatttgcctacagaatttcattcagtctacactttggcattctctctggcgatggagtgtggctgggctgaccgcaaaaggtgccttacacactgcccccaccctcagccgttgccccatcagaggctgcctcctccttctgattaccccccatgttgcatatcagggtgctcaaggattggagaggagacaaaaccaggagcagcacagtggggacatctcccgtctcaacagccccaggcctatgggggctctggaaggatgggccagcttgcaggggttggggagggagacatccagcttgggctttcccctttggaataaaccattggtctgtca

SEQ ID NO: 448328 - DNA, 2377 bp, Homo sapiens
cctcctcctcctcacaggtgtgtctctagtcctcgtggttgcctgccccactccctgccgagacgcctgccagaaaggtcacctatcctgaaccccagcaagcctgaaacagctcagccaagcaccctgcgatggaagctgcagatgcctccaggagcaacgggtcgagcccagaagccagggatgcccggagcccgtcgggccccagtggcagcctggagaatggcaccaaggctgacggcaaggatgccaagaccaccaacgggcacggcggggaggcagctgagggcaagagcctgggcagcgccctgaagccaggggaaggtaggagcgccctgttcgcgggcaatgagtggcggcgacccatcatccagtttgtcgagtccggggacgacaagaactccaactacttcagcatggactctatggaaggcaagaggtcgccgtacgcagggctccagctgggggctgccaagaagccacccgttacctttgccgaaaagggcgagctgcgcaagtccattttctcggagtcccggaagcccacggtgtccatcatggagcccggggagacccggcggaacagctacccccgggccgacacgggccttttttcacggtccaagtccggctccgaggaggtgctgtgcgactcctgcatcggcaacaagcagaaggcggtcaagtcctgcctggtgtgccaggcctccttctgcgagctgcatctcaagccccacctggagggcgccgccttccgagaccaccagctgctcgagcccatccgggactttgaggcccgcaagtgtcccgtgcatggcaagacgatggagctcttctgccagaccgaccagacctgcatctgctacctttgcatgttccaggagcacaagaatcatagcaccgtgacagtggaggaggccaaggccgagaaggagacggagctgtcactgcaaaaggagcagctgcagctcaagatcattgagattgaggatgaagctgagaagtggcagaaggagaaggaccgcatcaagagcttcaccaccaatgagaaggccatcctggagcagaacttccgggacctggtgcgggacctggagaagcaaaaggaggaagtgagggctgcgctggagcagcgggagcaggatgctgtggaccaagtgaaggtgatcatggatgctctggatgagagagccaaggtgctgcatgaggacaagcagacccgggagcagctgcatagcatcagcgactctgtgttgtttctgcaggaatttggtgcattgatgagcaattactctctccccccacccctgcccacctatcatgtcctgctggagggggagggcctgggacagtcactaggcaacttcaaggacgacctgctcaatgtatgcatgcgccacgttgagaagatgtgcaaggcggacctgagccgtaacttcattgagaggaaccacatggagaacggtggtgaccatcgctatgtgaacaactacacgaacagcttcgggggtgagtggagtgcaccggacaccatgaagagatactccatgtacctgacacccaaaggtggggtccggacatcataccagccctcgtctcctggccgcttcaccaaggagaccacccagaagaatttcaacaatctctatggcaccaaaggtaactacacctcccgggtctgggagtactcctccagcattcagaactctgacaatgacctgcccgtcgtccaaggcagctcctccttctccctgaaaggctatccctccctcatgcggagccaaagccccaaggcccagccccagacttggaaatctggcaagcagactatgctgtctcactaccggccattctacgtcaacaaaggcaacgggattgggtccaacgaagccccatgagctcctggcggaaggaacgaggcgccacacccctgctcttcctcctgaccctgctgctcttgccttctaagctactgtgcttgtctgggtgggagggagcctggtcctgcacctgccctctgcagccctctgccagcctcttgggggcagttccggcctctccgacttccccactggccacactccattcagactcctttcctgccttgtgacctcagatggtcaccatcattcctgtgctcagaggccaacccatcacaggggtgagataggttggggcctgccctaacccgccagcctcctcctctcgggctggatctgggggctagcagtgagtacccgcatggtatcagcctgcctctcccgcccacgccctgctgtctccaggcctatagacgtttctctccaagcttgcaggggttggggagggagacatccagcttgggctttcccctttggaataaaccattggtctgtca

SEQ ID NO: 448329 - DNA, 3122 bp, Homo sapiens
cctcctcctcctcacaggtgtgtctctagtcctcgtggttgcctgccccactccctgccgagacgcctgccagaaaggtcacctatcctgaaccccagcaagcctgaaacagctcagccaagcaccctgcgatggaagctgcagatgcctccaggagcaacgggtcgagcccagaagccagggatgcccggagcccgtcgggccccagtggcagcctggagaatggcaccaaggctgacggcaaggatgccaagaccaccaacgggcacggcggggaggcagctgagggcaagagcctgggcagcgccctgaagccaggggaaggtaggagcgccctgttcgcgggcaatgagtggcggcgacccatcatccagtttgtcgagtccggggacgacaagaactccaactacttcagcatggactctatggaaggcaagaggtcgccgtacgcagggctccagctgggggctgccaagaagccacccgttacctttgccgaaaagggcgagctgcgcaagtccattttctcggagtcccggaagcccacggtgtccatcatggagcccggggagacccggcggaacagctacccccgggccgacacgggccttttttcacggtccaagtccggctccgaggaggtgctgtgcgactcctgcatcggcaacaagcagaaggcggtcaagtcctgcctggtgtgccaggcctccttctgcgagctgcatctcaagccccacctggagggcgccgccttccgagaccaccagctgctcgagcccatccgggactttgaggcccgcaagtgtcccgtgcatggcaagacgatggagctcttctgccagaccgaccagacctgcatctgctacctttgcatgttccaggagcacaagaatcatagcaccgtgacagtggaggaggccaaggccgagaaggagacggagctgtcactgcaaaaggagcagctgcagctcaagatcattgagattgaggatgaagctgagaagtggcagaaggagaaggaccgcatcaagagcttcaccaccaatgagaaggccatcctggagcagaacttccgggacctggtgcgggacctggagaagcaaaaggaggaagtgagggctgcgctggagcagcgggagcaggatgctgtggaccaagtgaaggtgatcatggatgctctggatgagagagccaaggtgctgcatgaggacaagcagacccgggagcagctgcatagcatcagcgactctgtgttgtttctgcaggaatttggtgcattgatgagcaattactctctccccccacccctgcccacctatcatgtcctgctggagggggagggcctgggacagtcactaggcaacttcaaggacgacctgctcaatgtatgcatgcgccacgttgagaagatgtgcaaggcggacctgagccgtaacttcattgagaggaaccacatggagaacggtggtgaccatcgctatgtgaacaactacacgaacagcttcgggggtgagtggagtgcaccggacaccatgaagagatactccatgtacctgacacccaaaggtggggtccggacatcataccagccctcgtctcctggccgcttcaccaaggagaccacccagaagaatttcaacaatctctatggcaccaaaggtaactacacctcccgggtctgggagtactcctccagcattcagaactctgacaatgacctgcccgtcgtccaaggcagctcctccttctccctgaaaggctatccctccctcatgcggagccaaagccccaaggcccagccccagacttggaaatctggcaagcagactatgctgtctcactaccggccattctacgtcaacaaaggcaacgggattgggtccaacgaagccccatgagctcctggcggaaggaacgaggcgccacacccctgctcttcctcctgaccctgctgctcttgccttctaagctactgtgcttgtctgggtgggagggagcctggtcctgcacctgccctctgcagccctctgccagcctcttgggggcagttccggcctctccgacttccccactggccacactccattcagactcctttcctgccttgtgacctcagatggtcaccatcattcctgtgctcagaggccaacccatcacagggggtgctcaaggattggagaggagacaaaaccaggagcagcacagtggggacatctcccgtctcaacagccccaggcctatgggggctctggaaggatgggccagcttgcaggggttggggagggagacatccagcttgggctttcccctttggaataaaccattggtctgtcaaaaaaaaaaaaaaaaaaaaaaaaaaaaaaaaaaaaaaaaaaagcgatgacgaaggaaagaaaaaaatactcacatggaagagaaaacagaaagaaaatgagaatacaggaaggatatagtagcaaaagagggggctcccatgagtggaggctatgataattaataggagagacattgcggcgtggttttaaaagacagttgtagtagggagacaaagttggaactggtggagggtaatgttttgtggaaaaaggggagcgcccatttgactttcgtgggggagtgaggacagaacaaattggggagaagatactatatcctaaaacgagagagagagtttaagacgccttgaagaaggggagaaaatcatataaaacattgttgtaagcagggggtgagaaaaatgggttggtaaaaaacaacagagtggacatatgttgtttagagtgagagatgggcgacgaaaaagcagtggggcgccaacacgaagggacgcaaaagtgagcacgtgcaggaggaaacagatattgtgtacacccccaggggagagcgcattcggctactagacgggggaaagacacaatgcggtatatgatattgagagtaaatatcgcaaagaaatagattaaaataacgatacgagggaggacagacatgataaaaatacaaaataggtaagagaagagaaacataagtgtgcaagaaagaggactaggagcacgaagagtacagggataggagaaaaaaaggagagtaacaacaggtagaaaaaaacaacaaacaaagaa

SEQ ID NO: 448330 - DNA, 2263 bp, Homo sapiens
cctcctcctcctcacaggtgtgtctctagtcctcgtggttgcctgccccactccctgccgagacgcctgccagaaaggtcacctatcctgaaccccagcaagcctgaaacagctcagccaagcaccctgcgatggaagctgcagatgcctccaggagcaacgggtcgagcccagaagccagggatgcccggagcccgtcgggccccagtggcagcctggagaatggcaccaaggctgacggcaaggatgccaagaccaccaacgggcacggcggggaggcagctgagggcaagagcctgggcagcgccctgaagccaggggaaggtaggagcgccctgttcgcgggcaatgagtggcggcgacccatcatccagtttgtcgagtccggggacgacaagaactccaactacttcagcatggactctatggaaggcaagaggtcgccgtacgcagggctccagctgggggctgccaagaagccacccgttacctttgccgaaaagggcgagctgcgcaagtccattttctcggagtcccggaagcccacggtgtccatcatggagcccggggagacccggcggaacagctacccccgggccgacacgggccttttttcacggtccaagtccggctccgaggaggtgctgtgcgactcctgcatcggcaacaagcagaaggcggtcaagtcctgcctggtgtgccaggcctccttctgcgagctgcatctcaagccccacctggagggcgccgccttccgagaccaccagctgctcgagcccatccgggactttgaggcccgcaagtgtcccgtgcatggcaagacgatggagctcttctgccagaccgaccagacctgcatctgctacctttgcatgttccaggagcacaagaatcatagcaccgtgacagtggaggaggccaaggccgagaaggagacggagctgtcactgcaaaaggagcagctgcagctcaagatcattgagattgaggatgaagctgagaagtggcagaaggagaaggaccgcatcaagagcttcaccaccaatgagaaggccatcctggagcagaacttccgggacctggtgcgggacctggagaagcaaaaggaggaagtgagggctgcgctggagcagcgggagcaggatgctgtggaccaagtgaaggtgatcatggatgctctggatgagagagccaaggtgctgcatgaggacaagcagacccgggagcagctgcatagcatcagcgactctgtgttgtttctgcaggaatttggtgcattgatgagcaattactctctccccccacccctgcccacctatcatgtcctgctggagggggagggcctgggacagtcactaggcaacttcaaggacgacctgctcaatgtatgcatgcgccacgttgagaagatgtgcaaggcggacctgagccgtaacttcattgagaggaaccacatggagaacggtggtgaccatcgctatgtgaacaactacacgaacagcttcgggggtgagtggagtgcaccggacaccatgaagagatactccatgtacctgacacccaaaggtggggtccggacatcataccagccctcgtctcctggccgcttcaccaaggagaccacccagaagaatttcaacaatctctatggcaccaaaggtaactacacctcccgggtctgggagtactcctccagcattcagaactctgacaatgacctgcccgtcgtccaaggcagctcctccttctccctgaaaggctatccctccctcatgcggagccaaagccccaaggcccagccccagacttggaaatctggcaagcagactatgctgtctcactaccggccattctacgtcaacaaaggcaacgggattgggtccaacgaagccccatgagctcctggcggaaggaacgaggcgccacacccctgctcttcctcctgaccctgctgctcttgccttctaagctactgtgcttgtctgggtgggagggagcctggtcctgcacctgccctctgcagccctctgccagcctcttgggggcagttccggcctctccgacttccccactggccacactccattcagactcctttcctgccttgtgacctcagatggtcaccatcattcctgtgctcagaggccaacccatcacaggggtgagataggttggggcctgccctaacccgctaccatgtcgaagccccatcgctgggtcataaacttgccgcagtactcttgcccagcgatagggtagggct

SEQ ID NO: 448331 - DNA, 1711 bp, Homo sapiens
cctcctcctcctcacaggtgtgtctctagtcctcgtggttgcctgccccactccctgccgagacgcctgccagaaaggtcacctatcctgaaccccagcaagcctgaaacagctcagccaagcaccctgcgatggaagctgcagatgcctccaggagcaacgggtcgagcccagaagccagggatgcccggagcccgtcgggccccagtggcagcctggagaatggcaccaaggctgacggcaaggatgccaagaccaccaacgggcacggcggggaggcagctgagggcaagagcctgggcagcgccctgaagccaggggaaggtaggagcgccctgttcgcgggcaatgagtggcggcgacccatcatccagtttgtcgagtccggggacgacaagaactccaactacttcagcatggactctatggaaggcaagaggtcgccgtacgcagggctccagctgggggctgccaagaagccacccgttacctttgccgaaaagggcgagctgcgcaagtccattttctcggagtcccggaagcccacggtgtccatcatggagcccggggagacccggcggaacagctacccccgggccgacacgggccttttttcacggtccaagtccggctccgaggaggtgctgtgcgactcctgcatcggcaacaagcagaaggcggtcaagtcctgcctggtgtgccaggcctccttctgcgagctgcatctcaagccccacctggagggcgccgccttccgagaccaccagctgctcgagcccatccgggactttgaggcccgcaagtgtcccgtgcatggcaagacgatggagctcttctgccagaccgaccagacctgcatctgctacctttgcatgttccaggagcacaagaatcatagcaccgtgacagtggaggaggccaaggccgagaaggagacggagctgtcactgcaaaaggagcagctgcagctcaagatcattgagattgaggatgaagctgagaagtggcagaaggagaaggaccgcatcaagagcttcaccaccaatgagaaggccatcctggagcagaacttccgggacctggtgcgggacctggagaagcaaaaggaggaagtgagggctgcgctggagcagcgggagcaggatgctgtggaccaagtgaaggtgatcatggatgctctggatgagagagccaaggtgctgcatgaggacaagcagacccgggagcagctgcatagcatcagcgactctgtgttgtttctgcaggaatttggtgcattgatgagcaattactctctccccccacccctgcccacctatcatgtcctgctggagggggagggcctgggacagtcactaggcaacttcaaggacgacctgctcaatgtatgcatgcgccacgttgagaagatgtgcaaggcggacctgagccgtaacttcattgagaggaaccacatggagaacggtggtgaccatcgctatgtgaacaactacacgaacagcttcgggggtgagtggagtgcaccggacaccatgaagagatactccatgtacctgacacccaaaggtggggtccggacatcataccagccctcgtctcctggccgcttcaccaaggagagtaattgctcatcaatgcaccaaattcctgcagaaacaacacagagtcgctgatgctatgcagctgctcccgggtctgcttgtcctcatgc

SEQ ID NO: 448332 - DNA, 1464 bp, Homo sapiens
cctcctcctcctcacaggtgtgtctctagtcctcgtggttgcctgccccactccctgccgagacgcctgccagaaaggtcacctatcctgaaccccagcaagcctgaaacagctcagccaagcaccctgcgatggaagctgcagatgcctccaggagcaacgggtcgagcccagaagccagggatgcccggagcccgtcgggccccagtggcagcctggagaatggcaccaaggctgacggcaaggatgccaagaccaccaacgggcacggcggggaggcagctgagggcaagagcctgggcagcgccctgaagccaggggaaggtaggagcgccctgttcgcgggcaatgagtggcggcgacccatcatccagtttgtcgagtccggggacgacaagaactccaactacttcagcatggactctatggaaggcaagaggtcgccgtacgcagggctccagctgggggctgccaagaagccacccgttacctttgccgaaaagggcgagctgcgcaagtccattttctcggagtcccggaagcccacggtgtccatcatggagcccggggagacccggcggaacagctacccccgggccgacacgggccttttttcacggtccaagtccggctccgaggaggtgctgtgcgactcctgcatcggcaacaagcagaaggcggtcaagtcctgcctggtgtgccaggcctccttctgcgagctgcatctcaagccccacctggagggcgccgccttccgagaccaccagctgctcgagcccatccgggactttgaggcccgcaagtgtcccgtgcatggcaagacgatggagctcttctgccagaccgaccagacctgcatctgctacctttgcatgttccaggagcacaagaatcatagcaccgtgacagtggaggaggccaaggccgagaaggagacggagctgtcactgcaaaaggagcagctgcagctcaagatcattgagattgaggatgaagctgagaagtggcagaaggagaaggaccgcatcaagagcttcaccaccaatgagaaggccatcctggagcagaacttccgggacctggtgcgggacctggagaagcaaaaggaggaagtgagggctgcgctggagcagcgggagcaggatgctgtggaccaagtgaaggtgatcatggatgctctggatgagagagccaaggtgctgcatgaggacaagcagacccgggagcagctgcatagcatcagcgactctgtgttgtttctgcaggaatttggtgcattgatgagcaattactctctccccccacccctgcccacctatcataggagcagcacagtggggacatctcccgtctcaacagccccaggcctatgggggctctggaaggatgggccagcttgcaggggttggggagggagacatccagcttgggctttcccctttggaataaaccattggtctgtca

SEQ ID NO: 448333 - DNA, 7218 bp, Homo sapiens
  misc_feature (37)..(37): n is a, c, g, or t
gcgggagccgcttcgggccttctgggcatgtctgccntatggctccaggtttgtttttctccccggcactctgacggggagggctcccggcatctcctggcgtccgggtagaggacgcggaggatgctgagctgctggcgcactgcagcacaactagagatgtacggatgcccccatcttgatcttacagaatcagaggtacagccgcgagaaaggtctagtcaagaacagacagagtcgcttgaggactcaggagggtgtttgctgcgttgacaacagactacaccctcacagtttgctctgctcttccaacaccagtggaagatgatcacatcccagggatcagtgtcgtttagggatgtgactgtgggcttcactcaagaggagtggcagcatctggaccctgctcagaggaccctgtacagggatgtgatgctggagaactacagccaccttgtctcagtagggtattgcattcctaaaccagaagtgattctcaagttggagaaaggcgaggagccatggatattagaggaaaaatttccaagccagagtcatctggaattaattaataccagtagaaactattcaataatgaagttcaatgagtttaacaaaggtggaaaatgtttctgtgatgaaaagcatgaaataattcattctgaagaggaaccttctgaatataataaaaatgggaacagcttctggctgaatgaagacctcatttggcatcagaaaattaaaaattgggaacaatcttttgaatacaatgaatgtgggaaagctttccctgagaattcactcttccttgtacataagagaggttacacaggacagaaaacctgcaaatatactgaacatgggaaaacctgtgatatgtcatttttcatcactcatcagcaaacacatccaagagaaaaccactatggtaatgaatgtggagaaaatatctttgaggaatccattctccttgaacatcagagtgtttacccattcagccagaagttaaatctcactccaattcagagaacccactcaattaacaatattattgaatataatgagtgtggaacatttttcagtgaaaaattagtccttcatttacaacagagaacacatacaggagaaaaaccttatgaatgtcatgaatgtggaaaaaccttcacccagaagtcagcccacacaagacatcagagaacacacacagggggaaaaccctatgaatgtcatgaatgtgggaagaccttctataagaattcagacctcattaaacatcaaagaattcatacaggggagagaccttatggatgtcatgaatgtgggaaatccttcagtgaaaagtcaacccttactcaacatcaaagaacgcacacaggggagaaaccatatgaatgtcatgaatgtgggaaaaccttctcatttaagtcagtccttactgtgcatcagaaaacacacacaggggagaagccctatgaatgctatgcatgtgggaaagcctttctcagaaaatcagacctcattaaacatcaaagaatacacacaggtgaaaaaccttatgaatgtaatgaatgtgggaagtcattctctgagaagtcaacccttactaaacatctaagaactcacacaggtgagaaaccttatgaatgtattcagtgtggaaaatttttctgctactactccggtttcacagaacatctgagaagacacacaggggagaaaccttttggatgtaatgaatgtgggaaaaccttccgtcagaagtcagccctaattgttcaccagagaactcatataagacagaaaccctatggatgtaatcaatgtggaaaatcattctgtgtgaagtcaaaactcattgcacatcatagaacacacacaggggagaaaccctatgaatgtaatgtttgtggaaaatcattctatgttaagtcaaaactaactgtacatcagagaatacacttggggagaaaccctataaatgtagtaaacgagggaaattactctgggtgaagtcagaactttgtagaacacagaacataaagggtgagagaaatctgttaatataatgataatgagaacacctttgccctgaagtcagttctcacagtatagaagagaacttaaagagggaaaaaacaatatgaagatagggaatgcaggaaaacattattctggaatttggaccatacactatgttacaaaactaaaagtggaaaaaacttattggtgaatgaatataggaaacattttgcccaatgccactcttcattaaacatcagagaattcacacggggtgaaacctgggtcagcatccctaggttgagaagggatgcatttttctgctactactacagtttcacagaatacctgagaagacacacttggagaaaccttttgggtgtaatgaatgtgggaaaacctttcatcagaagtcagctctaattgttcaccacagaactcatataagacagaaaccctatgggtgtaatgaatgtggaaaatcattctgtgtgaagtcaagaggccagagaaaatgcacaaactgtaggaaactataggaaagcatttactatgaggttatattttatggagtatatgtaataagaagtagcttctcagtgaacatcagatagtagagaaagtatttttaactgtatccaatgtgtggatgttttaagttaaaatctaaatttaatatagaacagaggtgttgagttgcaggatatctagcaatttaagaaaatgtggaaaaaatatttttattgagaaatagcattttactttgttaatatctagtttagttcattgtcaagactgctattttctaagagacttctaaagacgccactcaagccaatggctataagtagttcaaaggtttattgcttagccatatgaaaaataagggaagattttttagcaaggggacccacaaacaagagtgctcttgtatgtccagaagaaagagaaagaccatcaatcaggggccatagtacaggagcccaccagcaggatttttgaataatcctagggcagactaaattcagacgacccatctcagaatggtggatcaaagcagcaagtcaatttgccttgtatgcaacttatgaggattagtagaagagagtgggtccagatttctggtggtttctgccctgcagatgtctaacacataagccaggacattctgctgtgagtgacttattgtacccaactctatttctctccatactgaaacatgtctttcataggtgatacaactttttaaaatgtatgtgtagatataacttaaatatggagctttcaaaaagcacaaataggctggacatggtggctcatgcctgtaatcccagtactttgggaggctgaggtgggcaaatcacctgaggtcaggagttccagaccagcctggccaacatgatgaaaccctgtctctactaaaaatacaaaaattagccgggcatggtggtgcacatcggtagtcctggctactagagaggttgaggtgggaggatcacttgaacctgggaggtgggggtttcagtgagctgagatcatgccactgcactccagcctgagtgacagagagagattcaaaaaacaaaaaaaaagcaaaaatatactttgctattgggtaaggtatagtagttggcagcagaatggacccattgaggataactataaaattacagaaaatatttaaatgcaacttattgctatagaagcaaagaggactaaagggcaaaattctagagagtggtaaatctcagaaagcacaagcataaaatgcagctctgggggccctttccacttctggctatagggaagaacctgaatactgaacttgattcaggcagaggaccataacctgggggtcaggggaaggcatgggggggaccagaaaccagaagaacaatcaagactgcaatgaaaaaaatggatacattaggagcttcaaacacatataatttctcaagaaatttccagatgtctcatgctgcatagggcaggagcctgaaaagctaatttgagaagataataagtaggatttttgttttgttttgcattttgcagtacaaaggagaaatgattagaacttaggaagtgccagtgggttggtgaacatgccatcagtaaaagccctggaaacaaggtcatactagagattggttgtgccttgtcacaactgcaaacaatacctgagtggagtattcaaaaacttgcttagaaagaaaactctaggaacagatggcttcactgaagttattccaaatatttaagaaataataccaggcttttataaacttttctagaagaaaaaagatggaacttttccaattcagtttttgaggccagtacaaccttgataacaaaacctaaaaaaaaaacaacaaaaaaacccataaagctatagaccaaagtctcatagatttagatgcaaaatcctaaaattgaaaaaaacatctagccatatccataaactatatcatcaccaagagatgtttattagggcaatcaaaagatttattattttaaaaaaatcagtgtggacttccattcctctttcttttgattcccccctttgacttttcatgtatctctcctgccttccttccccagagtggaggagttagacttgcctcgtgggatgagaggagttgtggctttgtgtctgctggcaccaagagggctgagggtgaggtgtggaagggacagggggaggagatgggcagcattgttgagagattggtaacactgagcaaataaatatgttgagaatgatgacagcaagatttctccattagagaaggtatttataaaaataggaatgaggagagctagaaaacctggagtgtggcattagaatagaactcatatcttttaaatatataggaacaaataaataaattgttgtgtgtgcacatatgcatatattttgtgttcattctactgagaggacctaaacacaatgacacctcagtaacagtaagcacaccaactgccaagttattagttcctaaatactatccacaaaaaaggggaacagggatgattcctagtcagagattgggagaaatacaagatgagcctgaatcatctcatgtacctgacagtaagaaaatactctggctggtctcagtggctcatgtctgtaattctagcatgttagaaggtcaaggtgggtgggttgcttgagctcaggagtttgagaccagcctgggcaacatggcacaattgtctctacaaaaaatacaaaaattagccaggcatggtggcatgcacctgtagtccgaggtactcaggaggcagagacgtgggaggatcgcttgagcctgggagattgaggctgcactgagctgtgatcgtgccactgtactctagcctggaagacagagtgagaccccatctcaggaaaaaagaaaaaaaaaaagatgtcattcagcaggttaatggataaactgtggaacatccagaaaactttaacattcttcaaagaaatagaaaacacaatcctaaaatttatatgggaaccacaaaagacttagaatagtcagctatcctgagcaaaaggaatcaaactggaggaatcatattacctgacttccaattattcaacagagctacagtaaccaaaacagcatgatactggcataacaacagacacataggaacagtatagacaacccagaaacaaattcatacatctatggtgaccacttttgacaaaggaatgaagaacatacactggggaaaagataatgtctttaataaatggtgctgggaaaactggatatccatatgcagaagaatgaaactagacccccatctcttagcatatacaaaaatcaaaattaattaaaaagttaaatctaagacctcaaactatgaaacagctaaaagaaaacatcggggaatctctccaggacattggagtgggcaaagatttcttgtgtaatacctgacaaacaggcaaccaaagcaaaagtggacaaatgggatcacatcaagttaaaaatcttctgcattgcaaaggaaataacaaagtgaagagacaacccatagaatgtgagataatatttgcaaactatccatctgtattaggccatttttgaagtactacaaagaaatacttgagactgagtaatttataaagaagaggtttaattggctcacggttttgcaggctgtacaggaagcatggtgctaacatctgatcagcttgtagggaggcatcaggaagtttccaaccatggtggaaggcaaaaggggaataagtatctcacatggcaggtgcagggcaaagagaggggggaagggaagtgccacacaaccagatcttgtgagtactcagattttgtgaggggtgcttgaggtcatggatacccatttaccctgatgtgtttatacacatttcatacctgtattaaaatatctcatgtaccccataaacatatacacctactttgtacccacaaaaatttaaaaataaagttaatttcaatgtttaaagacttgttattaaaataatagcagtttctataaatttaatatttcaataaaactcccagtatttattgttaacactggaaaaagttttccaaaacgtatatggcagaaatatgggccttgatgtgaggacagcatcaattaatgagggatcctctcccttgatcaaaacaccttccaccaagacccacctttaacgctgagcattacctctcaaagtgagatttgggcagggactaatatccaaactgtatcaacatctgacaaggtgttcacaaccagaatatataaggagctataacaattctatagaaaaaaaaatctgatttaaaactgggcaaaaatctgaatagacgtttctcaaaagaagacatacaaatggcaaacaggcatatgaaaaggtactcaacatcattgatccattagagaaatgcaaatcaaaactacagtaagatatcatctcaccccagttaaaatgtcttctctccaaaagacagataataacaaatgctgaagaggatgtggagaaaagggaaacctcgtgcactgtggaaatgttattagtacaaccactatggacaacaatttggaggtacctcaaaaactaaaaatagagctatcatacaatcccacaattccactggtagttatataccccaaagacagggaatcagtatattgaagatatatctgcaccgtgtttactgtagc

SEQ ID NO: 448334 - DNA, 6543 bp, Homo sapiens
  misc_feature (37)..(37): n is a, c, g, or t
gcgggagccgcttcgggccttctgggcatgtctgccntatggctccaggtttgtttttctccccggcactctgacggggagggctcccggcatctcctggcgtccgggtagaggacgcggaggatgctgagctgctggcgcactgcagcacaactagagatgtacggatgcccccatcttgatcttacagaatcagaggtacagccgcgagaaaggtctagtcaagaacagacagagtcgcttgaggactcaggagggtgtttgctgcgttgacaacagactacaccctcacagtttgctctgctcttccaacaccagtggaagatgatcacatcccagggatcagtgtcgtttagggatgtgactgtgggcttcactcaagaggagtggcagcatctggaccctgctcagaggaccctgtacagggatgtgatgctggagaactacagccaccttgtctcagtagggtattgcattcctaaaccagaagtgattctcaagttggagaaaggcgaggagccatggatattagaggaaaaatttccaagccagagtcatctggaattaattaataccagtagaaactattcaataatgaagttcaatgagtttaacaaaggtggaaaatgtttctgtgatgaaaagcatgaaataattcattctgaagaggaaccttctgaatataataaaaatgggaacagcttctggctgaatgaagacctcatttggcatcagaaaattaaaaattgggaacaatcttttgaatacaatgaatgtgggaaagctttccctgagaattcactcttccttgtacataagagaggttacacaggacagaaaacctgcaaatatactgaacatgggaaaacctgtgatatgtcatttttcatcactcatcagcaaacacatccaagagaaaaccactatggtaatgaatgtggagaaaatatctttgaggaatccattctccttgaacatcagagtgtttacccattcagccagaagttaaatctcactccaattcagagaacccactcaattaacaatattattgaatataatgagtgtggaacatttttcagtgaaaaattagtccttcatttacaacagagaacacatacaggagaaaaaccttatgaatgtcatgaatgtggaaaaaccttcacccagaagtcagcccacacaagacatcagagaacacacacagggggaaaaccctatgaatgtcatgaatgtgggaagaccttctataagaattcagacctcattaaacatcaaagaattcatacaggggagagaccttatggatgtcatgaatgtgggaaatccttcagtgaaaagtcaacccttactcaacatcaaagaacgcacacaggggagaaaccatatgaatgtcatgaatgtgggaaaaccttctcatttaagtcagtccttactgtgcatcagaaaacacacacaggggagaagccctatgaatgctatgcatgtgggaaagcctttctcagaaaatcagacctcattaaacatcaaagaatacacacaggtgaaaaaccttatgaatgtaatgaatgtgggaagtcattctctgagaagtcaacccttactaaacatctaagaactcacacaggtgagaaaccttatgaatgtattcagtgtggaaaatttttctgctactactccggtttcacagaacatctgagaagacacacaggggagaaaccttttggatgtaatgaatgtgggaaaaccttccgtcagaagtcagccctaattgttcaccagagaactcatataagacagaaaccctatggatgtaatcaatgtggaaaatcattctgtgtgaagtcaaaactcattgcacatcatagaacacacacaggggagaaaccctatgaatgtaatgtttgtggaaaatcattctatgttaagtcaaaactaactgtacatcagagaatacacttggggagaaaccctataaatgtagtaaacgagggaaattactctgggtgaagtcagaactttgtagaacacagaacataaagggtgagagaaatctgttaatataatgataatgagaacacctttgccctgaagtcagttctcacagtatagaagagaacttaaagagggaaaaaacaatatgaagatagggaatgcaggaaaacattattctggaatttggaccatacactatgttacaaaactaaaagtggaaaaaacttattggtgaatgaatataggaaacattttgcccaatgccactcttcattaaacatcagagaattcacacggggtgaaacctgggtcagcatccctaggttgagaagggatgcatttttctgctactactacagtttcacagaatacctgagaagacacacttggagaaaccttttgggtgtaatgaatgtgggaaaacctttcatcagaagtcagctctaattgttcaccacagaactcatataagacagaaaccctatgggtgtaatgaatgtggaaaatcattctgtgtgaagtcaagaggccagagaaaatgcacaaactgtaggaaactataggaaagcatttactatgaggttatattttatggagtatatgtaataagaagtagcttctcagtgaacatcagatagtagagaaagtatttttaactgtatccaatgtgtggatgttttaagttaaaatctaaatttaatatagaacagaggtgttgagttgcaggatatctagcaatttaagaaaatgtggaaaaaatatttttattgagaaatagcattttactttgttaatatctagtttagttcattgtcaagactgctattttctaagagacttctaaagacgccactcaagccaatggctataagtagttcaaaggtttattgcttagccatatgaaaaataagggaagattttttagcaaggggacccacaaacaagagtgctcttgtatgtccagaagaaagagaaagaccatcaatcaggggccatagtacaggagcccaccagcaggatttttgaataatcctagggcagactaaattcagacgacccatctcagaatggtggatcaaagcagcaagtcaatttgccttgtatgcaacttatgaggattagtagaagagagtgggtccagatttctggtggtttctgccctgcagatgtctaacacataagccaggacattctgctgtgagtgacttattgtacccaactctatttctctccatactgaaacatgtctttcataggtgatacaactttttaaaatgtatgtgtagatataacttaaatatggagctttcaaaaagcacaaataggctggacatggtggctcatgcctgtaatcccagtactttgggaggctgaggtgggcaaatcacctgaggtcaggagttccagaccagcctggccaacatgatgaaaccctgtctctactaaaaatacaaaaattagccgggcatggtggtgcacatcggtagtcctggctactagagaggttgaggtgggaggatcacttgaacctgggaggtgggggtttcagtgagctgagatcatgccactgcactccagcctgagtgacagagagagattcaaaaaacaaaaaaaaagcaaaaatatactttgctattgggtaaggtatagtagttggcagcagaatggacccattgaggataactataaaattacagaaaatatttaaatgcaacttattgctatagaagcaaagaggactaaagggcaaaattctagagagtggtaaatctcagaaagcacaagcataaaatgcagctctgggggccctttccacttctggctatagggaagaacctgaatactgaacttgattcaggcagaggaccataacctgggggtcaggggaaggcatgggggggaccagaaaccagaagaacaatcaagactgcaatgaaaaaaatggatacattaggagcttcaaacacatataatttctcaagaaatttccagatgtctcatgctgcatagggcaggagcctgaaaagctaatttgagaagataataagtaggatttttgttttgttttgcattttgcagtacaaaggagaaatgattagaacttaggaagtgccagtgggttggtgaacatgccatcagtaaaagccctggaaacaaggtcatactagagattggttgtgccttgtcacaactgcaaacaatacctgagtggagtattcaaaaacttgcttagaaagaaaactctaggaacagatggcttcactgaagttattccaaatatttaagaaataataccaggcttttataaacttttctagaagaaaaaagatggaacttttccaattcagtttttgaggccagtacaaccttgataacaaaacctaaaaaaaaaacaacaaaaaaacccataaagctatagaccaaagtctcatagatttagatgcaaaatcctaaaattgaaaaaaacatctagccatatccataaactatatcatcaccaagagatgtttattagggcaatcaaaagatttattattttaaaaaaatcagtgtggacttccattcctctttcttttgattcccccctttgacttttcatgtatctctcctgccttccttccccagagtggaggagttagacttgcctcgtgggatgagaggagttgtggctttgtgtctgctggcaccaagagggctgagggtgaggtgtggaagggacagggggaggagatgggcagcattgttgagagattggtaacactgagcaaataaatatgttgagaatgatgacagcaagatttctccattagagaaggtatttataaaaataggaatgaggagagctagaaaacctggagtgtggcattagaatagaactcatatcttttaaatatataggaacaaataaataaattgttgtgtgtgcacatatgcatatattttgtgttcattctactgagaggacctaaacacaatgacacctcagtaacagtaagcacaccaactgccaagttattagttcctaaatactatccacaaaaaaggggaacagggatgattcctagtcagagattgggagaaatacaagatgagcctgaatcatctcatgtacctgacagtaagaaaatactctggctggtctcagtggctcatgtctgtaattctagcatgttagaaggtcaaggtgggtgggttgcttgagctcaggagtttgagaccagcctgggcaacatggcacaattgtctctacaaaaaatacaaaaattagccaggcatggtggcatgcacctgtagtccgaggtactcaggaggcagagacgtgggaggatcgcttgagcctgggagattgaggctgcactgagctgtgatcgtgccactgtactctagcctggaagacagagtgagaccccatctcaggaaaaaagaaaaaaaaaaagatgtcattcagcaggttaatggataaactgtggaacatccagaaaactttaacattcttcaaagaaatagaaaacacaatcctaaaatttatatgggaaccacaaaagacttagaatagtcagctatcctgagcaaaaggaatcaaactggaggaatcatattacctgacttccaattattcaacagagctacagtaaccaaaacagcatgatactggcataacaacagacacataggaacagtatagacaacccagaaacaaattcatacatctatggtgaccacttttgacaaaggaatgaagaacatacactggggaaaagataatgtctttaataaatggtgctgggaaaactggatatccatatgcagaagaatgaaactagacccccatctcttagcatatacaaaaatcaaaattaattaaaaagttaaatctaagacctcaaactatgaaacagctaaaagaaaacatcggggaatctctccaggacattggagtgggcaaagatttcttgtgtaatacctgacaaacaggcaaccaaagcaaaagtggacaaatgggatcacatcaagttaaaaatcttctgcattgcaaaggaaataacaaagtgaagagacaacccatagaatgtgagataatatttgcaaactatccatctgtattaggccatttttgaagtactacaaagaaatacttgagactgagtaatttataaagaagaggtttaattggctcacggttttgcaggctgtacaggaagcatggtgctaacatctgatcagcttgtagggaggcatcaggaagtttccaaccatggtggaaggcaaaaggggaataagtatctcacatggcaggtgcagggcaaagagaggggggaagggaagtgccacacaaccagatcttgtgagtactcagattttgtgaggggtgcttgaggtcatggatacccatttaccctgatgtgtttatacacatttcatacctgtattaaaatatctcatgtaccccataaacatatacacctactttgtacccacaaaattcaaataagtacttctgtgtaaacaaaaaaacaaacaacacaaccacaaggacctaaccatgac

SEQ ID NO: 448335 - DNA, 269 bp, Homo sapiens
catgcctggattcgttactcgctcgttctagatgctgagctgctggcgcactgcagcacaactagagatgtacggatgcccccatcttgatcttacagaatcagaggtacagccgcgagaaaggtctgtaagttatctatttacgctttatttaaaagatgggatggggtggggtggacaggaaacgagcttaacgtgttaagttactgatgacattgacacattttgttgtggcagagtcaagaacagacagagtcgcttgaggactc

SEQ ID NO: 448336 - DNA, 937 bp, Homo sapiens
tagcaccagtgggcattttcagagggtccagctcatggctcaagtgacaggaagatgtaggagctttctgtcttgaatgaggattcgaaccaaagggcttaggcccagctgtcttggagcaaagcagctgttgtgggacccccacaggctgggagctttgtgcccattcagatgtgggggcagaagagggcaaggccgaaggagcagacagcaccgcttcttggggagttgtgaaggcatcatgcggagggaagagcttagcagccaagtggaggacagcaccctccatgcctggattcgttactcgctcgttctagatgctgagctgctggcgcactgcagcacaactagagatgtacggatgcccccatcttgatcttacagaatcagaggtacagccgcgagaaaggtctagtcaagaacagacagagtcgcttgaggactcaggagggtgtttgctgcgttgacaacagactacaccctcacagtttgctctgctcttccaacaccagtggaagatgatcacatcccagggatcagtgtcgtttagggatgtgactgtgggcttcactcaagaggagtggcagcatctggaccctgctcagaggaccctgtacagggatgtgatgctggagaactacagccaccttgtctcagtagggtattgcattcctaaaccagaagtgattctcaagttggagaaaggcgaggagccatggatattagaggaaaaatttccaagccagagtcatctgggtgagttagtatgtgccagatggaatttaaaggaaggtagatcacaaagggtaagtttggataataagaccattgaaatgttctttaggaatcatgttttagaggctccagacctttggaagtaacatgttgacgtgacccaaatatgcagtgactctgaatcacccagcatctcccagta

SEQ ID NO: 448337 - DNA, 3492 bp, Homo sapiens
gaaatggaagtaacgagtaagtttggatgcttcgattctaccctagattgagacgggtgagcatagaggcaaaaaaagacattttcttccaaacaagaggtgaccaaacgggcaagggagacctcctcccgggcatgcagagcgcagcgattctgtgcccagggagccggagggctggggctgggagatcccggcggagccccggcagagcagtcgcccgtgagcccccgcaactcagacgcgctcggcctcgcgctccggggctgggaccaccgagggcgagctgcagccttcgccacccggtccgccgccggactccgcctcccacaaacagcccggcaaggcccttttccgccgctccctcatccagcgaagcctccttcccagcttccccggcggcggcgccgtgacgtcacttccgttctccagcgcgcacgtgggaggaagtgctggtgccctctgccgctgctcccgtctctttggttacgctcgtcagccggtcggccgccgcctccagccgtgtgccgctatgggagtcccggcgttcttccgctggctcagccgcaagtacccgtccatcatagtcaactgcgtggaagagaagccaaaagaatgcaatggtgtaaagattccagttgatgccagtaaacctaatccaaatgatgtggagtttgataatctgtatttggatatgaatggaatcatccatccctgtactcatcctgaagacaaaccagcaccaaaaaatgaagatgaaatgatggttgcaatttttgagtacattgacagacttttcagtattgtaagaccaagaagacttctctacatggcaatagatggagtggcaccacgtgctaaaatgaaccagcagcgttcaaggaggttcagggcatcaaaagaaggaatggaagcagcagtcgagaagcagcgagtcagggaagaaatattggcaaaaggtggctttcttcctccagaagaaataaaagaaagatttgacagcaactgtattacaccaggaactgaattcatggacaatcttgctaaatgccttcgctattacatagctgatcgtttaaataatgaccctgggtggaaaaatttgacagttattttatctgatgctagtgctcctggtgaaggagaacataaaatcatggattacattagaaggcaaagagcccagcctaaccatgacccaaatactcatcattgtttatgtggagcagatgctgatctcattatgcttggccttgccacacatgaaccgaactttaccattattagagaagaattcaaaccaaacaagcccaaaccatgtggtctttgtaatcagtttggacatgaggtcaaagattgtgaaggtttgccaagagaaaagaagggaaagcatgatgaacttgccgatagtcttccttgtgcagaaggagagtttatcttccttcggcttaatgttcttcgtgagtatttggaaagagaactcacaatggccagcctaccattcacatttgatgttgagaggagcattgatgactgggttttcatgtgcttctttgtgggaaatgacttcctccctcatttgccatcgttagagattagggaaaatgcaattgaccgtttggttaacatatacaaaaatgtggtacacaaaactgggggttaccttacagaaagtggttatgtcaatctgcaaagagtacagatgatcatgttagcagttggtgaagttgaggatagcatttttaaaaagagaaaggatgatgaggacagttttagaagacgacagaaagaaaaaagaaagagaatgaagagagatcaaccagctttcactcctagtggaatattaactcctcatgccttgggttcaagaaattcaccaggttctcaagtagccagtaatccgagacaagcagcctatgaaatgaggatgcagaataactctagtccttcgatatctcctaatacgagtttcacatctgatggctccccgtctccattaggaggaattaagcgaaaagcagaagacagtgacagtgaacctgagccagaggataatgtcaggttatgggaagctggctggaagcagcggtactacaagaacaaatttgatgtggatgcagctgatgagaaattccgtcggaaagttgtgcagtcgtacgttgaaggactttgctgggttcttagatattattaccagggctgtgcttcctggaagtggtattatccatttcattatgcaccatttgcttcagactttgaaggcattgcagacatgccatctgattttgagaagggtacgaaaccgtttaaaccactagaacaacttatgggggtatttccagctgcaagtggtaattttctacctccatcatggcggaagctcatgagtgatcctgattctagtataattgacttctatcctgaagattttgctattgatttgaatgggaagaaatatgcatggcaaggtgttgctctcttgccattcgtggatgagcgaaggctacgagctgccctagaagaggtatacccagacctcactccagaagagaccagaagaaacagccttggaggtgatgtcttatttgtggggaaacatcacccactccatgacttcattttagagctgtaccagacaggttccacagagccagtggaggtaccccctgaactatgtcatgggattcaaggaaagttttctttggatgaagaagccattcttccagatcaaatagtatgttctcctgttcctatgttaagggatctgacacagaacactgtagtcagtattaattttaaagacccacagtttgctgaagattacatttttaaagctgtaatgcttccaggagcaagaaagccagcagcagtactgaaacctagtgactgggaaaaatccagcaatggacggcagtggaagcctcagcttggctttaaccgtgaccggaggcctgtgcacctggatcaggcagccttcaggactttgggccatgtgatgccaagaggctcaggaactggcatttacagcaatgctgcaccaccacctgtgacttaccagggaaacttatacaggccgcttttgagaggacaagcccagattccaaaacttatgtcaaatatgaggccccaggattcctggcgaggtcctcctccccttttccagcagcaaaggtttgacagaggcgttggggctgaacctctgctcccatggaaccggatgctgcaaacccagaatgcagccttccagccaaaccagtaccagatgctagctgggcctggtgggtatccacccagacgagatgatcgtggagggagacagggatatcccagagaaggaaggaaataccctttgccaccaccctcaggaagatacaattggaattaagcttttgtaaagctttcccaaatcctttcatcattctacagttttatgctatttgtggaaagatttctttctcaagtagtagtttttaataaaactacagtactttgtgt

SEQ ID NO: 448338 - DNA, 1337 bp, Homo sapiens
gaaatggaagtaacgagtaagtttggatgcttcgattctaccctagattgagacgggtgagcatagaggcaaaaaaagacattttcttccaaacaagaggtgaccaaacgggcaagggagacctcctcccgggcatgcagagcgcagcgattctgtgcccagggagccggagggctggggctgggagatcccggcggagccccggcagagcagtcgcccgtgagcccccgcaactcagacgcgctcggcctcgcgctccggggctgggaccaccgagggcgagctgcagccttcgccacccggtccgccgccggactccgcctcccacaaacagcccggcaaggcccttttccgccgctccctcatccagcgaagcctccttcccagcttccccggcggcggcgccgtgacgtcacttccgttctccagcgcgcacgtgggaggaagtgctggtgccctctgccgctgctcccgtctctttggttacgctcgtcagccggtcggccgccgcctccagccgtgtgccgctatgggagtcccggcgttcttccgctggctcagccgcaagtacccgtccatcatagtcaactgcgtggaagagaaggtgaggaggcgccaggcggccgccacactcgagcccgggcccccggcacgtctaggccgcggcccatgggctccgccgcctgcccccggggagccttgccggagctcgcgccctgctgccagcctcgcgagcagtcgcagccccacacgcgatgggacgcgggctgtgggattcagcaccccgggggcgaggaattcaggaccctcggcggggcaagggcctatagggttccgaactcgcaggagggtcgctcctcccctactcgctttttcccggcaccggaaggccccgcccactgctttgtttcctctccagaccgcgcattttgggtctcggaagaggttcagaggctgttgttgagcaatgcatgccaggtcagctgagctagcgggttatggatgcacggattcggaggccagctttttgacaaccttgtaaaggaatccctggcggcgaccttttcgttgtttaccaattgtgccggaaaggttttctcctagtgttcaggaccatttgttgttctggttagattggacgctgaaagcagtatgtcaggtccaggatgagcgctatagaattctgagaagttacccttctctgtgtgccctgactactgaacggggtgggtgcttgttgaaaatttcaagattactggatgtacttgagcagtacaatttttgttgttagttaatacgtaagtagatttttggccattattgagttttgtttttat

SEQ ID NO: 448339 - DNA, 422 bp, Homo sapiens
  misc_feature (42)..(42): n is a, c, g, or t
ttttctctatgattcagtataatgaattatatgtacttcagngactgagttattaagtattataggctattgtttagaaggtataagttaccatcaaatcaaagtgtagacaaccttgtaatattaacgaagatcatttggttttttagtgagttttgtaaagtgcttacagtttggactttattccattgcccttcttttctttctgtcatctaactgtgttgtgatttaattttaatttctacattcattccatttatgttagagagatcaaccagctttcactcctagtggaatattaactcctcatgccttgggttcaagaaattcaccaggttctcaagtagccagtaatccgagacaagcagcctatgaaatgaggatgcagaataactctgtaagtggcttacttttatgtgaca

SEQ ID NO: 448340 - DNA, 220 bp, Homo sapiens
gcacgagatttttaaccattatgaaaaaccagtactcctatcatctaagatccatgctgatttttattgcacaagaattaggtttgaactcttgagctggaacctcagcaaactagagtatatattgttcagtatttctttggaaacatttcattaatgtacttgtcttacagaaatttctgaactttagtaaaaaaaaataaagttaaacttttaaaac

SEQ ID NO: 448341 - DNA, 3977 bp, Homo sapiens
gaaatggaagtaacgagtaagtttggatgcttcgattctaccctagattgagacgggtgagcatagaggcaaaaaaagacattttcttccaaacaagaggtgaccaaacgggcaagggagacctcctcccgggcatgcagagcgcagcgattctgtgcccagggagccggagggctggggctgggagatcccggcggagccccggcagagcagtcgcccgtgagcccccgcaactcagacgcgctcggcctcgcgctccggggctgggaccaccgagggcgagctgcagccttcgccacccggtccgccgccggactccgcctcccacaaacagcccggcaaggcccttttccgccgctccctcatccagcgaagcctccttcccagcttccccggcggcggcgccgtgacgtcacttccgttctccagcgcgcacgtgggaggaagtgctggtgccctctgccgctgctcccgtctctttggttacgctcgtcagccggtcggccgccgcctccagccgtgtgccgctatgggagtcccggcgttcttccgctggctcagccgcaagtacccgtccatcatagtcaactgcgtggaagagaagccaaaagaatgcaatggtgtaaagattccagttgatgccagtaaacctaatccaaatgatgtggagtttgataatctgtatttggatatgaatggaatcatccatccctgtactcatcctgaagacaaaccagcaccaaaaaatgaagatgaaatgatggttgcaatttttgagtacattgacagacttttcagtattgtaagaccaagaagacttctctacatggcaatagatggagtggcaccacgtgctaaaatgaaccagcagcgttcaaggaggttcagggcatcaaaagaaggaatggaagcagcagtcgagaagcagcgagtcagggaagaaatattggcaaaaggtggctttcttcctccagaagaaataaaagaaagatttgacagcaactgtattacaccaggaactgaattcatggacaatcttgctaaatgccttcgctattacatagctgatcgtttaaataatgaccctgggtggaaaaatttgacagttattttatctgatgctagtgctcctggtgaaggagaacataaaatcatggattacattagaaggcaaagagcccagcctaaccatgacccaaatactcatcattgtttatgtggagcagatgctgatctcattatgcttggccttgccacacatgaaccgaactttaccattattagagaagaattcaaaccaaacaagcccaaaccatgtggtctttgtaatcagtttggacatgaggtcaaagattgtgaaggtttgccaagagaaaagaagggaaagcatgatgaacttgccgatagtcttccttgtgcagaaggagagtttatcttccttcggcttaatgttcttcgtgagtatttggaaagagaactcacaatggccagcctaccattcacatttgatgttgagaggagcattgatgactgggttttcatgtgcttctttgtgggaaatgacttcctccctcatttgccatcgttagagattagggaaaatgcaattgaccgtttggttaacatatacaaaaatgtggtacacaaaactgggggttaccttacagaaagtggttatgtcaatctgcaaagagtacagatgatcatgttagcagttggtgaagttgaggatagcatttttaaaaagagaaaggatgatgaggacagttttagaagacgacagaaagaaaaaagaaagagaatgaagagagatcaaccagctttcactcctagtggaatattaactcctcatgccttgggttcaagaaattcaccaggttctcaagtagccagtaatccgagacaagcagcctatgaaatgaggatgcagaataactctagtccttcgatatctcctaatacgagtttcacatctgatggctccccgtctccattaggaggaattaagcgaaaagcagaagacagtgacagtgaacctgagccagaggataatgtcaggttatgggaagctggctggaagcagcggtactacaagaacaaatttgatgtggatgcagctgatgagaaattccgtcggaaagttgtgcagtcgtacgttgaaggactttgctgggttcttagatattattaccagggctgtgcttcctggaagtggtattatccatttcattatgcaccatttgcttcagactttgaaggcattgcagacatgccatctgattttgagaagggtacgaaaccgtttaaaccactagaacaacttatgggggtatttccagctgcaagtggtaattttctacctccatcatggcggaagctcatgagtgatcctgattctagtataattgacttctatcctgaagattttgctattgatttgaatgggaagaaatatgcatggcaaggtgttgctctcttgccattcgtggatgagcgaaggctacgagctgccctagaagaggtatacccagacctcactccagaagagaccagaagaaacagccttggaggtgatgtcttatttgtggggaaacatcacccactccatgacttcattttagagctgtaccagacaggttccacagagccagtggaggtaccccctgaactatgtcatgggattcaaggaaagttttctttggatgaagaagccattcttccagatcaaatagtatgttctcctgttcctatgttaagggatctgacacagaacactgtagtcagtattaattttaaagacccacagtttgctgaagattacatttttaaagctgtaatgcttccaggagcaagaaagccagcagcagtactgaaacctagtgactgggaaaaatccagcaatggacggcagtggaagcctcagcttggctttaaccgtgaccggaggcctgtgcacctggatcaggcagccttcaggactttgggccatgtgatgccaagaggctcaggaactggcatttacagcaatgctgcaccaccacctgtgacttaccagggaaacttatacaggccgcttttgagaggacaagcccagattccaaaacttatgtcaaatatgaggccccaggattcctggcgaggtcctcctccccttttccagcagcaaaggtttgacagaggcgttggggctgaacctctgctcccatggaaccggatgctgcaaacccagaatgcagccttccagccaaaccagtaccagatgctagctgggcctggtgggtatccacccagacgagatgatcgtggagggagacagggatatcccagagaaggaaggaaataccctttgccaccaccctcaggaagatacaattggaattaagcttttgtaaagctttcccaaatcctttcatcattctacagttttatgctatttgtggaaagatttctttctcaagtagtagtttttaataaaactacagtactttgtgtatttcttttaactgtgtatatttctactgatctgatctcactgtttatgttgctttccaaagatgtatgttgcataatacagtggatctgaatttattattgcttataaaacacatttgatggaataggagtactggtttttcataatggttaaaaatgaaaccagctgtggatttcaaaacacagtgtattctagatcatctaagatccatgctgatttttattgcacaagaattaggtttgaactcttgagctggaacctcagcaaactagagtatatattgttcagtatttctttggaaacatttcattaatgtacttgtcttacagaaatttctgaactttagtaaaaaaaaataaagttaaacttttaaaacaaaacaaacggaacccacccacccccgcgccccgacaccgcccccgccgaccccacacccgcccacaccacaacacacacaaggtggggcgccgccggcaaaaaaaac

SEQ ID NO: 448342 - DNA, 3810 bp, Homo sapiens
gaaatggaagtaacgagtaagtttggatgcttcgattctaccctagattgagacgggtgagcatagaggcaaaaaaagacattttcttccaaacaagaggtgaccaaacgggcaagggagacctcctcccgggcatgcagagcgcagcgattctgtgcccagggagccggagggctggggctgggagatcccggcggagccccggcagagcagtcgcccgtgagcccccgcaactcagacgcgctcggcctcgcgctccggggctgggaccaccgagggcgagctgcagccttcgccacccggtccgccgccggactccgcctcccacaaacagcccggcaaggcccttttccgccgctccctcatccagcgaagcctccttcccagcttccccggcggcggcgccgtgacgtcacttccgttctccagcgcgcacgtgggaggaagtgctggtgccctctgccgctgctcccgtctctttggttacgctcgtcagccggtcggccgccgcctccagccgtgtgccgctatgggagtcccggcgttcttccgctggctcagccgcaagtacccgtccatcatagtcaactgcgtggaagagaagccaaaagaatgcaatggtgtaaagattccagttgatgccagtaaacctaatccaaatgatgtggagtttgataatctgtatttggatatgaatggaatcatccatccctgtactcatcctgaagacaaaccagcaccaaaaaatgaagatgaaatgatggttgcaatttttgagtacattgacagacttttcagtattgtaagaccaagaagacttctctacatggcaatagatggagtggcaccacgtgctaaaatgaaccagcagcgttcaaggaggttcagggcatcaaaagaaggaatggaagcagcagtcgagaagcagcgagtcagggaagaaatattggcaaaaggtggctttcttcctccagaagaaataaaagaaagatttgacagcaactgtattacaccaggaactgaattcatggacaatcttgctaaatgccttcgctattacatagctgatcgtttaaataatgaccctgggtggaaaaatttgacagttattttatctgatgctagtgctcctggtgaaggagaacataaaatcatggattacattagaaggcaaagagcccagcctaaccatgacccaaatactcatcattgtttatgtggagcagatgctgatctcattatgcttggccttgccacacatgaaccgaactttaccattattagagaagaattcaaaccaaacaagcccaaaccatgtggtctttgtaatcagtttggacatgaggtcaaagattgtgaaggtttgccaagagaaaagaagggaaagcatgatgaacttgccgatagtcttccttgtgcagaaggagagtttatcttccttcggcttaatgttcttcgtgagtatttggaaagagaactcacaatggccagcctaccattcacatttgatgttgagaggagcattgatgactgggttttcatgtgcttctttgtgggaaatgacttcctccctcatttgccatcgttagagattagggaaaatgcaattgaccgtttggttaacatatacaaaaatgtggtacacaaaactgggggttaccttacagaaagtggttatgtcaatctgcaaagagtacagatgatcatgttagcagttggtgaagttgaggatagcatttttaaaaagagaaaggatgatgaggacagttttagaagacgacagaaagaaaaaagaaagagaatgaagaaattcaccaggttctcaagtagccagtaatccgagacaagcagcctatgaaatgaggatgcagaataactctagtccttcgatatctcctaatacgagtttcacatctgatggctccccgtctccattaggaggaattaagcgaaaagcagaagacagtgacagtgaacctgagccagaggataatgtcaggttatgggaagctggctggaagcagcggtactacaagaacaaatttgatgtggatgcagctgatgagaaattccgtcggaaagttgtgcagtcgtacgttgaaggactttgctgggttcttagatattattaccagggctgtgcttcctggaagtggtattatccatttcattatgcaccatttgcttcagactttgaaggcattgcagacatgccatctgattttgagaagggtacgaaaccgtttaaaccactagaacaacttatgggggtatttccagctgcaagtggtaattttctacctccatcatggcggaagctcatgagtgatcctgattctagtataattgacttctatcctgaagattttgctattgatttgaatgggaagaaatatgcatggcaaggtgttgctctcttgccattcgtggatgagcgaaggctacgagctgccctagaagaggtatacccagacctcactccagaagagaccagaagaaacagccttggaggtgatgtcttatttgtggggaaacatcacccactccatgacttcattttagagctgtaccagacaggttccacagagccagtggaggtaccccctgaactatgtcatgggattcaaggaaagttttctttggatgaagaagccattcttccagatcaaatagtatgttctcctgttcctatgttaagggatctgacacagaacactgtagtcagtattaattttaaagacccacagtttgctgaagattacatttttaaagctgtaatgcttccaggagcaagaaagccagcagcagtactgaaacctagtgactgggaaaaatccagcaatggacggcagtggaagcctcagcttggctttaaccgtgaccggaggcctgtgcacctggatcaggcagccttcaggactttgggccatgtgatgccaagaggctcaggaactggcatttacagcaatgctgcaccaccacctgtgacttaccagggaaacttatacaggccgcttttgagaggacaagcccagattccaaaacttatgtcaaatatgaggccccaggattcctggcgaggtcctcctccccttttccagcagcaaaggtttgacagaggcgttggggctgaacctctgctcccatggaaccggatgctgcaaacccagaatgcagccttccagccaaaccagtaccagatgctagctgggcctggtgggtatccacccagacgagatgatcgtggagggagacagggatatcccagagaaggaaggaaataccctttgccaccaccctcaggaagatacaattggaattaagcttttgtaaagctttcccaaatcctttcatcattctacagttttatgctatttgtggaaagatttctttctcaagtagtagtttttaataaaactacagtactttgtgtatttcttttaactgtgtatatttctactgatctgatctcactgtttatgttgctttccaaagatgtatgttgcataatacagtggatctgaatttattattgcttataaaacacatttgatggaataggagtactggtttttcataatggttaaaaatgaaaccagctgtggatttcaaaacacagtgtattctagatcatctaagatccatgctgatttttattgcacaagaattaggtttgaactcttgagctggaacctcagcaaactagagtatatattgttcagtatttctttggaaacatttcattaatgtacttgtcttacagaaatttctgaactttagtaaaaaaaaataaagttaaacttttaaaac

SEQ ID NO: 448343 - DNA, 3741 bp, Homo sapiens
gaaatggaagtaacgagtaagtttggatgcttcgattctaccctagattgagacgggtgagcatagaggcaaaaaaagacattttcttccaaacaagaggtgaccaaacgggcaagggagacctcctcccgggcatgcagagcgcagcgattctgtgcccagggagccggagggctggggctgggagatcccggcggagccccggcagagcagtcgcccgtgagcccccgcaactcagacgcgctcggcctcgcgctccggggctgggaccaccgagggcgagctgcagccttcgccacccggtccgccgccggactccgcctcccacaaacagcccggcaaggcccttttccgccgctccctcatccagcgaagcctccttcccagcttccccggcggcggcgccgtgacgtcacttccgttctccagcgcgcacgtgggaggaagtgctggtgccctctgccgctgctcccgtctctttggttacgctcgtcagccggtcggccgccgcctccagccgtgtgccgctatgggagtcccggcgttcttccgctggctcagccgcaagtacccgtccatcatagtcaactgcgtggaagagaagaccagcaccaaaaaatgaagatgaaatgatggttgcaatttttgagtacattgacagacttttcagtattgtaagaccaagaagacttctctacatggcaatagatggagtggcaccacgtgctaaaatgaaccagcagcgttcaaggaggttcagggcatcaaaagaaggaatggaagcagcagtcgagaagcagcgagtcagggaagaaatattggcaaaaggtggctttcttcctccagaagaaataaaagaaagatttgacagcaactgtattacaccaggaactgaattcatggacaatcttgctaaatgccttcgctattacatagctgatcgtttaaataatgaccctgggtggaaaaatttgacagttattttatctgatgctagtgctcctggtgaaggagaacataaaatcatggattacattagaaggcaaagagcccagcctaaccatgacccaaatactcatcattgtttatgtggagcagatgctgatctcattatgcttggccttgccacacatgaaccgaactttaccattattagagaagaattcaaaccaaacaagcccaaaccatgtggtctttgtaatcagtttggacatgaggtcaaagattgtgaaggtttgccaagagaaaagaagggaaagcatgatgaacttgccgatagtcttccttgtgcagaaggagagtttatcttccttcggcttaatgttcttcgtgagtatttggaaagagaactcacaatggccagcctaccattcacatttgatgttgagaggagcattgatgactgggttttcatgtgcttctttgtgggaaatgacttcctccctcatttgccatcgttagagattagggaaaatgcaattgaccgtttggttaacatatacaaaaatgtggtacacaaaactgggggttaccttacagaaagtggttatgtcaatctgcaaagagtacagatgatcatgttagcagttggtgaagttgaggatagcatttttaaaaagagaaaggatgatgaggacagttttagaagacgacagaaagaaaaaagaaagagaatgaagagagatcaaccagctttcactcctagtggaatattaactcctcatgccttgggttcaagaaattcaccaggttctcaagtagccagtaatccgagacaagcagcctatgaaatgaggatgcagaataactctagtccttcgatatctcctaatacgagtttcacatctgatggctccccgtctccattaggaggaattaagcgaaaagcagaagacagtgacagtgaacctgagccagaggataatgtcaggttatgggaagctggctggaagcagcggtactacaagaacaaatttgatgtggatgcagctgatgagaaattccgtcggaaagttgtgcagtcgtacgttgaaggactttgctgggttcttagatattattaccagggctgtgcttcctggaagtggtattatccatttcattatgcaccatttgcttcagactttgaaggcattgcagacatgccatctgattttgagaagggtacgaaaccgtttaaaccactagaacaacttatgggggtatttccagctgcaagtggtaattttctacctccatcatggcggaagctcatgagtgatcctgattctagtataattgacttctatcctgaagattttgctattgatttgaatgggaagaaatatgcatggcaaggtgttgctctcttgccattcgtggatgagcgaaggctacgagctgccctagaagaggtatacccagacctcactccagaagagaccagaagaaacagccttggaggtgatgtcttatttgtggggaaacatcacccactccatgacttcattttagagctgtaccagacaggttccacagagccagtggaggtaccccctgaactatgtcatgggattcaaggaaagttttctttggatgaagaagccattcttccagatcaaatagtatgttctcctgttcctatgttaagggatctgacacagaacactgtagtcagtattaattttaaagacccacagtttgctgaagattacatttttaaagctgtaatgcttccaggagcaagaaagccagcagcagtactgaaacctagtgactgggaaaaatccagcaatggacggcagtggaagcctcagcttggctttaaccgtgaccggaggcctgtgcacctggatcaggcagccttcaggactttgggccatgtgatgccaagaggctcaggaactggcatttacagcaatgctgcaccaccacctgtgacttaccagggaaacttatacaggccgcttttgagaggacaagcccagattccaaaacttatgtcaaatatgaggccccaggattcctggcgaggtcctcctccccttttccagcagcaaaggtttgacagaggcgttggggctgaacctctgctcccatggaaccggatgctgcaaacccagaatgcagccttccagccaaaccagtaccagatgctagctgggcctggtgggtatccacccagacgagatgatcgtggagggagacagggatatcccagagaaggaaggaaataccctttgccaccaccctcaggaagatacaattggaattaagcttttgtaaagctttcccaaatcctttcatcattctacagttttatgctatttgtggaaagatttctttctcaagtagtagtttttaataaaactacagtactttgtgtatttcttttaactgtgtatatttctactgatctgatctcactgtttatgttgctttccaaagatgtatgttgcataatacagtggatctgaatttattattgcttataaaacacatttgatggaataggagtactggtttttcataatggttaaaaatgaaaccagctgtggatttcaaaacacagtgtattctagatcatctaagatccatgctgatttttattgcacaagaattaggtttgaactcttgagctggaacctcagcaaactagagtatatattgttcagtatttctttggaaacatttcattaatgtacttgtcttacagaaatttctgaactttagtaaaaaaaaataaagttaaacttttaaaac

SEQ ID NO: 448344 - DNA, 3757 bp, Homo sapiens
gaaatggaagtaacgagtaagtttggatgcttcgattctaccctagattgagacgggtgagcatagaggcaaaaaaagacattttcttccaaacaagaggtgaccaaacgggcaagggagacctcctcccgggcatgcagagcgcagcgattctgtgcccagggagccggagggctggggctgggagatcccggcggagccccggcagagcagtcgcccgtgagcccccgcaactcagacgcgctcggcctcgcgctccggggctgggaccaccgagggcgagctgcagccttcgccacccggtccgccgccggactccgcctcccacaaacagcccggcaaggcccttttccgccgctccctcatccagcgaagcctccttcccagcttccccggcggcggcgccgtgacgtcacttccgttctccagcgcgcacgtgggaggaagtgctggtgccctctgccgctgctcccgtctctttggttacgctcgtcagccggtcggccgccgcctccagccgtgtgccgctatgggagtcccggcgttcttccgctggctcagccgcaagtacccgtccatcatagtcaactgcgtggaagagaagccaaaagaatgcaatggtgtaaagattccagttgatgccagtaaacctaatccaaatgatgtggagtttgataatctgtatttggatatgaatggaatcatccatccctgtactcatcctgaagacaaaccagcaccaaaaaatgaagatgaaatgatggttgcaatttttgagtacattgacagacttttcagtattgtaagaccaagaagacttctctacatggcaatagatggagtggtggctttcttcctccagaagaaataaaagaaagatttgacagcaactgtattacaccaggaactgaattcatggacaatcttgctaaatgccttcgctattacatagctgatcgtttaaataatgaccctgggtggaaaaatttgacagttattttatctgatgctagtgctcctggtgaaggagaacataaaatcatggattacattagaaggcaaagagcccagcctaaccatgacccaaatactcatcattgtttatgtggagcagatgctgatctcattatgcttggccttgccacacatgaaccgaactttaccattattagagaagaattcaaaccaaacaagcccaaaccatgtggtctttgtaatcagtttggacatgaggtcaaagattgtgaaggtttgccaagagaaaagaagggaaagcatgatgaacttgccgatagtcttccttgtgcagaaggagagtttatcttccttcggcttaatgttcttcgtgagtatttggaaagagaactcacaatggccagcctaccattcacatttgatgttgagaggagcattgatgactgggttttcatgtgcttctttgtgggaaatgacttcctccctcatttgccatcgttagagattagggaaaatgcaattgaccgtttggttaacatatacaaaaatgtggtacacaaaactgggggttaccttacagaaagtggttatgtcaatctgcaaagagtacagatgatcatgttagcagttggtgaagttgaggatagcatttttaaaaagagaaaggatgatgaggacagttttagaagacgacagaaagaaaaaagaaagagaatgaagagagatcaaccagctttcactcctagtggaatattaactcctcatgccttgggttcaagaaattcaccaggttctcaagtagccagtaatccgagacaagcagcctatgaaatgaggatgcagaataactctagtccttcgatatctcctaatacgagtttcacatctgatggctccccgtctccattaggaggaattaagcgaaaagcagaagacagtgacagtgaacctgagccagaggataatgtcaggttatgggaagctggctggaagcagcggtactacaagaacaaatttgatgtggatgcagctgatgagaaattccgtcggaaagttgtgcagtcgtacgttgaaggactttgctgggttcttagatattattaccagggctgtgcttcctggaagtggtattatccatttcattatgcaccatttgcttcagactttgaaggcattgcagacatgccatctgattttgagaagggtacgaaaccgtttaaaccactagaacaacttatgggggtatttccagctgcaagtggtaattttctacctccatcatggcggaagctcatgagtgatcctgattctagtataattgacttctatcctgaagattttgctattgatttgaatgggaagaaatatgcatggcaaggtgttgctctcttgccattcgtggatgagcgaaggctacgagctgccctagaagaggtatacccagacctcactccagaagagaccagaagaaacagccttggaggtgatgtcttatttgtggggaaacatcacccactccatgacttcattttagagctgtaccagacaggttccacagagccagtggaggtaccccctgaactatgtcatgggattcaaggaaagttttctttggatgaagaagccattcttccagatcaaatagtatgttctcctgttcctatgttaagggatctgacacagaacactgtagtcagtattaattttaaagacccacagtttgctgaagattacatttttaaagctgtaatgcttccaggagcaagaaagccagcagcagtactgaaacctagtgactgggaaaaatccagcaatggacggcagtggaagcctcagcttggctttaaccgtgaccggaggcctgtgcacctggatcaggcagccttcaggactttgggccatgtgatgccaagaggctcaggaactggcatttacagcaatgctgcaccaccacctgtgacttaccagggaaacttatacaggccgcttttgagaggacaagcccagattccaaaacttatgtcaaatatgaggccccaggattcctggcgaggtcctcctccccttttccagcagcaaaggtttgacagaggcgttggggctgaacctctgctcccatggaaccggatgctgcaaacccagaatgcagccttccagccaaaccagtaccagatgctagctgggcctggtgggtatccacccagacgagatgatcgtggagggagacagggatatcccagagaaggaaggaaataccctttgccaccaccctcaggaagatacaattggaattaagcttttgtaaagctttcccaaatcctttcatcattctacagttttatgctatttgtggaaagatttctttctcaagtagtagtttttaataaaactacagtactttgtgtatttcttttaactgtgtatatttctactgatctgatctcactgtttatgttgctttccaaagatgtatgttgcataatacagtggatctgaatttattattgcttataaaacacatttgatggaataggagtactggtttttcataatggttaaaaatgaaaccagctgtggatttcaaaacacagtgtattctagatcatctaagatccatgctgatttttattgcacaagaattaggtttgaactcttgagctggaacctcagcaaactagagtatatattgttcagtatttctttggaaacatttcattaatgtacttgtcttacagaaatttctgaactttagtaaaaaaaaataaagttaaacttttaaaac

SEQ ID NO: 448345 - DNA, 3517 bp, Homo sapiens
gaaatggaagtaacgagtaagtttggatgcttcgattctaccctagattgagacgggtgagcatagaggcaaaaaaagacattttcttccaaacaagaggtgaccaaacgggcaagggagacctcctcccgggcatgcagagcgcagcgattctgtgcccagggagccggagggctggggctgggagatcccggcggagccccggcagagcagtcgcccgtgagcccccgcaactcagacgcgctcggcctcgcgctccggggctgggaccaccgagggcgagctgcagccttcgccacccggtccgccgccggactccgcctcccacaaacagcccggcaaggcccttttccgccgctccctcatccagcgaagcctccttcccagcttccccggcggcggcgccgtgacgtcacttccgttctccagcgcgcacgtgggaggaagtgctggtgccctctgccgctgctcccgtctctttggttacgctcgtcagccggtcggccgccgcctccagccgtgtgccgctatgggagtcccggcgttcttccgctggctcagccgcaagtacccgtccatcatagtcaactgcgtggaagagaaggtggctttcttcctccagaagaaataaaagaaagatttgacagcaactgtattacaccaggaactgaattcatggacaatcttgctaaatgccttcgctattacatagctgatcgtttaaataatgaccctgggtggaaaaatttgacagttattttatctgatgctagtgctcctggtgaaggagaacataaaatcatggattacattagaaggcaaagagcccagcctaaccatgacccaaatactcatcattgtttatgtggagcagatgctgatctcattatgcttggccttgccacacatgaaccgaactttaccattattagagaagaattcaaaccaaacaagcccaaaccatgtggtctttgtaatcagtttggacatgaggtcaaagattgtgaaggtttgccaagagaaaagaagggaaagcatgatgaacttgccgatagtcttccttgtgcagaaggagagtttatcttccttcggcttaatgttcttcgtgagtatttggaaagagaactcacaatggccagcctaccattcacatttgatgttgagaggagcattgatgactgggttttcatgtgcttctttgtgggaaatgacttcctccctcatttgccatcgttagagattagggaaaatgcaattgaccgtttggttaacatatacaaaaatgtggtacacaaaactgggggttaccttacagaaagtggttatgtcaatctgcaaagagtacagatgatcatgttagcagttggtgaagttgaggatagcatttttaaaaagagaaaggatgatgaggacagttttagaagacgacagaaagaaaaaagaaagagaatgaagagagatcaaccagctttcactcctagtggaatattaactcctcatgccttgggttcaagaaattcaccaggttctcaagtagccagtaatccgagacaagcagcctatgaaatgaggatgcagaataactctagtccttcgatatctcctaatacgagtttcacatctgatggctccccgtctccattaggaggaattaagcgaaaagcagaagacagtgacagtgaacctgagccagaggataatgtcaggttatgggaagctggctggaagcagcggtactacaagaacaaatttgatgtggatgcagctgatgagaaattccgtcggaaagttgtgcagtcgtacgttgaaggactttgctgggttcttagatattattaccagggctgtgcttcctggaagtggtattatccatttcattatgcaccatttgcttcagactttgaaggcattgcagacatgccatctgattttgagaagggtacgaaaccgtttaaaccactagaacaacttatgggggtatttccagctgcaagtggtaattttctacctccatcatggcggaagctcatgagtgatcctgattctagtataattgacttctatcctgaagattttgctattgatttgaatgggaagaaatatgcatggcaaggtgttgctctcttgccattcgtggatgagcgaaggctacgagctgccctagaagaggtatacccagacctcactccagaagagaccagaagaaacagccttggaggtgatgtcttatttgtggggaaacatcacccactccatgacttcattttagagctgtaccagacaggttccacagagccagtggaggtaccccctgaactatgtcatgggattcaaggaaagttttctttggatgaagaagccattcttccagatcaaatagtatgttctcctgttcctatgttaagggatctgacacagaacactgtagtcagtattaattttaaagacccacagtttgctgaagattacatttttaaagctgtaatgcttccaggagcaagaaagccagcagcagtactgaaacctagtgactgggaaaaatccagcaatggacggcagtggaagcctcagcttggctttaaccgtgaccggaggcctgtgcacctggatcaggcagccttcaggactttgggccatgtgatgccaagaggctcaggaactggcatttacagcaatgctgcaccaccacctgtgacttaccagggaaacttatacaggccgcttttgagaggacaagcccagattccaaaacttatgtcaaatatgaggccccaggattcctggcgaggtcctcctccccttttccagcagcaaaggtttgacagaggcgttggggctgaacctctgctcccatggaaccggatgctgcaaacccagaatgcagccttccagccaaaccagtaccagatgctagctgggcctggtgggtatccacccagacgagatgatcgtggagggagacagggatatcccagagaaggaaggaaataccctttgccaccaccctcaggaagatacaattggaattaagcttttgtaaagctttcccaaatcctttcatcattctacagttttatgctatttgtggaaagatttctttctcaagtagtagtttttaataaaactacagtactttgtgtatttcttttaactgtgtatatttctactgatctgatctcactgtttatgttgctttccaaagatgtatgttgcataatacagtggatctgaatttattattgcttataaaacacatttgatggaataggagtactggtttttcataatggttaaaaatgaaaccagctgtggatttcaaaacacagtgtattctagatcatctaagatccatgctgatttttattgcacaagaattaggtttgaactcttgagctggaacctcagcaaactagagtatatattgttcagtatttctttggaaacatttcattaatgtacttgtcttacagaaatttctgaactttagtaaaaaaaaataaagttaaacttttaaaac

SEQ ID NO: 448346 - DNA, 2597 bp, Homo sapiens
ggtgagggataatgtttgcgtagagtcccacttctctcttttctccattgtgccatgcatgctatagaataagagccctttttagataacagagtctaattaaattgtcttgctgatttttttaaaaatggataccttagttattaactaccttcaactaaaccttaagaattgttgagttgtttattttattttattttattttttaacttacttgtatcttctccatattgacagcctgtttgctccaggataaaaccaagggtctttgtaatggctttgcattttcctaaaatgattcaaaagctttctgaacagaattaccaagatcaattgaattgtatctaaattcagtcttccattgttaagttctgataagcagcattttgaacatatagtcttattgcctggtttaatcatgtacctagatttctggggtcgtcatttttgtgtaattatttgacagaatatgtggattttatacttttaggacagttttagaagacgacagaaagaaaaaagaaagagaatgaagagagatcaaccagctttcactcctagtggaatattaactcctcatgccttgggttcaagaaattcaccaggttctcaagtagccagtaatccgagacaagcagcctatgaaatgaggatgcagaataactctagtccttcgatatctcctaatacgagtttcacatctgatggctccccgtctccattaggaggaattaagcgaaaagcagaagacagtgacagtgaacctgagccagaggataatgtcaggttatgggaagctggctggaagcagcggtactacaagaacaaatttgatgtggatgcagctgatgagaaattccgtcggaaagttgtgcagtcgtacgttgaaggactttgctgggttcttagatattattaccagggctgtgcttcctggaagtggtattatccatttcattatgcaccatttgcttcagactttgaaggcattgcagacatgccatctgattttgagaagggtacgaaaccgtttaaaccactagaacaacttatgggggtatttccagctgcaagtggtaattttctacctccatcatggcggaagctcatgagtgatcctgattctagtataattgacttctatcctgaagattttgctattgatttgaatgggaagaaatatgcatggcaaggtgttgctctcttgccattcgtggatgagcgaaggctacgagctgccctagaagaggtatacccagacctcactccagaagagaccagaagaaacagccttggaggtgatgtcttatttgtggggaaacatcacccactccatgacttcattttagagctgtaccagacaggttccacagagccagtggaggtaccccctgaactatgtcatgggattcaaggaaagttttctttggatgaagaagccattcttccagatcaaatagtatgttctcctgttcctatgttaagggatctgacacagaacactgtagtcagtattaattttaaagacccacagtttgctgaagattacatttttaaagctgtaatgcttccaggagcaagaaagccagcagcagtactgaaacctagtgactgggaaaaatccagcaatggacggcagtggaagcctcagcttggctttaaccgtgaccggaggcctgtgcacctggatcaggcagccttcaggactttgggccatgtgatgccaagaggctcaggaactggcatttacagcaatgctgcaccaccacctgtgacttaccagggaaacttatacaggccgcttttgagaggacaagcccagattccaaaacttatgtcaaatatgaggccccaggattcctggcgaggtcctcctccccttttccagcagcaaaggtttgacagaggcgttggggctgaacctctgctcccatggaaccggatgctgcaaacccagaatgcagccttccagccaaaccagtaccagatgctagctgggcctggtgggtatccacccagacgagatgatcgtggagggagacagggatatcccagagaaggaaggaaataccctttgccaccaccctcaggaagatacaattggaattaagcttttgtaaagctttcccaaatcctttcatcattctacagttttatgctatttgtggaaagatttctttctcaagtagtagtttttaataaaactacagtactttgtgtatttcttttaactgtgtatatttctactgatctgatctcactgtttatgttgctttccaaagatgtatgttgcataatacagtggatctgaatttattattgcttataaaacacatttgatggaataggagtactggtttttcataatggttaaaaatgaaaccagctgtggatttcaaaacacagtgtattctagatcatctaagatccatgctgatttttattgcacaagaattaggtttgaactcttgagctggaacctcagcaaactagagtatatattgttcagtatttctttggaaacatttcattaatgtacttgtcttacagaaatttctgaactttagtaaaaaaaaataaagttaaacttttaaaac

SEQ ID NO: 448347 - DNA, 2895 bp, Homo sapiens
  misc_feature (2550)..(2550): n is a, c, g, or t
  misc_feature (2552)..(2552): n is a, c, g, or t
  misc_feature (2559)..(2560): n is a, c, g, or t
  misc_feature (2567)..(2567): n is a, c, g, or t
  misc_feature (2569)..(2569): n is a, c, g, or t
  misc_feature (2576)..(2576): n is a, c, g, or t
  misc_feature (2580)..(2580): n is a, c, g, or t
gaaatggaagtaacgagtaagtttggatgcttcgattctaccctagattgagacgggtgagcatagaggcaaaaaaagacattttcttccaaacaagaggtgaccaaacgggcaagggagacctcctcccgggcatgcagagcgcagcgattctgtgcccagggagccggagggctggggctgggagatcccggcggagccccggcagagcagtcgcccgtgagcccccgcaactcagacgcgctcggcctcgcgctccggggctgggaccaccgagggcgagctgcagccttcgccacccggtccgccgccggactccgcctcccacaaacagcccggcaaggcccttttccgccgctccctcatccagcgaagcctccttcccagcttccccggcggcggcgccgtgacgtcacttccgttctccagcgcgcacgtgggaggaagtgctggtgccctctgccgctgctcccgtctctttggttacgctcgtcagccggtcggccgccgcctccagccgtgtgccgctatgggagtcccggcgttcttccgctggctcagccgcaagtacccgtccatcatagtcaactgcgtggaagagaagccaaaagaatgcaatggtgtaaagattccagttgatgccagtaaacctaatccaaatgatgtggagtttgataatctgtatttggatatgaatggaatcatccatccctgtactcatcctgaagacaaaccagcaccaaaaaatgaagatgaaatgatggttgcaatttttgagtacattgacagacttttcagtattgtaagaccaagaagacttctctacatggcaatagatggagtggcaccacgtgctaaaatgaaccagcagcgttcaaggaggttcagggcatcaaaagaaggaatggaagcagcagtcgagaagcagcgagtcagggaagaaatattggcaaaaggtggctttcttcctccagaagaaataaaagaaagatttgacagcaactgtattacaccaggaactgaattcatggacaatcttgctaaatgccttcgctattacatagctgatcgtttaaataatgaccctgggtggaaaaatttgacagttattttatctgatgctagtgctcctggtgaaggagaacataaaatcatggattacattagaaggcaaagagcccagcctaaccatgacccaaatactcatcattgtttatgtggagcagatgctgatctcattatgcttggccttgccacacatgaaccgaactttaccattattagagaagaattcaaaccaaacaagcccaaaccatgtggtctttgtaatcagtttggacatgaggtcaaagattgtgaaggtttgccaagagaaaagaagggaaagcatgatgaacttgccgatagtcttccttgtgcagaaggagagtttatcttccttcggcttaatgttcttcgtgagtatttggaaagagaactcacaatggccagcctaccattcacatttgatgttgagaggagcattgatgactgggttttcatgtgcttctttgtgggaaatgacttcctccctcatttgccatcgttagagattagggaaaatgcaattgaccgtttggttaacatatacaaaaatgtggtacacaaaactgggggttaccttacagaaagtggttatgtcaatctgcaaagagtacagatgatcatgttagcagttggtgaagttgaggatagcatttttaaaaagagaaaggatgatgaggacagttttagaagacgacagaaagaaaaaagaaagagaatgaagagagatcaaccagctttcactcctagtggaatattaactcctcatgccttgggttcaagaaattcaccaggttctcaagtagccagtaatccgagacaagcagcctatgaaatgaggatgcagaataactctagtccttcgatatctcctaatacgagtttcacatctgatggctccccgtctccattaggaggaattaagcgaaaagcagaagacagtgacagtgaacctgagccagaggataatgtcaggttatgggaagctggctggaagcagcggtactacaagaacaaatttgatgtggatgcagctgatgagaaattccgtcggaaagttgtgcagtcgtacgttgaaggactttgctgggttcttagatattattaccagggctgtgcttcctggaagtggtattatccatttcattatgcaccatttgcttcagactttgaaggcattgcagacatgccatctgattttgagaagggtacgaaaccgtttaaaccactagaacaacttatgggggtatttccagctgcaagtggtaattttctacctccatcatggcggaagctcatgagtgatcctgattctagtataattgacttctatcctgaagattttgctattgatttgaatgggaagaaatatgcatggcaaggtgttgctctcttgccattcgtggatgagcgaaggctacgagctgccctagaagaggtatacccagacctcactccagaagagancngaaaaanngctggangngatgtcntatnggggggaacttcccatccatgagcttattgtagaagcgtacagaaagggtccagagccgtggggtaccccgacatgtggggatcaggaaggttctggcagaaaaccacgtccaacaaagaaagttccggcaagtaagggatgcacaaacggtgcggtattaaaccacgggggcacacactaaggaaggtccagagaaaagcggactgctaggaggaaccgcgggggtatggtaagaggacgaagcaaacactgatgagacagagtgaagaccacgaaggtggcaattagtctctggtgtatagagcgtttcttgt

SEQ ID NO: 448348 - DNA, 1962 bp, Homo sapiens
ttagtagacagcctgttactgaaggtgtgttaattcagcataaatgagctgtgcctggttttaggttatgggaagctggctggaagcagcggtactacaagaacaaatttgatgtggatgcagctgatgagaaattccgtcggaaagttgtgcagtcgtacgttgaaggactttgctgggttcttagatattattaccagggctgtgcttcctggaagtggtattatccatttcattatgcaccatttgcttcagactttgaaggcattgcagacatgccatctgattttgagaagggtacgaaaccggtaagcttaattacttaaagtcataaagtttatagaattctggattagataataatcttgggtctttaatgttttttcttttttcagtttaaaccactagaacaacttatgggggtatttccagctgcaagtggtaattttctacctccatcatggcggaagctcatgagtgatcctgattctagtataattgacttctatcctgaagattttgctattgatttgaatgggaagaaatatgcatggcaaggtgttgctctcttgccattcgtggatgagcgaaggctacgagctgccctagaagaggtatacccagacctcactccagaagagaccagaagaaacagccttggaggtgatgtcttatttgtggggaaacatcacccactccatgacttcattttagagctgtaccagacaggttccacagagccagtggaggtaccccctgaactatgtcatgggattcaaggaaagttttctttggatgaagaagccattcttccagatcaaatagtatgttctcctgttcctatgttaagggatctgacacagaacactgtagtcagtattaattttaaagacccacagtttgctgaagattacatttttaaagctgtaatgcttccaggagcaagaaagccagcagcagtactgaaacctagtgactgggaaaaatccagcaatggacggcagtggaagcctcagcttggctttaaccgtgaccggaggcctgtgcacctggatcaggcagccttcaggactttgggccatgtgatgccaagaggctcaggaactggcatttacagcaatgctgcaccaccacctgtgacttaccagggaaacttatacaggccgcttttgagaggacaagcccagattccaaaacttatgtcaaatatgaggccccaggattcctggcgaggtcctcctccccttttccagcagcaaaggtttgacagaggcgttggggctgaacctctgctcccatggaaccggatgctgcaaacccagaatgcagccttccagccaaaccagtaccagatgctagctgggcctggtgggtatccacccagacgagatgatcgtggagggagacagggatatcccagagaaggaaggaaataccctttgccaccaccctcaggaagatacaattggaattaagcttttgtaaagctttcccaaatcctttcatcattctacagttttatgctatttgtggaaagatttctttctcaagtagtagtttttaataaaactacagtactttgtgtatttcttttaactgtgtatatttctactgatctgatctcactgtttatgttgctttccaaagatgtatgttgcataatacagtggatctgaatttattattgcttataaaacacatttgatggaataggagtactggtttttcataatggttaaaaatgaaaccagctgtggatttcaaaacacagtgtattctagatcatctaagatccatgctgatttttattgcacaagaattaggtttgaactcttgagctggaacctcagcaaactagagtatatattgttcagtatttctttggaaacatttcattaatgtacttgtcttacagaaatttctgaactttagtaaaaaaaaataaagttaaacttttaaaac

SEQ ID NO: 448349 - DNA, 2836 bp, Homo sapiens
  misc_feature (2491)..(2491): n is a, c, g, or t
  misc_feature (2493)..(2493): n is a, c, g, or t
  misc_feature (2500)..(2501): n is a, c, g, or t
  misc_feature (2508)..(2508): n is a, c, g, or t
  misc_feature (2510)..(2510): n is a, c, g, or t
  misc_feature (2517)..(2517): n is a, c, g, or t
  misc_feature (2521)..(2521): n is a, c, g, or t
gaaatggaagtaacgagtaagtttggatgcttcgattctaccctagattgagacgggtgagcatagaggcaaaaaaagacattttcttccaaacaagaggtgaccaaacgggcaagggagacctcctcccgggcatgcagagcgcagcgattctgtgcccagggagccggagggctggggctgggagatcccggcggagccccggcagagcagtcgcccgtgagcccccgcaactcagacgcgctcggcctcgcgctccggggctgggaccaccgagggcgagctgcagccttcgccacccggtccgccgccggactccgcctcccacaaacagcccggcaaggcccttttccgccgctccctcatccagcgaagcctccttcccagcttccccggcggcggcgccgtgacgtcacttccgttctccagcgcgcacgtgggaggaagtgctggtgccctctgccgctgctcccgtctctttggttacgctcgtcagccggtcggccgccgcctccagccgtgtgccgctatgggagtcccggcgttcttccgctggctcagccgcaagtacccgtccatcatagtcaactgcgtggaagagaagccaaaagaatgcaatggtgtaaagattccagttgatgccagtaaacctaatccaaatgatgtggagtttgataatctgtatttggatatgaatggaatcatccatccctgtactcatcctgaagacaaaccagcaccaaaaaatgaagatgaaatgatggttgcaatttttgagtacattgacagacttttcagtattgtaagaccaagaagacttctctacatggcaatagatggagtggcaccacgtgctaaaatgaaccagcagcgttcaaggaggttcagggcatcaaaagaaggaatggaagcagcagtcgagaagcagcgagtcagggaagaaatattggcaaaaggtggctttcttcctccagaagaaataaaagaaagatttgacagcaactgtattacaccaggaactgaattcatggacaatcttgctaaatgccttcgctattacatagctgatcgtttaaataatgaccctgggtggaaaaatttgacagttattttatctgatgctagtgctcctggtgaaggagaacataaaatcatggattacattagaaggcaaagagcccagcctaaccatgacccaaatactcatcattgtttatgtggagcagatgctgatctcattatgcttggccttgccacacatgaaccgaactttaccattattagagaagaattcaaaccaaacaagcccaaaccatgtggtctttgtaatcagtttggacatgaggtcaaagattgtgaaggtttgccaagagaaaagaagggaaagcatgatgaacttgccgatagtcttccttgtgcagaaggagagtttatcttccttcggcttaatgttcttcgtgagtatttggaaagagaactcacaatggccagcctaccattcacatttgatgttgagaggagcattgatgactgggttttcatgtgcttctttgtgggaaatgacttcctccctcatttgccatcgttagagattagggaaaatgcaattgaccgtttggttaacatatacaaaaatgtggtacacaaaactgggggttaccttacagaaagtggttatgtcaatctgcaaagagtacagatgatcatgttagcagttggtgaagttgaggatagcatttttaaaaagagaaaggatgatgaggacagttttagaagacgacagaaagaaaaaagaaagagaatgaagaaattcaccaggttctcaagtagccagtaatccgagacaagcagcctatgaaatgaggatgcagaataactctagtccttcgatatctcctaatacgagtttcacatctgatggctccccgtctccattaggaggaattaagcgaaaagcagaagacagtgacagtgaacctgagccagaggataatgtcaggttatgggaagctggctggaagcagcggtactacaagaacaaatttgatgtggatgcagctgatgagaaattccgtcggaaagttgtgcagtcgtacgttgaaggactttgctgggttcttagatattattaccagggctgtgcttcctggaagtggtattatccatttcattatgcaccatttgcttcagactttgaaggcattgcagacatgccatctgattttgagaagggtacgaaaccgtttaaaccactagaacaacttatgggggtatttccagctgcaagtggtaattttctacctccatcatggcggaagctcatgagtgatcctgattctagtataattgacttctatcctgaagattttgctattgatttgaatgggaagaaatatgcatggcaaggtgttgctctcttgccattcgtggatgagcgaaggctacgagctgccctagaagaggtatacccagacctcactccagaagagancngaaaaanngctggangngatgtcntatnggggggaacttcccatccatgagcttattgtagaagcgtacagaaagggtccagagccgtggggtaccccgacatgtggggatcaggaaggttctggcagaaaaccacgtccaacaaagaaagttccggcaagtaagggatgcacaaacggtgcggtattaaaccacgggggcacacactaaggaaggtccagagaaaagcggactgctaggaggaaccgcgggggtatggtaagaggacgaagcaaacactgatgagacagagtgaagaccacgaaggtggcaattagtctctggtgtatagagcgtttcttgt

SEQ ID NO: 448350 - DNA, 1694 bp, Homo sapiens
gtgtgatacgtgggacagttcacatagacatcagagaatttattccagaaaggagcctcctgaatgtgatgaatacggcaaagctttaatcacatctcagcccttagcatcggaaagcttatactgtaaataaacttgatgaatattatatgtgaggaaaactttcatgtatagcactcattgcttcagacagaaaatgaattccgtcggtatgttccaatcgtgatgaatttgagaaacattgcaagagggagcctggccttgttcttgtttttcaaaaatttctttggtattctcacaagtttattcttccaaattaacttcagaatcagcttaccattttaaataagcaccccccttctaaatctattataacatctcactactttctcttctattcatattagcttaacttaagctaccatcctctcttgagtaagactgttttctaacatacagcaacaagagggttctttttaaaacataaatcagattatgtcatgggattcaaggaaagttttctttggatgaagaagccattcttccagatcaaatagtatgttctcctgttcctatgttaagggatctgacacagaacactgtagtcagtattaattttaaagacccacagtttgctgaagattacatttttaaagctgtaatgcttccaggagcaagaaagccagcagcagtactgaaacctagtgactgggaaaaatccagcaatggacggcagtggaagcctcagcttggctttaaccgtgaccggaggcctgtgcacctggatcaggcagccttcaggactttgggccatgtgatgccaagaggctcaggaactggcatttacagcaatgctgcaccaccacctgtgacttaccagggaaacttatacaggccgcttttgagaggacaagcccagattccaaaacttatgtcaaatatgaggccccaggattcctggcgaggtcctcctccccttttccagcagcaaaggtttgacagaggcgttggggctgaacctctgctcccatggaaccggatgctgcaaacccagaatgcagccttccagccaaaccagtaccagatgctagctgggcctggtgggtatccacccagacgagatgatcgtggagggagacagggatatcccagagaaggaaggaaataccctttgccaccaccctcaggaagatacaattggaattaagcttttgtaaagctttcccaaatcctttcatcattctacagttttatgctatttgtggaaagatttctttctcaagtagtagtttttaataaaactacagtactttgtgtatttcttttaactgtgtatatttctactgatctgatctcactgtttatgttgctttccaaagatgtatgttgcataatacagtggatctgaatttattattgcttataaaacacatttgatggaataggagtactggtttttcataatggttaaaaatgaaaccagctgtggatttcaaaacacagtgtattctagatcatctaagatccatgctgatttttattgcacaagaattaggtttgaactcttgagctggaacctcagcaaactagagtatatattgttcagtatttctttggaaacatttcattaatgtacttgtcttacagaaatttctgaactttagtaaaaaaaaataaagttaaacttttaaaac

SEQ ID NO: 448351 - DNA, 1360 bp, Homo sapiens
gaaatggaagtaacgagtaagtttggatgcttcgattctaccctagattgagacgggtgagcatagaggcaaaaaaagacattttcttccaaacaagaggtgaccaaacgggcaagggagacctcctcccgggcatgcagagcgcagcgattctgtgcccagggagccggagggctggggctgggagatcccggcggagccccggcagagcagtcgcccgtgagcccccgcaactcagacgcgctcggcctcgcgctccggggctgggaccaccgagggcgagctgcagccttcgccacccggtccgccgccggactccgcctcccacaaacagcccggcaaggcccttttccgccgctccctcatccagcgaagcctccttcccagcttccccggcggcggcgccgtgacgtcacttccgttctccagcgcgcacgtgggaggaagtgctggtgccctctgccgctgctcccgtctctttggttacgctcgtcagccggtcggccgccgcctccagccgtgtgccgctatgggagtcccggcgttcttccgctggctcagccgcaagtacccgtccatcatagtcaactgcgtggaagagaagatatgaggccccaggattcctggcgaggtcctcctccccttttccagcagcaaaggtttgacagaggcgttggggctgaacctctgctcccatggaaccggatgctgcaaacccagaatgcagccttccagccaaaccagtaccagatgctagctgggcctggtgggtatccacccagacgagatgatcgtggagggagacagggatatcccagagaaggaaggaaataccctttgccaccaccctcaggaagatacaattggaattaagcttttgtaaagctttcccaaatcctttcatcattctacagttttatgctatttgtggaaagatttctttctcaagtagtagtttttaataaaactacagtactttgtgtatttcttttaactgtgtatatttctactgatctgatctcactgtttatgttgctttccaaagatgtatgttgcataatacagtggatctgaatttattattgcttataaaacacatttgatggaataggagtactggtttttcataatggttaaaaatgaaaccagctgtggatttcaaaacacagtgtattctagatcatctaagatccatgctgatttttattgcacaagaattaggtttgaactcttgagctggaacctcagcaaactagagtatatattgttcagtatttctttggaaacatttcattaatgtacttgtcttacagaaatttctgaactttagtaaaaaaaaataaagttaaacttttaaaac

SEQ ID NO: 448352 - DNA, 1044 bp, Homo sapiens
catttaaagccctactatttgttgctaaataaaaaatccctaaaatcaattgctcatttggccttaactgacttagcaagctcttgccttggttaaagcaaagttactttccttgtgtaataagtctaaattgatgtgggtatcttaccacaaagtgacttgaattactactgctaggacagtgagaaaattgagaaccactgtctgtacatgttgtttacacagaacactttagttatttgtgtgcatttgtgattgttaaggttttttgttttatttttcagtaatagcatttgtgctagcctccaactttgcaacaagtctgtattaaagctctggatcaaagcaccttttatggggcctttccatgtgctgtacctttaacacatactcagtttccttatgatgtgtttttccatagaggtttaaagttaactgacttgcaggagtatcggtccagaaaataaactctttcttttgtttattttcagggatatcccagagaaggaaggaaataccctttgccaccaccctcaggaagatacaattggaattaagcttttgtaaagctttcccaaatcctttcatcattctacagttttatgctatttgtggaaagatttctttctcaagtagtagtttttaataaaactacagtactttgtgtatttcttttaactgtgtatatttctactgatctgatctcactgtttatgttgctttccaaagatgtatgttgcataatacagtggatctgaatttattattgcttataaaacacatttgatggaataggagtactggtttttcataatggttaaaaatgaaaccagctgtggatttcaaaacacagtgtattctagatcatctaagatccatgctgatttttattgcacaagaattaggtttgaactcttgagctggaacctcagcaaactagagtatatattgttcagtatttctttggaaacatttcattaatgtacttgtcttacagaaatttctgaactttagtaaaaaaaaataaagttaaacttttaaaac

SEQ ID NO: 448353 - DNA, 348 bp, Homo sapiens
caaggaggttcagggcatcaaaagaaggaatggaagcagcagtcgagaagcagcgagtcagggaagaaatattggcaaaaggtaaagaatatgcatcttgaagttggattttttcataagatgtatgcagaatgagggggtggtggcaactttttcttacaaagaggcaagcttttaatttaataaggatcccagaatatccagtgttcactgttgaggaaaagtagttcatgaaatctaccaataggcttaataggcttgtttattttcaaactctccagtaagagggagccttgggaatagggaattctggtggagattgcagattgtcaactcctctcagggcca

SEQ ID NO: 448354 - DNA, 3869 bp, Homo sapiens
gaaatggaagtaacgagtaagtttggatgcttcgattctaccctagattgagacgggtgagcatagaggcaaaaaaagacattttcttccaaacaagaggtgaccaaacgggcaagggagacctcctcccgggcatgcagagcgcagcgattctgtgcccagggagccggagggctggggctgggagatcccggcggagccccggcagagcagtcgcccgtgagcccccgcaactcagacgcgctcggcctcgcgctccggggctgggaccaccgagggcgagctgcagccttcgccacccggtccgccgccggactccgcctcccacaaacagcccggcaaggcccttttccgccgctccctcatccagcgaagcctccttcccagcttccccggcggcggcgccgtgacgtcacttccgttctccagcgcgcacgtgggaggaagtgctggtgccctctgccgctgctcccgtctctttggttacgctcgtcagccggtcggccgccgcctccagccgtgtgccgctatgggagtcccggcgttcttccgctggctcagccgcaagtacccgtccatcatagtcaactgcgtggaagagaagccaaaagaatgcaatggtgtaaagattccagttgatgccagtaaacctaatccaaatgatgtggagtttgataatctgtatttggatatgaatggaatcatccatccctgtactcatcctgaagacaaaccagcaccaaaaaatgaagatgaaatgatggttgcaatttttgagtacattgacagacttttcagtattgtaagaccaagaagacttctctacatggcaatagatggagtggcaccacgtgctaaaatgaaccagcagcgttcaaggaggttcagggcatcaaaagaaggaatggaagcagcagtcgagaagcagcgagtcagggaagaaatattggcaaaaggtggctttcttcctccagaagaaataaaagaaagatttgacagcaactgtattacaccaggaactgaattcatggacaatcttgctaaatgccttcgctattacatagctgatcgtttaaataatgaccctgggtggaaaaatttgacagttattttatctgatgctagtgctcctggtgaaggagaacataaaatcatggattacattagaaggcaaagagcccagcctaaccatgacccaaatactcatcattgtttatgtggagcagatgctgatctcattatgcttggccttgccacacatgaaccgaactttaccattattagagaagaattcaaaccaaacaagcccaaaccatgtggtctttgtaatcagtttggacatgaggtcaaagattgtgaaggtttgccaagagaaaagaagggaaagcatgatgaacttgccgatagtcttccttgtgcagaaggagagtttatcttccttcggcttaatgttcttcgtgagtatttggaaagagaactcacaatggccagcctaccattcacatttgatgttgagaggagcattgatgactgggttttcatgtgcttctttgtgggaaatgacttcctccctcatttgccatcgttagagattagggaaaatgcaattgaccgtttggttaacatatacaaaaatgtggtacacaaaactgggggttaccttacagaaagtggttatgtcaatctgcaaagagtacagatgatcatgttagcagttggtgaagttgaggatagcatttttaaaaagagaaaggatgatgaggacagttttagaagacgacagaaagaaaaaagaaagagaatgaagagagatcaaccagctttcactcctagtggaatattaactcctcatgccttgggttcaagaaattcaccaggttctcaagtagccagtaatccgagacaagcagcctatgaaatgaggatgcagaataactctagtccttcgatatctcctaatacgagtttcacatctgatggctccccgtctccattaggaggaattaagcgaaaagcagaagacagtgacagtgaacctgagccagaggataatgtcaggttatgggaagctggctggaagcagcggtactacaagaacaaatttgatgtggatgcagctgatgagaaattccgtcggaaagttgtgcagtcgtacgttgaaggactttgctgggttcttagatattattaccagggctgtgcttcctggaagtggtattatccatttcattatgcaccatttgcttcagactttgaaggcattgcagacatgccatctgattttgagaagggtacgaaaccgtttaaaccactagaacaacttatgggggtatttccagctgcaagtggtaattttctacctccatcatggcggaagctcatgagtgatcctgattctagtataattgacttctatcctgaagattttgctattgatttgaatgggaagaaatatgcatggcaaggtgttgctctcttgccattcgtggatgagcgaaggctacgagctgccctagaagaggtatacccagacctcactccagaagagaccagaagaaacagccttggaggtgatgtcttatttgtggggaaacatcacccactccatgacttcattttagagctgtaccagacaggttccacagagccagtggaggtaccccctgaactatgtcatgggattcaaggaaagttttctttggatgaagaagccattcttccagatcaaatagtatgttctcctgttcctatgttaagggatctgacacagaacactgtagtcagtattaattttaaagacccacagtttgctgaagattacatttttaaagctgtaatgcttccaggagcaagaaagccagcagcagtactgaaacctagtgactgggaaaaatccagcaatggacggcagtggaagcctcagcttggctttaaccgtgaccggaggcctgtgcacctggatcaggcagccttcaggactttgggccatgtgatgccaagaggctcaggaactggcatttacagcaatgctgcaccaccacctgtgacttaccagggaaacttatacaggccgcttttgagaggacaagcccagattccaaaacttatgtcaaatatgaggccccaggattcctggcgaggtcctcctccccttttccagcagcaaaggtttgacagaggcgttggggctgaacctctgctcccatggaaccggatgctgcaaacccagaatgcagccttccagccaaaccagtaccagatgctagctgggcctggtgggtatccacccagacgagatgatcgtggagggagacagggatatcccagagaaggaaggaaataccctttgccaccaccctcaggaagatacaattggaattaagcttttgtaaagctttcccaaatcctttcatcattctacagttttatgctatttgtggaaagatttctttctcaagtagtagtttttaataaaactacagtactttgtgtatttcttttaactgtgtatatttctactgatctgatctcactgtttatgttgctttccaaagatgtatgttgcataatacagtggatctgaatttattattgcttataaaacacatttgatggaataggagtactggtttttcataatggttaaaaatgaaaccagctgtggatttcaaaacacagtgtattctagatcatctaagatccatgctgatttttattgcacaagaattaggtttgaactcttgagctggaacctcagcaaactagagtatatattgttcagtatttctttggaaacatttcattaatgtacttgtcttacagaaatttctgaactttagtaaaaaaaaataaagttaaacttttaaaac

SEQ ID NO: 448355 - DNA, 3895 bp, Homo sapiens
gaaatggaagtaacgagtaagtttggatgcttcgattctaccctagattgagacgggtgagcatagaggcaaaaaaagacattttcttccaaacaagaggtgaccaaacgggcaagggagacctcctcccgggcatgcagagcgcagcgattctgtgcccagggagccggagggctggggctgggagatcccggcggagccccggcagagcagtcgcccgtgagcccccgcaactcagacgcgctcggcctcgcgctccggggctgggaccaccgagggcgagctgcagccttcgccacccggtccgccgccggactccgcctcccacaaacagcccggcaaggcccttttccgccgctccctcatccagcgaagcctccttcccagcttccccggcggcggcgccgtgacgtcacttccgttctccagcgcgcacgtgggaggaagtgctggtgccctctgccgctgctcccgtctctttggttacgctcgtcagccggtcggccgccgcctccagccgtgtgccgctatgggagtcccggcgttcttccgctggctcagccgcaagtacccgtccatcatagtcaactgcgtggaagagaagccaaaagaatgcaatggtgtaaagattccagttgatgccagtaaacctaatccaaatgatgtggagtttgataatctgtatttggatatgaatggaatcatccatccctgtactcatcctgaagacaaaccagcaccaaaaaatgaagatgaaatgatggttgcaatttttgagtacattgacagacttttcagtattgtaagaccaagaagacttctctacatggcaatagatggagtggcaccacgtgctaaaatgaaccagcagcgttcaaggaggttcagggcatcaaaagaaggaatggaagcagcagtcgagaagcagcgagtcagggaagaaatattggcaaaaggtggctttcttcctccagaagaaataaaagaaagatttgacagcaactgtattacaccaggaactgaattcatggacaatcttgctaaatgccttcgctattacatagctgatcgtttaaataatgaccctgggtggaaaaatttgacagttattttatctgatgctagtgctcctggtgaaggagaacataaaatcatggattacattagaaggcaaagagcccagcctaaccatgacccaaatactcatcattgtttatgtggagcagatgctgatctcattatgcttggccttgccacacatgaaccgaactttaccattattagagaagaattcaaaccaaacaagcccaaaccatgtggtctttgtaatcagtttggacatgaggtcaaagattgtgaaggtttgccaagagaaaagaagggaaagcatgatgaacttgccgatagtcttccttgtgcagaaggagagtttatcttccttcggcttaatgttcttcgtgagtatttggaaagagaactcacaatggccagcctaccattcacatttgatgttgagaggagcattgatgactgggttttcatgtgcttctttgtgggaaatgacttcctccctcatttgccatcgttagagattagggaaaatgcaattgaccgtttggttaacatatacaaaaatgtggtacacaaaactgggggttaccttacagaaagtggttatgtcaatctgcaaagagtacagatgatcatgttagcagttggtgaagttgaggatagcatttttaaaaagagaaaggatgatgaggacagttttagaagacgacagaaagaaaaaagaaagagaatgaagagagatcaaccagctttcactcctagtggaatattaactcctcatgccttgggttcaagaaattcaccaggttctcaagtagccagtaatccgagacaagcagcctatgaaatgaggatgcagaataactctagtccttcgatatctcctaatacgagtttcacatctgatggctccccgtctccattaggaggaattaagcgaaaagcagaagacagtgacagtgaacctgagccagaggataatgtcaggttatgggaagctggctggaagcagcggtactacaagaacaaatttgatgtggatgcagctgatgagaaattccgtcggaaagttgtgcagtcgtacgttgaaggactttgctgggttcttagatattattaccagggctgtgcttcctggaagtggtattatccatttcattatgcaccatttgcttcagactttgaaggcattgcagacatgccatctgattttgagaagggtacgaaaccgtttaaaccactagaacaacttatgggggtatttccagctgcaagtggtaattttctacctccatcatggcggaagctcatgagtgatcctgattctagtataattgacttctatcctgaagattttgctattgatttgaatgggaagaaatatgcatggcaaggtgttgctctcttgccattcgtggatgagcgaaggctacgagctgccctagaagaggtatacccagacctcactccagaagagaccagaagaaacagccttggaggtgatgtcttatttgtggggaaacatcacccactccatgacttcattttagagctgtaccagacaggttccacagagccagtggaggtaccccctgaactatgtcatgggattcaaggaaagttttctttggatgaagaagccattcttccagatcaaatagtatgttctcctgttcctatgttaagggatctgacacagaacactgtagtcagtattaattttaaagacccacagtttgctgaagattacatttttaaagctgtaatgcttccaggagcaagaaagccagcagcagtactgaaacctagtgactgggaaaaatccagcaatggacggcagtggaagcctcagcttggctttaaccgtgaccggaggcctgtgcacctggatcaggcagccttcaggactttgggccatgtgatgccaagaggctcaggaactggcatttacagcaatgctgcaccaccacctgtgacttaccagggaaacttatacaggccgcttttgagaggacaagcccagattccaaaacttatgtcaaatatgaggccccaggattcctggcgaggtcctcctccccttttccagcagcaaaggtttgacagaggcgttggggctgaacctctgctcccatggaaccggatgctgcaaacccagaatgcagccttccagccaaaccagtaccagatgctagctgggcctggtgggtatccacccagacgagatgatcgtggagggagacagggatatcccagagaaggaaggaaataccctttgccaccaccctcaggaagatacaattggaattaagcttttgtaaagctttcccaaatcctttcatcattctacagttttatgctatttgtggaaagatttctttctcaagtagtagtttttaataaaactacagtactttgtgtatttcttttaactgtgtatatttctactgatctgatctcactgtttatgttgctttccaaagatgtatgttgcataatacagtggatctgaatttattattgcttataaaacacatttgatggaataggagtactggtttttcataatggttaaaaatgaaaccagctgtggatttcaaaacacagtgtattctagatcatctaagatccatgctgatttttattgcacaagaattaggtttgaactcttgagctggaacctcagcaaactagagtatatattgttcagtatttctttggaaacatttcattaatgtacttgtcttacagaaatttctgaactttagtaaaaaaaaataaagttaaacttttaaaacaaaaaaaaaaaaccagcgcggccgct

SEQ ID NO: 448356 - DNA, 3876 bp, Homo sapiens
gaaatggaagtaacgagtaagtttggatgcttcgattctaccctagattgagacgggtgagcatagaggcaaaaaaagacattttcttccaaacaagaggtgaccaaacgggcaagggagacctcctcccgggcatgcagagcgcagcgattctgtgcccagggagccggagggctggggctgggagatcccggcggagccccggcagagcagtcgcccgtgagcccccgcaactcagacgcgctcggcctcgcgctccggggctgggaccaccgagggcgagctgcagccttcgccacccggtccgccgccggactccgcctcccacaaacagcccggcaaggcccttttccgccgctccctcatccagcgaagcctccttcccagcttccccggcggcggcgccgtgacgtcacttccgttctccagcgcgcacgtgggaggaagtgctggtgccctctgccgctgctcccgtctctttggttacgctcgtcagccggtcggccgccgcctccagccgtgtgccgctatgggagtcccggcgttcttccgctggctcagccgcaagtacccgtccatcatagtcaactgcgtggaagagaagccaaaagaatgcaatggtgtaaagattccagttgatgccagtaaacctaatccaaatgatgtggagtttgataatctgtatttggatatgaatggaatcatccatccctgtactcatcctgaagacaaaccagcaccaaaaaatgaagatgaaatgatggttgcaatttttgagtacattgacagacttttcagtattgtaagaccaagaagacttctctacatggcaatagatggagtggcaccacgtgctaaaatgaaccagcagcgttcaaggaggttcagggcatcaaaagaaggaatggaagcagcagtcgagaagcagcgagtcagggaagaaatattggcaaaaggtggctttcttcctccagaagaaataaaagaaagatttgacagcaactgtattacaccaggaactgaattcatggacaatcttgctaaatgccttcgctattacatagctgatcgtttaaataatgaccctgggtggaaaaatttgacagttattttatctgatgctagtgctcctggtgaaggagaacataaaatcatggattacattagaaggcaaagagcccagcctaaccatgacccaaatactcatcattgtttatgtggagcagatgctgatctcattatgcttggccttgccacacatgaaccgaactttaccattattagagaagaattcaaaccaaacaagcccaaaccatgtggtctttgtaatcagtttggacatgaggtcaaagattgtgaaggtttgccaagagaaaagaagggaaagcacacagcagggacagcatgatgacacttgccgatagtcttcctttcggcttaatgttcttcgtgagatatttgggaaccgctatttggaaagagaactcacaatggccagcctaccattcacatttgatgttgagaggagcattgatgactgggttttcatgtgcttctttgtgggaaatgacttcctccctcatttgccatcgttagagattagggaaaatgcaattgaccgtttggttaacatatacaaaaatgtggtacacaaaactgggggttaccttacagaaagtggttatgtcaatctgcaaagagtacagatgatcatgttagcagttggtgaagttgaggatagcatttttaaaaagagaaaggatgatgaggacagttttagaagacgacagaaagaaaaaagaaagagaatgaagagagatcaaccagctttcactcctagtggaatattaactcctcatgccttgggttcaagaaattcaccaggttctcaagtagccagtaatccgagacaagcagcctatgaaatgaggatgcagaataactctagtccttcgatatctcctaatacgagtttcacatctgatggctccccgtctccattaggaggaattaagcgaaaagcagaagacagtgacagtgaacctgagccagaggataatgtcaggttatgggaagctggctggaagcagcggtactacaagaacaaatttgatgtggatgcagctgatgagaaattccgtcggaaagttgtgcagtcgtacgttgaaggactttgctgggttcttagatattattaccagggctgtgcttcctggaagtggtattatccatttcattatgcaccatttgcttcagactttgaaggcattgcagacatgccatctgattttgagaagggtacgaaaccgtttaaaccactagaacaacttatgggggtatttccagctgcaagtggtaattttctacctccatcatggcggaagctcatgagtgatcctgattctagtataattgacttctatcctgaagattttgctattgatttgaatgggaagaaatatgcatggcaaggtgttgctctcttgccattcgtggatgagcgaaggctacgagctgccctagaagaggtatacccagacctcactccagaagagaccagaagaaacagccttggaggtgatgtcttatttgtggggaaacatcacccactccatgacttcattttagagctgtaccagacaggttccacagagccagtggaggtaccccctgaactatgtcatgggattcaaggaaagttttctttggatgaagaagccattcttccagatcaaatagtatgttctcctgttcctatgttaagggatctgacacagaacactgtagtcagtattaattttaaagacccacagtttgctgaagattacatttttaaagctgtaatgcttccaggagcaagaaagccagcagcagtactgaaacctagtgactgggaaaaatccagcaatggacggcagtggaagcctcagcttggctttaaccgtgaccggaggcctgtgcacctggatcaggcagccttcaggactttgggccatgtgatgccaagaggctcaggaactggcatttacagcaatgctgcaccaccacctgtgacttaccagggaaacttatacaggccgcttttgagaggacaagcccagattccaaaacttatgtcaaatatgaggccccaggattcctggcgaggtcctcctccccttttccagcagcaaaggtttgacagaggcgttggggctgaacctctgctcccatggaaccggatgctgcaaacccagaatgcagccttccagccaaaccagtaccagatgctagctgggcctggtgggtatccacccagacgagatgatcgtggagggagacagggatatcccagagaaggaaggaaataccctttgccaccaccctcaggaagatacaattggaattaagcttttgtaaagctttcccaaatcctttcatcattctacagttttatgctatttgtggaaagatttctttctcaagtagtagtttttaataaaactacagtactttgtgtatttcttttaactgtgtatatttctactgatctgatctcactgtttatgttgctttccaaagatgtatgttgcataatacagtggatctgaatttattattgcttataaaacacatttgatggaataggagtactggtttttcataatggttaaaaatgaaaccagctgtggatttcaaaacacagtgtattctagatcatctaagatccatgctgatttttattgcacaagaattaggtttgaactcttgagctggaacctcagcaaactagagtatatattgttcagtatttctttggaaacatttcattaatgtacttgtcttacagaaatttctgaactttagtaaaaaaaaataaagttaaacttttaaaac

SEQ ID NO: 448357 - DNA, 3951 bp, Homo sapiens
gaaatggaagtaacgagtaagtttggatgcttcgattctaccctagattgagacgggtgagcatagaggcaaaaaaagacattttcttccaaacaagaggtgaccaaacgggcaagggagacctcctcccgggcatgcagagcgcagcgattctgtgcccagggagccggagggctggggctgggagatcccggcggagccccggcagagcagtcgcccgtgagcccccgcaactcagacgcgctcggcctcgcgctccggggctgggaccaccgagggcgagctgcagccttcgccacccggtccgccgccggactccgcctcccacaaacagcccggcaaggcccttttccgccgctccctcatccagcgaagcctccttcccagcttccccggcggcggcgccgtgacgtcacttccgttctccagcgcgcacgtgggaggaagtgctggtgccctctgccgctgctcccgtctctttggttacgctcgtcagccggtcggccgccgcctccagccgtgtgccgctatgggagtcccggcgttcttccgctggctcagccgcaagtacccgtccatcatagtcaactgcgtggaagagaagccaaaagaatgcaatggtgtaaagattccagttgatgccagtaaacctaatccaaatgatgtggagtttgataatctgtatttggatatgaatggaatcatccatccctgtactcatcctgaagacaaaccagcaccaaaaaatgaagatgaaatgatggttgcaatttttgagtacattgacagacttttcagtattgtaagaccaagaagacttctctacatggcaatagatggagtggcaccacgtgctaaaatgaaccagcagcgttcaaggaggttcagggcatcaaaagaaggaatggaagcagcagtcgagaagcagcgagtcagggaagaaatattggcaaaaggtggctttcttcctccagaagaaataaaagaaagatttgacagcaactgtattacaccaggaactgaattcatggacaatcttgctaaatgccttcgctattacatagctgatcgtttaaataatgaccctgggtggaaaaatttgacagttattttatctgatgctagtgctcctggtgaaggagaacataaaatcatggattacattagaaggcaaagagcccagcctaaccatgacccaaatactcatcattgtttatgtggagcagatgctgatctcattatgcttggccttgccacacatgaaccgaactttaccattattagagaagaattcaaaccaaacaagcccaaaccatgtggtctttgtaatcagtttggacatgaggtcaaagattgtgaaggtttgccaagagaaaagaagggaaagcatgatgaacttgccgatagtcttccttgtgcagaaggagagtttatcttccttcggcttaatgttcttcgtgagtatttggaaagagaactcacaatggccagcctaccattcacatttgatgttgagaggagcattgatgactgggttttcatgtgcttctttgtgggaaatgacttcctccctcatttgccatcgttagagattagggaaaatgcaattgaccgtttggttaacatatacaaaaatgtggtacacaaaactggggtaagttcattcttgaatgatttcaaaacagaagtatttgcttttataagaagatcattttacatatattttatcacttacaggttaccttacagaaagtggttatgtcaatctgcaaagagtacagatgatcatgttagcagttggtgaagttgaggatagcatttttaaaaagagaaaggatgatgaggacagttttagaagacgacagaaagaaaaaagaaagagaatgaagagagatcaaccagctttcactcctagtggaatattaactcctcatgccttgggttcaagaaattcaccaggttctcaagtagccagtaatccgagacaagcagcctatgaaatgaggatgcagaataactctagtccttcgatatctcctaatacgagtttcacatctgatggctccccgtctccattaggaggaattaagcgaaaagcagaagacagtgacagtgaacctgagccagaggataatgtcaggttatgggaagctggctggaagcagcggtactacaagaacaaatttgatgtggatgcagctgatgagaaattccgtcggaaagttgtgcagtcgtacgttgaaggactttgctgggttcttagatattattaccagggctgtgcttcctggaagtggtattatccatttcattatgcaccatttgcttcagactttgaaggcattgcagacatgccatctgattttgagaagggtacgaaaccgtttaaaccactagaacaacttatgggggtatttccagctgcaagtggtaattttctacctccatcatggcggaagctcatgagtgatcctgattctagtataattgacttctatcctgaagattttgctattgatttgaatgggaagaaatatgcatggcaaggtgttgctctcttgccattcgtggatgagcgaaggctacgagctgccctagaagaggtatacccagacctcactccagaagagaccagaagaaacagccttggaggtgatgtcttatttgtggggaaacatcacccactccatgacttcattttagagctgtaccagacaggttccacagagccagtggaggtaccccctgaactatgtcatgggattcaaggaaagttttctttggatgaagaagccattcttccagatcaaatagtatgttctcctgttcctatgttaagggatctgacacagaacactgtagtcagtattaattttaaagacccacagtttgctgaagattacatttttaaagctgtaatgcttccaggagcaagaaagccagcagcagtactgaaacctagtgactgggaaaaatccagcaatggacggcagtggaagcctcagcttggctttaaccgtgaccggaggcctgtgcacctggatcaggcagccttcaggactttgggccatgtgatgccaagaggctcaggaactggcatttacagcaatgctgcaccaccacctgtgacttaccagggaaacttatacaggccgcttttgagaggacaagcccagattccaaaacttatgtcaaatatgaggccccaggattcctggcgaggtcctcctccccttttccagcagcaaaggtttgacagaggcgttggggctgaacctctgctcccatggaaccggatgctgcaaacccagaatgcagccttccagccaaaccagtaccagatgctagctgggcctggtgggtatccacccagacgagatgatcgtggagggagacagggatatcccagagaaggaaggaaataccctttgccaccaccctcaggaagatacaattggaattaagcttttgtaaagctttcccaaatcctttcatcattctacagttttatgctatttgtggaaagatttctttctcaagtagtagtttttaataaaactacagtactttgtgtatttcttttaactgtgtatatttctactgatctgatctcactgtttatgttgctttccaaagatgtatgttgcataatacagtggatctgaatttattattgcttataaaacacatttgatggaataggagtactggtttttcataatggttaaaaatgaaaccagctgtggatttcaaaacacagtgtattctagatcatctaagatccatgctgatttttattgcacaagaattaggtttgaactcttgagctggaacctcagcaaactagagtatatattgttcagtatttctttggaaacatttcattaatgtacttgtcttacagaaatttctgaactttagtaaaaaaaaataaagttaaacttttaaaac

SEQ ID NO: 448358 - DNA, 3761 bp, Homo sapiens
gaaatggaagtaacgagtaagtttggatgcttcgattctaccctagattgagacgggtgagcatagaggcaaaaaaagacattttcttccaaacaagaggtgaccaaacgggcaagggagacctcctcccgggcatgcagagcgcagcgattctgtgcccagggagccggagggctggggctgggagatcccggcggagccccggcagagcagtcgcccgtgagcccccgcaactcagacgcgctcggcctcgcgctccggggctgggaccaccgagggcgagctgcagccttcgccacccggtccgccgccggactccgcctcccacaaacagcccggcaaggcccttttccgccgctccctcatccagcgaagcctccttcccagcttccccggcggcggcgccgtgacgtcacttccgttctccagcgcgcacgtgggaggaagtgctggtgccctctgccgctgctcccgtctctttggttacgctcgtcagccggtcggccgccgcctccagccgtgtgccgctatgggagtcccggcgttcttccgctggctcagccgcaagtacccgtccatcatagtcaactgcgtggaagagaagccaaaagaatgcaatggtgtaaagattccagttgatgccagtaaacctaatccaaatgatgtggagtttgataatctgtatttggatatgaatggaatcatccatccctgtactcatcctgaagacaaaccagcaccaaaaaatgaagatgaaatgatggttgcaatttttgagtacattgacagacttttcagtattgtaagaccaagaagacttctctacatggcaatagatggagtggcaccacgtgctaaaatgaaccagcagcgttcaaggaggttcagggcatcaaaagaaggaatggaagcagcagtcgagaagcagcgagtcagggaagaaatattggcaaaaggtggctttcttcctccagaagaaataaaagaaagatttgacagcaactgtattacaccaggaactgaattcatggacaatcttgctaaatgccttcgctattacatagctgatcgtttaaataatgaccctgggtggaaaaatttgacagttattttatctgatgctagtgctcctggtgaaggagaacataaaatcatggattacattagaaggcaaagagcccagcctaaccatgacccaaatactcatcattgtttatgtggagcagatgctgatctcattatgcttggccttgccacacatgaaccgaactttaccattattagagaagaattcaaaccaaacaagcccaaaccatgtggtctttgtaatcagtttggacatgaggtcaaagattgtgaaggtttgccaagagaaaagaagggaaagcatgatgaacttgccgatagtcttccttgtgcagaaggagagtttatcttccttcggcttaatgttcttcgtgagtatttggaaagagaactcacaatggccagcctaccattcacatttgatgttgagaggagcattgatgactgggttttcatgtgcttctttgtgggaaatgacttcctccctcatttgccatcgttagagattagggaaaatgcaattgaccgtttggttaacatatacaaaaatgtggtacacaaaactggggacagttttagaagacgacagaaagaaaaaagaaagagaatgaagagagatcaaccagctttcactcctagtggaatattaactcctcatgccttgggttcaagaaattcaccaggttctcaagtagccagtaatccgagacaagcagcctatgaaatgaggatgcagaataactctagtccttcgatatctcctaatacgagtttcacatctgatggctccccgtctccattaggaggaattaagcgaaaagcagaagacagtgacagtgaacctgagccagaggataatgtcaggttatgggaagctggctggaagcagcggtactacaagaacaaatttgatgtggatgcagctgatgagaaattccgtcggaaagttgtgcagtcgtacgttgaaggactttgctgggttcttagatattattaccagggctgtgcttcctggaagtggtattatccatttcattatgcaccatttgcttcagactttgaaggcattgcagacatgccatctgattttgagaagggtacgaaaccgtttaaaccactagaacaacttatgggggtatttccagctgcaagtggtaattttctacctccatcatggcggaagctcatgagtgatcctgattctagtataattgacttctatcctgaagattttgctattgatttgaatgggaagaaatatgcatggcaaggtgttgctctcttgccattcgtggatgagcgaaggctacgagctgccctagaagaggtatacccagacctcactccagaagagaccagaagaaacagccttggaggtgatgtcttatttgtggggaaacatcacccactccatgacttcattttagagctgtaccagacaggttccacagagccagtggaggtaccccctgaactatgtcatgggattcaaggaaagttttctttggatgaagaagccattcttccagatcaaatagtatgttctcctgttcctatgttaagggatctgacacagaacactgtagtcagtattaattttaaagacccacagtttgctgaagattacatttttaaagctgtaatgcttccaggagcaagaaagccagcagcagtactgaaacctagtgactgggaaaaatccagcaatggacggcagtggaagcctcagcttggctttaaccgtgaccggaggcctgtgcacctggatcaggcagccttcaggactttgggccatgtgatgccaagaggctcaggaactggcatttacagcaatgctgcaccaccacctgtgacttaccagggaaacttatacaggccgcttttgagaggacaagcccagattccaaaacttatgtcaaatatgaggccccaggattcctggcgaggtcctcctccccttttccagcagcaaaggtttgacagaggcgttggggctgaacctctgctcccatggaaccggatgctgcaaacccagaatgcagccttccagccaaaccagtaccagatgctagctgggcctggtgggtatccacccagacgagatgatcgtggagggagacagggatatcccagagaaggaaggaaataccctttgccaccaccctcaggaagatacaattggaattaagcttttgtaaagctttcccaaatcctttcatcattctacagttttatgctatttgtggaaagatttctttctcaagtagtagtttttaataaaactacagtactttgtgtatttcttttaactgtgtatatttctactgatctgatctcactgtttatgttgctttccaaagatgtatgttgcataatacagtggatctgaatttattattgcttataaaacacatttgatggaataggagtactggtttttcataatggttaaaaatgaaaccagctgtggatttcaaaacacagtgtattctagatcatctaagatccatgctgatttttattgcacaagaattaggtttgaactcttgagctggaacctcagcaaactagagtatatattgttcagtatttctttggaaacatttcattaatgtacttgtcttacagaaatttctgaactttagtaaaaaaaaataaagttaaacttttaaaac

SEQ ID NO: 448359 - DNA, 2524 bp, Homo sapiens
gaactccgacactagtgatgggcatgttagccagtcagcagaaccagtcaggcccatcgggtataacctaaaccaaggcaacatgcagagggagcattgatgactgggttttcatgtgcttctttgtgggaaatgacttcctccctcatttgccatcgttagagattagggaaaatgcaattgaccgtttggttaacatatacaaaaatgtggtacacaaaactggggtaagttcattcttgaatgatttcaaaacagaagtatttgcttttataagaagatcattttacatatattttatcacttacaggttaccttacagaaagtggttatgtcaatctgcaaagagtacagatgatcatgttagcagttggtgaagttgaggatagcatttttaaaaagagaaaggatgatgaggacagttttagaagacgacagaaagaaaaaagaaagagaatgaagagagatcaaccagctttcactcctagtggaatattaactcctcatgccttgggttcaagaaattcaccaggttctcaagtagccagtaatccgagacaagcagcctatgaaatgaggatgcagaataactctagtccttcgatatctcctaatacgagtttcacatctgatggctccccgtctccattaggaggaattaagcgaaaagcagaagacagtgacagtgaacctgagccagaggataatgtcaggttatgggaagctggctggaagcagcggtactacaagaacaaatttgatgtggatgcagctgatgagaaattccgtcggaaagttgtgcagtcgtacgttgaaggactttgctgggttcttagatattattaccagggctgtgcttcctggaagtggtattatccatttcattatgcaccatttgcttcagactttgaaggcattgcagacatgccatctgattttgagaagggtacgaaaccgtttaaaccactagaacaacttatgggggtatttccagctgcaagtggtaattttctacctccatcatggcggaagctcatgagtgatcctgattctagtataattgacttctatcctgaagattttgctattgatttgaatgggaagaaatatgcatggcaaggtgttgctctcttgccattcgtggatgagcgaaggctacgagctgccctagaagaggtatacccagacctcactccagaagagaccagaagaaacagccttggaggtgatgtcttatttgtggggaaacatcacccactccatgacttcattttagagctgtaccagacaggttccacagagccagtggaggtaccccctgaactatgtcatgggattcaaggaaagttttctttggatgaagaagccattcttccagatcaaatagtatgttctcctgttcctatgttaagggatctgacacagaacactgtagtcagtattaattttaaagacccacagtttgctgaagattacatttttaaagctgtaatgcttccaggagcaagaaagccagcagcagtactgaaacctagtgactgggaaaaatccagcaatggacggcagtggaagcctcagcttggctttaaccgtgaccggaggcctgtgcacctggatcaggcagccttcaggactttgggccatgtgatgccaagaggctcaggaactggcatttacagcaatgctgcaccaccacctgtgacttaccagggaaacttatacaggccgcttttgagaggacaagcccagattccaaaacttatgtcaaatatgaggccccaggattcctggcgaggtcctcctccccttttccagcagcaaaggtttgacagaggcgttggggctgaacctctgctcccatggaaccggatgctgcaaacccagaatgcagccttccagccaaaccagtaccagatgctagctgggcctggtgggtatccacccagacgagatgatcgtggagggagacagggatatcccagagaaggaaggaaataccctttgccaccaccctcaggaagatacaattggaattaagcttttgtaaagctttcccaaatcctttcatcattctacagttttatgctatttgtggaaagatttctttctcaagtagtagtttttaataaaactacagtactttgtgtatttcttttaactgtgtatatttctactgatctgatctcactgtttatgttgctttccaaagatgtatgttgcataatacagtggatctgaatttattattgcttataaaacacatttgatggaataggagtactggtttttcataatggttaaaaatgaaaccagctgtggatttcaaaacacagtgtattctagatcatctaagatccatgctgatttttattgcacaagaattaggtttgaactcttgagctggaacctcagcaaactagagtatatattgttcagtatttctttggaaacatttcattaatgtacttgtcttacagaaatttctgaactttagtaaaaaaaaataaagttaaacttttaaaac

SEQ ID NO: 448360 - DNA, 2559 bp, Homo sapiens
  misc_feature (2472)..(2473): n is a, c, g, or t
  misc_feature (2494)..(2494): n is a, c, g, or t
  misc_feature (2500)..(2500): n is a, c, g, or t
  misc_feature (2502)..(2502): n is a, c, g, or t
gaaatggaagtaacgagtaagtttggatgcttcgattctaccctagattgagacgggtgagcatagaggcaaaaaaagacattttcttccaaacaagaggtgaccaaacgggcaagggagacctcctcccgggcatgcagagcgcagcgattctgtgcccagggagccggagggctggggctgggagatcccggcggagccccggcagagcagtcgcccgtgagcccccgcaactcagacgcgctcggcctcgcgctccggggctgggaccaccgagggcgagctgcagccttcgccacccggtccgccgccggactccgcctcccacaaacagcccggcaaggcccttttccgccgctccctcatccagcgaagcctccttcccagcttccccggcggcggcgccgtgacgtcacttccgttctccagcgcgcacgtgggaggaagtgctggtgccctctgccgctgctcccgtctctttggttacgctcgtcagccggtcggccgccgcctccagccgtgtgccgctatgggagtcccggcgttcttccgctggctcagccgcaagtacccgtccatcatagtcaactgcgtggaagagaagccaaaagaatgcaatggtgtaaagattccagttgatgccagtaaacctaatccaaatgatgtggagtttgataatctgtatttggatatgaatggaatcatccatccctgtactcatcctgaagacaaaccagcaccaaaaaatgaagatgaaatgatggttgcaatttttgagtacattgacagacttttcagtattgtaagaccaagaagacttctctacatggcaatagatggagtggcaccacgtgctaaaatgaaccagcagcgttcaaggaggttcagggcatcaaaagaaggaatggaagcagcagtcgagaagcagcgagtcagggaagaaatattggcaaaaggtggctttcttcctccagaagaaataaaagaaagatttgacagcaactgtattacaccaggaactgaattcatggacaatcttgctaaatgccttcgctattacatagctgatcgtttaaataatgaccctgggtggaaaaatttgacagttattttatctgatgctagtgctcctggtgaaggagaacataaaatcatggattacattagaaggcaaagagcccagcctaaccatgacccaaatactcatcattgtttatgtggagcagatgctgatctcattatgcttggccttgccacacatgaaccgaactttaccattattagagaagaattcaaaccaaacaagcccaaaccatgtggtctttgtaatcagtttggacatgaggtcaaagattgtgaaggtttgccaagagaaaagaagggaaagcatgatgaacttgccgatagtcttccttgtgcagaaggagagtttatcttccttcggcttaatgttcttcgtgagtatttggaaagagaactcacaatggccagcctaccattcacatttgatgttgagaggagcattgatgactgggttttcatgtgcttctttgtgggaaatgacttcctccctcatttgccatcgttagagattagggaaaatgcaattgaccgtttggttaacatatacaaaaatgtggtacacaaaactgggggttaccttacagaaagtggttatgtcaatctgcaaagagtacagatgatcatgttagcagttggtgaagttgaggatagcatttttaaaaagagaaaggatgatgaggacagttttagaagacgacagaaagaaaaaagaaagagaatgaagagagatcaaccagctttcactcctagtggaatattaactcctcatgccttgggttcaagaaattcaccaggttctcaagtagccagtaatccgagacaagcagcctatgaaatgaggatgcagaataactctagtccttcgatatctcctaatacgagtttcacatctgatggctccccgtctccattaggaggaattaagcgaaaagcagaagacagtgacagtgaacctgagccagaggataatgtcaggttatgggaagctggctggaagcagcggtactacaagaacaaatttgatgtggatgcagctgatgagaaattccgtcggaaagttgtgcagtcgtacgttgaaggactttgctgggttcttagatattattaccagggctgtgcttcctggaagtggtattatccatttcattatgcaccatttgcttcagactttgaaggcattgcagacatgccatctgattttgagaagggtacgaaaccgtttaaaccactagaacaacttatgggggtatttccagctgcaagtggtaattttctacctccatcatggcggaagctcatgagtgatcctgattctagtataattgacttctatcctgaagattttgctattgatttgaatgggaagaaatatgcatggcaagggtgccnntgccatcggggatgacgaagntagagngnctaaaaggttaccggactcaatcagaaaaccaaaacgcctgggagactttggggaaa

SEQ ID NO: 448361 - DNA, 2692 bp, Homo sapiens
gaaatggaagtaacgagtaagtttggatgcttcgattctaccctagattgagacgggtgagcatagaggcaaaaaaagacattttcttccaaacaagaggtgaccaaacgggcaagggagacctcctcccgggcatgcagagcgcagcgattctgtgcccagggagccggagggctggggctgggagatcccggcggagccccggcagagcagtcgcccgtgagcccccgcaactcagacgcgctcggcctcgcgctccggggctgggaccaccgagggcgagctgcagccttcgccacccggtccgccgccggactccgcctcccacaaacagcccggcaaggcccttttccgccgctccctcatccagcgaagcctccttcccagcttccccggcggcggcgccgtgacgtcacttccgttctccagcgcgcacgtgggaggaagtgctggtgccctctgccgctgctcccgtctctttggttacgctcgtcagccggtcggccgccgcctccagccgtgtgccgctatgggagtcccggcgttcttccgctggctcagccgcaagtacccgtccatcatagtcaactgcgtggaagagaagccaaaagaatgcaatggtgtaaagattccagttgatgccagtaaacctaatccaaatgatgtggagtttgataatctgtatttggatatgaatggaatcatccatccctgtactcatcctgaagacaaaccagcaccaaaaaatgaagatgaaatgatggttgcaatttttgagtacattgacagacttttcagtattgtaagaccaagaagacttctctacatggcaatagatggagtggcaccacgtgctaaaatgaaccagcagcgttcaaggaggttcagggcatcaaaagaaggaatggaagcagcagtcgagaagcagcgagtcagggaagaaatattggcaaaaggtggctttcttcctccagaagaaataaaagaaagatttgacagcaactgtattacaccaggaactgaattcatggacaatcttgctaaatgccttcgctattacatagctgatcgtttaaataatgaccctgggtggaaaaatttgacagttattttatctgatgctagtgctcctggtgaaggagaacataaaatcatggattacattagaaggcaaagagcccagcctaaccatgacccaaatactcatcattgtttatgtggagcagatgctgatctcattatgcttggccttgccacacatgaaccgaactttaccattattagagaagaattcaaaccaaacaagcccaaaccatgtggtctttgtaatcagtttggacatgaggtcaaagattgtgaaggtttgccaagagaaaagaagggaaagcatgatgaacttgccgatagtcttccttgtgcagaaggagagtttatcttccttcggcttaatgttcttcgtgagtatttggaaagagaactcacaatggccagcctaccattcacatttgatgttgagaggagcattgatgactgggttttcatgtgcttctttgtgggaaatgacttcctccctcatttgccatcgttagagattagggaaaatgcaattgaccgtttggttaacatatacaaaaatgtggtacacaaaactgggggttaccttacagaaagtggttatgtcaatctgcaaagagtacagatgatcatgttagcagttggtgaagttgaggatagcatttttaaaaagagaaaggatgatgaggacagttttagaagacgacagaaagaaaaaagaaagagaatgaagagagatcaaccagctttcactcctagtggaatattaactcctcatgccttgggttcaagaaattcaccaggttctcaagtagccagtaatccgagacaagcagcctatgaaatgaggatgcagaataactctagtccttcgatatctcctaatacgagtttcacatctgatggctccccgtctccattaggaggaattaagcgaaaagcagaagacagtgacagtgaacctgagccagaggataatgtcaggtgaagccattttttggtagcactttgttagcaaattgctgaaatagatgcagtctaattaatgctatttagcttagagcagcagtgccttcagatgcttgcctgtgatctttttatccatcagtaattaatgtggagggttagaatagtcagtaaattccagtgagatgtgtaagctgtagctgttaaacctaagtgtctagattagtatgcgtgcaggctttcgtcctccaatccacttttccctctgagaccaggcacaagatcggctagatatcatatctaggtgtttagctctgactatgtgatctgaatgttgctgtttggagactgattaaattttcaagctgcttaacctagaaagttcagttatacttagacacttaatatagtttgccttaatcttctctattgaaagagttcttcctcaaaatgaaatatgcagaaatcattctgttaagagatcaatatgtatgttttttaaaaaccacagacttgcatatgcgcaattatatttcatgacagaggagtttccctttaactgtatacttcaaatttaaaataggaagctgattctttaattcatcctgaagtttgagatcattatataataagattaacaacctctcatgta

SEQ ID NO: 448362 - DNA, 2245 bp, Homo sapiens
gaaatggaagtaacgagtaagtttggatgcttcgattctaccctagattgagacgggtgagcatagaggcaaaaaaagacattttcttccaaacaagaggtgaccaaacgggcaagggagacctcctcccgggcatgcagagcgcagcgattctgtgcccagggagccggagggctggggctgggagatcccggcggagccccggcagagcagtcgcccgtgagcccccgcaactcagacgcgctcggcctcgcgctccggggctgggaccaccgagggcgagctgcagccttcgccacccggtccgccgccggactccgcctcccacaaacagcccggcaaggcccttttccgccgctccctcatccagcgaagcctccttcccagcttccccggcggcggcgccgtgacgtcacttccgttctccagcgcgcacgtgggaggaagtgctggtgccctctgccgctgctcccgtctctttggttacgctcgtcagccggtcggccgccgcctccagccgtgtgccgctatgggagtcccggcgttcttccgctggctcagccgcaagtacccgtccatcatagtcaactgcgtggaagagaagccaaaagaatgcaatggtgtaaagattccagttgatgccagtaaacctaatccaaatgatgtggagtttgataatctgtatttggatatgaatggaatcatccatccctgtactcatcctgaagacaaaccagcaccaaaaaatgaagatgaaatgatggttgcaatttttgagtacattgacagacttttcagtattgtaagaccaagaagacttctctacatggcaatagatggagtggcaccacgtgctaaaatgaaccagcagcgttcaaggaggttcagggcatcaaaagaaggaatggaagcagcagtcgagaagcagcgagtcagggaagaaatattggcaaaaggtggctttcttcctccagaagaaataaaagaaagatttgacagcaactgtattacaccaggaactgaattcatggacaatcttgctaaatgccttcgctattacatagctgatcgtttaaataatgaccctgggtggaaaaatttgacagttattttatctgatgctagtgctcctggtgaaggagaacataaaatcatggattacattagaaggcaaagagcccagcctaaccatgacccaaatactcatcattgtttatgtggagcagatgctgatctcattatgcttggccttgccacacatgaaccgaactttaccattattagagaagaattcaaaccaaacaagcccaaaccatgtggtctttgtaatcagtttggacatgaggtcaaagattgtgaaggtttgccaagagaaaagaagggaaagcatgatgaacttgccgatagtcttccttgtgcagaaggagagtttatcttccttcggcttaatgttcttcgtgagtatttggaaagagaactcacaatggccagcctaccattcacatttgatgttgagaggagcattgatgactgggttttcatgtgcttctttgtgggaaatgacttcctccctcatttgccatcgttagagattagggaaaatgcaattgaccgtttggttaacatatacaaaaatgtggtacacaaaactgggggttaccttacagaaagtggttatgtcaatctgcaaagagtacagatgatcatgttagcagttggtgaagttgaggatagcatttttaaaaagagaaaggatgatgaggacagttttagaagacgacagaaagaaaaaagaaagagaatgaaggtgagttttaattaatttcatgagattggcaatagcgtaattttacaatttatgaggaagatgttcattacagtagctttattccttgtccagtaggacttagtcagggacgtaagtgtccacccagttacctttttacctgtagaaagaacactggtgtcgatttaaagaaggtcctctaggctctgatgtctgaagggatacacttgggaggtgagaggtgggtggcagttagctatttgaatggtttacagcaatcaagtattgttttttaagtaaaaatggtcaatattttgtatccccttgaaagttactgtactcttatttctacctctttgtcagattaatctttctagaacacaacactctaaacttgtttctctgctctaaaagcaccactgactccttaatcccctcagaatccaattctgtcttagt

SEQ ID NO: 448363 - DNA, 1300 bp, Homo sapiens
gaaatggaagtaacgagtaagtttggatgcttcgattctaccctagattgagacgggtgagcatagaggcaaaaaaagacattttcttccaaacaagaggtgaccaaacgggcaagggagacctcctcccgggcatgcagagcgcagcgattctgtgcccagggagccggagggctggggctgggagatcccggcggagccccggcagagcagtcgcccgtgagcccccgcaactcagacgcgctcggcctcgcgctccggggctgggaccaccgagggcgagctgcagccttcgccacccggtccgccgccggactccgcctcccacaaacagcccggcaaggcccttttccgccgctccctcatccagcgaagcctccttcccagcttccccggcggcggcgccgtgacgtcacttccgttctccagcgcgcacgtgggaggaagtgctggtgccctctgccgctgctcccgtctctttggttacgctcgtcagccggtcggccgccgcctccagccgtgtgccgctatgggagtcccggcgttcttccgctggctcagccgcaagtacccgtccatcatagtcaactgcgtggaagagaagccaaaagaatgcaatggtgtaaagattccagttgatgccagtaaacctaatccaaatgatgtggagtttgataatctgtatttggatatgaatggaatcatccatccctgtactcatcctgaagacaaaccagcaccaaaaaatgaagatgaaatgatggttgcaatttttgagtacattgacagacttttcagtattgtaagaccaagaagacttctctacatggcaatagatggagtggcaccacgtgctaaaatgaaccagcagcgttcaaggaggttcagggcatcaaaagaaggaatggaagcagcagtcgagaagcagcgagtcagggaagaaatattggcaaaaggtggctttcttcctccagaagaaataaaagaaagatttgacagcaactgtattacaccaggaactgaattcatggacaatcttgctaaatgccttcgctattacatagctgatcgtttaaataatgaccctgggtggaaaaatttgacagttattttatctgatgctagtgctcctggtgaaggagaacataaaatcatggattacattagaaggcaaagagcccaggagacagggcattgtgacatcgtgcggtggtacccccaccagtctctctgctcccatggagccgtgcaggtcccatcagcagtgccactgagctggcccccagtgttgatgccctgg

SEQ ID NO: 448364 - DNA, 422 bp, Homo sapiens
tttcctcctaatacagtgactggcagtgaaagagttcagatcactgcaattggagatgttcttggtccttccatcaatggcttagcctcattgattcggatgccttatggctgtggtgaacagaacatgataaattttgctccaaatatttacattttggattatctgactaaaaagaaacaactgacagataatttgaaagaaaaagctctttcatttatgaggcaaggttaccagagagaacttctctatcagagggaagatggctctttcagtgcttttgggaattatgacccttctgggagcacttgcagggggctctgcagctgccaacgtgtccacgtctccaaaaggaggctccaggtttgccacagcccggaaagaggaggctggagtctatagcactggcaattagagacttc

SEQ ID NO: 448365 - DNA, 821 bp, Homo sapiens
tttcctcctaatacagtgactggcagtgaaagagttcagatcactgcaattggagatgttcttggtccttccatcaatggcttagcctcattgattcggatgccttatggctgtggtgaacagaacatgataaattttgctccaaatatttacattttggattatctgactaaaaagaaacaactgacagataatttgaaagaaaaagctctttcatttatgaggcaaggttaccagagagaacttctctatcagagggaagatggctctttcagtgcttttgggaattatgacccttctgggagcacttggttgtcagcttttgttttaagatgtttccttgaagccgatccttacatagatattgatcagaatgtgttacacagaacatacacttggcttaaaggacatcagaaatccaacggtgaattttgggatccaggaagagtgattcatagtgagcttcaaggtggcaataaaagtccagtaacacttacagcctatattgtaacttctctcctgggatatagaaagtatcagcctaacattgatgtgcaagagtctatccattttttggagtctgaattcagtagaggaatttcagacaattatactctagcccttataacttatgcattgtcatcagtggggagtcctaaagcgaaggaagctttgaatatgctgacttggagagcagaacaagaaggtggcatgcaattctgggtgtcatcagagtccaaactttctgactcctggcagccacgctccctggatattgaagttgcagcctatgcactgctctcacacttcttacaatttca

SEQ ID NO: 448366 - DNA, 1152 bp, Homo sapiens
gacaagcacctgtaccctaatcttcctaagccccaaaattgacattgcccctggaaaccaaaccttaccagtccctgtcagagcccaagtccatcagcatagggctgtgcagataatacccttgcttataggactaggagttaccaatgccacaggaactggaatagcaggtttgtccccttccctgtcctactatcatacactcttaaaggatctctcagacagcctacaagacatagcaaaatccacccttactctccaatcccaaatagactccttagcagcagtaactctgcagaaccaccgtggcttagacctcctaaccgtcgaaaaaggtgggctatgcacctttttaggggaagattgtttttccaccaaccagtctggactagtacgagatgctgcctcgcagttaaatgaaaaggcttctaaaatcagacaatgtctttcagacttttaacaccaatctttggagctgggcgttgtggcttctccctatagctgggcccctcatttccatcattctccttctcctatttggaccctgcctcttccgtctagcctctcagttcctacaaaatctcattcaagctattaccaatcaatctatgcgacaaatgctactcctaactgcccctcaatgtcaccccaccccaagatctctctcccaattaggagtccatgccgccccaagtcccgctcgaagaatccctgagaaacatcaccccgtccacttcttttcttattaaaacaaaaagacaggaatgtcatatcccacaaatatggctgcattattgccagcaggccattattgacggtgggccattaagaactctgtgaccggcacatatgcctccagacttcctggaaccagaaaacctgcaacaaccaaaaaccacaaaagaagaacaacgggtttctgttccaactggttgatcaacttcttgagtcaacaagtcccaaaaccatgttgtaattttccacccgccactttgccctgtaaagactgctctccctcacacctccgggctgactcccttttccgattcagcccactaacacccaagtgaataaacggccttgttgctcacacaaagtctgcttgggtcttcaatccagaccacgctgtaacacacacttacaaaattctgc

SEQ ID NO: 448367 - DNA, 5677 bp, Homo sapiens
  misc_feature (1663)..(1663): n is a, c, g, or t
  misc_feature (2211)..(2211): n is a, c, g, or t
  misc_feature (4655)..(4655): n is a, c, g, or t
  misc_feature (5274)..(5274): n is a, c, g, or t
  misc_feature (5310)..(5310): n is a, c, g, or t
  misc_feature (5352)..(5352): n is a, c, g, or t
  misc_feature (5482)..(5482): n is a, c, g, or t
  misc_feature (5527)..(5527): n is a, c, g, or t
  misc_feature (5645)..(5645): n is a, c, g, or t
ggacttgcgactgtgtcaggatccaggcaatgagcaaggagattggcctgcagatgcacgaggagctcctgaaggtgaccaatgagctctacacagtcatgaaaacctaccacatgtaccatgcagagagcatcagtgcggaaagcaagctgaaggaggctgagaagcaggaggagaagcagttcaataagtcaggagacctcagcatgaacctgctccggcacgaggaccggccccagcgccgcagctctgtgaagaagattgagaagatgaaggagaagaggcaggccaagtactctgagaacaagctgaaatgcacaaaggcccggaatgactacttgctcaatctggcagccaccaacgcagctataagcaaatactacatccatgatgtctctgatctgatcgattgctgtgatttgggcttccatgccagcctggcccgcaccttccggacctatctctcagctgaatacaacctggagacctctcgccacgaagggctggatgtcattgagaatgcagtggacaacctggattcccgaagtgacaagcacacagtcatggacatgtgcaatcaagtcttctgccctccactcaagttcgagttccagccccacatgggggatgaggtctgccaggtcagcgctcagcagcccgtccagacagaactgctcatgcgttatcaccagctgcagtccagactggccaccctcaagatagagaatgaggaggttaggaaaaccctggatgccaccatgcagacattacaggacatgctgactgtggaggactttgatgtctccgatgccttccaacacagtcgatcgacagagtccgtcaagtcggctgcctctgagacctacatgagcaagatcaacattgccaagaggagagccaaccagcaggaaacagaaatgttttattttacaaaatttaaagagtatgtgaatggcagtaacctcatcaccaagctgcaggccaagcacgatttactcaagcagaccctgggcgaaggggaaagagcagaatgcggcaccaccaggtgagagtgggagagttgtgttttctttcatctgctgcccgaggtgggagtgggatggggctggggaggcactgccaggagctggagaagcagggatggcttcttcaccaatgtccccaagggccggtgtgggtgtgcccaggtgaggcacagttgctgctttgcttgttctagcattagactgacaaagccacgcccctccaggctggcgatggaaggggcgcttttggggctgctgtgtggcagtggggcaccctccctttgcgctggccatcgggtgagacagtattgtctactcagagtggctgagggcagcctgtaggggccagaggctgtggggtggctgttgacctctcttcccacctgctacaccatgctgagcaaactgcccagccatgctgcgaggcccagcctgaggtccccatgtaccaaggctttgggccaggctcagattgcgcgcagctgggcacacgcatgtgcataggcgtgcacagactctcctgccgtccacaccctagcttggacctcacgggcacttggatgagctgacggaaagtaacacacgggcaacttctgctttctcttcagcttgttcaacattcccttttgcgctttttnctgagcagaccagagccagtgaacactttccactcagcagctgatagcccaggggctgactttacttccctttcagagagcttagatccataagtggctctgtcactggccaggttgtttgcttagagcctatttcatttctatgttcctattaagagatattgcactgcctagctggaattcagccagtggcccagaggcctgcacttttccatcacacggcagtagagcgctactttttgcctcactttctgggcccagggacctgagggcattctttcttttcccacaaatgctttccagtggccccaaatcctgggaagccctcatgtttggcaagagcaaagatgaactcccaactctctcctgctccttgggaagggagttgggcaaagtcttggcaacctctggggttttcagtttcctgggctcaggatggggagacggagggcttggcagaagttcagcccgtacagctgttcctctgggctctggcaatttggaaacatcaggatgattcacaccaggcaaggcccttccagcacacngggcggcagatgtgcagggtcactttcgaagaaccttttagaaacgaacccattataatttttttttcttttctggcgagagaatgttgtcatagtctcaaaacaacagaagctgtattttacaccaaattctgcaaatagtgaaacagatgggggatgaattgagctgtccctcacttcctcctaattcctagaactcacgcagagaagtttgttccagcagagtgtgggagaggagatctgtaatcaaacacttggccaggtctcagggtcttccctcaggggaaagttgagggtttgtgtgttttgttttgttttgttttgttttgttttgtgttttaaataaagccctctgaagtgttgtcttccacaccctccttgacctagggcctgggaaatccaagctgagtttatcagacctcccacttagacaccctgcattcaactgcagctaccctgcgttcaattgcagacatagccctgtgtactctggttcctggtcaaggtcaaagacaactttgttagtaaactaaaagtctccccttacctccaaaatcatgatttaacttgtggaaattgttgctaacaatgtctctgtcctatggctctctctgtatcttccatggactcccacacgaggtggatatcatttctggatggttatttgagcaggatcccctcagctaagttgctgttgaccttgtatagaggaactggtgttgcatatgggctgcagcatgttatatttttctcacacttcagaaccttatcttagaatagaccaaattcataataaccctgtaattcaggatggccagatgtgataatgcacttaagtttaaaagcgtattgcaaatgtcaaagcaagatgcaaatataaggtttgattattgtgattcaaatgaatgtctggctccccttacccaggttgacatgccctcgtggtctggattagaggtgaaatcacttgagatcttgttcaggcagatgcaacacagtacacagcccatgaatagcctccaagggcccgactggcattgccctacagcattgccaccatttgggatgttgacctccaagtctattaggttatctaggggaatttttcatcacatccctttagttgcaggataattttgaggctatttcctgtgttgccaacgtgtgttaattttcatcttgattaaaaggcagaaaggggacattggtctctggtttctctttcttcctctctgtggctttctctgttcctgttttccctgcctctctttctttctttctttcctttttgctctgcatctgagcagcagaagagatggaaggcttaggctgccccactttccttggccgagctgcccccctgctccccactttgtgccccacccagcacttcagtaagtcgatatagatttgatattgtgcaaagttgggatagctacgtttccttgtcagagattccagacagtgcacagagcaccacacaaagaaagaaatcctcgtgtgattcacacagtcctttgctttctggattgggcaggaaaaatgggaaaacatatgctatttccccttttttccactttgtagaatttaagaaaaaacaaaaaacacttaggactttcttttaaggaaaccctccagttgggcaccgtaggttttttgatattgagtgtccaacacctgcttttagagtctccgctcttcctggccatgagaatttaacagataatttaatgttacttctggatgttctatgataaaatcactttcatactcacactagatccttgagagtaggaagagctgaattttaccaccagcctcaatcacattttatttgtgtgaccttaggcaagtttcttcatcttttgtgggctcactggccttgtatgtaaagtgaattgaatattctttcccagcctcacagggttgttgtgaggttgtcatgcaatgtgataaggaaatgatctgggaatgttcaaaaacaagccaaacactatgaaaacagggtgacaatgttgctatcatcaagttatttctaatccccaaacttaaaacctttggccttgtgtcacatttttgacactctcttttgcctttggtatttgaaaatttaagagcagctcttgtaagaaatcccaccccacatacatacatcctcaaaaaaaaataagtaatttttgaaaaataaatgacatggacttagctaaccaaattgacatagatccaagatgggcttgaaagaatcttgcctgttgtttcttttcaaaattttgatctgtgctgttattttgtttccattgtttgggtggcatgatatttggattcacctggtttttgcccatgcatgtactggagctagcagcatttgctcaatactcaaacacctaggagaagttggttagaggtccctggggatggctggcttaccgaaggagacaggtacnacaagcccagtcagcagaggcagcatgaatctcattaatcctgattggctgcatagtctggaagatttcttgcccgctcacagaaatcaatcaagacttgggggaccaggtctttgcttgtcatgtgtggacattatctgtgcctggctgagtccccacttgttgctacccaaattttgaaccaagccatttgaaaatgaactgcctctcttggttaggggccctcttcttaaccttcaaaaggcctttgccccagaaggctggcaccattgagtcaggccaacttgtgtggtgaaatgagcaaataagccaacacaggtatatgcatggtgagcaattctggaaacgggtccagtgtttgtggctgtttctctggtgaactgtggtgtggttacccctccctgtggccaagagtggagcacactttaggaatggaaatcctaaagtaaagcaagacactttcaacctgatcccatggcaaaggttactggggtagatgagtccttggctggaaataaaaaagtgccctaaggctccatgatggtggcctggtaggaaaagccctgaacttggagccaaagagtcctgggtttgggctccagctctgtcagttctcctncacaggaggcttcagtctctgcctctgtaaaatggngccacatgcacagggttgagatggtattaagtataataatgnatttgaaagtgctttaattgaaaatgtacttgaggctgggtaaggaggctcatgcctgtaatctcagcactttgggaggccaaggcgggcagatcacgacgtcaggagttcaagaccagcctggccaacntggtgaaaccctgtctctactaaagatacaaaaaattagctgggngtcgtggtacatgcctgtaatcccagctactcgggaggctgaggcaggagaatcgcttgaacctgggaggcagaggttgcggtcagctgagatcatgccattgcaccccagcctgggngacagggcaagactccgtctcaaagaaaaagg

SEQ ID NO: 448368 - DNA, 4277 bp, Homo sapiens
  misc_feature (1)..(2): n is a, c, g, or t
  misc_feature (435)..(435): n is a, c, g, or t
  misc_feature (447)..(447): n is a, c, g, or t
  misc_feature (503)..(503): n is a, c, g, or t
  misc_feature (1150)..(1150): n is a, c, g, or t
  misc_feature (1330)..(1330): n is a, c, g, or t
  misc_feature (2785)..(2785): n is a, c, g, or t
  misc_feature (3024)..(3024): n is a, c, g, or t
  misc_feature (3318)..(3318): n is a, c, g, or t
  misc_feature (3832)..(3832): n is a, c, g, or t
  misc_feature (4018)..(4018): n is a, c, g, or t
  misc_feature (4044)..(4044): n is a, c, g, or t
  misc_feature (4063)..(4063): n is a, c, g, or t
  misc_feature (4189)..(4189): n is a, c, g, or t
  misc_feature (4196)..(4197): n is a, c, g, or t
  misc_feature (4219)..(4219): n is a, c, g, or t
nnctgcccatttatttcctgcataacactacataacataacttgcaactgtcttatttaatggcctatttacttcggttttttttcttgtccctctccctacaatgtaagcaacatgaagccaggaaccttgtccgccttatctatcattgcatccctcctaccagcacactgcctggcatattagaactcactcaatggctctataaaaaaaaactggctgattatgtgaattaacccttgcctcaagaagcttataatctagtgagggggtagtagctggtgaaattataccagcacattaacaattaaatctgatggactggattactcagccactatgcccatcatggttgccagtctactctcagtgcctgcatcagtcggggcttttgcatgcagaaagacagggcagcccttgttagcttcatcttanctcctgggatangtcacctcagctataagacaagagagtcaggccagatgaaataactcatggtactncaaagggttctttttgttctggcctgtggtccttctgattataaatgctggggttttaccactgccctctggatcttacagaacacgtaagcattgacagacttcaccaagaagacagctcagcaaattccagggctaggagggcactgggggagatatttgggaagcttcgcaaggaggaggctgggagtagttttctgattaggaaggtccccggagtggtcacatggaaaagataggatggtataggcctgcatctgagctgcgggagggcccagaggccaactggactggcatgagaggctgaaggtgctgtgagggtagataaccccccgcagtgagtcccattcccgtgtttccttcagtgacagcccacacagcgagccaggggccatcgatgaagttgaccatgacaatggcactgagcctcataccagcgatgaaggtgagtgagggggatcctggggacaagggattcttcctggggcctctcacactgacttttgtcagcccaaccacagggctggcccacatagacctcttcagctttccaagtcagccatctgtccttcagaatagacgaagaccccgaaaaaccttcatggcatgccccaagtcctggcatgggcctgacacagagcagatcntcataggctcacgctgtgttcacgacaccccacacctagcccacttcattccttaatgtgtcctgcctggcccaggtacaaatcctaagagacatgagttccctaagtagaaagcaagctctgttcctccatccttcccctttgagggtctgctctgtgccaagcctgtgctgggacttnggcacagggatgaacaagacgtcggtccttgaggaactcccagtctgtcaccagatcttgacaggttggaagtagcttctcatggtgcaaagcgataatgccagattacaggtgtgtctggtgcattgggcaccctggagatgaaatcaaagggtgatgatcctgggaaatgtgtggtgagagagagagagagaaaggccagtcaagacctttctccagattcctccaccccttccagacaaggagaagagagtcggactagtctctagggaaactggactgtgtagacaagcaatctgaaccatatgccaacttatccgtcaggcagagtaggcatagtgccaagggcccatggtacttgtagaggtccactaaaatgttttaatttcttttaaaatcagaaaaaaaatgaacacaatatccagtctggattatatttgtctttatactaatgcagttgtaaaatataatttttaactttttttttgaatggaggaagggacccatgcaggcaaaagggcctaggacccttgaaagttagaatacggcccaggatgcaccaagcacctgggatagttttcctttttaaacatcatggcttagcagttctcttacttgtcctttgtgtttcttttgtgggaccaggacacgttggccaccacatttgtcaggagagcagggcaggcattcaggtgacagttctgggaactggtaaaagagacaagactgacagatgggttttcacattctagtaggactatttcagttgctaatgacagaacccccaactcaaatcaacttaagcttaagagagagtaagttcctatacctgaaaagtcccagggttgggatggcttcaggcacagctggatccaggagcaagggtgatttttgtcagcactttgtctctgtcttcttgttctgcttccctctgtgctggtttcattctcatgtaggatcttccggtgcagtggtctctggcaattccaggctttcaccatcatcttacccaaactctcagtggaaaagggcttcctttctataatggttccaagagaggtcctggggtggagtctcattggactgccttgagtcatgcacccagtcatgatccagtccccatggcctgagagggagctaatgggtcagacccgggtcacaggaacagaaaagcaaatccagatgtcacgttcagcttgatcagactcctgagaggctaaagtcatcctgaactgaggaatgtgtcctgcagaggctttgtttggagatgtgaaggccgccaccttctgcttattcctggtgatttgcttttctctttcctcctttttttcttctgccgaccacctccagttctcccctccctctatcccttttaacagccctcaccctgtcctctccatctgttgctctttttatttctggatctccttctgtccatctctttatctctccctntagcttgctctctctctctctctctctcctactcctgtcatttcctctcctttgtcttgaccgaagcacctgccttcctgggggctgaggtccctgtcagtccctttgctggtttttccacagctcctcgggctgatgggcagaaggcttctctggacaccaggactgaagatgaggagggacagagagaatagggcttgctgggtcagcgaagaagcagccatgggactcacccagtngggcttcctccccataagaaccaccccccagaaagtgctgcctcccacttctcagggtaaaggttcacagtggcccccagaatgcatgagtcagagctttgggtccccctccgagatgatccttcttctttttgttctttgtaaggctgctggtttctgggaatgacaaaggcaggaaaaatcattctgggaaggaagaagccacagtctgggagagccagtttcatgttccctgaaggctctcaaagtatcctgtgtgtattagtggggggtattgaatcaggggcactcttnggtggaaaatcaattgcattttctaaatgttacattcttgccatccctggccaaacagtggcagaatagtgagctgcagagacagtcaaggggtcactgtgctcagaaaaaagagacctggagttgaagcacagagggagtccttatggtcatgtaatctgaggcaagccacatcacctctggcctctatttccttatctataaaatgggaatgacagcaccaagcaaattatggcatgggttaaaatgaggtgacatatgtgaaggagcctagcacagtgcctgggacagggaggtggataagaaacatcaatggactctgtatcaaacagacatccttcctaatcctgatagaaaaactgagtcctggagaattttcttgacctaactggcattggcagttactggtcattggcaaccagaacctcctgatttgtttacctgtttcctcttagacatttcatttaggggatcatcaatatctgtcttctttgctcttgacagcacccggtangaatggaatccagcaggcctcaaaggtcaaatcaggcagagaaccatgagtccaggtctttgccatgcatgaatcagccaatgaatgccaaattgcaggaacaatttagttgtttgtgtatctgttgcctttcttgtctcaaagattctgtaccaactgggcgtggtggctcacacctgtaacccnaacactttgggaagttgaggtgggcngatcacttgagcccagganttcgagaccagcctgggcaacatggtgaaactccgtctctacaaaaaaaaccaaaatacaaaaattagccaggcatggtggcatatgcctgtggtcccagcaactcaggaggctgaagtgggaganttacttnngcccagggaggttgaggctgcngtgagccatgattgtgccactgtactccagcctgagtgacagaacaaggtcctgtctc

SEQ ID NO: 448369 - DNA, 369 bp, Homo sapiens
ttgtaagcgaagggtgatgggcgttcattattttatttttacaacttttctatagatttaaacattttcaaataagttgcagggagaactttaaacttgctgaagtggggggcctcatatgtgggggagacttttcccatctgcctttcctgtggttcaggctggaccaggtcatctcttcggccatctgcacgttctctgactccttcccaagctgaaatatcatctcgtctcttgtttccactcaggtgaattcataaaagggaatgcactgttcgggaacctggaaaacttaggtccagctggactcagaccttcacacggcatcagcagatatatgccccgtccggctctatgccagcttcactc

SEQ ID NO: 448370 - DNA, 4077 bp, Homo sapiens
  misc_feature (2196)..(2196): n is a, c, g, or t
tatgctcatagctgactctagaggataaaatgaggtcgagtgaagagacagtcattagtgagaacctaagccccatcgtagcacagtattacatgtggttgggaaaaataaaaatacagtggtgtggaatactccaaaacctagaaatgctgtaggaataaatctgtggtaactatagaggtttaacttatatcattttcaaactatttaattttttcttttcctggttctactaattatactgtgtcagatttggaactaaacaggcaaggaggctttgagtcacatcgttttcattttaaatcaggctgtgatgcactgtggctggtgccgtcttgcatgaaacgcatgagccgtgagcgcccagttcagactggggccagggaggggcagtccttggcactttctgtcctagaggacactgtcagttgagttaatacaagtgacatagcttcccttccctcccccttcacccactccctccagaacatttagtgtagatgaaaatgtggtgatagaaatgggtgcatgatcttcacgtgtgacagccaggcctttgcctcttggccaagtaaagcccttccgggtcgctctccttcgattccattttacctcctcttctgatcacttccagagatgagctgtttctggataatggcacacgggcaaatctgtgtgccctgtgggccgctgttacttaccctctcctgcgagacccaggggcttttccctactgttcccacgcttcctctctctcgaggccactgaagtttggagtcaaaaggcccagagtctgagtcccagccctgagcacttaggagccttctgacttagggtttgtcactccacctcattgagcctgactgttctgctccataaaatagggtaataaaggtcaaacatcagtgagcaagctgtgtacactggaaaacactgaatcaatacaatgcgtttgtgattatcattagtaaggtaagtcttagatcagagccctccagcccttctttttgaaacctcccaatggcatttcagaagtgagcagtggaattttcctgccatcctaataagagccctggattccatcattaacatttcagcccattggatgaagtggtgccctctcctctggtcccccgcgaaaaggtaaatacacccaaagggagggacctagttaagtcactggcacctagataagttaggagggtaaagccactacctcgtctgaaggactggacttgacaccccacagtggaagggagcatcaggagaggaacaaaaaaagggatctcagggagaggccagtgtcaaacttgacctcccttgtttggcctagaatgaacccttctctttagctcctggatatgaaaggccatctgcttggagcacagaaagatattgccattttacagcttaagagagtaaggccttgggctgtgctgtgacctgcccaagatttgacactggctaggagcagaggctgcgtcaggctcttaaagtcatgtgtttgcatgctggatgctatactgtccagccaggacacaagacttctgatttctaccctcaagatactcccagatcctaaatccagtagcctcccaggcaaaatatagcaatctgccacaactgccagatgaaaagcaacaatcagagtagaaaaatctgttgcctgatatacataacaccaatcagaccgtgtggatttttctctgaattgactgattttgtttttttcttactgaaaatggacctgcctttcactgaattttctgagggcagagtcttagctgttttctttaagcaccttttttttttttttccattgggaaatggctgatgagttcacatttagggatgtacacacacagatggcagacgtctccccactcatccagccccagatctgagccttgacgcaggccaagtggaaaaatactttcccgcccccctcccctgttcccacttcctcatctggcactatgcatgtctcactcaccctccacagcactcagtcccatcgacgttcactgaacattggctttctctttctgactcctgcctgttttagtccactatatattgctgtatttgcttaaatgctggaaagtaactgttaaaatgtgaaattgtaatttttaaaaaggctacaattaaattttagccaatgccactcaccaaatctttgcacctagtagatanatcaatgtaaaaacaaatacctaactgtacagtgagtgtgggggaaatgtagtaacctagttagtagtcttcaatataaccaattgtacaaggggaagtggtgtttacctacttgttcatcaccattactgaaagccgtactgatcagttagttgacaacgggcatttttttttctttgcttcatggaatgatttcttttcttaaccttcgacttatcctgaggtcaagccttttgtctttatgtgtaaccgacgttcagtctattctaggaatgaaccagcaagttgttcatttaaaactgaccaaagacaattaattcctggtctagtttcctgggccttgtggctcagctgccactaaagagctttttggataaaattgagaacaagctgtgcttcctaccccactctccccgtccccttttattcccttttcctcttaaagagctgctctgagctgtgggattctatgaaaaattcttgcctttccttgtttcagtgctaacgatttctcacctcgaagcgccttttgaaccccggacagagtgcacaatcggagggaattgcgagcttgggaattagactttggagtcttttctctgaagtcaccaggccaggggtcaggagagagatggattcccaagggatgaaaggtttctattcaatgaagaaatcggagtgggaagagacacagggaaattgagccatattttggctatcggctggaaccagcagttcagagatctgccttataaacatttaaaaccggtttgtggtacacaaagaggaaccagtgtggggaaggggcctttatgtggggctttcttctctgttggagtcccttggagtgccttgttgggtatatttctctgtcattcaggaggcacgaatgtggaggacttctcgtgacctggtcgtgatgtggcattcagtgcatgtccacagctaatggaaaaacacgaggactcgggtaatggttcttcctctcagtctttctattcctaacttttcacacatccagatggttccacactagtgcaaatgcctcactctcctgagaaacccagaaagaagagtggctggctcacaaccatggggttagcccctgctgggctgggagtcggggtggcggccaggaggaaaggcagaaaggggtgagccgaggtgttgcctagctgattttctgctgtgcagagctaatgctgacatttcatgtcaacttccccggttctctggggtctcctctcctctgagcagccacatagaacattccccacatatccaaagctgcccaggggagccgagagaagggactttgctgtcaggtccaagccctcctgacctccctgagattgatctgccagtgtcctgctgtccctctgggactggccacatggccatcgctgccccttgttgacacctcctttctgtgtgagttgtccccggccaataacaaagctgttccttgaaccagaacaaccagagtgcacttttccttccttagacggaagtagatcctggctagggtttctgcccaggcccttgttcccggcagtgtgactgtttacatggtttggcaataggtttgattctgattgcttcagagtggctggtctattttgtttcctttggtttccttcctccccaaattgtgacaggaaaaacagaccaaaaccaccctaggaaattgctggttgcctgtccccacgtgatgataaatgttgccctcttctggatatcgtttctctaccttacgaccaaacgcccgtcctatagagtgtctgattggatcctctgtcgcgtattctgatggtgcctgctggtttgacgtggagctatcctgtgaaataaaacagcttaacttttctcaaaaatgctcca

SEQ ID NO: 448371 - DNA, 4115 bp, Homo sapiens
  misc_feature (2234)..(2234): n is a, c, g, or t
aacttccctctggaggttgcacactgtactaggaaggccactgattctgttagacagagggagtcgggtttgtaagtgtgtagagacgggggatagtgagaacctaagccccatcgtagcacagtattacatgtggttgggaaaaataaaaatacagtggtgtggaatactccaaaacctagaaatgctgtaggaataaatctgtggtaactatagaggtttaacttatatcattttcaaactatttaattttttcttttcctggttctactaattatactgtgtcagatttggaactaaacaggcaaggaggctttgagtcacatcgttttcattttaaatcaggctgtgatgcactgtggctggtgccgtcttgcatgaaacgcatgagccgtgagcgcccagttcagactggggccagggaggggcagtccttggcactttctgtcctagaggacactgtcagttgagttaatacaagtgacatagcttcccttccctcccccttcacccactccctccagaacatttagtgtagatgaaaatgtggtgatagaaatgggtgcatgatcttcacgtgtgacagccaggcctttgcctcttggccaagtaaagcccttccgggtcgctctccttcgattccattttacctcctcttctgatcacttccagagatgagctgtttctggataatggcacacgggcaaatctgtgtgccctgtgggccgctgttacttaccctctcctgcgagacccaggggcttttccctactgttcccacgcttcctctctctcgaggccactgaagtttggagtcaaaaggcccagagtctgagtcccagccctgagcacttaggagccttctgacttagggtttgtcactccacctcattgagcctgactgttctgctccataaaatagggtaataaaggtcaaacatcagtgagcaagctgtgtacactggaaaacactgaatcaatacaatgcgtttgtgattatcattagtaaggtaagtcttagatcagagccctccagcccttctttttgaaacctcccaatggcatttcagaagtgagcagtggaattttcctgccatcctaataagagccctggattccatcattaacatttcagcccattggatgaagtggtgccctctcctctggtcccccgcgaaaaggtaaatacacccaaagggagggacctagttaagtcactggcacctagataagttaggagggtaaagccactacctcgtctgaaggactggacttgacaccccacagtggaagggagcatcaggagaggaacaaaaaaagggatctcagggagaggccagtgtcaaacttgacctcccttgtttggcctagaatgaacccttctctttagctcctggatatgaaaggccatctgcttggagcacagaaagatattgccattttacagcttaagagagtaaggccttgggctgtgctgtgacctgcccaagatttgacactggctaggagcagaggctgcgtcaggctcttaaagtcatgtgtttgcatgctggatgctatactgtccagccaggacacaagacttctgatttctaccctcaagatactcccagatcctaaatccagtagcctcccaggcaaaatatagcaatctgccacaactgccagatgaaaagcaacaatcagagtagaaaaatctgttgcctgatatacataacaccaatcagaccgtgtggatttttctctgaattgactgattttgtttttttcttactgaaaatggacctgcctttcactgaattttctgagggcagagtcttagctgttttctttaagcaccttttttttttttttccattgggaaatggctgatgagttcacatttagggatgtacacacacagatggcagacgtctccccactcatccagccccagatctgagccttgacgcaggccaagtggaaaaatactttcccgcccccctcccctgttcccacttcctcatctggcactatgcatgtctcactcaccctccacagcactcagtcccatcgacgttcactgaacattggctttctctttctgactcctgcctgttttagtccactatatattgctgtatttgcttaaatgctggaaagtaactgttaaaatgtgaaattgtaatttttaaaaaggctacaattaaattttagccaatgccactcaccaaatctttgcacctagtagatanatcaatgtaaaaacaaatacctaactgtacagtgagtgtgggggaaatgtagtaacctagttagtagtcttcaatataaccaattgtacaaggggaagtggtgtttacctacttgttcatcaccattactgaaagccgtactgatcagttagttgacaacgggcatttttttttctttgcttcatggaatgatttcttttcttaaccttcgacttatcctgaggtcaagccttttgtctttatgtgtaaccgacgttcagtctattctaggaatgaaccagcaagttgttcatttaaaactgaccaaagacaattaattcctggtctagtttcctgggccttgtggctcagctgccactaaagagctttttggataaaattgagaacaagctgtgcttcctaccccactctccccgtccccttttattcccttttcctcttaaagagctgctctgagctgtgggattctatgaaaaattcttgcctttccttgtttcagtgctaacgatttctcacctcgaagcgccttttgaaccccggacagagtgcacaatcggagggaattgcgagcttgggaattagactttggagtcttttctctgaagtcaccaggccaggggtcaggagagagatggattcccaagggatgaaaggtttctattcaatgaagaaatcggagtgggaagagacacagggaaattgagccatattttggctatcggctggaaccagcagttcagagatctgccttataaacatttaaaaccggtttgtggtacacaaagaggaaccagtgtggggaaggggcctttatgtggggctttcttctctgttggagtcccttggagtgccttgttgggtatatttctctgtcattcaggaggcacgaatgtggaggacttctcgtgacctggtcgtgatgtggcattcagtgcatgtccacagctaatggaaaaacacgaggactcgggtaatggttcttcctctcagtctttctattcctaacttttcacacatccagatggttccacactagtgcaaatgcctcactctcctgagaaacccagaaagaagagtggctggctcacaaccatggggttagcccctgctgggctgggagtcggggtggcggccaggaggaaaggcagaaaggggtgagccgaggtgttgcctagctgattttctgctgtgcagagctaatgctgacatttcatgtcaacttccccggttctctggggtctcctctcctctgagcagccacatagaacattccccacatatccaaagctgcccaggggagccgagagaagggactttgctgtcaggtccaagccctcctgacctccctgagattgatctgccagtgtcctgctgtccctctgggactggccacatggccatcgctgccccttgttgacacctcctttctgtgtgagttgtccccggccaataacaaagctgttccttgaaccagaacaaccagagtgcacttttccttccttagacggaagtagatcctggctagggtttctgcccaggcccttgttcccggcagtgtgactgtttacatggtttggcaataggtttgattctgattgcttcagagtggctggtctattttgtttcctttggtttccttcctccccaaattgtgacaggaaaaacagaccaaaaccaccctaggaaattgctggttgcctgtccccacgtgatgataaatgttgccctcttctggatatcgtttctctaccttacgaccaaacgcccgtcctatagagtgtctgattggatcctctgtcgcgtattctgatggtgcctgctggtttgacgtggagctatcctgtgaaataaaacagcttaacttttctcaaaaatgctcca

SEQ ID NO: 448372 - DNA, 410 bp, Homo sapiens
cagcctgagccagaaggctgacagcgaggccagcagtgggccattgctggatgacaaggcctcttccaaaaacgacctccagtcccccacggagcacatctcggattacggctttgggggggtgatgggccggtaggatatgcggattcattttttccctgctggtgtcaatcctgttcatgtctgatttgggagaagcacaagggcagagaggagagaaggagcctactgcagccccttgttccccacaaaatgaaatgggcacactgggcgggctggctggcattggcccaagaaggccaggtatagaaccatccagcctgtgttgcagggaggaggaggaggaaagacatgtgttgggaacccagtgcttttttatttaaaataataataatgtgtgagagagatac

SEQ ID NO: 448373 - DNA, 547 bp, Homo sapiens
actaatttgtgttttccacattaatacagtgagaaggattatttttgttctgcctatatcctagggacttcatatggaagaagtaaagtgacagctgggaaagggactttaggtgtcaacggcagtatgagaatacaggatttttgtcaatctgctgtgtttccccaggttaggaaaaccctggatgccaccatgcagacattacaggacatgctgactgtggaggactttgatgtctccgatgccttccaacacagtcgatcgacagagtccgtcaagtcggctgcctctgagacctacatgagcaagatcaacattgccaagaggagagccaaccagcaggaaacagaaatgttttattttacagtaagtggcatcctgggcccagaaccacactgtcggccaagccactggcagtgacttttcaggagcaacccaagctactgagaaccagagaaaccacatgggtcaattggatctaagactccatcaccatgcttttaaaattaagttgcctggcttggttttctgaaatgcagaaagtgaa

SEQ ID NO: 448374 - DNA, 8239 bp, Homo sapiens
  misc_feature (6358)..(6358): n is a, c, g, or t
acttgggtggcttccgtggtgtggctcatgtgctgcggtcttgtcagtttttagccatggctcgggaaagtgacttggcccctcagtacctccgtttcctcatccattacatcggagcctgtcctctacgtgggactgaaagatccgcacgcagctggtggagcagttcaaatgtctggagcagcaatcagagtcgcgactgcagctgcttcaagacctccaggagtttttccgccggaaagctgagattgagctcgagtactcccgcagcctggagaagctggctgagcgcttctcctccaaaatccgcagctcccgggagcaccagttcaagaaggaccagtacctcctctcgcctgtgaactgttggtatctggttctgcatcagacccggcgggagagccgagaccatgccaccctcaatgacatcttcatgaacaatgtcatcgtccgcctctcccagatcagtgaggatgtcatcagactcttcaaaaagagcaaggagattggcctgcagatgcacgaggagctcctgaaggtgaccaatgagctctacacagtcatgaaaacctaccacatgtaccatgcagagagcatcagtgcggaaagcaagctgaaggaggctgagaagcaggaggagaagcagttcaataagtcaggagacctcagcatgaacctgctccggcacgaggaccggccccagcgccgcagctctgtgaagaagattgagaagatgaaggagaagaggcaggccaagtactctgagaacaagctgaaatgcacaaaggcccggaatgactacttgctcaatctggcagccaccaacgcagctataagcaaatactacatccatgatgtctctgatctgatcgattgctgtgatttgggcttccatgccagcctggcccgcaccttccggacctatctctcagctgaatacaacctggagacctctcgccacgaagggctggatgtcattgagaatgcagtggacaacctggattcccgaagtgacaagcacacagtcatggacatgtgcaatcaagtcttctgccctccactcaagttcgagttccagccccacatgggggatgaggtctgccaggtcagcgctcagcagcccgtccagacagaactgctcatgcgttatcaccagctgcagtccagactggccaccctcaagatagagaatgaggaggttaggaaaaccctggatgccaccatgcagacattacaggacatgctgactgtggaggactttgatgtctccgatgccttccaacacagtcgatcgacagagtccgtcaagtcggctgcctctgagacctacatgagcaagatcaacattgccaagaggagagccaaccagcaggaaacagaaatgttttattttacaaaatttaaagagtatgtgaatggcagtaacctcatcaccaagctgcaggccaagcacgatttactcaagcagaccctgggcgaaggggaaagagcagaatgcggcaccaccagaggaagaagaaatgctcgaaccaggaaccaggattcaggacaagctataccgcttgtagtcgagagctgcatccgttacatcaatttatatggactccagcagcaggggatcttcagagtgccaggatctcaggtggaagtcaatgacatcaaaaattcctttgagagaggtgaagacccccttgtggacgatcaaaatgaacgagatatcaattcagtcgctggtgttttaaaactgtatttccgaggactggaaaacccactctttcctaaggaaaggtttcaagatttgatatctactattaaactggagaacccagccgagagggtgcaccagatccaacaaatcctcgtcacccttccccgcgtggtcattgtggtcatgagatacctcttcgctttcctcaaccacctctcccagtatagcgacgagaacatgatggatccctacaacctggccatctgcttcgggcctaccctcatgcacatccctgatgggcaggaccctgtgtcctgccaggcacacatcaatgaagtcatcaaaaccatcatcatccatcatgaagccatcttccccagcccccgggagctagagggacctgtgtatgaaaaatgcatggctggaggggaagaatattgtgacagcccacacagcgagccaggggccatcgatgaagttgaccatgacaatggcactgagcctcataccagcgatgaagaagtggagcagatcgaggctattgccaagtttgactacatggggcggtccccgcgtgagctatccttcaagaagggggcctcgctgctcctgtaccaccgcgcctcggaggactggtgggagggccggcacaacggcgtggatggactcatcccccatcagtacatagttgtacaggacatggatgatgccttctccgacagcctgagccagaaggctgacagcgaggccagcagtgggccattgctggatgacaaggcctcttccaaaaacgacctccagtcccccacggagcacatctcggattacggctttgggggggtgatgggccgagtgcggttacgatctgatggagcagccatccccagacgccgaagcgggggcgacacacacagcccgccccggggcctgggccccagcatagacacaccaccccgggctgctgcctgccccagcagcccccacaaaatccccctcacccgggggaggatcgagagccctgagaagcggaggatggcgacgttcgggagcgctggcagcatcaactaccctgacaagaaggcgctctccgaagggcactcgatgaggtcgacctgcggttccaccaggcacagcagcctaggggaccacaagtccctggaggccgaggccctggcagaagacatcgagaagaccatgagcacggctctgcacgagttgcgggaactcgagaggcagaacacggtcaagcaggcgccagatgtggtgctggacaccctggagcccctgaagaacccgccaggccccgtcagctcggagcccgccagtccccttcacaccatcgtcatccgcgaccccgatgccgccatgcgccgcagcagcagctcctccaccgagatgatgaccaccttcaagccagccctgtccgcccgcctggctggcgcccagctccgcccgccccccatgcggcccgtgcggccggtggtccagcaccggtccagcagcagcagcagctcgggcgtgggcagcccggccgtgacgcccaccgagaagatgttccccaacagctcagcggacaagtcgggcaccatgtgacctgcaggatgggccgcgccgccgtggcccgctgtggctcaccacggcccagggtggccttggtggcttccacgtgcttcccagtgaccctggccttggagggcagaggtccgtctgggagggtgtgtctgtgcagagctgaggcccgggcgctggctgcagctcacgtccagccatgggaatcccacggacctctcgcgtgtcaacagacgaccagaggagtgctggagctccagcagccccaaccacagcattccctaacatggaggcaaaataccacatggcttctcccgcatatcgtcactggaaacttcctctctcgacattctctctacatacgtatatgtgtgtgtatatcgatgtgtgcatatatacacatgtatacgtatgtacgtgtctgtaggtgtgtgtatatatatatatatttatgcatctatatacatatactagatctggacacacgcatactaagtgtatatagtatctcctttttctttttatgaaacttagatttacctcagatccatgccaccaaacatctcccaccgagttatttggtgggatttgcagggacttttctgggagaacttaaaggcccatagtaactgcgaatgaagcaatataccactaacctgcagaaaaacacaaacaaaaacagactcccactgtctccagaagtcgtggccttccagaacagtctgcccctcaaggaagggtggggcaggcagtacccccaagcaggctgctcccagaggtggggaacccttcataggaaatccccacccccgtccaccccagagaccctgcccttccacccggaggccaaaggccaactgtactcccaaaggcatgggagaaggttggcgagaagacccctgactaccacatccttgtgtttgtgtgtagagacgggggatagtgagaacctaagccccatcgtagcacagtattacatgtggttgggaaaaataaaaatacagtggtgtggaatactccaaaacctagaaatgctgtaggaataaatctgtggtaactatagaggtttaacttatatcattttcaaactatttaattttttcttttcctggttctactaattatactgtgtcagatttggaactaaacaggcaaggaggctttgagtcacatcgttttcattttaaatcaggctgtgatgcactgtggctggtgccgtcttgcatgaaacgcatgagccgtgagcgcccagttcagactggggccagggaggggcagtccttggcactttctgtcctagaggacactgtcagttgagttaatacaagtgacatagcttcccttccctcccccttcacccactccctccagaacatttagtgtagatgaaaatgtggtgatagaaatgggtgcatgatcttcacgtgtgacagccaggcctttgcctcttggccaagtaaagcccttccgggtcgctctccttcgattccattttacctcctcttctgatcacttccagagatgagctgtttctggataatggcacacgggcaaatctgtgtgccctgtgggccgctgttacttaccctctcctgcgagacccaggggcttttccctactgttcccacgcttcctctctctcgaggccactgaagtttggagtcaaaaggcccagagtctgagtcccagccctgagcacttaggagccttctgacttagggtttgtcactccacctcattgagcctgactgttctgctccataaaatagggtaataaaggtcaaacatcagtgagcaagctgtgtacactggaaaacactgaatcaatacaatgcgtttgtgattatcattagtaaggtaagtcttagatcagagccctccagcccttctttttgaaacctcccaatggcatttcagaagtgagcagtggaattttcctgccatcctaataagagccctggattccatcattaacatttcagcccattggatgaagtggtgccctctcctctggtcccccgcgaaaaggtaaatacacccaaagggagggacctagttaagtcactggcacctagataagttaggagggtaaagccactacctcgtctgaaggactggacttgacaccccacagtggaagggagcatcaggagaggaacaaaaaaagggatctcagggagaggccagtgtcaaacttgacctcccttgtttggcctagaatgaacccttctctttagctcctggatatgaaaggccatctgcttggagcacagaaagatattgccattttacagcttaagagagtaaggccttgggctgtgctgtgacctgcccaagatttgacactggctaggagcagaggctgcgtcaggctcttaaagtcatgtgtttgcatgctggatgctatactgtccagccaggacacaagacttctgatttctaccctcaagatactcccagatcctaaatccagtagcctcccaggcaaaatatagcaatctgccacaactgccagatgaaaagcaacaatcagagtagaaaaatctgttgcctgatatacataacaccaatcagaccgtgtggatttttctctgaattgactgattttgtttttttcttactgaaaatggacctgcctttcactgaattttctgagggcagagtcttagctgttttctttaagcaccttttttttttttttccattgggaaatggctgatgagttcacatttagggatgtacacacacagatggcagacgtctccccactcatccagccccagatctgagccttgacgcaggccaagtggaaaaatactttcccgcccccctcccctgttcccacttcctcatctggcactatgcatgtctcactcaccctccacagcactcagtcccatcgacgttcactgaacattggctttctctttctgactcctgcctgttttagtccactatatattgctgtatttgcttaaatgctggaaagtaactgttaaaatgtgaaattgtaatttttaaaaaggctacaattaaattttagccaatgccactcaccaaatctttgcacctagtagatanatcaatgtaaaaacaaatacctaactgtacagtgagtgtgggggaaatgtagtaacctagttagtagtcttcaatataaccaattgtacaaggggaagtggtgtttacctacttgttcatcaccattactgaaagccgtactgatcagttagttgacaacgggcatttttttttctttgcttcatggaatgatttcttttcttaaccttcgacttatcctgaggtcaagccttttgtctttatgtgtaaccgacgttcagtctattctaggaatgaaccagcaagttgttcatttaaaactgaccaaagacaattaattcctggtctagtttcctgggccttgtggctcagctgccactaaagagctttttggataaaattgagaacaagctgtgcttcctaccccactctccccgtccccttttattcccttttcctcttaaagagctgctctgagctgtgggattctatgaaaaattcttgcctttccttgtttcagtgctaacgatttctcacctcgaagcgccttttgaaccccggacagagtgcacaatcggagggaattgcgagcttgggaattagactttggagtcttttctctgaagtcaccaggccaggggtcaggagagagatggattcccaagggatgaaaggtttctattcaatgaagaaatcggagtgggaagagacacagggaaattgagccatattttggctatcggctggaaccagcagttcagagatctgccttataaacatttaaaaccggtttgtggtacacaaagaggaaccagtgtggggaaggggcctttatgtggggctttcttctctgttggagtcccttggagtgccttgttgggtatatttctctgtcattcaggaggcacgaatgtggaggacttctcgtgacctggtcgtgatgtggcattcagtgcatgtccacagctaatggaaaaacacgaggactcgggtaatggttcttcctctcagtctttctattcctaacttttcacacatccagatggttccacactagtgcaaatgcctcactctcctgagaaacccagaaagaagagtggctggctcacaaccatggggttagcccctgctgggctgggagtcggggtggcggccaggaggaaaggcagaaaggggtgagccgaggtgttgcctagctgattttctgctgtgcagagctaatgctgacatttcatgtcaacttccccggttctctggggtctcctctcctctgagcagccacatagaacattccccacatatccaaagctgcccaggggagccgagagaagggactttgctgtcaggtccaagccctcctgacctccctgagattgatctgccagtgtcctgctgtccctctgggactggccacatggccatcgctgccccttgttgacacctcctttctgtgtgagttgtccccggccaataacaaagctgttccttgaaccagaacaaccagagtgcacttttccttccttagacggaagtagatcctggctagggtttctgcccaggcccttgttcccggcagtgtgactgtttacatggtttggcaataggtttgattctgattgcttcagagtggctggtctattttgtttcctttggtttccttcctccccaaattgtgacaggaaaaacagaccaaaaccaccctaggaaattgctggttgcctgtccccacgtgatgataaatgttgccctcttctggatatcgtttctctaccttacgaccaaacgcccgtcctatagagtgtctgattggatcctctgtcgcgtattctgatggtgcctgctggtttgacgtggagctatcctgtgaaataaaacagcttaacttttctcaaaaatgctcca

SEQ ID NO: 448375 - DNA, 2221 bp, Homo sapiens
aaaaaaaaaaaaaaaaaaaaaattggtcttaaaggcatccatttctgggaatgaagccatgttcgctgctaacacttttggatgttgtgaggccacgtggagtgtgtgagagactaggttttatggatggtctggttcaggtaccaggtctgctggaaggttcctgttcggataagctggtagctacctagctctgagcctgccttcaagaacacctgtgttcatcctctgattctctgtgtgtacctcttgtggcgtttcctctcccgggtgtgaacatcctaaccgttattgtgcaaacccaagaacgtcagatcccaaagcacaacaacctggatggactttgggaacatctaagcaatgtaagagagaggtgcactgagagtacgtcttggtcccctccaccctgagagcatctgacggtcctcagtactgaactcccggaagctgctctgagcccggtgacctcatctgggccaggtgtggtgcctgagctgaatgctcaggtgcttacagtgttgcaatccctaagagagtagagtctggaggagaaaccgtgaaaaagaccttacacaccaccaagaacttccgaatgggcgtgaatccaccgtttcttctctttgcaaaaagaaccaccacagctgctcaaagaacacagtgaactcatcactttggttcatcaaaaaatcatcgcccatgcgttattcctgagtgcattttcttacaactttttgactgcttccttttcttcttctcttaagagttgtgggcttaagaatgggatagagtcataatggcaacctccaagccctctcaattcttgattaagaacacaggtagacatgaatcccaattgtctattgctatcttatttatatgattcgggaaaatacagcatgtaaaaatattgctgaggagcctcagtgattgggtacaagaagcaagagtacagaaattatttttgccaaatttattttgtaaatatgagggtctgtacctaaatttaaaaaaaaaaacacgtagaactaggtattttgttctcttcttagtaaatttgtagtggttgtatactacactagctgcaattttcacatttttctaattcagaaaggtttttcttatattaggggaaaaagtatttattttaatatataaaatcactctgaaaatcactctcataaaaaatggagcgcatgtaaatttttatcaaagaaaaataaacaggtgaatggggatagtgattttcttttttcagcacagtctacctcagtgtattgttaagatgtgattcaatcatggacatctttgagatttcagaattctacctggaaccggtctgaatcagggaacgtgtgtatcagctgattcgaatgccagggaccagtaagaattttgagggagggagttgggatggagaaggtatggcctttatgcgagcatagatccttttcttcctggctggtaatattcttctctgaatttaatcttcctttaaaaaaaaatcctccatctattgtcactatgttccccaaacataaactaagttccaggctgtcatgatgtatctgatatatggggtaacccagcaaggtgtaccttcctttggtgagagatggctgccggggcaaagacgggctttgattcagagcaagcattcccacctgttccatggaatccccctgaagtgagcacaaaggtgccctgggctccctgatggtttatgcccactcctttcaggctggtgatgcaccttacacacaaacacctaatgcaatgtctttttaaattctccaagtgggatgggagcatgtgagggaaattccaatccaaaacccattaatgtgctgaacgctttttttttttttttttttttttgcaacaacaccttggacctctgtgttggggtttgactgacctcaagctgatattattggaccttgtgcagctttgataacccatgtgagagtctaggcaggaccagtggggcccaaatcttgctgctcttgtacttttaggcactgcccttgcagactcacctttctccacctgccctggagaaaggtagggtgtgctgggcctgccccttgcaaatgggattcaccagtttcatttatttgactctactgccacagtgaaaagagcaaacagctattgggttgcaaacctcctttgacattaggaaatgttgactttgtaacaataaaactttggtcctagaaag

SEQ ID NO: 448376 - DNA, 724 bp, Homo sapiens
ccaccagctttctttgcacactgtttctcatgatggacccatttcctttctccctgacagacccctctgtgcccctggatccaatctcagtgtctaactcatcatcccagattattctgaagtggaaaccaccctccgaccccaatggcaacatcacccactacctggttttctgggagaggcaggcggaagacagtgagctgttcgagctggattattgcctcaaaggtgagtgcaggcagctgtgctaggatcggtggggtttgcacacgtgtgtctgatgcactttgcttcacctctagggaagcagctatctcttcctgtgtctcagtgtcggaaggcacacacacacacactccattctatctcatatgaaaacacacatacatgtttttatctatttatttatttattttattttttatttatttacttttttgagatggagtttcactcttgttgcccaggctggagtgcaatgacgcgaccttggctcatcgcaacctccacctctcgggttcaagtgattctcctgcatcagcctcccgagtagctgggattacaggcacgcgccaccacgcccggctaatttggtatttttagtagggacggggtttctccatgttggtcagcctggtctcaaactcccgacctcaggtgacctcaggtgatccacccaccttggcctcccaaagtgctgggattacaggcatgagccaccaca

SEQ ID NO: 448377 - DNA, 326 bp, Homo sapiens
ggagaacccaggggtttctctggctttttgcatgcggcgggcagctgtgctggagagcagatgcttcaccaattcagaaatccaatgccttcactctgaaatgaaatctgggcatgaatgtggggagaaaccttcactaacacactcttgctaaaacatagaatcatgggagtgcttcctgggtaccccctccctgccttctgtttgcagccactgtttgctcactaaacatctctgcacctcccgcgtgcatttgcagaggtgggtgggggtccccggagtctgagctccccgcggctgggtgccccgacccagcagctcctaca

SEQ ID NO: 448378 - DNA, 276 bp, Homo sapiens
tttgctcgactctgaggatcccgtaagatctgtgggcaggatgcgtgtggttccaacagttggacggtggtagacattgacccacccctgaggtccaacgaccccaaatcacagaaccacccagggtggctgatgcggggtctcaagccctggacccagtatgccatctttgtgaagaccctggtcaccttttcggatgaacgccggacctatggggccaagagtgacatcatttatgtccagacagatgccaccagtgagtgtgtcttgggaatg

SEQ ID NO: 448379 - DNA, 9032 bp, Homo sapiens
  misc_feature (1047)..(1047): n is a, c, g, or t
  misc_feature (1776)..(1776): n is a, c, g, or t
ggggggctgcgcggccgggtcggtgcgcacacgagaaggacgcgcggcccccagcgctcttgggggccgcctcggagcatgacccccgcgggccagcgccgcgcgcctgatccgaggagaccccgcgctcccgcagccatgggcaccgggggccggcggggggcggcggccgcgccgctgctggtggcggtggccgcgctgctactgggcgccgcgggccacctgtaccccggagaggtgtgtcccggcatggatatccggaacaacctcactaggttgcatgagctggagaattgctctgtcatcgaaggacacttgcagatactcttgatgttcaaaacgaggcccgaagatttccgagacctcagtttccccaaactcatcatgatcactgattacttgctgctcttccgggtctatgggctcgagagcctgaaggacctgttccccaacctcacggtcatccggggatcacgactgttctttaactacgcgctggtcatcttcgagatggttcacctcaaggaactcggcctctacaacctgatgaacatcacccggggttctgtccgcatcgagaagaacaatgagctctgttacttggccactatcgactggtcccgtatcctggattccgtggaggataattacatcgtgttgaacaaagatgacaacgaggagtgtggagacatctgtccgggtaccgcgaagggcaagaccaactgccccgccaccgtcatcaacgggcagtttgtcgaacgatgttggactcatagtcactgccagaaagtttgcccgaccatctgtaagtcacacggctgcaccgccgaaggcctctgttgccacagcgagtgcctgggcaactgttctcagcccgacgaccccaccaagtgcgtggcctgccgcaacttctacctggacggcaggtgtgtggagacctgcccgcccccgtactaccacttccaggactggcgctgtgtgaacttcagcttctgccaggacctgcaccacaaatgcaagaactcgcggaggcagggctgccaccantacgtcattcacaacaacaagtgcatccctgagtgtccctccgggtacacgatgaattccagcaacttgctgtgcaccccatgcctgggtccctgtcccaaggtgtgccacctcctagaaggcgagaagaccatcgactcggtgacgtctgcccaggagctccgaggatgcaccgtcatcaacgggagtctgatcatcaacattcgaggaggcaacaatctggcagctgagctagaagccaacctcggcctcattgaagaaatttcagggtatctaaaaatccgccgatcctacgctctggtgtcactttccttcttccggaagttacgtctgattcgaggagagaccttggaaattgggaactactccttctatgccttggacaaccagaacctaaggcagctctgggactggagcaaacacaacctcaccatcactcaggggaaactcttcttccactataaccccaaactctgcttgtcagaaatccacaagatggaagaagtttcaggaaccaaggggcgccaggagagaaacgacattgccctgaagaccaatggggaccaggcatcctgtgaaaatgagttacttaaattttcttacattcggacatcttttgacaagatcttgctgagatgggagccgtactggccccccgacttccgagacctcttggggttcatgctgttctacaaagaggccccttatcagaatgtgacggagttcgangggcaggatgcgtgtggttccaacagttggacggtggtagacattgacccacccctgaggtccaacgaccccaaatcacagaaccacccagggtggctgatgcggggtctcaagccctggacccagtatgccatctttgtgaagaccctggtcaccttttcggatgaacgccggacctatggggccaagagtgacatcatttatgtccagacagatgccaccaacccctctgtgcccctggatccaatctcagtgtctaactcatcatcccagattattctgaagtggaaaccaccctccgaccccaatggcaacatcacccactacctggttttctgggagaggcaggcggaagacagtgagctgttcgagctggattattgcctcaaagggctgaagctgccctcgaggacctggtctccaccattcgagtctgaagattctcagaagcacaaccagagtgagtatgaggattcggccggcgaatgctgctcctgtccaaagacagactctcagatcctgaaggagctggaggagtcctcgtttaggaagacgtttgaggattacctgcacaacgtggttttcgtccccagaaaaacctcttcaggcactggtgccgaggaccctaggccatctcggaaacgcaggtcccttggcgatgttgggaatgtgacggtggccgtgcccacggtggcagctttccccaacacttcctcgaccagcgtgcccacgagtccggaggagcacaggccttttgagaaggtggtgaacaaggagtcgctggtcatctccggcttgcgacacttcacgggctatcgcatcgagctgcaggcttgcaaccaggacacccctgaggaacggtgcagtgtggcagcctacgtcagtgcgaggaccatgcctgaagccaaggctgatgacattgttggccctgtgacgcatgaaatctttgagaacaacgtcgtccacttgatgtggcaggagccgaaggagcccaatggtctgatcgtgctgtatgaagtgagttatcggcgatatggtgatgaggagctgcatctctgcgtctcccgcaagcacttcgctctggaacggggctgcaggctgcgtgggctgtcaccggggaactacagcgtgcgaatccgggccacctcccttgcgggcaacggctcttggacggaacccacctatttctacgtgacagactatttagacgtcccgtcaaatattgcaaaaattatcatcggccccctcatctttgtctttctcttcagtgttgtgattggaagtatttatctattcctgagaaagaggcagccagatgggccgctgggaccgctttacgcttcttcaaaccctgagtatctcagtgccagtgatgtgtttccatgctctgtgtacgtgccggacgagtgggaggtgtctcgagagaagatcaccctccttcgagagctggggcagggctccttcggcatggtgtatgagggcaatgccagggacatcatcaagggtgaggcagagacccgcgtggcggtgaagacggtcaacgagtcagccagtctccgagagcggattgagttcctcaatgaggcctcggtcatgaagggcttcacctgccatcacgtggtgcgcctcctgggagtggtgtccaagggccagcccacgctggtggtgatggagctgatggctcacggagacctgaagagctacctccgttctctgcggccagaggctgagaataatcctggccgccctccccctacccttcaagagatgattcagatggcggcagagattgctgacgggatggcctacctgaacgccaagaagtttgtgcatcgggacctggcagcgagaaactgcatggtcgcccatgattttactgtcaaaattggagactttggaatgaccagagacatctatgaaacggattactaccggaaagggggcaagggtctgctccctgtacggtggatggcaccggagtccctgaaggatggggtcttcaccacttcttctgacatgtggtcctttggcgtggtcctttgggaaatcaccagcttggcagaacagccttaccaaggcctgtctaatgaacaggtgttgaaatttgtcatggatggagggtatctggatcaacccgacaactgtccagagagagtcactgacctcatgcgcatgtgctggcaattcaaccccaagatgaggccaaccttcctggagattgtcaacctgctcaaggacgacctgcaccccagctttccagaggtgtcgttcttccacagcgaggagaacaaggctcccgagagtgaggagctggagatggagtttgaggacatggagaatgtgcccctggaccgttcctcgcactgtcagagggaggaggcggggggccgggatggagggtcctcgctgggtttcaagcggagctacgaggaacacatcccttacacacacatgaacggaggcaagaaaaacgggcggattctgaccttgcctcggtccaatccttcctaacagtgcctaccgtggcgggggcgggcaggggttcccattttcgctttcctctggtttgaaagcctctggaaaactcaggattctcacgactctaccatgtccaatggagttcagagatcgttcctatacatttctgttcatcttaaggtggactcgtttggttaccaatttaactagtcctgcagaggatttaactgtgaacctggagggcaaggggtttccacagttgctgctcctttggggcaacgacggtttcaaaccaggattttgtgttttttcgttccccccacccgcccccagcagatggaaagaaagcacctgtttttacaaattctttttttttttttttttttttgctggtgtctgagcttcagtataaaagacaaaacttcctgtttgtggaacaaaagttcgaaagaaaaaacaaaacaaaaacacccagccctgttccaggagaatttcaagttttacaggttgagcttcaagatggtttttttggttttttttttttctctcatccaggctgaaggattttttttttctttacaaaatgagttcctcaaattgaccaatagctgctgctttcatattttggataagggtctgtggtcccggcgtgtgctcacgtgtgtatgcacgtgtgtgtgtccattagacacggctgatgtgtgtgcaaagtatccatgcggagttgatgctttgggaattggctcatgaaggttcttctcaagggtgcgagctcatccccctctctccttccttcttattgactgggagactgtgctctcgacagattcttcttgtgtcagaagtctagcctcaggtttctaccctcccttcacattggtggccaagggaggagcatttcatttggagtgattatgaatcttttcaagaccaaaccaagctaggacattaaaaaaaaaaaaagaaaaagaaagaaaaaacaaaatggaaaaaggaaaaaaaaaaagaactgagatgacagagttttgagaatatatttgtaccatatttaatttttaaagtctctggtattagcctcataagttattgactattccccggggttggcggggagtggggacatgagttggtctgcctgttgtggggccgggaaggggagggagtcaggcacaagtggcctctttgtttggtcttaaaggcatccatttctgggaatgaagccatgttcgctgctaacacttttggatgttgtgaggccacgtggagtgtgtgagagactaggttttatggatggtctggttcaggtaccaggtctgctggaaggttcctgttcggataagctggtagctacctagctctgagcctgccttcaagaacacctgtgttcatcctctgattctctgtgtgtacctcttgtggcgtttcctctcccgggtgtgaacatcctaaccgttattgtgcaaacccaagaacgtcagatcccaaagcacaacaacctggatggactttgggaacatctaagcaatgtaagagagaggtgcactgagagtacgtcttggtcccctccaccctgagagcatctgacggtcctcagtactgaactcccggaagctgctctgagcccggtgacctcatctgggccaggtgtggtgcctgagctgaatgctcaggtgcttacagtgttgcaatccctaagagagtagagtctggaggagaaaccgtgaaaaagaccttacacaccaccaagaacttccgaatgggcgtgaatccaccgtttcttctctttgcaaaaagaaccaccacagctgctcaaagaacacagtgaactcatcactttggttcatcaaaaaatcatcgcccatgcgttattcctgagtgcattttcttacaactttttgactgcttccttttcttcttctcttaagagttgtgggcttaagaatgggatagagtcataatggcaacctccaagccctctcaattcttgattaagaacacaggtagacatgaatcccaattgtctattgctatcttatttatatgattcgggaaaatacagcatgtaaaaatattgctgaggagcctcagtgattgggtacaagaagcaagagtacagaaattatttttgccaaatttattttgtaaatatgagggtctgtacctaaatttaaaaaaaaaaacacgtagaactaggtattttgttctcttcttagtaaatttgtagtggttgtatactacactagctgcaattttcacatttttctaattcagaaaggtttttcttatattaggggaaaaagtatttattttaatatataaaatcactctgaaaatcactctcataaaaaatggagcgcatgtaaatttttatcaaagaaaaataaacaggtgaatggggatagtgattttcttttttcagcacagtctacctcagtgtattgttaagatgtgattcaatcatggacatctttgagatttcagaattctacctggaaccggtctgaatcagggaacgtgtgtatcagctgattcgaatgccagggaccagtaagaattttgagggagggagttgggatggagaaggtatggcctttatgcgagcatagatccttttcttcctggctggtaatattcttctctgaatttaatcttcctttaaaaaaaaatcctccatctattgtcactatgttccccaaacataaactaagttccaggctgtcatgatgtatctgatatatggggtaacccagcaaggtgtaccttcctttggtgagagatggctgccggggcaaagacgggctttgattcagagcaagcattcccacctgttccatggaatccccctgaagtgagcacaaaggtgccctgggctccctgatggtttatgcccactcctttcaggctggtgatgcaccttacacacaaacacctaatgcaatgtctttttaaattctccaagtgggatgggagcatgtgagggaaattccaatccaaaacccattaatgtgctgaacgctttttttttttttttttttttttgcaacaacaccttggacctctgtgttggggtttgactgacctcaagctgatattattggaccttgtgcagctttgataacccatgtgagagtctaggcaggaccagtggggcccaaatcttgctgctcttgtacttttaggcactgcccttgcagactcacctttctccacctgccctggagaaaggtagggtgtgctgggcctgccccttgcaaatgggattcaccagtttcatttatttgactctactgccacagtgaaaagagcaaacagctattgggttgcaaacctcctttgacattaggaaatgttgactttgtaacaataaaactttggtcctagaaagacacggttgtcctgggagtttgtagtgttaagttgcaacaacaacaacaaaaagcaacaaaaccagcttaggataacactttttgttgcttgttcttaaagatgtctcactatgattaaaacccttttcattaatgtagtgaaagccacacaggagttccttcttccaggaggagaataccaagcacatcactttctctctgcatcagtgatgtcaaatacgcatcagtgagaaagagaagcactgctgcttgtctggatataggctgaggatgattgagagaagctgtgggaactgacacaagggtctgcataggtcatcctgtgaccctggggactatgttaccaactgacagacagatctttcactgtatcctagcagggcaggtagtccaccaagaaatgtgcttattggattgggaggtgtttatttgtagtctgctgtaacacgtgtgaaagagcaggagcgtcatcagcatatgacttgcgctggtcatccggtaaatggatgtgctgtagtcccagtgctaatcatttctctccttcacagtgggtggaagtttagggttaaatgtcctttgaatgtcacctggtgagtccttgacaccttaggctcttcagaaacaatggttttgttgaggatggggaacagggaatgccgattttatatacatggtacacagagaggggtgtcacttcagaaaatcttccagcatgttcttcagaatattaatttatatgcgaggtgaggttgggaatgaaaagaacaggtcagcacttttttttttcctagaacatacaaaagaacatggtggactttcagggagtgcaatggaaggtgaatatttccttaagggtccccgagaaatgggagtgaggggaggggacacaatggctttttgagcttacttttaccttctgatactagtcaaggtccagaaccagccaccagccaaatttctatctgggtgcgggccactgaaaatccttgttaaaaaccagatcacaaatctggggctcttggtcccattggagaaggaaggaagagcctcaaaataagtgtgcacccatgcacatattcaggaacagcttgtttagtctttacactttgcctgaaagttgcttctcctcgtccctttgtgtgcctgggtggcctcggccctgtgcgttggcaacgcaggatcaaatgtgctgcagcttttgcagaaaacaactcagaaacacaaaaccccccaacagctcaattattattttttcaatgttttcctacaagagccaagtagcaccatgtacagaagacgcctttttttttggaatattgaaatcgttctgcatgtaaaatatgggataatgacctgtttatattaaaattctgattaaattatctgagaata

SEQ ID NO: 448380 - DNA, 9050 bp, Homo sapiens
  misc_feature (1047)..(1047): n is a, c, g, or t
  misc_feature (1776)..(1776): n is a, c, g, or t
ggggggctgcgcggccgggtcggtgcgcacacgagaaggacgcgcggcccccagcgctcttgggggccgcctcggagcatgacccccgcgggccagcgccgcgcgcctgatccgaggagaccccgcgctcccgcagccatgggcaccgggggccggcggggggcggcggccgcgccgctgctggtggcggtggccgcgctgctactgggcgccgcgggccacctgtaccccggagaggtgtgtcccggcatggatatccggaacaacctcactaggttgcatgagctggagaattgctctgtcatcgaaggacacttgcagatactcttgatgttcaaaacgaggcccgaagatttccgagacctcagtttccccaaactcatcatgatcactgattacttgctgctcttccgggtctatgggctcgagagcctgaaggacctgttccccaacctcacggtcatccggggatcacgactgttctttaactacgcgctggtcatcttcgagatggttcacctcaaggaactcggcctctacaacctgatgaacatcacccggggttctgtccgcatcgagaagaacaatgagctctgttacttggccactatcgactggtcccgtatcctggattccgtggaggataattacatcgtgttgaacaaagatgacaacgaggagtgtggagacatctgtccgggtaccgcgaagggcaagaccaactgccccgccaccgtcatcaacgggcagtttgtcgaacgatgttggactcatagtcactgccagaaagtttgcccgaccatctgtaagtcacacggctgcaccgccgaaggcctctgttgccacagcgagtgcctgggcaactgttctcagcccgacgaccccaccaagtgcgtggcctgccgcaacttctacctggacggcaggtgtgtggagacctgcccgcccccgtactaccacttccaggactggcgctgtgtgaacttcagcttctgccaggacctgcaccacaaatgcaagaactcgcggaggcagggctgccaccantacgtcattcacaacaacaagtgcatccctgagtgtccctccgggtacacgatgaattccagcaacttgctgtgcaccccatgcctgggtccctgtcccaaggtgtgccacctcctagaaggcgagaagaccatcgactcggtgacgtctgcccaggagctccgaggatgcaccgtcatcaacgggagtctgatcatcaacattcgaggaggcaacaatctggcagctgagctagaagccaacctcggcctcattgaagaaatttcagggtatctaaaaatccgccgatcctacgctctggtgtcactttccttcttccggaagttacgtctgattcgaggagagaccttggaaattgggaactactccttctatgccttggacaaccagaacctaaggcagctctgggactggagcaaacacaacctcaccatcactcaggggaaactcttcttccactataaccccaaactctgcttgtcagaaatccacaagatggaagaagtttcaggaaccaaggggcgccaggagagaaacgacattgccctgaagaccaatggggaccaggcatcctgtgaaaatgagttacttaaattttcttacattcggacatcttttgacaagatcttgctgagatgggagccgtactggccccccgacttccgagacctcttggggttcatgctgttctacaaagaggccccttatcagaatgtgacggagttcgangggcaggatgcgtgtggttccaacagttggacggtggtagacattgacccacccctgaggtccaacgaccccaaatcacagaaccacccagggtggctgatgcggggtctcaagccctggacccagtatgccatctttgtgaagaccctggtcaccttttcggatgaacgccggacctatggggccaagagtgacatcatttatgtccagacagatgccaccaacccctctgtgcccctggatccaatctcagtgtctaactcatcatcccagattattctgaagtggaaaccaccctccgaccccaatggcaacatcacccactacctggttttctgggagaggcaggcggaagacagtgagctgttcgagctggattattgcctcaaagggctgaagctgccctcgaggacctggtctccaccattcgagtctgaagattctcagaagcacaaccagagtgagtatgaggattcggccggcgaatgctgctcctgtccaaagacagactctcagatcctgaaggagctggaggagtcctcgtttaggaagacgtttgaggattacctgcacaacgtggttttcgtccccaggccatctcggaaacgcaggtcccttggcgatgttgggaatgtgacggtggccgtgcccacggtggcagctttccccaacacttcctcgaccagcgtgcccacgagtccggaggagcacaggccttttgagaaggtggtgaacaaggagtcgctggtcatctccggcttgcgacacttcacgggctatcgcatcgagctgcaggcttgcaaccaggacacccctgaggaacggtgcagtgtggcagcctacgtcagtgcgaggaccatgcctgaagccaaggctgatgacattgttggccctgtgacgcatgaaatctttgagaacaacgtcgtccacttgatgtggcaggagccgaaggagcccaatggtctgatcgtgctgtatgaagtgagttatcggcgatatggtgatgaggagctgcatctctgcgtctcccgcaagcacttcgctctggaacggggctgcaggctgcgtgggctgtcaccggggaactacagcgtgcgaatccgggccacctcccttgcgggcaacggctcttggacggaacccacctatttctacgtgacagactatttagacgtcccgtcaaatattgcaaaaattatcatcggccccctcatctttgtctttctcttcagtgttgtgattggaagtatttatctattcctgagaaagaggcagccagatgggccgctgggaccgctttacgcttcttcaaaccctgagtatctcagtgccagtgatgtgtttccatgctctgtgtacgtgccggacgagtgggaggtgtctcgagagaagatcaccctccttcgagagctggggcagggctccttcggcatggtgtatgagggcaatgccagggacatcatcaagggtgaggcagagacccgcgtggcggtgaagacggtcaacgagtcagccagtctccgagagcggattgagttcctcaatgaggcctcggtcatgaagggcttcacctgccatcacgtggtgcgcctcctgggagtggtgtccaagggccagcccacgctggtggtgatggagctgatggctcacggagacctgaagagctacctccgttctctgcggccagaggctgagaataatcctggccgccctccccctacccttcaagagatgattcagatggcggcagagattgctgacgggatggcctacctgaacgccaagaagtttgtgcatcgggacctggcagcgagaaactgcatggtcgcccatgattttactgtcaaaattggagactttggaatgaccagagacatctatgaaacggattactaccggaaagggggcaagggtctgctccctgtacggtggatggcaccggagtccctgaaggatggggtcttcaccacttcttctgacatgtggtcctttggcgtggtcctttgggaaatcaccagcttggcagaacagccttaccaaggcctgtctaatgaacaggtgttgaaatttgtcatggatggagggtatctggatcaacccgacaactgtccagagagagtcactgacctcatgcgcatgtgctggcaattcaaccccaagatgaggccaaccttcctggagattgtcaacctgctcaaggacgacctgcaccccagctttccagaggtgtcgttcttccacagcgaggagaacaaggctcccgagagtgaggagctggagatggagtttgaggacatggagaatgtgcccctggaccgttcctcgcactgtcagagggaggaggcggggggccgggatggagggtcctcgctgggtttcaagcggagctacgaggaacacatcccttacacacacatgaacggaggcaagaaaaacgggcggattctgaccttgcctcggtccaatccttcctaacagtgcctaccgtggcgggggcgggcaggggttcccattttcgctttcctctggtttgaaagcctctggaaaactcaggattctcacgactctaccatgtccaatggagttcagagatcgttcctatacatttctgttcatcttaaggtggactcgtttggttaccaatttaactagtcctgcagaggatttaactgtgaacctggagggcaaggggtttccacagttgctgctcctttggggcaacgacggtttcaaaccaggattttgtgttttttcgttccccccacccgcccccagcagatggaaagaaagcacctgtttttacaaattctttttttttttttttttttttgctggtgtctgagcttcagtataaaagacaaaacttcctgtttgtggaacaaaagttcgaaagaaaaaacaaaacaaaaacacccagccctgttccaggagaatttcaagttttacaggttgagcttcaagatggtttttttggttttttttttttctctcatccaggctgaaggattttttttttctttacaaaatgagttcctcaaattgaccaatagctgctgctttcatattttggataagggtctgtggtcccggcgtgtgctcacgtgtgtatgcacgtgtgtgtgtccattagacacggctgatgtgtgtgcaaagtatccatgcggagttgatgctttgggaattggctcatgaaggttcttctcaagggtgcgagctcatccccctctctccttccttcttattgactgggagactgtgctctcgacagattcttcttgtgtcagaagtctagcctcaggtttctaccctcccttcacattggtggccaagggaggagcatttcatttggagtgattatgaatcttttcaagaccaaaccaagctaggacattaaaaaaaaaaaaagaaaaagaaagaaaaaacaaaatggaaaaaggaaaaaaaaaaagaactgagatgacagagttttgagaatatatttgtaccatatttaatttttaaagtctctggtattagcctcataagttattgactattccccggggttggcggggagtggggacatgagttggtctgcctgttgtggggccgggaaggggagggagtcaggcacaagtggcctctttgtttggtcttaaaggcatccatttctgggaatgaagccatgttcgctgctaacacttttggatgttgtgaggccacgtggagtgtgtgagagactaggttttatggatggtctggttcaggtaccaggtctgctggaaggttcctgttcggataagctggtagctacctagctctgagcctgccttcaagaacacctgtgttcatcctctgattctctgtgtgtacctcttgtggcgtttcctctcccgggtgtgaacatcctaaccgttattgtgcaaacccaagaacgtcagatcccaaagcacaacaacctggatggactttgggaacatctaagcaatgtaagagagaggtgcactgagagtacgtcttggtcccctccaccctgagagcatctgacggtcctcagtactgaactcccggaagctgctctgagcccggtgacctcatctgggccaggtgtggtgcctgagctgaatgctcaggtgcttacagtgttgcaatccctaagagagtagagtctggaggagaaaccgtgaaaaagaccttacacaccaccaagaacttccgaatgggcgtgaatccaccgtttcttctctttgcaaaaagaaccaccacagctgctcaaagaacacagtgaactcatcactttggttcatcaaaaaatcatcgcccatgcgttattcctgagtgcattttcttacaactttttgactgcttccttttcttcttctcttaagagttgtgggcttaagaatgggatagagtcataatggcaacctccaagccctctcaattcttgattaagaacacaggtagacatgaatcccaattgtctattgctatcttatttatatgattcgggaaaatacagcatgtaaaaatattgctgaggagcctcagtgattgggtacaagaagcaagagtacagaaattatttttgccaaatttattttgtaaatatgagggtctgtacctaaatttaaaaaaaaaaacacgtagaactaggtattttgttctcttcttagtaaatttgtagtggttgtatactacactagctgcaattttcacatttttctaattcagaaaggtttttcttatattaggggaaaaagtatttattttaatatataaaatcactctgaaaatcactctcataaaaaatggagcgcatgtaaatttttatcaaagaaaaataaacaggtgaatggggatagtgattttcttttttcagcacagtctacctcagtgtattgttaagatgtgattcaatcatggacatctttgagatttcagaattctacctggaaccggtctgaatcagggaacgtgtgtatcagctgattcgaatgccagggaccagtaagaattttgagggagggagttgggatggagaaggtatggcctttatgcgagcatagatccttttcttcctggctggtaatattcttctctgaatttaatcttcctttaaaaaaaaatcctccatctattgtcactatgttccccaaacataaactaagttccaggctgtcatgatgtatctgatatatggggtaacccagcaaggtgtaccttcctttggtgagagatggctgccggggcaaagacgggctttgattcagagcaagcattcccacctgttccatggaatccccctgaagtgagcacaaaggtgccctgggctccctgatggtttatgcccactcctttcaggctggtgatgcaccttacacacaaacacctaatgcaatgtctttttaaattctccaagtgggatgggagcatgtgagggaaattccaatccaaaacccattaatgtgctgaacgctttttttttttttttttttttttgcaacaacaccttggacctctgtgttggggtttgactgacctcaagctgatattattggaccttgtgcagctttgataacccatgtgagagtctaggcaggaccagtggggcccaaatcttgctgctcttgtacttttaggcactgcccttgcagactcacctttctccacctgccctggagaaaggtagggtgtgctgggcctgccccttgcaaatgggattcaccagtttcatttatttgactctactgccacagtgaaaagagcaaacagctattgggttgcaaacctcctttgacattaggaaatgttgactttgtaacaataaaactttggtcctagaaagacacggttgtcctgggagtttgtagtgttaagttgcaacaacaacaacaaaaagcaacaaaaccagcttaggataacactttttgttgcttgttcttaaagatgtctcactatgattaaaacccttttcattaatgtagtgaaagccacacaggagttccttcttccaggaggagaataccaagcacatcactttctctctgcatcagtgatgtcaaatacgcatcagaaaatgttcaggttttaggagctgtcctaggtgctgtttcatcattggaagcagtgagaaagagaagcactgctgcttgtctggatataggctgaggatgattgagagaagctgtgggaactgacacaagggtctgcataggtcatcctgtgaccctggggactatgttaccaactgacagacagatctttcactgtatcctagcagggcaggtagtccaccaagaaatgtgcttattggattgggaggtgtttatttgtagtctgctgtaacacgtgtgaaagagcaggagcgtcatcagcatatgacttgcgctggtcatccggtaaatggatgtgctgtagtcccagtgctaatcatttctctccttcacagtgggtggaagtttagggttaaatgtcctttgaatgtcacctggtgagtccttgacaccttaggctcttcagaaacaatggttttgttgaggatggggaacagggaatgccgattttatatacatggtacacagagaggggtgtcacttcagaaaatcttccagcatgttcttcagaatattaatttatatgcgaggtgaggttgggaatgaaaagaacaggtcagcacttttttttttcctagaacatacaaaagaacatggtggactttcagggagtgcaatggaaggtgaatatttccttaagggtccccgagaaatgggagtgaggggaggggacacaatggctttttgagcttacttttaccttctgatactagtcaaggtccagaaccagccaccagccaaatttctatctgggtgcgggccactgaaaatccttgttaaaaaccagatcacaaatctggggctcttggtcccattggagaaggaaggaagagcctcaaaataagtgtgcacccatgcacatattcaggaacagcttgtttagtctttacactttgcctgaaagttgcttctcctcgtccctttgtgtgcctgggtggcctcggccctgtgcgttggcaacgcaggatcaaatgtgctgcagcttttgcagaaaacaactcagaaacacaaaaccccccaacagctcaattattattttttcaatgttttcctacaagagccaagtagcaccatgtacagaagacgcctttttttttggaatattgaaatcgttctgcatgtaaaatatgggataatgacctgtttatattaaaattctgattaaattatctgagaata

SEQ ID NO: 448381 - DNA, 8607 bp, Homo sapiens
  misc_feature (1047)..(1047): n is a, c, g, or t
  misc_feature (1776)..(1776): n is a, c, g, or t
ggggggctgcgcggccgggtcggtgcgcacacgagaaggacgcgcggcccccagcgctcttgggggccgcctcggagcatgacccccgcgggccagcgccgcgcgcctgatccgaggagaccccgcgctcccgcagccatgggcaccgggggccggcggggggcggcggccgcgccgctgctggtggcggtggccgcgctgctactgggcgccgcgggccacctgtaccccggagaggtgtgtcccggcatggatatccggaacaacctcactaggttgcatgagctggagaattgctctgtcatcgaaggacacttgcagatactcttgatgttcaaaacgaggcccgaagatttccgagacctcagtttccccaaactcatcatgatcactgattacttgctgctcttccgggtctatgggctcgagagcctgaaggacctgttccccaacctcacggtcatccggggatcacgactgttctttaactacgcgctggtcatcttcgagatggttcacctcaaggaactcggcctctacaacctgatgaacatcacccggggttctgtccgcatcgagaagaacaatgagctctgttacttggccactatcgactggtcccgtatcctggattccgtggaggataattacatcgtgttgaacaaagatgacaacgaggagtgtggagacatctgtccgggtaccgcgaagggcaagaccaactgccccgccaccgtcatcaacgggcagtttgtcgaacgatgttggactcatagtcactgccagaaagtttgcccgaccatctgtaagtcacacggctgcaccgccgaaggcctctgttgccacagcgagtgcctgggcaactgttctcagcccgacgaccccaccaagtgcgtggcctgccgcaacttctacctggacggcaggtgtgtggagacctgcccgcccccgtactaccacttccaggactggcgctgtgtgaacttcagcttctgccaggacctgcaccacaaatgcaagaactcgcggaggcagggctgccaccantacgtcattcacaacaacaagtgcatccctgagtgtccctccgggtacacgatgaattccagcaacttgctgtgcaccccatgcctgggtccctgtcccaaggtgtgccacctcctagaaggcgagaagaccatcgactcggtgacgtctgcccaggagctccgaggatgcaccgtcatcaacgggagtctgatcatcaacattcgaggaggcaacaatctggcagctgagctagaagccaacctcggcctcattgaagaaatttcagggtatctaaaaatccgccgatcctacgctctggtgtcactttccttcttccggaagttacgtctgattcgaggagagaccttggaaattgggaactactccttctatgccttggacaaccagaacctaaggcagctctgggactggagcaaacacaacctcaccatcactcaggggaaactcttcttccactataaccccaaactctgcttgtcagaaatccacaagatggaagaagtttcaggaaccaaggggcgccaggagagaaacgacattgccctgaagaccaatggggaccaggcatcctgtgaaaatgagttacttaaattttcttacattcggacatcttttgacaagatcttgctgagatgggagccgtactggccccccgacttccgagacctcttggggttcatgctgttctacaaagaggccccttatcagaatgtgacggagttcgangggcaggatgcgtgtggttccaacagttggacggtggtagacattgacccacccctgaggtccaacgaccccaaatcacagaaccacccagggtggctgatgcggggtctcaagccctggacccagtatgccatctttgtgaagaccctggtcaccttttcggatgaacgccggacctatggggccaagagtgacatcatttatgtccagacagatgccaccaacccctctgtgcccctggatccaatctcagtgtctaactcatcatcccagattattctgaagtggaaaccaccctccgaccccaatggcaacatcacccactacctggttttctgggagaggcaggcggaagacagtgagctgttcgagctggattattgcctcaaagggctgaagctgccctcgaggacctggtctccaccattcgagtctgaagattctcagaagcacaaccagagtgagtatgaggattcggccggcgaatgctgctcctgtccaaagacagactctcagatcctgaaggagctggaggagtcctcgtttaggaagacgtttgaggattacctgcacaacgtggttttcgtccccagaaaaacctcttcaggcactggtgccgaggaccctaggccatctcggaaacgcaggtcccttggcgatgttgggaatgtgacggtggccgtgcccacggtggcagctttccccaacacttcctcgaccagcgtgcccacgagtccggaggagcacaggccttttgagaaggtggtgaacaaggagtcgctggtcatctccggcttgcgacacttcacgggctatcgcatcgagctgcaggcttgcaaccaggacacccctgaggaacggtgcagtgtggcagcctacgtcagtgcgaggaccatgcctgaagccaaggctgatgacattgttggccctgtgacgcatgaaatctttgagaacaacgtcgtccacttgatgtggcaggagccgaaggagcccaatggtctgatcgtgctgtatgaagtgagttatcggcgatatggtgatgaggagctgcatctctgcgtctcccgcaagcacttcgctctggaacggggctgcaggctgcgtgggctgtcaccggggaactacagcgtgcgaatccgggccacctcccttgcgggcaacggctcttggacggaacccacctatttctacgtgacagactatttagacgtcccgtcaaatattgcaaaaattatcatcggccccctcatctttgtctttctcttcagtgttgtgattggaagtatttatctattcctgagaaagaggcagccagatgggccgctgggaccgctttacgcttcttcaaaccctgagtatctcagtgccagtgatgtgtttccatgctctgtgtacgtgccggacgagtgggaggtgtctcgagagaagatcaccctccttcgagagctggggcagggctccttcggcatggtgtatgagggcaatgccagggacatcatcaagggtgaggcagagacccgcgtggcggtgaagacggtcaacgagtcagccagtctccgagagcggattgagttcctcaatgaggcctcggtcatgaagggcttcacctgccatcacgtggtgcgcctcctgggagtggtgtccaagggccagcccacgctggtggtgatggagctgatggctcacggagacctgaagagctacctccgttctctgcggccagaggctgagaataatcctggccgccctccccctacccttcaagagatgattcagatggcggcagagattgctgacgggatggcctacctgaacgccaagaagtttgtgcatcgggacctggcagcgagaaactgcatggtcgcccatgattttactgtcaaaattggagactttggaatgaccagagacatctatgaaacggattactaccggaaagggggcaagggtctgctccctgtacggtggatggcaccggagtccctgaaggatggggtcttcaccacttcttctgacatgtggtcctttggcgtggtcctttgggaaatcaccagcttggcagaacagccttaccaaggcctgtctaatgaacaggtgttgaaatttgtcatggatggagggtatctggatcaacccgacaactgtccagagagagtcactgacctcatgcgcatgtgctggcaattcaaccccaagatgaggccaaccttcctggagattgtcaacctgctcaaggacgacctgcaccccagctttccagaggtgtcgttcttccacagcgaggagaacaaggctcccgagagtgaggagctggagatggagtttgaggacatggagaatgtgcccctggaccgttcctcgcactgtcagagggaggaggcggggggccgggatggagggtcctcgctgggtttcaagcggagctacgaggaacacatcccttacacacacatgaacggaggcaagaaaaacgggcggattctgaccttgcctcggtccaatccttcctaacagtgcctaccgtggcgggggcgggcaggggttcccattttcgctttcctctggtttgaaagcctctggaaaactcaggattctcacgactctaccatgtccaatggagttcagagatcgttcctatacatttctgttcatcttaaggtggactcgtttggttaccaatttaactagtcctgcagaggatttaactgtgaacctggagggcaaggggtttccacagttgctgctcctttggggcaacgacggtttcaaaccaggattttgtgttttttcgttccccccacccgcccccagcagatggaaagaaagcacctgtttttacaaattctttttttttttttttttttttgctggtgtctgagcttcagtataaaagacaaaacttcctgtttgtggaacaaaagttcgaaagaaaaaacaaaacaaaaacacccagccctgttccaggagaatttcaagttttacaggttgagcttcaagatggtttttttggttttttttttttctctcatccaggctgaaggattttttttttctttacaaaatgagttcctcaaattgaccaatagctgctgctttcatattttggataagggtctgtggtcccggcgtgtgctcacgtgtgtatgcacgtgtgtgtgtccattagacacggctgatgtgtgtgcaaagtatccatgcggagttgatgctttgggaattggctcatgaaggttcttctcaagggtgcgagctcatccccctctctccttccttcttattgactgggagactgtgctctcgacagattcttcttgtgtcagaagtctagcctcaggtttctaccctcccttcacattggtggccaagggaggagcatttcatttggagtgattatgaatcttttcaagaccaaaccaagctaggacattaaaaaaaaaaaaagaaaaagaaagaaaaaacaaaatggaaaaaggaaaaaaaaaaagaactgagatgacagagttttgagaatatatttgtaccatatttaatttttaaagtctctggtattagcctcataagttattgactattccccggggttggcggggagtggggacatgagttggtctgcctgttgtggggccgggaaggggagggagtcaggcacaagtggcctctttgtttggtcttaaaggcatccatttctgggaatgaagccatgttcgctgctaacacttttggatgttgtgaggccacgtggagtgtgtgagagactaggttttatggatggtctggttcaggtaccaggtctgctggaaggttcctgttcggataagctggtagctacctagctctgagcctgccttcaagaacacctgtgttcatcctctgattctctgtgtgtacctcttgtggcgtttcctctcccgggtgtgaacatcctaaccgttattgtgcaaacccaagaacgtcagatcccaaagcacaacaacctggatggactttgggaacatctaagcaatgtaagagagaggtgcactgagagtacgtcttggtcccctccaccctgagagcatctgacggtcctcagtactgaactcccggaagctgctctgagcccggtgacctcatctgggccaggtgtggtgcctgagctgaatgctcaggtgcttacagtgttgcaatccctaagagagtagagtctggaggagaaaccgtgaaaaagaccttacacaccaccaagaacttccgaatgggcgtgaatccaccgtttcttctctttgcaaaaagaaccaccacagctgctcaaagaacacagtgaactcatcactttggttcatcaaaaaatcatcgcccatgcgttattcctgagtgcattttcttacaactttttgactgcttccttttcttcttctcttaagagttgtgggcttaagaatgggatagagtcataatggcaacctccaagccctctcaattcttgattaagaacacaggtagacatgaatcccaattgtctattgctatcttatttatatgattcgggaaaatacagcatgtaaaaatattgctgaggagcctcagtgattgggtacaagaagcaagagtacagaaattatttttgccaaatttattttgtaaatatgagggtctgtacctaaatttaaaaaaaaaaacacgtagaactaggtattttgttctcttcttagtaaatttgtagtggttgtatactacactagctgcaattttcacatttttctaattcagaaaggtttttcttatattaggggaaaaagtatttattttaatatataaaatcactctgaaaatcactctcataaaaaatggagcgcatgtaaatttttatcaaagaaaaataaacaggtgaatggggatagtgattttcttttttcagcacagtctacctcagtgtattgttaagatgtgattcaatcatggacatctttgagatttcagaattctacctggaaccggtctgaatcagggaacgtgtgtatcagctgattcgaatgccagggaccagtaagaattttgagggagggagttgggatggagaaggtatggcctttatgcgagcatagatccttttcttcctggctggtaatattcttctctgaatttaatcttcctttaaaaaaaaatcctccatctattgtcactatgttccccaaacataaactaagttccaggctgtcatgatgtatctgatatatggggtaacccagcaaggtgtaccttcctttggtgagagatggctgccggggcaaagacgggctttgattcagagcaagcattcccacctgttccatggaatccccctgaagtgagcacaaaggtgccctgggctccctgatggtttatgcccactcctttcaggctggtgatgcaccttacacacaaacacctaatgcaatgtctttttaaattctccaagtgggatgggagcatgtgagggaaattccaatccaaaacccattaatgtgctgaacgctttttttttttttttttttttttgcaacaacaccttggacctctgtgttggggtttgactgacctcaagctgatattattggaccttgtgcagctttgataacccatgtgagagtctaggcaggaccagtggggcccaaatcttgctgctcttgtacttttaggcactgcccttgcagactcacctttctccacctgccctggagaaaggtagggtgtgctgggcctgccccttgcaaatgggattcaccagtttcatttatttgactctactgccacagtgaaaagagcaaacagctattgggttgcaaacctcctttgacattaggaaatgttgactttgtaacaataaaactttggtcctagaaagacacggttgtcctgggagtttgtagtgttaagttgcaacaacaacaacaaaaagcaacaaaaccagcttaggataacactttttgttgcttgttcttaaagatgtctcactatgattaaaacccttttcattaatgtagtgaaagccacacaggagttccttcttccaggaggagaataccaagcacatcactttctctctgcatcagtgatgtcaaatacgcatcagaaaatgttcaggttttaggagctgtcctaggtgctgtttcatcattggaagcagtgagaaagagaagcactgctgcttgtctggatataggctgaggatgattgagagaagctgtgggaactgacacaagggtctgcataggtcatcctgtgaccctggggactatgttaccaactgacagacagatctttcactgtatcctagcagggcaggtagtccaccaagaaatgtgcttattggattgggaggtgtttatttgtagtctgctgtaacacgtgtgaaagagcaggagcgtcatcagcatatgacttgcgctggtcatccggtaaatggatgtgctgtagtcccagtgctaatcatttctctccttcacagtgggtggaagtttagggttaaatgtcctttgaatgtcacctggtgagtccttgacaccttaggctcttcagaaacaatggttttgttgaggatggggaacagggaatgccgattttatatacatggtacacagagaggggtgtcacttcagaaaatcttccagcatgttcttcagaatattaatttatatgcgaggtgaggttgggaatgaaaagaacaggtcagcacttttttttttcctagaacatacaaaagaacatggtggactttcagggagtgcaatggaaggtgaatatttccttaagggtccccgagaaatgggagtggaatgcatgttcctttactgtcttctttgcaacatactt

SEQ ID NO: 448382 - DNA, 9130 bp, Homo sapiens
  misc_feature (1047)..(1047): n is a, c, g, or t
  misc_feature (1776)..(1776): n is a, c, g, or t
ggggggctgcgcggccgggtcggtgcgcacacgagaaggacgcgcggcccccagcgctcttgggggccgcctcggagcatgacccccgcgggccagcgccgcgcgcctgatccgaggagaccccgcgctcccgcagccatgggcaccgggggccggcggggggcggcggccgcgccgctgctggtggcggtggccgcgctgctactgggcgccgcgggccacctgtaccccggagaggtgtgtcccggcatggatatccggaacaacctcactaggttgcatgagctggagaattgctctgtcatcgaaggacacttgcagatactcttgatgttcaaaacgaggcccgaagatttccgagacctcagtttccccaaactcatcatgatcactgattacttgctgctcttccgggtctatgggctcgagagcctgaaggacctgttccccaacctcacggtcatccggggatcacgactgttctttaactacgcgctggtcatcttcgagatggttcacctcaaggaactcggcctctacaacctgatgaacatcacccggggttctgtccgcatcgagaagaacaatgagctctgttacttggccactatcgactggtcccgtatcctggattccgtggaggataattacatcgtgttgaacaaagatgacaacgaggagtgtggagacatctgtccgggtaccgcgaagggcaagaccaactgccccgccaccgtcatcaacgggcagtttgtcgaacgatgttggactcatagtcactgccagaaagtttgcccgaccatctgtaagtcacacggctgcaccgccgaaggcctctgttgccacagcgagtgcctgggcaactgttctcagcccgacgaccccaccaagtgcgtggcctgccgcaacttctacctggacggcaggtgtgtggagacctgcccgcccccgtactaccacttccaggactggcgctgtgtgaacttcagcttctgccaggacctgcaccacaaatgcaagaactcgcggaggcagggctgccaccantacgtcattcacaacaacaagtgcatccctgagtgtccctccgggtacacgatgaattccagcaacttgctgtgcaccccatgcctgggtccctgtcccaaggtgtgccacctcctagaaggcgagaagaccatcgactcggtgacgtctgcccaggagctccgaggatgcaccgtcatcaacgggagtctgatcatcaacattcgaggaggcaacaatctggcagctgagctagaagccaacctcggcctcattgaagaaatttcagggtatctaaaaatccgccgatcctacgctctggtgtcactttccttcttccggaagttacgtctgattcgaggagagaccttggaaattgggaactactccttctatgccttggacaaccagaacctaaggcagctctgggactggagcaaacacaacctcaccatcactcaggggaaactcttcttccactataaccccaaactctgcttgtcagaaatccacaagatggaagaagtttcaggaaccaaggggcgccaggagagaaacgacattgccctgaagaccaatggggaccaggcatcctgtgaaaatgagttacttaaattttcttacattcggacatcttttgacaagatcttgctgagatgggagccgtactggccccccgacttccgagacctcttggggttcatgctgttctacaaagaggccccttatcagaatgtgacggagttcgangggcaggatgcgtgtggttccaacagttggacggtggtagacattgacccacccctgaggtccaacgaccccaaatcacagaaccacccagggtggctgatgcggggtctcaagccctggacccagtatgccatctttgtgaagaccctggtcaccttttcggatgaacgccggacctatggggccaagagtgacatcatttatgtccagacagatgccaccaacccctctgtgcccctggatccaatctcagtgtctaactcatcatcccagattattctgaagtggaaaccaccctccgaccccaatggcaacatcacccactacctggttttctgggagaggcaggcggaagacagtgagctgttcgagctggattattgcctcaaagggctgaagctgccctcgaggacctggtctccaccattcgagtctgaagattctcagaagcacaaccagagtgagtatgaggattcggccggcgaatgctgctcctgtccaaagacagactctcagatcctgaaggagctggaggagtcctcgtttaggaagacgtttgaggattacctgcacaacgtggttttcgtccccagaaaaacctcttcaggcactggtgccgaggaccctaggccatctcggaaacgcaggtcccttggcgatgttgggaatgtgacggtggccgtgcccacggtggcagctttccccaacacttcctcgaccagcgtgcccacgagtccggaggagcacaggccttttgagaaggtggtgaacaaggagtcgctggtcatctccggcttgcgacacttcacgggctatcgcatcgagctgcaggcttgcaaccaggacacccctgaggaacggtgcagtgtggcagcctacgtcagtgcgaggaccatgcctgaagccaaggctgatgacattgttggccctgtgacgcatgaaatctttgagaacaacgtcgtccacttgatgtggcaggagccgaaggagcccaatggtctgatcgtgctgtatgaagtgagttatcggcgatatggtgatgaggagctgcatctctgcgtctcccgcaagcacttcgctctggaacggggctgcaggctgcgtgggctgtcaccggggaactacagcgtgcgaatccgggccacctcccttgcgggcaacggctcttggacggaacccacctatttctacgtgacagactatttagacgtcccgtcaaatattgcaaaaattatcatcggccccctcatctttgtctttctcttcagtgttgtgattggaagtatttatctattcctgagaaagaggcagccagatgggccgctgggaccgctttacgcttcttcaaaccctgagtatctcagtgccagtgatgtgtttccatgctctgtgtacgtgccggacgagtgggaggtgtctcgagagaagatcaccctccttcgagagctggggcagggctccttcggcatggtgtatgagggcaatgccagggacatcatcaagggtgaggcagagacccgcgtggcggtgaagacggtcaacgagtcagccagtctccgagagcggattgagttcctcaatgaggcctcggtcatgaagggcttcacctgccatcacgtggtgcgcctcctgggagtggtgtccaagggccagcccacgctggtggtgatggagctgatggctcacggagacctgaagagctacctccgttctctgcggccagaggctgagaataatcctggccgccctccccctacccttcaagagatgattcagatggcggcagagattgctgacgggatggcctacctgaacgccaagaagtttgtgcatcgggacctggcagcgagaaactgcatggtcgcccatgattttactgtcaaaattggaggttcgtctggctttctgctttgaaaacataacgacccaggccagactttggaatgaccagagacatctatgaaacggattactaccggaaagggggcaagggtctgctccctgtacggtggatggcaccggagtccctgaaggatggggtcttcaccacttcttctgacatgtggtcctttggcgtggtcctttgggaaatcaccagcttggcagaacagccttaccaaggcctgtctaatgaacaggtgttgaaatttgtcatggatggagggtatctggatcaacccgacaactgtccagagagagtcactgacctcatgcgcatgtgctggcaattcaaccccaagatgaggccaaccttcctggagattgtcaacctgctcaaggacgacctgcaccccagctttccagaggtgtcgttcttccacagcgaggagaacaaggctcccgagagtgaggagctggagatggagtttgaggacatggagaatgtgcccctggaccgttcctcgcactgtcagagggaggaggcggggggccgggatggagggtcctcgctgggtttcaagcggagctacgaggaacacatcccttacacacacatgaacggaggcaagaaaaacgggcggattctgaccttgcctcggtccaatccttcctaacagtgcctaccgtggcgggggcgggcaggggttcccattttcgctttcctctggtttgaaagcctctggaaaactcaggattctcacgactctaccatgtccaatggagttcagagatcgttcctatacatttctgttcatcttaaggtggactcgtttggttaccaatttaactagtcctgcagaggatttaactgtgaacctggagggcaaggggtttccacagttgctgctcctttggggcaacgacggtttcaaaccaggattttgtgttttttcgttccccccacccgcccccagcagatggaaagaaagcacctgtttttacaaattctttttttttttttttttttttgctggtgtctgagcttcagtataaaagacaaaacttcctgtttgtggaacaaaagttcgaaagaaaaaacaaaacaaaaacacccagccctgttccaggagaatttcaagttttacaggttgagcttcaagatggtttttttggttttttttttttctctcatccaggctgaaggattttttttttctttacaaaatgagttcctcaaattgaccaatagctgctgctttcatattttggataagggtctgtggtcccggcgtgtgctcacgtgtgtatgcacgtgtgtgtgtccattagacacggctgatgtgtgtgcaaagtatccatgcggagttgatgctttgggaattggctcatgaaggttcttctcaagggtgcgagctcatccccctctctccttccttcttattgactgggagactgtgctctcgacagattcttcttgtgtcagaagtctagcctcaggtttctaccctcccttcacattggtggccaagggaggagcatttcatttggagtgattatgaatcttttcaagaccaaaccaagctaggacattaaaaaaaaaaaaagaaaaagaaagaaaaaacaaaatggaaaaaggaaaaaaaaaaagaactgagatgacagagttttgagaatatatttgtaccatatttaatttttaaagtctctggtattagcctcataagttattgactattccccggggttggcggggagtggggacatgagttggtctgcctgttgtggggccgggaaggggagggagtcaggcacaagtggcctctttgtttggtcttaaaggcatccatttctgggaatgaagccatgttcgctgctaacacttttggatgttgtgaggccacgtggagtgtgtgagagactaggttttatggatggtctggttcaggtaccaggtctgctggaaggttcctgttcggataagctggtagctacctagctctgagcctgccttcaagaacacctgtgttcatcctctgattctctgtgtgtacctcttgtggcgtttcctctcccgggtgtgaacatcctaaccgttattgtgcaaacccaagaacgtcagatcccaaagcacaacaacctggatggactttgggaacatctaagcaatgtaagagagaggtgcactgagagtacgtcttggtcccctccaccctgagagcatctgacggtcctcagtactgaactcccggaagctgctctgagcccggtgacctcatctgggccaggtgtggtgcctgagctgaatgctcaggtgcttacagtgttgcaatccctaagagagtagagtctggaggagaaaccgtgaaaaagaccttacacaccaccaagaacttccgaatgggcgtgaatccaccgtttcttctctttgcaaaaagaaccaccacagctgctcaaagaacacagtgaactcatcactttggttcatcaaaaaatcatcgcccatgcgttattcctgagtgcattttcttacaactttttgactgcttccttttcttcttctcttaagagttgtgggcttaagaatgggatagagtcataatggcaacctccaagccctctcaattcttgattaagaacacaggtagacatgaatcccaattgtctattgctatcttatttatatgattcgggaaaatacagcatgtaaaaatattgctgaggagcctcagtgattgggtacaagaagcaagagtacagaaattatttttgccaaatttattttgtaaatatgagggtctgtacctaaatttaaaaaaaaaaacacgtagaactaggtattttgttctcttcttagtaaatttgtagtggttgtatactacactagctgcaattttcacatttttctaattcagaaaggtttttcttatattaggggaaaaagtatttattttaatatataaaatcactctgaaaatcactctcataaaaaatggagcgcatgtaaatttttatcaaagaaaaataaacaggtgaatggggatagtgattttcttttttcagcacagtctacctcagtgtattgttaagatgtgattcaatcatggacatctttgagatttcagaattctacctggaaccggtctgaatcagggaacgtgtgtatcagctgattcgaatgccagggaccagtaagaattttgagggagggagttgggatggagaaggtatggcctttatgcgagcatagatccttttcttcctggctggtaatattcttctctgaatttaatcttcctttaaaaaaaaatcctccatctattgtcactatgttccccaaacataaactaagttccaggctgtcatgatgtatctgatatatggggtaacccagcaaggtgtaccttcctttggtgagagatggctgccggggcaaagacgggctttgattcagagcaagcattcccacctgttccatggaatccccctgaagtgagcacaaaggtgccctgggctccctgatggtttatgcccactcctttcaggctggtgatgcaccttacacacaaacacctaatgcaatgtctttttaaattctccaagtgggatgggagcatgtgagggaaattccaatccaaaacccattaatgtgctgaacgctttttttttttttttttttttttgcaacaacaccttggacctctgtgttggggtttgactgacctcaagctgatattattggaccttgtgcagctttgataacccatgtgagagtctaggcaggaccagtggggcccaaatcttgctgctcttgtacttttaggcactgcccttgcagactcacctttctccacctgccctggagaaaggtagggtgtgctgggcctgccccttgcaaatgggattcaccagtttcatttatttgactctactgccacagtgaaaagagcaaacagctattgggttgcaaacctcctttgacattaggaaatgttgactttgtaacaataaaactttggtcctagaaagacacggttgtcctgggagtttgtagtgttaagttgcaacaacaacaacaaaaagcaacaaaaccagcttaggataacactttttgttgcttgttcttaaagatgtctcactatgattaaaacccttttcattaatgtagtgaaagccacacaggagttccttcttccaggaggagaataccaagcacatcactttctctctgcatcagtgatgtcaaatacgcatcagaaaatgttcaggttttaggagctgtcctaggtgctgtttcatcattggaagcagtgagaaagagaagcactgctgcttgtctggatataggctgaggatgattgagagaagctgtgggaactgacacaagggtctgcataggtcatcctgtgaccctggggactatgttaccaactgacagacagatctttcactgtatcctagcagggcaggtagtccaccaagaaatgtgcttattggattgggaggtgtttatttgtagtctgctgtaacacgtgtgaaagagcaggagcgtcatcagcatatgacttgcgctggtcatccggtaaatggatgtgctgtagtcccagtgctaatcatttctctccttcacagtgggtggaagtttagggttaaatgtcctttgaatgtcacctggtgagtccttgacaccttaggctcttcagaaacaatggttttgttgaggatggggaacagggaatgccgattttatatacatggtacacagagaggggtgtcacttcagaaaatcttccagcatgttcttcagaatattaatttatatgcgaggtgaggttgggaatgaaaagaacaggtcagcacttttttttttcctagaacatacaaaagaacatggtggactttcagggagtgcaatggaaggtgaatatttccttaagggtccccgagaaatgggagtgaggggaggggacacaatggctttttgagcttacttttaccttctgatactagtcaaggtccagaaccagccaccagccaaatttctatctgggtgcgggccactgaaaatccttgttaaaaaccagatcacaaatctggggctcttggtcccattggagaaggaaggaagagcctcaaaataagtgtgcacccatgcacatattcaggaacagcttgtttagtctttacactttgcctgaaagttgcttctcctcgtccctttgtgtgcctgggtggcctcggccctgtgcgttggcaacgcaggatcaaatgtgctgcagcttttgcagaaaacaactcagaaacacaaaaccccccaacagctcaattattattttttcaatgttttcctacaagagccaagtagcaccatgtacagaagacgcctttttttttggaatattgaaatcgttctgcatgtaaaatatgggataatgacctgtttatattaaaattctgattaaattatctgagaata

SEQ ID NO: 448383 - DNA, 6329 bp, Homo sapiens
gggtggacactcccagatgtgcaaagctcagccaccctccttctcctcctctcttcctcccaggagctgcatctctgcgtctcccgcaagcacttcgctctggaacggggctgcaggctgcgtgggctgtcaccggggaactacagcgtgcgaatccgggccacctcccttgcgggcaacggctcttggacggaacccacctatttctacgtgacagactatttagacgtcccgtcaaatattgcaaaaattatcatcggccccctcatctttgtctttctcttcagtgttgtgattggaagtatttatctattcctgagaaagaggcagccagatgggccgctgggaccgctttacgcttcttcaaaccctgagtatctcagtgccagtgatgtgtttccatgctctgtgtacgtgccggacgagtgggaggtgtctcgagagaagatcaccctccttcgagagctggggcagggctccttcggcatggtgtatgagggcaatgccagggacatcatcaagggtgaggcagagacccgcgtggcggtgaagacggtcaacgagtcagccagtctccgagagcggattgagttcctcaatgaggcctcggtcatgaagggcttcacctgccatcacgtggtgcgcctcctgggagtggtgtccaagggccagcccacgctggtggtgatggagctgatggctcacggagacctgaagagctacctccgttctctgcggccagaggctgagaataatcctggccgccctccccctacccttcaagagatgattcagatggcggcagagattgctgacgggatggcctacctgaacgccaagaagtttgtgcatcgggacctggcagcgagaaactgcatggtcgcccatgattttactgtcaaaattggagactttggaatgaccagagacatctatgaaacggattactaccggaaagggggcaagggtctgctccctgtacggtggatggcaccggagtccctgaaggatggggtcttcaccacttcttctgacatgtggtcctttggcgtggtcctttgggaaatcaccagcttggcagaacagccttaccaaggcctgtctaatgaacaggtgttgaaatttgtcatggatggagggtatctggatcaacccgacaactgtccagagagagtcactgacctcatgcgcatgtgctggcaattcaaccccaagatgaggccaaccttcctggagattgtcaacctgctcaaggacgacctgcaccccagctttccagaggtgtcgttcttccacagcgaggagaacaaggctcccgagagtgaggagctggagatggagtttgaggacatggagaatgtgcccctggaccgttcctcgcactgtcagagggaggaggcggggggccgggatggagggtcctcgctgggtttcaagcggagctacgaggaacacatcccttacacacacatgaacggaggcaagaaaaacgggcggattctgaccttgcctcggtccaatccttcctaacagtgcctaccgtggcgggggcgggcaggggttcccattttcgctttcctctggtttgaaagcctctggaaaactcaggattctcacgactctaccatgtccaatggagttcagagatcgttcctatacatttctgttcatcttaaggtggactcgtttggttaccaatttaactagtcctgcagaggatttaactgtgaacctggagggcaaggggtttccacagttgctgctcctttggggcaacgacggtttcaaaccaggattttgtgttttttcgttccccccacccgcccccagcagatggaaagaaagcacctgtttttacaaattctttttttttttttttttttttgctggtgtctgagcttcagtataaaagacaaaacttcctgtttgtggaacaaaagttcgaaagaaaaaacaaaacaaaaacacccagccctgttccaggagaatttcaagttttacaggttgagcttcaagatggtttttttggttttttttttttctctcatccaggctgaaggattttttttttctttacaaaatgagttcctcaaattgaccaatagctgctgctttcatattttggataagggtctgtggtcccggcgtgtgctcacgtgtgtatgcacgtgtgtgtgtccattagacacggctgatgtgtgtgcaaagtatccatgcggagttgatgctttgggaattggctcatgaaggttcttctcaagggtgcgagctcatccccctctctccttccttcttattgactgggagactgtgctctcgacagattcttcttgtgtcagaagtctagcctcaggtttctaccctcccttcacattggtggccaagggaggagcatttcatttggagtgattatgaatcttttcaagaccaaaccaagctaggacattaaaaaaaaaaaaagaaaaagaaagaaaaaacaaaatggaaaaaggaaaaaaaaaaagaactgagatgacagagttttgagaatatatttgtaccatatttaatttttaaagtctctggtattagcctcataagttattgactattccccggggttggcggggagtggggacatgagttggtctgcctgttgtggggccgggaaggggagggagtcaggcacaagtggcctctttgtttggtcttaaaggcatccatttctgggaatgaagccatgttcgctgctaacacttttggatgttgtgaggccacgtggagtgtgtgagagactaggttttatggatggtctggttcaggtaccaggtctgctggaaggttcctgttcggataagctggtagctacctagctctgagcctgccttcaagaacacctgtgttcatcctctgattctctgtgtgtacctcttgtggcgtttcctctcccgggtgtgaacatcctaaccgttattgtgcaaacccaagaacgtcagatcccaaagcacaacaacctggatggactttgggaacatctaagcaatgtaagagagaggtgcactgagagtacgtcttggtcccctccaccctgagagcatctgacggtcctcagtactgaactcccggaagctgctctgagcccggtgacctcatctgggccaggtgtggtgcctgagctgaatgctcaggtgcttacagtgttgcaatccctaagagagtagagtctggaggagaaaccgtgaaaaagaccttacacaccaccaagaacttccgaatgggcgtgaatccaccgtttcttctctttgcaaaaagaaccaccacagctgctcaaagaacacagtgaactcatcactttggttcatcaaaaaatcatcgcccatgcgttattcctgagtgcattttcttacaactttttgactgcttccttttcttcttctcttaagagttgtgggcttaagaatgggatagagtcataatggcaacctccaagccctctcaattcttgattaagaacacaggtagacatgaatcccaattgtctattgctatcttatttatatgattcgggaaaatacagcatgtaaaaatattgctgaggagcctcagtgattgggtacaagaagcaagagtacagaaattatttttgccaaatttattttgtaaatatgagggtctgtacctaaatttaaaaaaaaaaacacgtagaactaggtattttgttctcttcttagtaaatttgtagtggttgtatactacactagctgcaattttcacatttttctaattcagaaaggtttttcttatattaggggaaaaagtatttattttaatatataaaatcactctgaaaatcactctcataaaaaatggagcgcatgtaaatttttatcaaagaaaaataaacaggtgaatggggatagtgattttcttttttcagcacagtctacctcagtgtattgttaagatgtgattcaatcatggacatctttgagatttcagaattctacctggaaccggtctgaatcagggaacgtgtgtatcagctgattcgaatgccagggaccagtaagaattttgagggagggagttgggatggagaaggtatggcctttatgcgagcatagatccttttcttcctggctggtaatattcttctctgaatttaatcttcctttaaaaaaaaatcctccatctattgtcactatgttccccaaacataaactaagttccaggctgtcatgatgtatctgatatatggggtaacccagcaaggtgtaccttcctttggtgagagatggctgccggggcaaagacgggctttgattcagagcaagcattcccacctgttccatggaatccccctgaagtgagcacaaaggtgccctgggctccctgatggtttatgcccactcctttcaggctggtgatgcaccttacacacaaacacctaatgcaatgtctttttaaattctccaagtgggatgggagcatgtgagggaaattccaatccaaaacccattaatgtgctgaacgctttttttttttttttttttttttgcaacaacaccttggacctctgtgttggggtttgactgacctcaagctgatattattggaccttgtgcagctttgataacccatgtgagagtctaggcaggaccagtggggcccaaatcttgctgctcttgtacttttaggcactgcccttgcagactcacctttctccacctgccctggagaaaggtagggtgtgctgggcctgccccttgcaaatgggattcaccagtttcatttatttgactctactgccacagtgaaaagagcaaacagctattgggttgcaaacctcctttgacattaggaaatgttgactttgtaacaataaaactttggtcctagaaagacacggttgtcctgggagtttgtagtgttaagttgcaacaacaacaacaaaaagcaacaaaaccagcttaggataacactttttgttgcttgttcttaaagatgtctcactatgattaaaacccttttcattaatgtagtgaaagccacacaggagttccttcttccaggaggagaataccaagcacatcactttctctctgcatcagtgatgtcaaatacgcatcagaaaatgttcaggttttaggagctgtcctaggtgctgtttcatcattggaagcagtgagaaagagaagcactgctgcttgtctggatataggctgaggatgattgagagaagctgtgggaactgacacaagggtctgcataggtcatcctgtgaccctggggactatgttaccaactgacagacagatctttcactgtatcctagcagggcaggtagtccaccaagaaatgtgcttattggattgggaggtgtttatttgtagtctgctgtaacacgtgtgaaagagcaggagcgtcatcagcatatgacttgcgctggtcatccggtaaatggatgtgctgtagtcccagtgctaatcatttctctccttcacagtgggtggaagtttagggttaaatgtcctttgaatgtcacctggtgagtccttgacaccttaggctcttcagaaacaatggttttgttgaggatggggaacagggaatgccgattttatatacatggtacacagagaggggtgtcacttcagaaaatcttccagcatgttcttcagaatattaatttatatgcgaggtgaggttgggaatgaaaagaacaggtcagcacttttttttttcctagaacatacaaaagaacatggtggactttcagggagtgcaatggaaggtgaatatttccttaagggtccccgagaaatgggagtgaggggaggggacacaatggctttttgagcttacttttaccttctgatactagtcaaggtccagaaccagccaccagccaaatttctatctgggtgcgggccactgaaaatccttgttaaaaaccagatcacaaatctggggctcttggtcccattggagaaggaaggaagagcctcaaaataagtgtgcacccatgcacatattcaggaacagcttgtttagtctttacactttgcctgaaagttgcttctcctcgtccctttgtgtgcctgggtggcctcggccctgtgcgttggcaacgcaggatcaaatgtgctgcagcttttgcagaaaacaactcagaaacacaaaaccccccaacagctcaattattattttttcaatgttttcctacaagagccaagtagcaccatgtacagaagacgcctttttttttggaatattgaaatcgttctgcatgtaaaatatgggataatgacctgtttatattaaaattctgattaaattatctgagaata

SEQ ID NO: 448384 - DNA, 5496 bp, Homo sapiens
  misc_feature (1047)..(1047): n is a, c, g, or t
  misc_feature (1776)..(1776): n is a, c, g, or t
ggggggctgcgcggccgggtcggtgcgcacacgagaaggacgcgcggcccccagcgctcttgggggccgcctcggagcatgacccccgcgggccagcgccgcgcgcctgatccgaggagaccccgcgctcccgcagccatgggcaccgggggccggcggggggcggcggccgcgccgctgctggtggcggtggccgcgctgctactgggcgccgcgggccacctgtaccccggagaggtgtgtcccggcatggatatccggaacaacctcactaggttgcatgagctggagaattgctctgtcatcgaaggacacttgcagatactcttgatgttcaaaacgaggcccgaagatttccgagacctcagtttccccaaactcatcatgatcactgattacttgctgctcttccgggtctatgggctcgagagcctgaaggacctgttccccaacctcacggtcatccggggatcacgactgttctttaactacgcgctggtcatcttcgagatggttcacctcaaggaactcggcctctacaacctgatgaacatcacccggggttctgtccgcatcgagaagaacaatgagctctgttacttggccactatcgactggtcccgtatcctggattccgtggaggataattacatcgtgttgaacaaagatgacaacgaggagtgtggagacatctgtccgggtaccgcgaagggcaagaccaactgccccgccaccgtcatcaacgggcagtttgtcgaacgatgttggactcatagtcactgccagaaagtttgcccgaccatctgtaagtcacacggctgcaccgccgaaggcctctgttgccacagcgagtgcctgggcaactgttctcagcccgacgaccccaccaagtgcgtggcctgccgcaacttctacctggacggcaggtgtgtggagacctgcccgcccccgtactaccacttccaggactggcgctgtgtgaacttcagcttctgccaggacctgcaccacaaatgcaagaactcgcggaggcagggctgccaccantacgtcattcacaacaacaagtgcatccctgagtgtccctccgggtacacgatgaattccagcaacttgctgtgcaccccatgcctgggtccctgtcccaaggtgtgccacctcctagaaggcgagaagaccatcgactcggtgacgtctgcccaggagctccgaggatgcaccgtcatcaacgggagtctgatcatcaacattcgaggaggcaacaatctggcagctgagctagaagccaacctcggcctcattgaagaaatttcagggtatctaaaaatccgccgatcctacgctctggtgtcactttccttcttccggaagttacgtctgattcgaggagagaccttggaaattgggaactactccttctatgccttggacaaccagaacctaaggcagctctgggactggagcaaacacaacctcaccatcactcaggggaaactcttcttccactataaccccaaactctgcttgtcagaaatccacaagatggaagaagtttcaggaaccaaggggcgccaggagagaaacgacattgccctgaagaccaatggggaccaggcatcctgtgaaaatgagttacttaaattttcttacattcggacatcttttgacaagatcttgctgagatgggagccgtactggccccccgacttccgagacctcttggggttcatgctgttctacaaagaggccccttatcagaatgtgacggagttcgangggcaggatgcgtgtggttccaacagttggacggtggtagacattgacccacccctgaggtccaacgaccccaaatcacagaaccacccagggtggctgatgcggggtctcaagccctggacccagtatgccatctttgtgaagaccctggtcaccttttcggatgaacgccggacctatggggccaagagtgacatcatttatgtccagacagatgccaccaacccctctgtgcccctggatccaatctcagtgtctaactcatcatcccagattattctgaagtggaaaccaccctccgaccccaatggcaacatcacccactacctggttttctgggagaggcaggcggaagacagtgagctgttcgagctggattattgcctcaaagggctgaagctgccctcgaggacctggtctccaccattcgagtctgaagattctcagaagcacaaccagagtgagtatgaggattcggccggcgaatgctgctcctgtccaaagacagactctcagatcctgaaggagctggaggagtcctcgtttaggaagacgtttgaggattacctgcacaacgtggttttcgtccccagaaaaacctcttcaggcactggtgccgaggaccctaggccatctcggaaacgcaggtcccttggcgatgttgggaatgtgacggtggccgtgcccacggtggcagctttccccaacacttcctcgaccagcgtgcccacgagtccggaggagcacaggccttttgagaaggtggtgaacaaggagtcgctggtcatctccggcttgcgacacttcacgggctatcgcatcgagctgcaggcttgcaaccaggacacccctgaggaacggtgcagtgtggcagcctacgtcagtgcgaggaccatgcctgaagccaaggctgatgacattgttggccctgtgacgcatgaaatctttgagaacaacgtcgtccacttgatgtggcaggagccgaaggagcccaatggtctgatcgtgctgtatgaagtgagttatcggcgatatggtgatgaggagctgcatctctgcgtctcccgcaagcacttcgctctggaacggggctgcaggctgcgtgggctgtcaccggggaactacagcgtgcgaatccgggccacctcccttgcgggcaacggctcttggacggaacccacctatttctacgtgacagactatttagacgtcccgtcaaatattgcaaaaattatcatcggccccctcatctttgtctttctcttcagtgttgtgattggaagtatttatctattcctgagaaagaggcagccagatgggccgctgggaccgctttacgcttcttcaaaccctgagtatctcagtgccagtgatgtgtttccatgctctgtgtacgtgccggacgagtgggaggtgtctcgagagaagatcaccctccttcgagagctggggcagggctccttcggcatggtgtatgagggcaatgccagggacatcatcaagggtgaggcagagacccgcgtggcggtgaagacggtcaacgagtcagccagtctccgagagcggattgagttcctcaatgaggcctcggtcatgaagggcttcacctgccatcacgtggtgcgcctcctgggagtggtgtccaagggccagcccacgctggtggtgatggagctgatggctcacggagacctgaagagctacctccgttctctgcggccagaggctgagaataatcctggccgccctccccctacccttcaagagatgattcagatggcggcagagattgctgacgggatggcctacctgaacgccaagaagtttgtgcatcgggacctggcagcgagaaactgcatggtcgcccatgattttactgtcaaaattggagactttggaatgaccagagacatctatgaaacggattactaccggaaagggggcaagggtctgctccctgtacggtggatggcaccggagtccctgaaggatggggtcttcaccacttcttctgacatgtggtcctttggcgtggtcctttgggaaatcaccagcttggcagaacagccttaccaaggcctgtctaatgaacaggtgttgaaatttgtcatggatggagggtatctggatcaacccgacaactgtccagagagagtcactgacctcatgcgcatgtgctggcaattcaaccccaagatgaggccaaccttcctggagattgtcaacctgctcaaggacgacctgcaccccagctttccagaggtgtcgttcttccacagcgaggagaacaaggctcccgagagtgaggagctggagatggagtttgaggacatggagaatgtgcccctggaccgttcctcgcactgtcagagggaggaggcggggggccgggatggagggtcctcgctgggtttcaagcggagctacgaggaacacatcccttacacacacatgaacggaggcaagaaaaacgggcggattctgaccttgcctcggtccaatccttcctaacagtgcctaccgtggcgggggcgggcaggggttcccattttcgctttcctctggtttgaaagcctctggaaaactcaggattctcacgactctaccatgtccaatggagttcagagatcgttcctatacatttctgttcatcttaaggtggactcgtttggttaccaatttaactagtcctgcagaggatttaactgtgaacctggagggcaaggggtttccacagttgctgctcctttggggcaacgacggtttcaaaccaggattttgtgttttttcgttccccccacccgcccccagcagatggaaagaaagcacctgtttttacaaattctttttttttttttttttttttgctggtgtctgagcttcagtataaaagacaaaacttcctgtttgtggaacaaaagttcgaaagaaaaaacaaaacaaaaacacccagccctgttccaggagaatttcaagttttacaggttgagcttcaagatggtttttttggttttttttttttctctcatccaggctgaaggattttttttttctttacaaaatgagttcctcaaattgaccaatagctgctgctttcatattttggataagggtctgtggtcccggcgtgtgctcacgtgtgtatgcacgtgtgtgtgtccattagacacggctgatgtgtgtgcaaagtatccatgcggagttgatgctttgggaattggctcatgaaggttcttctcaagggtgcgagctcatccccctctctccttccttcttattgactgggagactgtgctctcgacagattcttcttgtgtcagaagtctagcctcaggtttctaccctcccttcacattggtggccaagggaggagcatttcatttggagtgattatgaatcttttcaagaccaaaccaagctaggacattaaaaaaaaaaaaaacaggaaaacggaaggaaaaaccaaatgtgggaaaagggagaaacacaaaaaggacttgtgaaatgtgacaggatgtttggagaaatttttggggcccaattttaacttttaaaggtcccgggatatttagcctcaataggtaatggactttcccccggggattaggggggaattgggggccattgagttggggcctgccgtgttgttgggcccggaaaggggacgggacgtcagggaccaatgtggccttatggagggccttaagggatcaattacgg

SEQ ID NO: 448385 - DNA, 8184 bp, Homo sapiens
  misc_feature (1047)..(1047): n is a, c, g, or t
  misc_feature (1776)..(1776): n is a, c, g, or t
ggggggctgcgcggccgggtcggtgcgcacacgagaaggacgcgcggcccccagcgctcttgggggccgcctcggagcatgacccccgcgggccagcgccgcgcgcctgatccgaggagaccccgcgctcccgcagccatgggcaccgggggccggcggggggcggcggccgcgccgctgctggtggcggtggccgcgctgctactgggcgccgcgggccacctgtaccccggagaggtgtgtcccggcatggatatccggaacaacctcactaggttgcatgagctggagaattgctctgtcatcgaaggacacttgcagatactcttgatgttcaaaacgaggcccgaagatttccgagacctcagtttccccaaactcatcatgatcactgattacttgctgctcttccgggtctatgggctcgagagcctgaaggacctgttccccaacctcacggtcatccggggatcacgactgttctttaactacgcgctggtcatcttcgagatggttcacctcaaggaactcggcctctacaacctgatgaacatcacccggggttctgtccgcatcgagaagaacaatgagctctgttacttggccactatcgactggtcccgtatcctggattccgtggaggataattacatcgtgttgaacaaagatgacaacgaggagtgtggagacatctgtccgggtaccgcgaagggcaagaccaactgccccgccaccgtcatcaacgggcagtttgtcgaacgatgttggactcatagtcactgccagaaagtttgcccgaccatctgtaagtcacacggctgcaccgccgaaggcctctgttgccacagcgagtgcctgggcaactgttctcagcccgacgaccccaccaagtgcgtggcctgccgcaacttctacctggacggcaggtgtgtggagacctgcccgcccccgtactaccacttccaggactggcgctgtgtgaacttcagcttctgccaggacctgcaccacaaatgcaagaactcgcggaggcagggctgccaccantacgtcattcacaacaacaagtgcatccctgagtgtccctccgggtacacgatgaattccagcaacttgctgtgcaccccatgcctgggtccctgtcccaaggtgtgccacctcctagaaggcgagaagaccatcgactcggtgacgtctgcccaggagctccgaggatgcaccgtcatcaacgggagtctgatcatcaacattcgaggaggcaacaatctggcagctgagctagaagccaacctcggcctcattgaagaaatttcagggtatctaaaaatccgccgatcctacgctctggtgtcactttccttcttccggaagttacgtctgattcgaggagagaccttggaaattgggaactactccttctatgccttggacaaccagaacctaaggcagctctgggactggagcaaacacaacctcaccatcactcaggggaaactcttcttccactataaccccaaactctgcttgtcagaaatccacaagatggaagaagtttcaggaaccaaggggcgccaggagagaaacgacattgccctgaagaccaatggggaccaggcatcctgtgaaaatgagttacttaaattttcttacattcggacatcttttgacaagatcttgctgagatgggagccgtactggccccccgacttccgagacctcttggggttcatgctgttctacaaagaggccccttatcagaatgtgacggagttcgangggcaggatgcgtgtggttccaacagttggacggtggtagacattgacccacccctgaggtccaacgaccccaaatcacagaaccacccagggtggctgatgcggggtctcaagccctggacccagtatgccatctttgtgaagaccctggtcaccttttcggatgaacgccggacctatggggccaagagtgacatcatttatgtccagacagatgccaccaacccctctgtgcccctggatccaatctcagtgtctaactcatcatcccagattattctgaagtggaaaccaccctccgaccccaatggcaacatcacccactacctggttttctgggagaggcaggcggaagacagtgagctgttcgagctggattattgcctcaaagggctgaagctgccctcgaggacctggtctccaccattcgagtctgaagattctcagaagcacaaccagagtgagtatgaggattcggccggcgaatgctgctcctgtccaaagacagactctcagatcctgaaggagctggaggagtcctcgtttaggaagacgtttgaggattacctgcacaacgtggttttcgtccccagaaaaacctcttcaggcactggtgccgaggaccctaggccatctcggaaacgcaggtcccttggcgatgttgggaatgtgacggtggccgtgcccacggtggcagctttccccaacacttcctcgaccagcgtgcccacgagtccggaggagcacaggccttttgagaaggtggtgaacaaggagtcgctggtcatctccggcttgcgacacttcacgggctatcgcatcgagctgcaggcttgcaaccaggacacccctgaggaacggtgcagtgtggcagcctacgtcagtgcgaggaccatgcctgaagccaaggctgatgacattgttggccctgtgacgcatgaaatctttgagaacaacgtcgtccacttgatgtggcaggagccgaaggagcccaatggtctgatcgtgctgtatgaagtgagttatcggcgatatggtgatgaggagctgcatctctgcgtctcccgcaagcacttcgctctggaacggggctgcaggctgcgtgggctgtcaccggggaactacagcgtgcgaatccgggccacctcccttgcgggcaacggctcttggacggaacccacctatttctacgtgacagactatttagacgtcccgtcaaatattgcaaaaattatcatcggccccctcatctttgtctttctcttcagtgttgtgattggaagtatttatctattcctgagaaagaggcagccagatgggccgctgggaccgctttacgcttcttcaaaccctgagtatctcagtgccagtgatgtgtttccatgctctgtgtacgtgccggacgagtgggaggtgtctcgagagaagatcaccctccttcgagagctggggcagggctccttcggcatggtgtatgagggcaatgccagggacatcatcaagggtgaggcagagacccgcgtggcggtgaagacggtcaacgagtcagccagtctccgagagcggattgagttcctcaatgaggcctcggtcatgaagggcttcacctgccatcacgtggtgcgcctcctgggagtggtgtccaagggccagcccacgctggtggtgatggagctgatggctcacggagacctgaagagctacctccgttctctgcggccagaggctgagaataatcctggccgccctccccctacccttcaagagatgattcagatggcggcagagattgctgacgggatggcctacctgaacgccaagaagtttgtgcatcgggacctggcagcgagaaactgcatggtcgcccatgattttactgtcaaaattggagactttggaatgaccagagacatctatgaaacggattactaccggaaagggggcaagggtctgctccctgtacggtggatggcaccggagtccctgaaggatggggtcttcaccacttcttctgacatgtggtcctttggcgtggtcctttgggaaatcaccagcttggcagaacagccttaccaaggcctgtctaatgaacaggtgttgaaatttgtcatggatggagggtatctggatcaacccgacaactgtccagagagagtcactgacctcatgcgcatgtgctggcaattcaaccccaagatgaggccaaccttcctggagattgtcaacctgctcaaggacgacctgcaccccagctttccagaggtgtcgttcttccacagcgaggagaacaaggctcccgagagtgaggagctggagatggagtttgaggacatggagaatgtgcccctggaccgttcctctctccttccttcttattgactgggagactgtgctctcgacagattcttcttgtgtcagaagtctagcctcaggtttctaccctcccttcacattggtggccaagggaggagcatttcatttggagtgattatgaatcttttcaagaccaaaccaagctaggacattaaaaaaaaaaaaagaaaaagaaagaaaaaacaaaatggaaaaaggaaaaaaaaaaagaactgagatgacagagttttgagaatatatttgtaccatatttaatttttaaagtctctggtattagcctcataagttattgactattccccggggttggcggggagtggggacatgagttggtctgcctgttgtggggccgggaaggggagggagtcaggcacaagtggcctctttgtttggtcttaaaggcatccatttctgggaatgaagccatgttcgctgctaacacttttggatgttgtgaggccacgtggagtgtgtgagagactaggttttatggatggtctggttcaggtaccaggtctgctggaaggttcctgttcggataagctggtagctacctagctctgagcctgccttcaagaacacctgtgttcatcctctgattctctgtgtgtacctcttgtggcgtttcctctcccgggtgtgaacatcctaaccgttattgtgcaaacccaagaacgtcagatcccaaagcacaacaacctggatggactttgggaacatctaagcaatgtaagagagaggtgcactgagagtacgtcttggtcccctccaccctgagagcatctgacggtcctcagtactgaactcccggaagctgctctgagcccggtgacctcatctgggccaggtgtggtgcctgagctgaatgctcaggtgcttacagtgttgcaatccctaagagagtagagtctggaggagaaaccgtgaaaaagaccttacacaccaccaagaacttccgaatgggcgtgaatccaccgtttcttctctttgcaaaaagaaccaccacagctgctcaaagaacacagtgaactcatcactttggttcatcaaaaaatcatcgcccatgcgttattcctgagtgcattttcttacaactttttgactgcttccttttcttcttctcttaagagttgtgggcttaagaatgggatagagtcataatggcaacctccaagccctctcaattcttgattaagaacacaggtagacatgaatcccaattgtctattgctatcttatttatatgattcgggaaaatacagcatgtaaaaatattgctgaggagcctcagtgattgggtacaagaagcaagagtacagaaattatttttgccaaatttattttgtaaatatgagggtctgtacctaaatttaaaaaaaaaaacacgtagaactaggtattttgttctcttcttagtaaatttgtagtggttgtatactacactagctgcaattttcacatttttctaattcagaaaggtttttcttatattaggggaaaaagtatttattttaatatataaaatcactctgaaaatcactctcataaaaaatggagcgcatgtaaatttttatcaaagaaaaataaacaggtgaatggggatagtgattttcttttttcagcacagtctacctcagtgtattgttaagatgtgattcaatcatggacatctttgagatttcagaattctacctggaaccggtctgaatcagggaacgtgtgtatcagctgattcgaatgccagggaccagtaagaattttgagggagggagttgggatggagaaggtatggcctttatgcgagcatagatccttttcttcctggctggtaatattcttctctgaatttaatcttcctttaaaaaaaaatcctccatctattgtcactatgttccccaaacataaactaagttccaggctgtcatgatgtatctgatatatggggtaacccagcaaggtgtaccttcctttggtgagagatggctgccggggcaaagacgggctttgattcagagcaagcattcccacctgttccatggaatccccctgaagtgagcacaaaggtgccctgggctccctgatggtttatgcccactcctttcaggctggtgatgcaccttacacacaaacacctaatgcaatgtctttttaaattctccaagtgggatgggagcatgtgagggaaattccaatccaaaacccattaatgtgctgaacgctttttttttttttttttttttttgcaacaacaccttggacctctgtgttggggtttgactgacctcaagctgatattattggaccttgtgcagctttgataacccatgtgagagtctaggcaggaccagtggggcccaaatcttgctgctcttgtacttttaggcactgcccttgcagactcacctttctccacctgccctggagaaaggtagggtgtgctgggcctgccccttgcaaatgggattcaccagtttcatttatttgactctactgccacagtgaaaagagcaaacagctattgggttgcaaacctcctttgacattaggaaatgttgactttgtaacaataaaactttggtcctagaaagacacggttgtcctgggagtttgtagtgttaagttgcaacaacaacaacaaaaagcaacaaaaccagcttaggataacactttttgttgcttgttcttaaagatgtctcactatgattaaaacccttttcattaatgtagtgaaagccacacaggagttccttcttccaggaggagaataccaagcacatcactttctctctgcatcagtgatgtcaaatacgcatcagaaaatgttcaggttttaggagctgtcctaggtgctgtttcatcattggaagcagtgagaaagagaagcactgctgcttgtctggatataggctgaggatgattgagagaagctgtgggaactgacacaagggtctgcataggtcatcctgtgaccctggggactatgttaccaactgacagacagatctttcactgtatcctagcagggcaggtagtccaccaagaaatgtgcttattggattgggaggtgtttatttgtagtctgctgtaacacgtgtgaaagagcaggagcgtcatcagcatatgacttgcgctggtcatccggtaaatggatgtgctgtagtcccagtgctaatcatttctctccttcacagtgggtggaagtttagggttaaatgtcctttgaatgtcacctggtgagtccttgacaccttaggctcttcagaaacaatggttttgttgaggatggggaacagggaatgccgattttatatacatggtacacagagaggggtgtcacttcagaaaatcttccagcatgttcttcagaatattaatttatatgcgaggtgaggttgggaatgaaaagaacaggtcagcacttttttttttcctagaacatacaaaagaacatggtggactttcagggagtgcaatggaaggtgaatatttccttaagggtccccgagaaatgggagtgaggggaggggacacaatggctttttgagcttacttttaccttctgatactagtcaaggtccagaaccagccaccagccaaatttctatctgggtgcgggccactgaaaatccttgttaaaaaccagatcacaaatctggggctcttggtcccattggagaaggaaggaagagcctcaaaataagtgtgcacccatgcacatattcaggaacagcttgtttagtctttacactttgcctgaaagttgcttctcctcgtccctttgtgtgcctgggtggcctcggccctgtgcgttggcaacgcaggatcaaatgtgctgcagcttttgcagaaaacaactcagaaacacaaaaccccccaacagctcaattattattttttcaatgttttcctacaagagccaagtagcaccatgtacagaagacgcctttttttttggaatattgaaatcgttctgcatgtaaaatatgggataatgacctgtttatattaaaattctgattaaattatctgagaata

SEQ ID NO: 448386 - DNA, 3885 bp, Homo sapiens
ggtcctgtaacctgtggacactgtcagctcaccatcagctgggagaggtggggccctggaggctaagcttagttgctgtaaacattagtgtagcaaggcaggaggcagcaagctccctctctccaaccccgaacacggatatatccgtgttcggggttggcggggagtggggacatgagttggtctgcctgttgtggggccgggaaggggagggagtcaggcacaagtggcctctttgtttggtcttaaaggcatccatttctgggaatgaagccatgttcgctgctaacacttttggatgttgtgaggccacgtggagtgtgtgagagactaggttttatggatggtctggttcaggtaccaggtctgctggaaggttcctgttcggataagctggtagctacctagctctgagcctgccttcaagaacacctgtgttcatcctctgattctctgtgtgtacctcttgtggcgtttcctctcccgggtgtgaacatcctaaccgttattgtgcaaacccaagaacgtcagatcccaaagcacaacaacctggatggactttgggaacatctaagcaatgtaagagagaggtgcactgagagtacgtcttggtcccctccaccctgagagcatctgacggtcctcagtactgaactcccggaagctgctctgagcccggtgacctcatctgggccaggtgtggtgcctgagctgaatgctcaggtgcttacagtgttgcaatccctaagagagtagagtctggaggagaaaccgtgaaaaagaccttacacaccaccaagaacttccgaatgggcgtgaatccaccgtttcttctctttgcaaaaagaaccaccacagctgctcaaagaacacagtgaactcatcactttggttcatcaaaaaatcatcgcccatgcgttattcctgagtgcattttcttacaactttttgactgcttccttttcttcttctcttaagagttgtgggcttaagaatgggatagagtcataatggcaacctccaagccctctcaattcttgattaagaacacaggtagacatgaatcccaattgtctattgctatcttatttatatgattcgggaaaatacagcatgtaaaaatattgctgaggagcctcagtgattgggtacaagaagcaagagtacagaaattatttttgccaaatttattttgtaaatatgagggtctgtacctaaatttaaaaaaaaaaacacgtagaactaggtattttgttctcttcttagtaaatttgtagtggttgtatactacactagctgcaattttcacatttttctaattcagaaaggtttttcttatattaggggaaaaagtatttattttaatatataaaatcactctgaaaatcactctcataaaaaatggagcgcatgtaaatttttatcaaagaaaaataaacaggtgaatggggatagtgattttcttttttcagcacagtctacctcagtgtattgttaagatgtgattcaatcatggacatctttgagatttcagaattctacctggaaccggtctgaatcagggaacgtgtgtatcagctgattcgaatgccagggaccagtaagaattttgagggagggagttgggatggagaaggtatggcctttatgcgagcatagatccttttcttcctggctggtaatattcttctctgaatttaatcttcctttaaaaaaaaatcctccatctattgtcactatgttccccaaacataaactaagttccaggctgtcatgatgtatctgatatatggggtaacccagcaaggtgtaccttcctttggtgagagatggctgccggggcaaagacgggctttgattcagagcaagcattcccacctgttccatggaatccccctgaagtgagcacaaaggtgccctgggctccctgatggtttatgcccactcctttcaggctggtgatgcaccttacacacaaacacctaatgcaatgtctttttaaattctccaagtgggatgggagcatgtgagggaaattccaatccaaaacccattaatgtgctgaacgctttttttttttttttttttttttgcaacaacaccttggacctctgtgttggggtttgactgacctcaagctgatattattggaccttgtgcagctttgataacccatgtgagagtctaggcaggaccagtggggcccaaatcttgctgctcttgtacttttaggcactgcccttgcagactcacctttctccacctgccctggagaaaggtagggtgtgctgggcctgccccttgcaaatgggattcaccagtttcatttatttgactctactgccacagtgaaaagagcaaacagctattgggttgcaaacctcctttgacattaggaaatgttgactttgtaacaataaaactttggtcctagaaagacacggttgtcctgggagtttgtagtgttaagttgcaacaacaacaacaaaaagcaacaaaaccagcttaggataacactttttgttgcttgttcttaaagatgtctcactatgattaaaacccttttcattaatgtagtgaaagccacacaggagttccttcttccaggaggagaataccaagcacatcactttctctctgcatcagtgatgtcaaatacgcatcagaaaatgttcaggttttaggagctgtcctaggtgctgtttcatcattggaagcagtgagaaagagaagcactgctgcttgtctggatataggctgaggatgattgagagaagctgtgggaactgacacaagggtctgcataggtcatcctgtgaccctggggactatgttaccaactgacagacagatctttcactgtatcctagcagggcaggtagtccaccaagaaatgtgcttattggattgggaggtgtttatttgtagtctgctgtaacacgtgtgaaagagcaggagcgtcatcagcatatgacttgcgctggtcatccggtaaatggatgtgctgtagtcccagtgctaatcatttctctccttcacagtgggtggaagtttagggttaaatgtcctttgaatgtcacctggtgagtccttgacaccttaggctcttcagaaacaatggttttgttgaggatggggaacagggaatgccgattttatatacatggtacacagagaggggtgtcacttcagaaaatcttccagcatgttcttcagaatattaatttatatgcgaggtgaggttgggaatgaaaagaacaggtcagcacttttttttttcctagaacatacaaaagaacatggtggactttcagggagtgcaatggaaggtgaatatttccttaagggtccccgagaaatgggagtgaggggaggggacacaatggctttttgagcttacttttaccttctgatactagtcaaggtccagaaccagccaccagccaaatttctatctgggtgcgggccactgaaaatccttgttaaaaaccagatcacaaatctggggctcttggtcccattggagaaggaaggaagagcctcaaaataagtgtgcacccatgcacatattcaggaacagcttgtttagtctttacactttgcctgaaagttgcttctcctcgtccctttgtgtgcctgggtggcctcggccctgtgcgttggcaacgcaggatcaaatgtgctgcagcttttgcagaaaacaactcagaaacacaaaaccccccaacagctcaattattattttttcaatgttttcctacaagagccaagtagcaccatgtacagaagacgcctttttttttggaatattgaaatcgttctgcatgtaaaatatgggataatgacctgtttatattaaaattctgattaaattatctgagaata

SEQ ID NO: 448387 - DNA, 2254 bp, Homo sapiens
  misc_feature (1047)..(1047): n is a, c, g, or t
  misc_feature (1776)..(1776): n is a, c, g, or t
ggggggctgcgcggccgggtcggtgcgcacacgagaaggacgcgcggcccccagcgctcttgggggccgcctcggagcatgacccccgcgggccagcgccgcgcgcctgatccgaggagaccccgcgctcccgcagccatgggcaccgggggccggcggggggcggcggccgcgccgctgctggtggcggtggccgcgctgctactgggcgccgcgggccacctgtaccccggagaggtgtgtcccggcatggatatccggaacaacctcactaggttgcatgagctggagaattgctctgtcatcgaaggacacttgcagatactcttgatgttcaaaacgaggcccgaagatttccgagacctcagtttccccaaactcatcatgatcactgattacttgctgctcttccgggtctatgggctcgagagcctgaaggacctgttccccaacctcacggtcatccggggatcacgactgttctttaactacgcgctggtcatcttcgagatggttcacctcaaggaactcggcctctacaacctgatgaacatcacccggggttctgtccgcatcgagaagaacaatgagctctgttacttggccactatcgactggtcccgtatcctggattccgtggaggataattacatcgtgttgaacaaagatgacaacgaggagtgtggagacatctgtccgggtaccgcgaagggcaagaccaactgccccgccaccgtcatcaacgggcagtttgtcgaacgatgttggactcatagtcactgccagaaagtttgcccgaccatctgtaagtcacacggctgcaccgccgaaggcctctgttgccacagcgagtgcctgggcaactgttctcagcccgacgaccccaccaagtgcgtggcctgccgcaacttctacctggacggcaggtgtgtggagacctgcccgcccccgtactaccacttccaggactggcgctgtgtgaacttcagcttctgccaggacctgcaccacaaatgcaagaactcgcggaggcagggctgccaccantacgtcattcacaacaacaagtgcatccctgagtgtccctccgggtacacgatgaattccagcaacttgctgtgcaccccatgcctgggtccctgtcccaaggtgtgccacctcctagaaggcgagaagaccatcgactcggtgacgtctgcccaggagctccgaggatgcaccgtcatcaacgggagtctgatcatcaacattcgaggaggcaacaatctggcagctgagctagaagccaacctcggcctcattgaagaaatttcagggtatctaaaaatccgccgatcctacgctctggtgtcactttccttcttccggaagttacgtctgattcgaggagagaccttggaaattgggaactactccttctatgccttggacaaccagaacctaaggcagctctgggactggagcaaacacaacctcaccatcactcaggggaaactcttcttccactataaccccaaactctgcttgtcagaaatccacaagatggaagaagtttcaggaaccaaggggcgccaggagagaaacgacattgccctgaagaccaatggggaccaggcatcctgtgaaaatgagttacttaaattttcttacattcggacatcttttgacaagatcttgctgagatgggagccgtactggccccccgacttccgagacctcttggggttcatgctgttctacaaagaggccccttatcagaatgtgacggagttcgangggcaggatgcgtgtggttccaacagttggacggtggtagacattgacccacccctgaggtccaacgaccccaaatcacagaaccacccagggtggctgatgcggggtctcaagccctggacccagtatgccatctttgtgaagaccctggtcaccttttcggatgaacgccggacctatggggccaagagtgacatcatttatgtccagacagatgccaccaacccctctgtgcccctggatccaatctcagtgtctaactcatcatcccagattattctgaagtggaaaccaccctccgaccccaatggcaacatcacccactacctggttttctgggagaggcaggcggaagacagtgagctgttcgagctggattattgcctcaaaggcagaagcaggaagcagggcagaagcaggaagcggcagaagcaggaagcagcagaagcaggaagcggcagaagcaggaagcgggtac

SEQ ID NO: 448388 - DNA, 1060 bp, Homo sapiens
ggggggctgcgcggccgggtcggtgcgcacacgagaaggacgcgcggcccccagcgctcttgggggccgcctcggagcatgacccccgcgggccagcgccgcgcgcctgatccgaggagaccccgcgctcccgcagccatgggcaccgggggccggcggggggcggcggccgcgccgctgctggtggcggtggccgcgctgctactgggcgccgcgggccacctgtaccccggagaggtgtgtcccggcatggatatccggaacaacctcactaggttgcatgagctggagaattgctctgtcatcgaaggacacttgcagatactcttgatgttcaaaacgaggcccgaagatttccgagacctcagtttccccaaactcatcatgatcactgattacttgctgctcttccgggtctatgggctcgagagcctgaaggacctgttccccaacctcacggtcatccggggatcacgactgttctttaactacgcgctggtcatcttcgagatggttcacctcaaggaactcggcctctacaacctgatgaacatcacccggggttctgtccgcatcgagaagaacaatgagctctgttacttggccactatcgactggtcccgtatcctggattccgtggaggataattacatcgtgttgaacaaagatgacaacgaggagtgtggagacatctgtccgggtaccgcgaagggcaagaccaactgccccgccaccgtcatcaacgggcagtttgtcgaacgatgttggactcatagtcactgccagaaaggtacgccggggatacagggttctaagcagtgtctcgtgccttgttctagaaagcttaaaatgttttatggcttaaaaatgttaaatggtcattaggtagggccggggaatagtgggtggtggcattcactagcccagggagtggcagacattttctgtaaagactcagatagtagatacttcagattttgcaggccatatggtctctgatgcaacgactcaattctgccactgtattggacaagcagccacaggcatgcataaatgtatg

SEQ ID NO: 448389 - DNA, 233 bp, Homo sapiens
cggacacatgtggcctccaagtgtcagagcccagtggtctgtctaatgaagttccctctgtcctcaaaggcgttggttttgtttccacagaaaaacctcttcaggcactggtgccgaggaccctaggtatgactcacctgtgcgacccctggtgcctgctccgcgcagggccggcggcgtgccaggcagatgcctcggagaacccaggggtttctctggctttttgcatgcgg

SEQ ID NO: 448390 - DNA, 305 bp, Homo sapiens
cgtgagtgtgagtggccaagttgcaaaactggctcttacctttgaatcttcccccattcatactcagccaggcacatggggaggagacccttaagggaatagcagcgtcacctctgccttctcacggtccctccaggaagtgtgggggtcccaggctttggtctgaaactacactgaaatagctcatttttgccttttgttttaacttttccaggtgaaaatgagttacttaaattttcttacattcggacatcttttgacaagatcttgctgagatgggagccgtactggccccccgacttccg

SEQ ID NO: 448391 - DNA, 202 bp, Homo sapiens
aaatgagttacttaaattttcttacattcggacatcttttgacaagatcttgctgagatgggagccgtactggccccccgacttccgagacctcttggggttcatgctgttctacaaagaggcgtaagtagaagagttagagagacgctgaggaggcgagggctggctggctctgtgcttgctacgtttgtgctccaatctg

SEQ ID NO: 448392 - DNA, 9086 bp, Homo sapiens
  misc_feature (1047)..(1047): n is a, c, g, or t
  misc_feature (1776)..(1776): n is a, c, g, or t
ggggggctgcgcggccgggtcggtgcgcacacgagaaggacgcgcggcccccagcgctcttgggggccgcctcggagcatgacccccgcgggccagcgccgcgcgcctgatccgaggagaccccgcgctcccgcagccatgggcaccgggggccggcggggggcggcggccgcgccgctgctggtggcggtggccgcgctgctactgggcgccgcgggccacctgtaccccggagaggtgtgtcccggcatggatatccggaacaacctcactaggttgcatgagctggagaattgctctgtcatcgaaggacacttgcagatactcttgatgttcaaaacgaggcccgaagatttccgagacctcagtttccccaaactcatcatgatcactgattacttgctgctcttccgggtctatgggctcgagagcctgaaggacctgttccccaacctcacggtcatccggggatcacgactgttctttaactacgcgctggtcatcttcgagatggttcacctcaaggaactcggcctctacaacctgatgaacatcacccggggttctgtccgcatcgagaagaacaatgagctctgttacttggccactatcgactggtcccgtatcctggattccgtggaggataattacatcgtgttgaacaaagatgacaacgaggagtgtggagacatctgtccgggtaccgcgaagggcaagaccaactgccccgccaccgtcatcaacgggcagtttgtcgaacgatgttggactcatagtcactgccagaaagtttgcccgaccatctgtaagtcacacggctgcaccgccgaaggcctctgttgccacagcgagtgcctgggcaactgttctcagcccgacgaccccaccaagtgcgtggcctgccgcaacttctacctggacggcaggtgtgtggagacctgcccgcccccgtactaccacttccaggactggcgctgtgtgaacttcagcttctgccaggacctgcaccacaaatgcaagaactcgcggaggcagggctgccaccantacgtcattcacaacaacaagtgcatccctgagtgtccctccgggtacacgatgaattccagcaacttgctgtgcaccccatgcctgggtccctgtcccaaggtgtgccacctcctagaaggcgagaagaccatcgactcggtgacgtctgcccaggagctccgaggatgcaccgtcatcaacgggagtctgatcatcaacattcgaggaggcaacaatctggcagctgagctagaagccaacctcggcctcattgaagaaatttcagggtatctaaaaatccgccgatcctacgctctggtgtcactttccttcttccggaagttacgtctgattcgaggagagaccttggaaattgggaactactccttctatgccttggacaaccagaacctaaggcagctctgggactggagcaaacacaacctcaccatcactcaggggaaactcttcttccactataaccccaaactctgcttgtcagaaatccacaagatggaagaagtttcaggaaccaaggggcgccaggagagaaacgacattgccctgaagaccaatggggaccaggcatcctgtgaaaatgagttacttaaattttcttacattcggacatcttttgacaagatcttgctgagatgggagccgtactggccccccgacttccgagacctcttggggttcatgctgttctacaaagaggccccttatcagaatgtgacggagttcgangggcaggatgcgtgtggttccaacagttggacggtggtagacattgacccacccctgaggtccaacgaccccaaatcacagaaccacccagggtggctgatgcggggtctcaagccctggacccagtatgccatctttgtgaagaccctggtcaccttttcggatgaacgccggacctatggggccaagagtgacatcatttatgtccagacagatgccaccaacccctctgtgcccctggatccaatctcagtgtctaactcatcatcccagattattctgaagtggaaaccaccctccgaccccaatggcaacatcacccactacctggttttctgggagaggcaggcggaagacagtgagctgttcgagctggattattgcctcaaagggctgaagctgccctcgaggacctggtctccaccattcgagtctgaagattctcagaagcacaaccagagtgagtatgaggattcggccggcgaatgctgctcctgtccaaagacagactctcagatcctgaaggagctggaggagtcctcgtttaggaagacgtttgaggattacctgcacaacgtggttttcgtccccagaaaaacctcttcaggcactggtgccgaggaccctaggccatctcggaaacgcaggtcccttggcgatgttgggaatgtgacggtggccgtgcccacggtggcagctttccccaacacttcctcgaccagcgtgcccacgagtccggaggagcacaggccttttgagaaggtggtgaacaaggagtcgctggtcatctccggcttgcgacacttcacgggctatcgcatcgagctgcaggcttgcaaccaggacacccctgaggaacggtgcagtgtggcagcctacgtcagtgcgaggaccatgcctgaagccaaggctgatgacattgttggccctgtgacgcatgaaatctttgagaacaacgtcgtccacttgatgtggcaggagccgaaggagcccaatggtctgatcgtgctgtatgaagtgagttatcggcgatatggtgatgaggagctgcatctctgcgtctcccgcaagcacttcgctctggaacggggctgcaggctgcgtgggctgtcaccggggaactacagcgtgcgaatccgggccacctcccttgcgggcaacggctcttggacggaacccacctatttctacgtgacagactatttagacgtcccgtcaaatattgcaaaaattatcatcggccccctcatctttgtctttctcttcagtgttgtgattggaagtatttatctattcctgagaaagaggcagccagatgggccgctgggaccgctttacgcttcttcaaaccctgagtatctcagtgccagtgatgtgtttccatgctctgtgtacgtgccggacgagtgggaggtgtctcgagagaagatcaccctccttcgagagctggggcagggctccttcggcatggtgtatgagggcaatgccagggacatcatcaagggtgaggcagagacccgcgtggcggtgaagacggtcaacgagtcagccagtctccgagagcggattgagttcctcaatgaggcctcggtcatgaagggcttcacctgccatcacgtggtgcgcctcctgggagtggtgtccaagggccagcccacgctggtggtgatggagctgatggctcacggagacctgaagagctacctccgttctctgcggccagaggctgagaataatcctggccgccctccccctacccttcaagagatgattcagatggcggcagagattgctgacgggatggcctacctgaacgccaagaagtttgtgcatcgggacctggcagcgagaaactgcatggtcgcccatgattttactgtcaaaattggagactttggaatgaccagagacatctatgaaacggattactaccggaaagggggcaagggtctgctccctgtacggtggatggcaccggagtccctgaaggatggggtcttcaccacttcttctgacatgtggtcctttggcgtggtcctttgggaaatcaccagcttggcagaacagccttaccaaggcctgtctaatgaacaggtgttgaaatttgtcatggatggagggtatctggatcaacccgacaactgtccagagagagtcactgacctcatgcgcatgtgctggcaattcaaccccaagatgaggccaaccttcctggagattgtcaacctgctcaaggacgacctgcaccccagctttccagaggtgtcgttcttccacagcgaggagaacaaggctcccgagagtgaggagctggagatggagtttgaggacatggagaatgtgcccctggaccgttcctcgcactgtcagagggaggaggcggggggccgggatggagggtcctcgctgggtttcaagcggagctacgaggaacacatcccttacacacacatgaacggaggcaagaaaaacgggcggattctgaccttgcctcggtccaatccttcctaacagtgcctaccgtggcgggggcgggcaggggttcccattttcgctttcctctggtttgaaagcctctggaaaactcaggattctcacgactctaccatgtccaatggagttcagagatcgttcctatacatttctgttcatcttaaggtggactcgtttggttaccaatttaactagtcctgcagaggatttaactgtgaacctggagggcaaggggtttccacagttgctgctcctttggggcaacgacggtttcaaaccaggattttgtgttttttcgttccccccacccgcccccagcagatggaaagaaagcacctgtttttacaaattctttttttttttttttttttttgctggtgtctgagcttcagtataaaagacaaaacttcctgtttgtggaacaaaagttcgaaagaaaaaacaaaacaaaaacacccagccctgttccaggagaatttcaagttttacaggttgagcttcaagatggtttttttggttttttttttttctctcatccaggctgaaggattttttttttctttacaaaatgagttcctcaaattgaccaatagctgctgctttcatattttggataagggtctgtggtcccggcgtgtgctcacgtgtgtatgcacgtgtgtgtgtccattagacacggctgatgtgtgtgcaaagtatccatgcggagttgatgctttgggaattggctcatgaaggttcttctcaagggtgcgagctcatccccctctctccttccttcttattgactgggagactgtgctctcgacagattcttcttgtgtcagaagtctagcctcaggtttctaccctcccttcacattggtggccaagggaggagcatttcatttggagtgattatgaatcttttcaagaccaaaccaagctaggacattaaaaaaaaaaaaagaaaaagaaagaaaaaacaaaatggaaaaaggaaaaaaaaaaagaactgagatgacagagttttgagaatatatttgtaccatatttaatttttaaagtctctggtattagcctcataagttattgactattccccggggttggcggggagtggggacatgagttggtctgcctgttgtggggccgggaaggggagggagtcaggcacaagtggcctctttgtttggtcttaaaggcatccatttctgggaatgaagccatgttcgctgctaacacttttggatgttgtgaggccacgtggagtgtgtgagagactaggttttatggatggtctggttcaggtaccaggtctgctggaaggttcctgttcggataagctggtagctacctagctctgagcctgccttcaagaacacctgtgttcatcctctgattctctgtgtgtacctcttgtggcgtttcctctcccgggtgtgaacatcctaaccgttattgtgcaaacccaagaacgtcagatcccaaagcacaacaacctggatggactttgggaacatctaagcaatgtaagagagaggtgcactgagagtacgtcttggtcccctccaccctgagagcatctgacggtcctcagtactgaactcccggaagctgctctgagcccggtgacctcatctgggccaggtgtggtgcctgagctgaatgctcaggtgcttacagtgttgcaatccctaagagagtagagtctggaggagaaaccgtgaaaaagaccttacacaccaccaagaacttccgaatgggcgtgaatccaccgtttcttctctttgcaaaaagaaccaccacagctgctcaaagaacacagtgaactcatcactttggttcatcaaaaaatcatcgcccatgcgttattcctgagtgcattttcttacaactttttgactgcttccttttcttcttctcttaagagttgtgggcttaagaatgggatagagtcataatggcaacctccaagccctctcaattcttgattaagaacacaggtagacatgaatcccaattgtctattgctatcttatttatatgattcgggaaaatacagcatgtaaaaatattgctgaggagcctcagtgattgggtacaagaagcaagagtacagaaattatttttgccaaatttattttgtaaatatgagggtctgtacctaaatttaaaaaaaaaaacacgtagaactaggtattttgttctcttcttagtaaatttgtagtggttgtatactacactagctgcaattttcacatttttctaattcagaaaggtttttcttatattaggggaaaaagtatttattttaatatataaaatcactctgaaaatcactctcataaaaaatggagcgcatgtaaatttttatcaaagaaaaataaacaggtgaatggggatagtgattttcttttttcagcacagtctacctcagtgtattgttaagatgtgattcaatcatggacatctttgagatttcagaattctacctggaaccggtctgaatcagggaacgtgtgtatcagctgattcgaatgccagggaccagtaagaattttgagggagggagttgggatggagaaggtatggcctttatgcgagcatagatccttttcttcctggctggtaatattcttctctgaatttaatcttcctttaaaaaaaaatcctccatctattgtcactatgttccccaaacataaactaagttccaggctgtcatgatgtatctgatatatggggtaacccagcaaggtgtaccttcctttggtgagagatggctgccggggcaaagacgggctttgattcagagcaagcattcccacctgttccatggaatccccctgaagtgagcacaaaggtgccctgggctccctgatggtttatgcccactcctttcaggctggtgatgcaccttacacacaaacacctaatgcaatgtctttttaaattctccaagtgggatgggagcatgtgagggaaattccaatccaaaacccattaatgtgctgaacgctttttttttttttttttttttttgcaacaacaccttggacctctgtgttggggtttgactgacctcaagctgatattattggaccttgtgcagctttgataacccatgtgagagtctaggcaggaccagtggggcccaaatcttgctgctcttgtacttttaggcactgcccttgcagactcacctttctccacctgccctggagaaaggtagggtgtgctgggcctgccccttgcaaatgggattcaccagtttcatttatttgactctactgccacagtgaaaagagcaaacagctattgggttgcaaacctcctttgacattaggaaatgttgactttgtaacaataaaactttggtcctagaaagacacggttgtcctgggagtttgtagtgttaagttgcaacaacaacaacaaaaagcaacaaaaccagcttaggataacactttttgttgcttgttcttaaagatgtctcactatgattaaaacccttttcattaatgtagtgaaagccacacaggagttccttcttccaggaggagaataccaagcacatcactttctctctgcatcagtgatgtcaaatacgcatcagaaaatgttcaggttttaggagctgtcctaggtgctgtttcatcattggaagcagtgagaaagagaagcactgctgcttgtctggatataggctgaggatgattgagagaagctgtgggaactgacacaagggtctgcataggtcatcctgtgaccctggggactatgttaccaactgacagacagatctttcactgtatcctagcagggcaggtagtccaccaagaaatgtgcttattggattgggaggtgtttatttgtagtctgctgtaacacgtgtgaaagagcaggagcgtcatcagcatatgacttgcgctggtcatccggtaaatggatgtgctgtagtcccagtgctaatcatttctctccttcacagtgggtggaagtttagggttaaatgtcctttgaatgtcacctggtgagtccttgacaccttaggctcttcagaaacaatggttttgttgaggatggggaacagggaatgccgattttatatacatggtacacagagaggggtgtcacttcagaaaatcttccagcatgttcttcagaatattaatttatatgcgaggtgaggttgggaatgaaaagaacaggtcagcacttttttttttcctagaacatacaaaagaacatggtggactttcagggagtgcaatggaaggtgaatatttccttaagggtccccgagaaatgggagtgaggggaggggacacaatggctttttgagcttacttttaccttctgatactagtcaaggtccagaaccagccaccagccaaatttctatctgggtgcgggccactgaaaatccttgttaaaaaccagatcacaaatctggggctcttggtcccattggagaaggaaggaagagcctcaaaataagtgtgcacccatgcacatattcaggaacagcttgtttagtctttacactttgcctgaaagttgcttctcctcgtccctttgtgtgcctgggtggcctcggccctgtgcgttggcaacgcaggatcaaatgtgctgcagcttttgcagaaaacaactcagaaacacaaaaccccccaacagctcaattattattttttcaatgttttcctacaagagccaagtagcaccatgtacagaagacgcctttttttttggaatattgaaatcgttctgcatgtaaaatatgggataatgacctgtttatattaaaattctgattaaattatctgagaata

SEQ ID NO: 448393 - DNA, 9032 bp, Homo sapiens
  misc_feature (1047)..(1047): n is a, c, g, or t
  misc_feature (1776)..(1776): n is a, c, g, or t
ggggggctgcgcggccgggtcggtgcgcacacgagaaggacgcgcggcccccagcgctcttgggggccgcctcggagcatgacccccgcgggccagcgccgcgcgcctgatccgaggagaccccgcgctcccgcagccatgggcaccgggggccggcggggggcggcggccgcgccgctgctggtggcggtggccgcgctgctactgggcgccgcgggccacctgtaccccggagaggtgtgtcccggcatggatatccggaacaacctcactaggttgcatgagctggagaattgctctgtcatcgaaggacacttgcagatactcttgatgttcaaaacgaggcccgaagatttccgagacctcagtttccccaaactcatcatgatcactgattacttgctgctcttccgggtctatgggctcgagagcctgaaggacctgttccccaacctcacggtcatccggggatcacgactgttctttaactacgcgctggtcatcttcgagatggttcacctcaaggaactcggcctctacaacctgatgaacatcacccggggttctgtccgcatcgagaagaacaatgagctctgttacttggccactatcgactggtcccgtatcctggattccgtggaggataattacatcgtgttgaacaaagatgacaacgaggagtgtggagacatctgtccgggtaccgcgaagggcaagaccaactgccccgccaccgtcatcaacgggcagtttgtcgaacgatgttggactcatagtcactgccagaaagtttgcccgaccatctgtaagtcacacggctgcaccgccgaaggcctctgttgccacagcgagtgcctgggcaactgttctcagcccgacgaccccaccaagtgcgtggcctgccgcaacttctacctggacggcaggtgtgtggagacctgcccgcccccgtactaccacttccaggactggcgctgtgtgaacttcagcttctgccaggacctgcaccacaaatgcaagaactcgcggaggcagggctgccaccantacgtcattcacaacaacaagtgcatccctgagtgtccctccgggtacacgatgaattccagcaacttgctgtgcaccccatgcctgggtccctgtcccaaggtgtgccacctcctagaaggcgagaagaccatcgactcggtgacgtctgcccaggagctccgaggatgcaccgtcatcaacgggagtctgatcatcaacattcgaggaggcaacaatctggcagctgagctagaagccaacctcggcctcattgaagaaatttcagggtatctaaaaatccgccgatcctacgctctggtgtcactttccttcttccggaagttacgtctgattcgaggagagaccttggaaattgggaactactccttctatgccttggacaaccagaacctaaggcagctctgggactggagcaaacacaacctcaccatcactcaggggaaactcttcttccactataaccccaaactctgcttgtcagaaatccacaagatggaagaagtttcaggaaccaaggggcgccaggagagaaacgacattgccctgaagaccaatggggaccaggcatcctgtgaaaatgagttacttaaattttcttacattcggacatcttttgacaagatcttgctgagatgggagccgtactggccccccgacttccgagacctcttggggttcatgctgttctacaaagaggccccttatcagaatgtgacggagttcgangggcaggatgcgtgtggttccaacagttggacggtggtagacattgacccacccctgaggtccaacgaccccaaatcacagaaccacccagggtggctgatgcggggtctcaagccctggacccagtatgccatctttgtgaagaccctggtcaccttttcggatgaacgccggacctatggggccaagagtgacatcatttatgtccagacagatgccaccaacccctctgtgcccctggatccaatctcagtgtctaactcatcatcccagattattctgaagtggaaaccaccctccgaccccaatggcaacatcacccactacctggttttctgggagaggcaggcggaagacagtgagctgttcgagctggattattgcctcaaagggctgaagctgccctcgaggacctggtctccaccattcgagtctgaagattctcagaagcacaaccagagtgagtatgaggattcggccggcgaatgctgctcctgtccaaagacagactctcagatcctgaaggagctggaggagtcctcgtttaggaagacgtttgaggattacctgcacaacgtggttttcgtccccagaaaaacctcttcaggcactggtgccgaggaccctaggccatctcggaaacgcaggtcccttggcgatgttgggaatgtgacggtggccgtgcccacggtggcagctttccccaacacttcctcgaccagcgtgcccacgagtccggaggagcacaggccttttgagaaggtggtgaacaaggagtcgctggtcatctccggcttgcgacacttcacgggctatcgcatcgagctgcaggcttgcaaccaggacacccctgaggaacggtgcagtgtggcagcctacgtcagtgcgaggaccatgcctgaagccaaggctgatgacattgttggccctgtgacgcatgaaatctttgagaacaacgtcgtccacttgatgtggcaggagccgaaggagcccaatggtctgatcgtgctgtatgaagtgagttatcggcgatatggtgatgaggagctgcatctctgcgtctcccgcaagcacttcgctctggaacggggctgcaggctgcgtgggctgtcaccggggaactacagcgtgcgaatccgggccacctcccttgcgggcaacggctcttggacggaacccacctatttctacgtgacagactatttagacgtcccgtcaaatattgcaaaaattatcatcggccccctcatctttgtctttctcttcagtgttgtgattggaagtatttatctattcctgagaaagaggcagccagatgggccgctgggaccgctttacgcttcttcaaaccctgagtatctcagtgccagtgatgtgtttccatgctctgtgtacgtgccggacgagtgggaggtgtctcgagagaagatcaccctccttcgagagctggggcagggctccttcggcatggtgtatgagggcaatgccagggacatcatcaagggtgaggcagagacccgcgtggcggtgaagacggtcaacgagtcagccagtctccgagagcggattgagttcctcaatgaggcctcggtcatgaagggcttcacctgccatcacgtggtgcgcctcctgggagtggtgtccaagggccagcccacgctggtggtgatggagctgatggctcacggagacctgaagagctacctccgttctctgcggccagaggctgagaataatcctggccgccctccccctacccttcaagagatgattcagatggcggcagagattgctgacgggatggcctacctgaacgccaagaagtttgtgcatcgggacctggcagcgagaaactgcatggtcgcccatgattttactgtcaaaattggagactttggaatgaccagagacatctatgaaacggattactaccggaaagggggcaagggtctgctccctgtacggtggatggcaccggagtccctgaaggatggggtcttcaccacttcttctgacatgtggtcctttggcgtggtcctttgggaaatcaccagcttggcagaacagccttaccaaggcctgtctaatgaacaggtgttgaaatttgtcatggatggagggtatctggatcaacccgacaactgtccagagagagtcactgacctcatgcgcatgtgctggcaattcaaccccaagatgaggccaaccttcctggagattgtcaacctgctcaaggacgacctgcaccccagctttccagaggtgtcgttcttccacagcgaggagaacaaggctcccgagagtgaggagctggagatggagtttgaggacatggagaatgtgcccctggaccgttcctcgcactgtcagagggaggaggcggggggccgggatggagggtcctcgctgggtttcaagcggagctacgaggaacacatcccttacacacacatgaacggaggcaagaaaaacgggcggattctgaccttgcctcggtccaatccttcctaacagtgcctaccgtggcgggggcgggcaggggttcccattttcgctttcctctggtttgaaagcctctggaaaactcaggattctcacgactctaccatgtccaatggagttcagagatcgttcctatacatttctgttcatcttaaggtggactcgtttggttaccaatttaactagtcctgcagaggatttaactgtgaacctggagggcaaggggtttccacagttgctgctcctttggggcaacgacggtttcaaaccaggattttgtgttttttcgttccccccacccgcccccagcagatggaaagaaagcacctgtttttacaaattctttttttttttttttttttttgctggtgtctgagcttcagtataaaagacaaaacttcctgtttgtggaacaaaagttcgaaagaaaaaacaaaacaaaaacacccagccctgttccaggagaatttcaagttttacaggttgagcttcaagatggtttttttggttttttttttttctctcatccaggctgaaggattttttttttctttacaaaatgagttcctcaaattgaccaatagctgctgctttcatattttggataagggtctgtggtcccggcgtgtgctcacgtgtgtatgcacgtgtgtgtgtccattagacacggctgatgtgtgtgcaaagtatccatgcggagttgatgctttgggaattggctcatgaaggttcttctcaagggtgcgagctcatccccctctctccttccttcttattgactgggagactgtgctctcgacagattcttcttgtgtcagaagtctagcctcaggtttctaccctcccttcacattggtggccaagggaggagcatttcatttggagtgattatgaatcttttcaagaccaaaccaagctaggacattaaaaaaaaaaaaagaaaaagaaagaaaaaacaaaatggaaaaaggaaaaaaaaaaagaactgagatgacagagttttgagaatatatttgtaccatatttaatttttaaagtctctggtattagcctcataagttattgactattccccggggttggcggggagtggggacatgagttggtctgcctgttgtggggccgggaaggggagggagtcaggcacaagtggcctctttgtttggtcttaaaggcatccatttctgggaatgaagccatgttcgctgctaacacttttggatgttgtgaggccacgtggagtgtgtgagagactaggttttatggatggtctggttcaggtaccaggtctgctggaaggttcctgttcggataagctggtagctacctagctctgagcctgccttcaagaacacctgtgttcatcctctgattctctgtgtgtacctcttgtggcgtttcctctcccgggtgtgaacatcctaaccgttattgtgcaaacccaagaacgtcagatcccaaagcacaacaacctggatggactttgggaacatctaagcaatgtaagagagaggtgcactgagagtacgtcttggtcccctccaccctgagagcatctgacggtcctcagtactgaactcccggaagctgctctgagcccggtgacctcatctgggccaggtgtggtgcctgagctgaatgctcaggtgcttacagtgttgcaatccctaagagagtagagtctggaggagaaaccgtgaaaaagaccttacacaccaccaagaacttccgaatgggcgtgaatccaccgtttcttctctttgcaaaaagaaccaccacagctgctcaaagaacacagtgaactcatcactttggttcatcaaaaaatcatcgcccatgcgttattcctgagtgcattttcttacaactttttgactgcttccttttcttcttctcttaagagttgtgggcttaagaatgggatagagtcataatggcaacctccaagccctctcaattcttgattaagaacacaggtagacatgaatcccaattgtctattgctatcttatttatatgattcgggaaaatacagcatgtaaaaatattgctgaggagcctcagtgattgggtacaagaagcaagagtacagaaattatttttgccaaatttattttgtaaatatgagggtctgtacctaaatttaaaaaaaaaaacacgtagaactaggtattttgttctcttcttagtaaatttgtagtggttgtatactacactagctgcaattttcacatttttctaattcagaaaggtttttcttatattaggggaaaaagtatttattttaatatataaaatcactctgaaaatcactctcataaaaaatggagcgcatgtaaatttttatcaaagaaaaataaacaggtgaatggggatagtgattttcttttttcagcacagtctacctcagtgtattgttaagatgtgattcaatcatggacatctttgagatttcagaattctacctggaaccggtctgaatcagggaacgtgtgtatcagctgattcgaatgccagggaccagtaagaattttgagggagggagttgggatggagaaggtatggcctttatgcgagcatagatccttttcttcctggctggtaatattcttctctgaatttaatcttcctttaaaaaaaaatcctccatctattgtcactatgttccccaaacataaactaagttccaggctgtcatgatgtatctgatatatggggtaacccagcaaggtgtaccttcctttggtgagagatggctgccggggcaaagacgggctttgattcagagcaagcattcccacctgttccatggaatccccctgaagtgagcacaaaggtgccctgggctccctgatggtttatgcccactcctttcaggctggtgatgcaccttacacacaaacacctaatgcaatgtctttttaaattctccaagtgggatgggagcatgtgagggaaattccaatccaaaacccattaatgtgctgaacgctttttttttttttttttttttttgcaacaacaccttggacctctgtgttggggtttgactgacctcaagctgatattattggaccttgtgcagctttgataacccatgtgagagtctaggcaggaccagtggggcccaaatcttgctgctcttgtacttttaggcactgcccttgcagactcacctttctccacctgccctggagaaaggtagggtgtgctgggcctgccccttgcaaatgggattcaccagtttcatttatttgactctactgccacagtgaaaagagcaaacagctattgggttgcaaacctcctttgacattaggaaatgttgactttgtaacaataaaactttggtcctagaaagacacggttgtcctgggagtttgtagtgttaagttgcaacaacaacaacaaaaagcaacaaaaccagcttaggataacactttttgttgcttgttcttaaagatgtctcactatgattaaaacccttttcattaatgtagtgaaagccacacaggagttccttcttccaggaggagaataccaagcacatcactttctctctgcatcagtgatgtcaaatacgcatcagaaaatgttcaggttttaggagctgtcctaggtgctgtttcatcattggaagcagtgagaaagagaagcactgctgcttgtctggatataggctgaggatgattgagagaagctgtgggaactgacacaagggtctgcataggtcatcctgtgaccctggggactatgttaccaactgacagacagatctttcactgtatcctagcagggcaggtagtccaccaagaaatgtgcttattggattgggaggtgtttatttgtagtctgctgtaacacgtgtgaaagagcaggagcgtcatcagcatatgacttgcgctggtcatccggtaaatggatgtgctgtagtcccagtgctaatcatttctctccttcacagtgggtggaagtttagggttaaatgtcctttgaatgtcacctggtgagtccttgacaccttaggctcttcagaaacaatggttttgttgaggatggggaacagggaatgccgattttatatacatggtacacagagaggggtgtcacttcagaaaatcttccagcatgttcttcagaatattaatttatatgcgaggtgaggttgggaatgaaaagaacaggtcagcacttttttttttcctagaacatacaggtccccgagaaatgggagtgaggggaggggacacaatggctttttgagcttacttttaccttctgatactagtcaaggtccagaaccagccaccagccaaatttctatctgggtgcgggccactgaaaatccttgttaaaaaccagatcacaaatctggggctcttggtcccattggagaaggaaggaagagcctcaaaataagtgtgcacccatgcacatattcaggaacagcttgtttagtctttacactttgcctgaaagttgcttctcctcgtccctttgtgtgcctgggtggcctcggccctgtgcgttggcaacgcaggatcaaatgtgctgcagcttttgcagaaaacaactcagaaacacaaaaccccccaacagctcaattattattttttcaatgttttcctacaagagccaagtagcaccatgtacagaagacgcctttttttttggaatattgaaatcgttctgcatgtaaaatatgggataatgacctgtttatattaaaattctgattaaattatctgagaata

SEQ ID NO: 448394 - DNA, 6653 bp, Homo sapiens
  misc_feature (1047)..(1047): n is a, c, g, or t
  misc_feature (1776)..(1776): n is a, c, g, or t
ggggggctgcgcggccgggtcggtgcgcacacgagaaggacgcgcggcccccagcgctcttgggggccgcctcggagcatgacccccgcgggccagcgccgcgcgcctgatccgaggagaccccgcgctcccgcagccatgggcaccgggggccggcggggggcggcggccgcgccgctgctggtggcggtggccgcgctgctactgggcgccgcgggccacctgtaccccggagaggtgtgtcccggcatggatatccggaacaacctcactaggttgcatgagctggagaattgctctgtcatcgaaggacacttgcagatactcttgatgttcaaaacgaggcccgaagatttccgagacctcagtttccccaaactcatcatgatcactgattacttgctgctcttccgggtctatgggctcgagagcctgaaggacctgttccccaacctcacggtcatccggggatcacgactgttctttaactacgcgctggtcatcttcgagatggttcacctcaaggaactcggcctctacaacctgatgaacatcacccggggttctgtccgcatcgagaagaacaatgagctctgttacttggccactatcgactggtcccgtatcctggattccgtggaggataattacatcgtgttgaacaaagatgacaacgaggagtgtggagacatctgtccgggtaccgcgaagggcaagaccaactgccccgccaccgtcatcaacgggcagtttgtcgaacgatgttggactcatagtcactgccagaaagtttgcccgaccatctgtaagtcacacggctgcaccgccgaaggcctctgttgccacagcgagtgcctgggcaactgttctcagcccgacgaccccaccaagtgcgtggcctgccgcaacttctacctggacggcaggtgtgtggagacctgcccgcccccgtactaccacttccaggactggcgctgtgtgaacttcagcttctgccaggacctgcaccacaaatgcaagaactcgcggaggcagggctgccaccantacgtcattcacaacaacaagtgcatccctgagtgtccctccgggtacacgatgaattccagcaacttgctgtgcaccccatgcctgggtccctgtcccaaggtgtgccacctcctagaaggcgagaagaccatcgactcggtgacgtctgcccaggagctccgaggatgcaccgtcatcaacgggagtctgatcatcaacattcgaggaggcaacaatctggcagctgagctagaagccaacctcggcctcattgaagaaatttcagggtatctaaaaatccgccgatcctacgctctggtgtcactttccttcttccggaagttacgtctgattcgaggagagaccttggaaattgggaactactccttctatgccttggacaaccagaacctaaggcagctctgggactggagcaaacacaacctcaccatcactcaggggaaactcttcttccactataaccccaaactctgcttgtcagaaatccacaagatggaagaagtttcaggaaccaaggggcgccaggagagaaacgacattgccctgaagaccaatggggaccaggcatcctgtgaaaatgagttacttaaattttcttacattcggacatcttttgacaagatcttgctgagatgggagccgtactggccccccgacttccgagacctcttggggttcatgctgttctacaaagaggccccttatcagaatgtgacggagttcgangggcaggatgcgtgtggttccaacagttggacggtggtagacattgacccacccctgaggtccaacgaccccaaatcacagaaccacccagggtggctgatgcggggtctcaagccctggacccagtatgccatctttgtgaagaccctggtcaccttttcggatgaacgccggacctatggggccaagagtgacatcatttatgtccagacagatgccaccaacccctctgtgcccctggatccaatctcagtgtctaactcatcatcccagattattctgaagtggaaaccaccctccgaccccaatggcaacatcacccactacctggttttctgggagaggcaggcggaagacagtgagctgttcgagctggattattgcctcaaagggctgaagctgccctcgaggacctggtctccaccattcgagtctgaagattctcagaagcacaaccagagtgagtatgaggattcggccggcgaatgctgctcctgtccaaagacagactctcagatcctgaaggagctggaggagtcctcgtttaggaagacgtttgaggattacctgcacaacgtggttttcgtccccagaaaaacctcttcaggcactggtgccgaggaccctaggccatctcggaaacgcaggtcccttggcgatgttgggaatgtgacggtggccgtgcccacggtggcagctttccccaacacttcctcgaccagcgtgcccacgagtccggaggagcacaggccttttgagaaggtggtgaacaaggagtcgctggtcatctccggcttgcgacacttcacgggctatcgcatcgagctgcaggcttgcaaccaggacacccctgaggaacggtgcagtgtggcagcctacgtcagtgcgaggaccatgcctgaagccaaggctgatgacattgttggccctgtgacgcatgaaatctttgagaacaacgtcgtccacttgatgtggcaggagccgaaggagcccaatggtctgatcgtgctgtatgaagtgagttatcggcgatatggtgatgaggagctgcatctctgcgtctcccgcaagcacttcgctctggaacggggctgcaggctgcgtgggctgtcaccggggaactacagcgtgcgaatccgggccacctcccttgcgggcaacggctcttggacggaacccacctatttctacgtgacagactatttagacgtcccgtcaaatattgcaaaaattatcatcggccccctcatctttgtctttctcttcagtgttgtgattggaagtatttatctattcctgagaaagaggcagccagatgggccgctgggaccgctttacgcttcttcaaaccctgagtatctcagtgccagtgatgtgtttccatgctctgtgtacgtgccggacgagtgggaggtgtctcgagagaagatcaccctccttcgagagctggggcagggctccttcggcatggtgtatgagggcaatgccagggacatcatcaagggtgaggcagagacccgcgtggcggtgaagacggtcaacgagtcagccagtctccgagagcggattgagttcctcaatgaggcctcggtcatgaagggcttcacctgccatcacgtggtgcgcctcctgggagtggtgtccaagggccagcccacgctggtggtgatggagctgatggctcacggagacctgaagagctacctccgttctctgcggccagaggctgagaataatcctggccgccctccccctacccttcaagagatgattcagatggcggcagagattgctgacgggatggcctacctgaacgccaagaagtttgtgcatcgggacctggcagcgagaaactgcatggtcgcccatgattttactgtcaaaattggagactttggaatgaccagagacatctatgaaacggattactaccggaaagggggcaagggtctgctccctgtacggtggatggcaccggagtccctgaaggatggggtcttcaccacttcttctgacatgtggtcctttggcgtggtcctttgggaaatcaccagcttggcagaacagccttaccaaggcctgtctaatgaacaggtgttgaaatttgtcatggatggagggtatctggatcaacccgacaactgtccagagagagtcactgacctcatgcgcatgtgctggcaattcaaccccaagatgaggccaaccttcctggagattgtcaacctgctcaaggacgacctgcaccccagctttccagaggtgtcgttcttccacagcgaggagaacaaggctcccgagagtgaggagctggagatggagtttgaggacatggagaatgtgcccctggaccgttcctcgcactgtcagagggaggaggcggggggccgggatggagggtcctcgctgggtttcaagcggagctacgaggaacacatcccttacacacacatgaacggaggcaagaaaaacgggcggattctgaccttgcctcggtccaatccttcctaacagtgcctaccgtggcgggggcgggcaggggttcccattttcgctttcctctggtttgaaagcctctggaaaactcaggattctcacgactctaccatgtccaatggagttcagagatcgttcctatacatttctgttcatcttaaggtggactcgtttggttaccaatttaactagtcctgcagaggatttaactgtgaacctggagggcaaggggtttccacagttgctgctcctttggggcaacgacggtttcaaaccaggattttgtgttttttcgttccccccacccgcccccagcagatggaaagaaagcacctgtttttacaaattctttttttttttttttttttttgctggtgtctgagcttcagtataaaagacaaaacttcctgtttgtggaacaaaagttcgaaagaaaaaacaaaacaaaaacacccagccctgttccaggagaatttcaagttttacaggttgagcttcaagatggtttttttggttttttttttttctctcatccaggctgaaggattttttttttctttacaaaatgagttcctcaaattgaccaatagctgctgctttcatattttggataagggtctgtggtcccggcgtgtgctcacgtgtgtatgcacgtgtgtgtgtccattagacacggctgatgtgtgtgcaaagtatccatgcggagttgatgctttgggaattggctcatgaaggttcttctcaagggtgcgagctcatccccctctctccttccttcttattgactgggagactgtgctctcgacagattcttcttgtgtcagaagtctagcctcaggtttctaccctcccttcacattggtggccaagggaggagcatttcatttggagtgattatgaatcttttcaagaccaaaccaagctaggacattaaaaaaaaaaaaagaaaaagaaagaaaaaacaaaatggaaaaaggaaaaaaaaaaagaactgagatgacagagttttgagaatatatttgtaccatatttaatttttaaagtctctggtattagcctcataagttattgactattccccggggttggcggggagtggggacatgagttggtctgcctgttgtggggccgggaaggggagggagtcaggcacaagtggcctctttgtttggtcttaaaggcatccatttctgggaatgaagccatgttcgctgctaacacttttggatgttgtgaggccacgtggagtgtgtgagagactaggttttatggatggtctggttcaggtaccaggtctgctggaaggttcctgttcggataagctggtagctacctagctctgagcctgccttcaagaacacctgtgttcatcctctgattctctgtgtgtacctcttgtggcgtttcctctcccgggtgtgaacatcctaaccgttattgtgcaaacccaagaacgtcagatcccaaagcacaacaacctggatggactttgggaacatctaagcaatgtaagagagaggtgcactgagagtacgtcttggtcccctccaccctgagagcatctgacggtcctcagtactgaactcccggaagctgctctgagcccggtgacctcatctgggccaggtgtggtgcctgagctgaatgctcaggtgcttacagtgttgcaatccctaagagagtagagtctggaggagaaaccgtgaaaaagaccttacacaccaccaagaacttccgaatgggcgtgaatccaccgtttcttctctttgcaaaaagaaccaccacagctgctcaaagaacacagtgaactcatcactttggttcatcaaaaaatcatcgcccatgcgttattcctgagtgcattttcttacaactttttgactgcttccttttcttcttctcttaagagttgtgggcttaagaatgggatagagtcataatggcaacctccaagccctctcaattcttgattaagaacacaggtagacatgaatcccaattgtctattgctatcttatttatatgattcgggaaaatacagcatgtaaaaatattgctgaggagcctcagtgattgggtacaagaagcaagagtacagaaattatttttgccaaatttattttgtaaatatgagggtctgtacctaaatttaaaaaaaaaaacacgtagaactaggtattttgttctcttcttagtaaatttgtagtggttgtatactacactagctgcaattttcacatttttctaattcagaaaggtttttcttatattaggggaaaaagtatttattttaatatataaaatcactctgaaaatcactctcataaaaaatggagcgcatgtaaatttttatcaaagaaaaataaacaggtgaatgggga

SEQ ID NO: 448395 - DNA, 8437 bp, Homo sapiens
  misc_feature (1127)..(1127): n is a, c, g, or t
caggcccatcatctcaaggtaacggcacattcttattaccacatgcattagtccatttctgcactgctataaagaatacatggaactgggtaatttataaagaaaagaggtttaattggctgacagttctgcaggctgtacgggaagcatagcagcttctgcttctggggagacctcaggaaacttacaatcgtggcggaaagcaaaggggaggtaggcacatcttacatgagctgaggcaggagaatctcttgaacccagaaggcagaggttgcagtgagctgagatcgcaccactgcactccagcctgggcaacagagcgagactctgtcacacaaacacacacacacacacaaagaaataccatatcaggcagaaagatgcctgagatgtctgaaggaccttggataccgtgacacccccctcccctttctctttctctctctctctgctccgtccttagcttgctgtgcaccccatgcctgggtccctgtcccaaggtgtgccacctcctagaaggcgagaagaccatcgactcggtgacgtctgcccaggagctccgaggatgcaccgtcatcaacgggagtctgatcatcaacattcgaggaggcaacaatctggcagctgagctagaagccaacctcggcctcattgaagaaatttcagggtatctaaaaatccgccgatcctacgctctggtgtcactttccttcttccggaagttacgtctgattcgaggagagaccttggaaattgggaactactccttctatgccttggacaaccagaacctaaggcagctctgggactggagcaaacacaacctcaccatcactcaggggaaactcttcttccactataaccccaaactctgcttgtcagaaatccacaagatggaagaagtttcaggaaccaaggggcgccaggagagaaacgacattgccctgaagaccaatggggaccaggcatcctgtgaaaatgagttacttaaattttcttacattcggacatcttttgacaagatcttgctgagatgggagccgtactggccccccgacttccgagacctcttggggttcatgctgttctacaaagaggccccttatcagaatgtgacggagttcgangggcaggatgcgtgtggttccaacagttggacggtggtagacattgacccacccctgaggtccaacgaccccaaatcacagaaccacccagggtggctgatgcggggtctcaagccctggacccagtatgccatctttgtgaagaccctggtcaccttttcggatgaacgccggacctatggggccaagagtgacatcatttatgtccagacagatgccaccaacccctctgtgcccctggatccaatctcagtgtctaactcatcatcccagattattctgaagtggaaaccaccctccgaccccaatggcaacatcacccactacctggttttctgggagaggcaggcggaagacagtgagctgttcgagctggattattgcctcaaagggctgaagctgccctcgaggacctggtctccaccattcgagtctgaagattctcagaagcacaaccagagtgagtatgaggattcggccggcgaatgctgctcctgtccaaagacagactctcagatcctgaaggagctggaggagtcctcgtttaggaagacgtttgaggattacctgcacaacgtggttttcgtccccagaaaaacctcttcaggcactggtgccgaggaccctaggccatctcggaaacgcaggtcccttggcgatgttgggaatgtgacggtggccgtgcccacggtggcagctttccccaacacttcctcgaccagcgtgcccacgagtccggaggagcacaggccttttgagaaggtggtgaacaaggagtcgctggtcatctccggcttgcgacacttcacgggctatcgcatcgagctgcaggcttgcaaccaggacacccctgaggaacggtgcagtgtggcagcctacgtcagtgcgaggaccatgcctgaagccaaggctgatgacattgttggccctgtgacgcatgaaatctttgagaacaacgtcgtccacttgatgtggcaggagccgaaggagcccaatggtctgatcgtgctgtatgaagtgagttatcggcgatatggtgatgaggagctgcatctctgcgtctcccgcaagcacttcgctctggaacggggctgcaggctgcgtgggctgtcaccggggaactacagcgtgcgaatccgggccacctcccttgcgggcaacggctcttggacggaacccacctatttctacgtgacagactatttagacgtcccgtcaaatattgcaaaaattatcatcggccccctcatctttgtctttctcttcagtgttgtgattggaagtatttatctattcctgagaaagaggcagccagatgggccgctgggaccgctttacgcttcttcaaaccctgagtatctcagtgccagtgatgtgtttccatgctctgtgtacgtgccggacgagtgggaggtgtctcgagagaagatcaccctccttcgagagctggggcagggctccttcggcatggtgtatgagggcaatgccagggacatcatcaagggtgaggcagagacccgcgtggcggtgaagacggtcaacgagtcagccagtctccgagagcggattgagttcctcaatgaggcctcggtcatgaagggcttcacctgccatcacgtggtgcgcctcctgggagtggtgtccaagggccagcccacgctggtggtgatggagctgatggctcacggagacctgaagagctacctccgttctctgcggccagaggctgagaataatcctggccgccctccccctacccttcaagagatgattcagatggcggcagagattgctgacgggatggcctacctgaacgccaagaagtttgtgcatcgggacctggcagcgagaaactgcatggtcgcccatgattttactgtcaaaattggagactttggaatgaccagagacatctatgaaacggattactaccggaaagggggcaagggtctgctccctgtacggtggatggcaccggagtccctgaaggatggggtcttcaccacttcttctgacatgtggtcctttggcgtggtcctttgggaaatcaccagcttggcagaacagccttaccaaggcctgtctaatgaacaggtgttgaaatttgtcatggatggagggtatctggatcaacccgacaactgtccagagagagtcactgacctcatgcgcatgtgctggcaattcaaccccaagatgaggccaaccttcctggagattgtcaacctgctcaaggacgacctgcaccccagctttccagaggtgtcgttcttccacagcgaggagaacaaggctcccgagagtgaggagctggagatggagtttgaggacatggagaatgtgcccctggaccgttcctcgcactgtcagagggaggaggcggggggccgggatggagggtcctcgctgggtttcaagcggagctacgaggaacacatcccttacacacacatgaacggaggcaagaaaaacgggcggattctgaccttgcctcggtccaatccttcctaacagtgcctaccgtggcgggggcgggcaggggttcccattttcgctttcctctggtttgaaagcctctggaaaactcaggattctcacgactctaccatgtccaatggagttcagagatcgttcctatacatttctgttcatcttaaggtggactcgtttggttaccaatttaactagtcctgcagaggatttaactgtgaacctggagggcaaggggtttccacagttgctgctcctttggggcaacgacggtttcaaaccaggattttgtgttttttcgttccccccacccgcccccagcagatggaaagaaagcacctgtttttacaaattctttttttttttttttttttttgctggtgtctgagcttcagtataaaagacaaaacttcctgtttgtggaacaaaagttcgaaagaaaaaacaaaacaaaaacacccagccctgttccaggagaatttcaagttttacaggttgagcttcaagatggtttttttggttttttttttttctctcatccaggctgaaggattttttttttctttacaaaatgagttcctcaaattgaccaatagctgctgctttcatattttggataagggtctgtggtcccggcgtgtgctcacgtgtgtatgcacgtgtgtgtgtccattagacacggctgatgtgtgtgcaaagtatccatgcggagttgatgctttgggaattggctcatgaaggttcttctcaagggtgcgagctcatccccctctctccttccttcttattgactgggagactgtgctctcgacagattcttcttgtgtcagaagtctagcctcaggtttctaccctcccttcacattggtggccaagggaggagcatttcatttggagtgattatgaatcttttcaagaccaaaccaagctaggacattaaaaaaaaaaaaagaaaaagaaagaaaaaacaaaatggaaaaaggaaaaaaaaaaagaactgagatgacagagttttgagaatatatttgtaccatatttaatttttaaagtctctggtattagcctcataagttattgactattccccggggttggcggggagtggggacatgagttggtctgcctgttgtggggccgggaaggggagggagtcaggcacaagtggcctctttgtttggtcttaaaggcatccatttctgggaatgaagccatgttcgctgctaacacttttggatgttgtgaggccacgtggagtgtgtgagagactaggttttatggatggtctggttcaggtaccaggtctgctggaaggttcctgttcggataagctggtagctacctagctctgagcctgccttcaagaacacctgtgttcatcctctgattctctgtgtgtacctcttgtggcgtttcctctcccgggtgtgaacatcctaaccgttattgtgcaaacccaagaacgtcagatcccaaagcacaacaacctggatggactttgggaacatctaagcaatgtaagagagaggtgcactgagagtacgtcttggtcccctccaccctgagagcatctgacggtcctcagtactgaactcccggaagctgctctgagcccggtgacctcatctgggccaggtgtggtgcctgagctgaatgctcaggtgcttacagtgttgcaatccctaagagagtagagtctggaggagaaaccgtgaaaaagaccttacacaccaccaagaacttccgaatgggcgtgaatccaccgtttcttctctttgcaaaaagaaccaccacagctgctcaaagaacacagtgaactcatcactttggttcatcaaaaaatcatcgcccatgcgttattcctgagtgcattttcttacaactttttgactgcttccttttcttcttctcttaagagttgtgggcttaagaatgggatagagtcataatggcaacctccaagccctctcaattcttgattaagaacacaggtagacatgaatcccaattgtctattgctatcttatttatatgattcgggaaaatacagcatgtaaaaatattgctgaggagcctcagtgattgggtacaagaagcaagagtacagaaattatttttgccaaatttattttgtaaatatgagggtctgtacctaaatttaaaaaaaaaaacacgtagaactaggtattttgttctcttcttagtaaatttgtagtggttgtatactacactagctgcaattttcacatttttctaattcagaaaggtttttcttatattaggggaaaaagtatttattttaatatataaaatcactctgaaaatcactctcataaaaaatggagcgcatgtaaatttttatcaaagaaaaataaacaggtgaatggggatagtgattttcttttttcagcacagtctacctcagtgtattgttaagatgtgattcaatcatggacatctttgagatttcagaattctacctggaaccggtctgaatcagggaacgtgtgtatcagctgattcgaatgccagggaccagtaagaattttgagggagggagttgggatggagaaggtatggcctttatgcgagcatagatccttttcttcctggctggtaatattcttctctgaatttaatcttcctttaaaaaaaaatcctccatctattgtcactatgttccccaaacataaactaagttccaggctgtcatgatgtatctgatatatggggtaacccagcaaggtgtaccttcctttggtgagagatggctgccggggcaaagacgggctttgattcagagcaagcattcccacctgttccatggaatccccctgaagtgagcacaaaggtgccctgggctccctgatggtttatgcccactcctttcaggctggtgatgcaccttacacacaaacacctaatgcaatgtctttttaaattctccaagtgggatgggagcatgtgagggaaattccaatccaaaacccattaatgtgctgaacgctttttttttttttttttttttttgcaacaacaccttggacctctgtgttggggtttgactgacctcaagctgatattattggaccttgtgcagctttgataacccatgtgagagtctaggcaggaccagtggggcccaaatcttgctgctcttgtacttttaggcactgcccttgcagactcacctttctccacctgccctggagaaaggtagggtgtgctgggcctgccccttgcaaatgggattcaccagtttcatttatttgactctactgccacagtgaaaagagcaaacagctattgggttgcaaacctcctttgacattaggaaatgttgactttgtaacaataaaactttggtcctagaaagacacggttgtcctgggagtttgtagtgttaagttgcaacaacaacaacaaaaagcaacaaaaccagcttaggataacactttttgttgcttgttcttaaagatgtctcactatgattaaaacccttttcattaatgtagtgaaagccacacaggagttccttcttccaggaggagaataccaagcacatcactttctctctgcatcagtgatgtcaaatacgcatcagaaaatgttcaggttttaggagctgtcctaggtgctgtttcatcattggaagcagtgagaaagagaagcactgctgcttgtctggatataggctgaggatgattgagagaagctgtgggaactgacacaagggtctgcataggtcatcctgtgaccctggggactatgttaccaactgacagacagatctttcactgtatcctagcagggcaggtagtccaccaagaaatgtgcttattggattgggaggtgtttatttgtagtctgctgtaacacgtgtgaaagagcaggagcgtcatcagcatatgacttgcgctggtcatccggtaaatggatgtgctgtagtcccagtgctaatcatttctctccttcacagtgggtggaagtttagggttaaatgtcctttgaatgtcacctggtgagtccttgacaccttaggctcttcagaaacaatggttttgttgaggatggggaacagggaatgccgattttatatacatggtacacagagaggggtgtcacttcagaaaatcttccagcatgttcttcagaatattaatttatatgcgaggtgaggttgggaatgaaaagaacaggtcagcacttttttttttcctagaacatacaaaagaacatggtggactttcagggagtgcaatggaaggtgaatatttccttaagggtccccgagaaatgggagtgaggggaggggacacaatggctttttgagcttacttttaccttctgatactagtcaaggtccagaaccagccaccagccaaatttctatctgggtgcgggccactgaaaatccttgttaaaaaccagatcacaaatctggggctcttggtcccattggagaaggaaggaagagcctcaaaataagtgtgcacccatgcacatattcaggaacagcttgtttagtctttacactttgcctgaaagttgcttctcctcgtccctttgtgtgcctgggtggcctcggccctgtgcgttggcaacgcaggatcaaatgtgctgcagcttttgcagaaaacaactcagaaacacaaaaccccccaacagctcaattattattttttcaatgttttcctacaagagccaagtagcaccatgtacagaagacgcctttttttttggaatattgaaatcgttctgcatgtaaaatatgggataatgacctgtttatattaaaattctgattaaattatctgagaata

SEQ ID NO: 448396 - DNA, 5859 bp, Homo sapiens
tatctgtctgctgtccgggcaggtatgtctgctctcctagaccagggctgagcacgctgcatccaggccacagggtgctgtgtgtgacatagacaccagggagggaggagaaccctggtgagtcgaatcacggaccctcctccaagaaccctggttgcttgctctgcaggtgcgcctcctgggagtggtgtccaagggccagcccacgctggtggtgatggagctgatggctcacggagacctgaagagctacctccgttctctgcggccagaggctgagaataatcctggccgccctccccctacccttcaagagatgattcagatggcggcagagattgctgacgggatggcctacctgaacgccaagaagtttgtgcatcgggacctggcagcgagaaactgcatggtcgcccatgattttactgtcaaaattggagactttggaatgaccagagacatctatgaaacggattactaccggaaagggggcaagggtctgctccctgtacggtggatggcaccggagtccctgaaggatggggtcttcaccacttcttctgacatgtggtcctttggcgtggtcctttgggaaatcaccagcttggcagaacagccttaccaaggcctgtctaatgaacaggtgttgaaatttgtcatggatggagggtatctggatcaacccgacaactgtccagagagagtcactgacctcatgcgcatgtgctggcaattcaaccccaagatgaggccaaccttcctggagattgtcaacctgctcaaggacgacctgcaccccagctttccagaggtgtcgttcttccacagcgaggagaacaaggctcccgagagtgaggagctggagatggagtttgaggacatggagaatgtgcccctggaccgttcctcgcactgtcagagggaggaggcggggggccgggatggagggtcctcgctgggtttcaagcggagctacgaggaacacatcccttacacacacatgaacggaggcaagaaaaacgggcggattctgaccttgcctcggtccaatccttcctaacagtgcctaccgtggcgggggcgggcaggggttcccattttcgctttcctctggtttgaaagcctctggaaaactcaggattctcacgactctaccatgtccaatggagttcagagatcgttcctatacatttctgttcatcttaaggtggactcgtttggttaccaatttaactagtcctgcagaggatttaactgtgaacctggagggcaaggggtttccacagttgctgctcctttggggcaacgacggtttcaaaccaggattttgtgttttttcgttccccccacccgcccccagcagatggaaagaaagcacctgtttttacaaattctttttttttttttttttttttgctggtgtctgagcttcagtataaaagacaaaacttcctgtttgtggaacaaaagttcgaaagaaaaaacaaaacaaaaacacccagccctgttccaggagaatttcaagttttacaggttgagcttcaagatggtttttttggttttttttttttctctcatccaggctgaaggattttttttttctttacaaaatgagttcctcaaattgaccaatagctgctgctttcatattttggataagggtctgtggtcccggcgtgtgctcacgtgtgtatgcacgtgtgtgtgtccattagacacggctgatgtgtgtgcaaagtatccatgcggagttgatgctttgggaattggctcatgaaggttcttctcaagggtgcgagctcatccccctctctccttccttcttattgactgggagactgtgctctcgacagattcttcttgtgtcagaagtctagcctcaggtttctaccctcccttcacattggtggccaagggaggagcatttcatttggagtgattatgaatcttttcaagaccaaaccaagctaggacattaaaaaaaaaaaaagaaaaagaaagaaaaaacaaaatggaaaaaggaaaaaaaaaaagaactgagatgacagagttttgagaatatatttgtaccatatttaatttttaaagtctctggtattagcctcataagttattgactattccccggggttggcggggagtggggacatgagttggtctgcctgttgtggggccgggaaggggagggagtcaggcacaagtggcctctttgtttggtcttaaaggcatccatttctgggaatgaagccatgttcgctgctaacacttttggatgttgtgaggccacgtggagtgtgtgagagactaggttttatggatggtctggttcaggtaccaggtctgctggaaggttcctgttcggataagctggtagctacctagctctgagcctgccttcaagaacacctgtgttcatcctctgattctctgtgtgtacctcttgtggcgtttcctctcccgggtgtgaacatcctaaccgttattgtgcaaacccaagaacgtcagatcccaaagcacaacaacctggatggactttgggaacatctaagcaatgtaagagagaggtgcactgagagtacgtcttggtcccctccaccctgagagcatctgacggtcctcagtactgaactcccggaagctgctctgagcccggtgacctcatctgggccaggtgtggtgcctgagctgaatgctcaggtgcttacagtgttgcaatccctaagagagtagagtctggaggagaaaccgtgaaaaagaccttacacaccaccaagaacttccgaatgggcgtgaatccaccgtttcttctctttgcaaaaagaaccaccacagctgctcaaagaacacagtgaactcatcactttggttcatcaaaaaatcatcgcccatgcgttattcctgagtgcattttcttacaactttttgactgcttccttttcttcttctcttaagagttgtgggcttaagaatgggatagagtcataatggcaacctccaagccctctcaattcttgattaagaacacaggtagacatgaatcccaattgtctattgctatcttatttatatgattcgggaaaatacagcatgtaaaaatattgctgaggagcctcagtgattgggtacaagaagcaagagtacagaaattatttttgccaaatttattttgtaaatatgagggtctgtacctaaatttaaaaaaaaaaacacgtagaactaggtattttgttctcttcttagtaaatttgtagtggttgtatactacactagctgcaattttcacatttttctaattcagaaaggtttttcttatattaggggaaaaagtatttattttaatatataaaatcactctgaaaatcactctcataaaaaatggagcgcatgtaaatttttatcaaagaaaaataaacaggtgaatggggatagtgattttcttttttcagcacagtctacctcagtgtattgttaagatgtgattcaatcatggacatctttgagatttcagaattctacctggaaccggtctgaatcagggaacgtgtgtatcagctgattcgaatgccagggaccagtaagaattttgagggagggagttgggatggagaaggtatggcctttatgcgagcatagatccttttcttcctggctggtaatattcttctctgaatttaatcttcctttaaaaaaaaatcctccatctattgtcactatgttccccaaacataaactaagttccaggctgtcatgatgtatctgatatatggggtaacccagcaaggtgtaccttcctttggtgagagatggctgccggggcaaagacgggctttgattcagagcaagcattcccacctgttccatggaatccccctgaagtgagcacaaaggtgccctgggctccctgatggtttatgcccactcctttcaggctggtgatgcaccttacacacaaacacctaatgcaatgtctttttaaattctccaagtgggatgggagcatgtgagggaaattccaatccaaaacccattaatgtgctgaacgctttttttttttttttttttttttgcaacaacaccttggacctctgtgttggggtttgactgacctcaagctgatattattggaccttgtgcagctttgataacccatgtgagagtctaggcaggaccagtggggcccaaatcttgctgctcttgtacttttaggcactgcccttgcagactcacctttctccacctgccctggagaaaggtagggtgtgctgggcctgccccttgcaaatgggattcaccagtttcatttatttgactctactgccacagtgaaaagagcaaacagctattgggttgcaaacctcctttgacattaggaaatgttgactttgtaacaataaaactttggtcctagaaagacacggttgtcctgggagtttgtagtgttaagttgcaacaacaacaacaaaaagcaacaaaaccagcttaggataacactttttgttgcttgttcttaaagatgtctcactatgattaaaacccttttcattaatgtagtgaaagccacacaggagttccttcttccaggaggagaataccaagcacatcactttctctctgcatcagtgatgtcaaatacgcatcagaaaatgttcaggttttaggagctgtcctaggtgctgtttcatcattggaagcagtgagaaagagaagcactgctgcttgtctggatataggctgaggatgattgagagaagctgtgggaactgacacaagggtctgcataggtcatcctgtgaccctggggactatgttaccaactgacagacagatctttcactgtatcctagcagggcaggtagtccaccaagaaatgtgcttattggattgggaggtgtttatttgtagtctgctgtaacacgtgtgaaagagcaggagcgtcatcagcatatgacttgcgctggtcatccggtaaatggatgtgctgtagtcccagtgctaatcatttctctccttcacagtgggtggaagtttagggttaaatgtcctttgaatgtcacctggtgagtccttgacaccttaggctcttcagaaacaatggttttgttgaggatggggaacagggaatgccgattttatatacatggtacacagagaggggtgtcacttcagaaaatcttccagcatgttcttcagaatattaatttatatgcgaggtgaggttgggaatgaaaagaacaggtcagcacttttttttttcctagaacatacaaaagaacatggtggactttcagggagtgcaatggaaggtgaatatttccttaagggtccccgagaaatgggagtgaggggaggggacacaatggctttttgagcttacttttaccttctgatactagtcaaggtccagaaccagccaccagccaaatttctatctgggtgcgggccactgaaaatccttgttaaaaaccagatcacaaatctggggctcttggtcccattggagaaggaaggaagagcctcaaaataagtgtgcacccatgcacatattcaggaacagcttgtttagtctttacactttgcctgaaagttgcttctcctcgtccctttgtgtgcctgggtggcctcggccctgtgcgttggcaacgcaggatcaaatgtgctgcagcttttgcagaaaacaactcagaaacacaaaaccccccaacagctcaattattattttttcaatgttttcctacaagagccaagtagcaccatgtacagaagacgcctttttttttggaatattgaaatcgttctgcatgtaaaatatgggataatgacctgtttatattaaaattctgattaaattatctgagaata

SEQ ID NO: 448397 - DNA, 4422 bp, Homo sapiens
tattatagccgcacttcccgtttgtgggccaaaggtcggaagggtaaccccacccgcacccccccccctgttccaggagaatttcaagttttacaggttgagcttcaagatggtttttttggttttttttttttctctcatccaggctgaaggattttttttttctttacaaaatgagttcctcaaattgaccaatagctgctgctttcatattttggataagggtctgtggtcccggcgtgtgctcacgtgtgtatgcacgtgtgtgtgtccattagacacggctgatgtgtgtgcaaagtatccatgcggagttgatgctttgggaattggctcatgaaggttcttctcaagggtgcgagctcatccccctctctccttccttcttattgactgggagactgtgctctcgacagattcttcttgtgtcagaagtctagcctcaggtttctaccctcccttcacattggtggccaagggaggagcatttcatttggagtgattatgaatcttttcaagaccaaaccaagctaggacattaaaaaaaaaaaaagaaaaagaaagaaaaaacaaaatggaaaaaggaaaaaaaaaaagaactgagatgacagagttttgagaatatatttgtaccatatttaatttttaaagtctctggtattagcctcataagttattgactattccccggggttggcggggagtggggacatgagttggtctgcctgttgtggggccgggaaggggagggagtcaggcacaagtggcctctttgtttggtcttaaaggcatccatttctgggaatgaagccatgttcgctgctaacacttttggatgttgtgaggccacgtggagtgtgtgagagactaggttttatggatggtctggttcaggtaccaggtctgctggaaggttcctgttcggataagctggtagctacctagctctgagcctgccttcaagaacacctgtgttcatcctctgattctctgtgtgtacctcttgtggcgtttcctctcccgggtgtgaacatcctaaccgttattgtgcaaacccaagaacgtcagatcccaaagcacaacaacctggatggactttgggaacatctaagcaatgtaagagagaggtgcactgagagtacgtcttggtcccctccaccctgagagcatctgacggtcctcagtactgaactcccggaagctgctctgagcccggtgacctcatctgggccaggtgtggtgcctgagctgaatgctcaggtgcttacagtgttgcaatccctaagagagtagagtctggaggagaaaccgtgaaaaagaccttacacaccaccaagaacttccgaatgggcgtgaatccaccgtttcttctctttgcaaaaagaaccaccacagctgctcaaagaacacagtgaactcatcactttggttcatcaaaaaatcatcgcccatgcgttattcctgagtgcattttcttacaactttttgactgcttccttttcttcttctcttaagagttgtgggcttaagaatgggatagagtcataatggcaacctccaagccctctcaattcttgattaagaacacaggtagacatgaatcccaattgtctattgctatcttatttatatgattcgggaaaatacagcatgtaaaaatattgctgaggagcctcagtgattgggtacaagaagcaagagtacagaaattatttttgccaaatttattttgtaaatatgagggtctgtacctaaatttaaaaaaaaaaacacgtagaactaggtattttgttctcttcttagtaaatttgtagtggttgtatactacactagctgcaattttcacatttttctaattcagaaaggtttttcttatattaggggaaaaagtatttattttaatatataaaatcactctgaaaatcactctcataaaaaatggagcgcatgtaaatttttatcaaagaaaaataaacaggtgaatggggatagtgattttcttttttcagcacagtctacctcagtgtattgttaagatgtgattcaatcatggacatctttgagatttcagaattctacctggaaccggtctgaatcagggaacgtgtgtatcagctgattcgaatgccagggaccagtaagaattttgagggagggagttgggatggagaaggtatggcctttatgcgagcatagatccttttcttcctggctggtaatattcttctctgaatttaatcttcctttaaaaaaaaatcctccatctattgtcactatgttccccaaacataaactaagttccaggctgtcatgatgtatctgatatatggggtaacccagcaaggtgtaccttcctttggtgagagatggctgccggggcaaagacgggctttgattcagagcaagcattcccacctgttccatggaatccccctgaagtgagcacaaaggtgccctgggctccctgatggtttatgcccactcctttcaggctggtgatgcaccttacacacaaacacctaatgcaatgtctttttaaattctccaagtgggatgggagcatgtgagggaaattccaatccaaaacccattaatgtgctgaacgctttttttttttttttttttttttgcaacaacaccttggacctctgtgttggggtttgactgacctcaagctgatattattggaccttgtgcagctttgataacccatgtgagagtctaggcaggaccagtggggcccaaatcttgctgctcttgtacttttaggcactgcccttgcagactcacctttctccacctgccctggagaaaggtagggtgtgctgggcctgccccttgcaaatgggattcaccagtttcatttatttgactctactgccacagtgaaaagagcaaacagctattgggttgcaaacctcctttgacattaggaaatgttgactttgtaacaataaaactttggtcctagaaagacacggttgtcctgggagtttgtagtgttaagttgcaacaacaacaacaaaaagcaacaaaaccagcttaggataacactttttgttgcttgttcttaaagatgtctcactatgattaaaacccttttcattaatgtagtgaaagccacacaggagttccttcttccaggaggagaataccaagcacatcactttctctctgcatcagtgatgtcaaatacgcatcagaaaatgttcaggttttaggagctgtcctaggtgctgtttcatcattggaagcagtgagaaagagaagcactgctgcttgtctggatataggctgaggatgattgagagaagctgtgggaactgacacaagggtctgcataggtcatcctgtgaccctggggactatgttaccaactgacagacagatctttcactgtatcctagcagggcaggtagtccaccaagaaatgtgcttattggattgggaggtgtttatttgtagtctgctgtaacacgtgtgaaagagcaggagcgtcatcagcatatgacttgcgctggtcatccggtaaatggatgtgctgtagtcccagtgctaatcatttctctccttcacagtgggtggaagtttagggttaaatgtcctttgaatgtcacctggtgagtccttgacaccttaggctcttcagaaacaatggttttgttgaggatggggaacagggaatgccgattttatatacatggtacacagagaggggtgtcacttcagaaaatcttccagcatgttcttcagaatattaatttatatgcgaggtgaggttgggaatgaaaagaacaggtcagcacttttttttttcctagaacatacaaaagaacatggtggactttcagggagtgcaatggaaggtgaatatttccttaagggtccccgagaaatgggagtgaggggaggggacacaatggctttttgagcttacttttaccttctgatactagtcaaggtccagaaccagccaccagccaaatttctatctgggtgcgggccactgaaaatccttgttaaaaaccagatcacaaatctggggctcttggtcccattggagaaggaaggaagagcctcaaaataagtgtgcacccatgcacatattcaggaacagcttgtttagtctttacactttgcctgaaagttgcttctcctcgtccctttgtgtgcctgggtggcctcggccctgtgcgttggcaacgcaggatcaaatgtgctgcagcttttgcagaaaacaactcagaaacacaaaaccccccaacagctcaattattattttttcaatgttttcctacaagagccaagtagcaccatgtacagaagacgcctttttttttggaatattgaaatcgttctgcatgtaaaatatgggataatgacctgtttatattaaaattctgattaaattatctgagaata

SEQ ID NO: 448398 - DNA, 3937 bp, Homo sapiens
  misc_feature (1047)..(1047): n is a, c, g, or t
  misc_feature (1776)..(1776): n is a, c, g, or t
ggggggctgcgcggccgggtcggtgcgcacacgagaaggacgcgcggcccccagcgctcttgggggccgcctcggagcatgacccccgcgggccagcgccgcgcgcctgatccgaggagaccccgcgctcccgcagccatgggcaccgggggccggcggggggcggcggccgcgccgctgctggtggcggtggccgcgctgctactgggcgccgcgggccacctgtaccccggagaggtgtgtcccggcatggatatccggaacaacctcactaggttgcatgagctggagaattgctctgtcatcgaaggacacttgcagatactcttgatgttcaaaacgaggcccgaagatttccgagacctcagtttccccaaactcatcatgatcactgattacttgctgctcttccgggtctatgggctcgagagcctgaaggacctgttccccaacctcacggtcatccggggatcacgactgttctttaactacgcgctggtcatcttcgagatggttcacctcaaggaactcggcctctacaacctgatgaacatcacccggggttctgtccgcatcgagaagaacaatgagctctgttacttggccactatcgactggtcccgtatcctggattccgtggaggataattacatcgtgttgaacaaagatgacaacgaggagtgtggagacatctgtccgggtaccgcgaagggcaagaccaactgccccgccaccgtcatcaacgggcagtttgtcgaacgatgttggactcatagtcactgccagaaagtttgcccgaccatctgtaagtcacacggctgcaccgccgaaggcctctgttgccacagcgagtgcctgggcaactgttctcagcccgacgaccccaccaagtgcgtggcctgccgcaacttctacctggacggcaggtgtgtggagacctgcccgcccccgtactaccacttccaggactggcgctgtgtgaacttcagcttctgccaggacctgcaccacaaatgcaagaactcgcggaggcagggctgccaccantacgtcattcacaacaacaagtgcatccctgagtgtccctccgggtacacgatgaattccagcaacttgctgtgcaccccatgcctgggtccctgtcccaaggtgtgccacctcctagaaggcgagaagaccatcgactcggtgacgtctgcccaggagctccgaggatgcaccgtcatcaacgggagtctgatcatcaacattcgaggaggcaacaatctggcagctgagctagaagccaacctcggcctcattgaagaaatttcagggtatctaaaaatccgccgatcctacgctctggtgtcactttccttcttccggaagttacgtctgattcgaggagagaccttggaaattgggaactactccttctatgccttggacaaccagaacctaaggcagctctgggactggagcaaacacaacctcaccatcactcaggggaaactcttcttccactataaccccaaactctgcttgtcagaaatccacaagatggaagaagtttcaggaaccaaggggcgccaggagagaaacgacattgccctgaagaccaatggggaccaggcatcctgtgaaaatgagttacttaaattttcttacattcggacatcttttgacaagatcttgctgagatgggagccgtactggccccccgacttccgagacctcttggggttcatgctgttctacaaagaggccccttatcagaatgtgacggagttcgangggcaggatgcgtgtggttccaacagttggacggtggtagacattgacccacccctgaggtccaacgaccccaaatcacagaaccacccagggtggctgatgcggggtctcaagccctggacccagtatgccatctttgtgaagaccctggtcaccttttcggatgaacgccggacctatggggccaagagtgacatcatttatgtccagacagatgccaccaacccctctgtgcccctggatccaatctcagtgtctaactcatcatcccagattattctgaagtggaaaccaccctccgaccccaatggcaacatcacccactacctggttttctgggagaggcaggcggaagacagtgagctgttcgagctggattattgcctcaaagggctgaagctgccctcgaggacctggtctccaccattcgagtctgaagattctcagaagcacaaccagagtgagtatgaggattcggccggcgaatgctgctcctgtccaaagacagactctcagatcctgaaggagctggaggagtcctcgtttaggaagacgtttgaggattacctgcacaacgtggttttcgtccccagaaaaacctcttcaggcactggtgccgaggaccctaggccatctcggaaacgcaggtcccttggcgatgttgggaatgtgacggtggccgtgcccacggtggcagctttccccaacacttcctcgaccagcgtgcccacgagtccggaggagcacaggccttttgagaaggtggtgaacaaggagtcgctggtcatctccggcttgcgacacttcacgggctatcgcatcgagctgcaggcttgcaaccaggacacccctgaggaacggtgcagtgtggcagcctacgtcagtgcgaggaccatgcctgaagccaaggctgatgacattgttggccctgtgacgcatgaaatctttgagaacaacgtcgtccacttgatgtggcaggagccgaaggagcccaatggtctgatcgtgctgtatgaagtgagttatcggcgatatggtgatgaggagctgcatctctgcgtctcccgcaagcacttcgctctggaacggggctgcaggctgcgtgggctgtcaccggggaactacagcgtgcgaatccgggccacctcccttgcgggcaacggctcttggacggaacccacctatttctacgtgacagactatttagacgtcccgtcaaatattgcaaaaattatcatcggccccctcatctttgtctttctcttcagtgttgtgattggaagtatttatctattcctgagaaagaggcagccagatgggccgctgggaccgctttacgcttcttcaaaccctgagtatctcagtgccagtgatgtgtttccatgctctgtgtacgtgccggacgagtgggaggtgtctcgagagaagatcaccctccttcgagagctggggcagggctccttcggcatggtgtatgagggcaatgccagggacatcatcaagggtgaggcagagacccgcgtggcggtgaagacggtcaacgagtcagccagtctccgagagcggattgagttcctcaatgaggcctcggtcatgaagggcttcacctgccatcacgtggtgcgcctcctgggagtggtgtccaagggccagcccacgctggtggtgatggagctgatggctcacggagacctgaagagctacctccgttctctgcggccagaggctgagaataatcctggccgccctccccctacccttcaagagatgattcagatggcggcagagattgctgacgggatggcctacctgaacgccaagaagtttgtgcatcgggacctggcagcgagaaactgcatggtcgcccatgattttactgtcaaaattggaggttcgtctggctttctgctttgaaaacataacgacccaggccagactttggaatgaccagagacatctatgaaacggattactaccggaaagggggcaagggtctgctccctgtacggtggatggcaccggagtccctgaaggatggggtcttcaccacttcttctgacatgtggtcctttggcgtggtcctttgggaaatcacctgcttggttgacagtcacatccagtgaatggtggaacccatttcctgctaatgtgtgaaattgaa

SEQ ID NO: 448399 - DNA, 2292 bp, Homo sapiens
  misc_feature (1047)..(1047): n is a, c, g, or t
  misc_feature (1776)..(1776): n is a, c, g, or t
ggggggctgcgcggccgggtcggtgcgcacacgagaaggacgcgcggcccccagcgctcttgggggccgcctcggagcatgacccccgcgggccagcgccgcgcgcctgatccgaggagaccccgcgctcccgcagccatgggcaccgggggccggcggggggcggcggccgcgccgctgctggtggcggtggccgcgctgctactgggcgccgcgggccacctgtaccccggagaggtgtgtcccggcatggatatccggaacaacctcactaggttgcatgagctggagaattgctctgtcatcgaaggacacttgcagatactcttgatgttcaaaacgaggcccgaagatttccgagacctcagtttccccaaactcatcatgatcactgattacttgctgctcttccgggtctatgggctcgagagcctgaaggacctgttccccaacctcacggtcatccggggatcacgactgttctttaactacgcgctggtcatcttcgagatggttcacctcaaggaactcggcctctacaacctgatgaacatcacccggggttctgtccgcatcgagaagaacaatgagctctgttacttggccactatcgactggtcccgtatcctggattccgtggaggataattacatcgtgttgaacaaagatgacaacgaggagtgtggagacatctgtccgggtaccgcgaagggcaagaccaactgccccgccaccgtcatcaacgggcagtttgtcgaacgatgttggactcatagtcactgccagaaagtttgcccgaccatctgtaagtcacacggctgcaccgccgaaggcctctgttgccacagcgagtgcctgggcaactgttctcagcccgacgaccccaccaagtgcgtggcctgccgcaacttctacctggacggcaggtgtgtggagacctgcccgcccccgtactaccacttccaggactggcgctgtgtgaacttcagcttctgccaggacctgcaccacaaatgcaagaactcgcggaggcagggctgccaccantacgtcattcacaacaacaagtgcatccctgagtgtccctccgggtacacgatgaattccagcaacttgctgtgcaccccatgcctgggtccctgtcccaaggtgtgccacctcctagaaggcgagaagaccatcgactcggtgacgtctgcccaggagctccgaggatgcaccgtcatcaacgggagtctgatcatcaacattcgaggaggcaacaatctggcagctgagctagaagccaacctcggcctcattgaagaaatttcagggtatctaaaaatccgccgatcctacgctctggtgtcactttccttcttccggaagttacgtctgattcgaggagagaccttggaaattgggaactactccttctatgccttggacaaccagaacctaaggcagctctgggactggagcaaacacaacctcaccatcactcaggggaaactcttcttccactataaccccaaactctgcttgtcagaaatccacaagatggaagaagtttcaggaaccaaggggcgccaggagagaaacgacattgccctgaagaccaatggggaccaggcatcctgtgaaaatgagttacttaaattttcttacattcggacatcttttgacaagatcttgctgagatgggagccgtactggccccccgacttccgagacctcttggggttcatgctgttctacaaagaggccccttatcagaatgtgacggagttcgangggcaggatgcgtgtggttccaacagttggacggtggtagacattgacccacccctgaggtccaacgaccccaaatcacagaaccacccagggtggctgatgcggggtctcaagccctggacccagtatgccatctttgtgaagaccctggtcaccttttcggatgaacgccggacctatggggccaagagtgacatcatttatgtccagacagatgccaccaacccctctgtgcccctggatccaatctcagtgtctaactcatcatcccagattattctgaagtggaaaccaccctccgaccccaatggcaacatcacccactacctggttttctgggagaggcaggcggaagacagtgagctgttcgagctggattattgcctcaaagggcgagtccagtcatcagctccgctgtaagctgttggccctgcattcaagtaaccagaaccacccgtgagagctgccaccagtaatgtcactcgaagcttccttttttttttttttaattccgaa

SEQ ID NO: 448400 - DNA, 637 bp, Homo sapiens
catttagctttccttgccccatttctgaccgcgggcacctttatccccgtaaattatctcctgaagatcttctatgttgacgcactggagacagttcccctttctccttctgcacctgccgcgttactcaatcccctgtaatcccattgtcccgactgcatcatttcagaggtggtgattttaaggattttaacagggcttgccaaaagaattattttcttggcgttttgaaagtaattacttaggcatgggtactttacagagaaagctactcatcccggctggctgcagagtttacagggcccgggatgaaaacacagggcccaggtttcctgtccatgaagccggctctgcccctgatccttctgatgcatccaccgtgcgtctgctcacctgtcttgctttctgttcattttctcttgtagtgtgtcccggcatggatatccggaacaacctcactaggttgcatgagctggagaattgctctgtcatcgaaggacacttgcagatactcttgatgttcaaaacgaggcccgaagatttccgagacctcagtttccccaaactcatcatgatcactgattacttgctgctcttccgggtctatgggctcgagagcctgaaggacctgttcccc

SEQ ID NO: 448401 - DNA, 817 bp, Homo sapiens
cggacgcgtgggtcgacccacgcgtccggtggggcgcccacaatttgcgcgctctctttctgctgctccccagctctcggatacagccgacaccatgggtttcggagacctgaaaagccctgccggcctccaggtgctcaacgattacctggcggacaagagctacatcgaggggtatgtgccatcacaagcagatgtggcagtatttgaagccgtgtccagcccaccgcctgccgacttgtgtcatgccctacgttggtataatcacatcaagtcttacgaaaaggaaaaggccagcctgccaggagtgaagaaagctttgggcaaatatggtcctgccgatgtggaagacactacaggaagtggagctacagatagtaaagatgatgatgacattgacctctttggatctgatgatgaggaggaaagtgaagaagcaaagaggctaagggaagaacgtcttgcacaatatgaatcaaagaaagccaaaaaacctgcacttgttgccaagtcttccatcttactagatgtgaaaccttgggatgatgagacagatatggcgaaattagaggagtgcgtcagaagcattcaagcagacggcttagtctggggctcatctaaactagttccagtgggatacggaattaagaaacttcaaatacagtgtgtagttgaagatgataaagttggaacagatatgctggaggagcagatcactgcttttgaggactatgtgcagtccatggatgtggctgctttcaacaagatctaaaatccatcctggatcatggcatttaaataaaagattgaaagatta

SEQ ID NO: 448402 - DNA, 1040 bp, Homo sapiens
  misc_feature (911)..(911): n is a, c, g, or t
  misc_feature (927)..(927): n is a, c, g, or t
  misc_feature (936)..(936): n is a, c, g, or t
  misc_feature (959)..(959): n is a, c, g, or t
  misc_feature (966)..(966): n is a, c, g, or t
  misc_feature (981)..(981): n is a, c, g, or t
cgcagttccgccggaagtggccccagcctcgaggccgggcgtcttcggtcatctccggcgcttctagggctggttcccgtcatcttcgggagccgtggaggtggggcgcccacaatttgcgcgctctctttctgctgctccccagctctcggatacagccgacaccatgggtttcggagacctgaaaagccctgccggcctccaggtgctcaacgattacctggcggacaagagctacatcgaggggtatgtgccatcacaagcagatgtggcagtatttgaagccgtgtccagcccaccgcctgccgacttgtgtcatgccctacgttggtataatcacatcaagtcttacgaaaaggaaaaggccagcctgccaggagtgaagaaagctttgggcaaatatggtcctgccgatgtggaagacactacaggaagtggagctacagatagtaaagatgatgatgacattgacctctttggatctgatgatgaggaggaaagtgaagaagcaaagaggctaagggaagaacgtcttgcacaatatgaatcaaagaaagccaaaaaacctgcacttgttgccaagtcttccatcttactagatgtgaaaccttgggatgatgagacagatatggcgaaattagaggagtgcgtcagaagcattcaagcagacggcttagtctggggctcatctaaactagttccagtgggatacggaattaagaaacttcaaatacagtgtgtagttgaagatgataaagttggaacagatatgctggaggagcagatcactgcttttgaggactatgtgcagtccatggatgtggctgctttcaacaagatctaaaatccatcctggatcatggcatttaaataaaagattgaaagattaggagattaaaaaaaaaaaactngggtttttgggggggnaaagggttnaaagggctggttatgtctcgccnttttgtnaagggaatggggccnaaaggggtaatgaacggggttgtagagaggtagaaaaagagagataaaaagggagataa

SEQ ID NO: 448403 - DNA, 501 bp, Homo sapiens
gactctagacgatcccttaacaccgcaatctcagacactacaggaagtggagctacagatagtaaagatgatgatgacattgacctctttggatctgatgatgaggaggaaagtgaagaagcaaagaggctaagggaagaacgtcttgcacaatatgaatcaaagaaagccaaaaaacctgcacttgttgccaagtcttccatcttactagatgtgaaaccttgggatgatgagacagatatggcgaaattagaggagtgcgtcagaagcattcaagcagacggcttagtctggggctcatctaaactagttccagtgggatacggaattaagaaacttcaaatacagtgtgtagttgaagatgataaagttggaacagatatgctggaggagcagatcactgcttttgaggactatgtgcagtccatggatgtggctgctttcaacaagatctaaaatccatcctggatcatggcatttaaataaaagattgaaagatta

SEQ ID NO: 448404 - DNA, 590 bp, Homo sapiens
ttcttccacagctactggtctgcagctgttcttatggtagcagttgtggcattcctctgtgggaaagaaactgttaacacaaacacctctttcttagcaaaacagaaagtgggtatatatgtgtgacagacacaagatgtatctgtagttttgtttggctaaggagatagtctcaaaacaaattgagatggatttgtttgtgtcttggagtagggtgaaaaaaatacaattcattatttgaataatgctgtttattgtttttagaacctgcacttgttgccaagtcttccatcttactagatgtgaaaccttgggatgatgagacagatatggcgaaattagaggagtgcgtcagaagcattcaagcagacggcttagtctggggctcatctaaactagttccagtgggatacggaattaagaaacttcaaatacagtgtgtagttgaagatgataaagttggaacagatatgctggaggagcagatcactgcttttgaggactatgtgcagtccatggatgtggctgctttcaacaagatctaaaatccatcctggatcatggcatttaaataaaagattgaaagatta

SEQ ID NO: 448405 - DNA, 758 bp, Homo sapiens
cgcagttccgccggaagtggccccagcctcgaggccgggcgtcttcggtcatctccggcgcttctagggctggttcccgtcatcttcgggagccgtggagctctcggatacagccgacaccatgggtttcggagacctgaaaagccctgccggcctccaggtgctcaacgattacctggcggacaagagctacatcgaggggtatgtgccatcacaagcagatgtggcagtatttgaagccgtgtccagcccaccgcctgccgacttgtgtcatgccctacgttggtataatcacatcaagtcttacgaaaaggaaaaggccagcctgccaggagtgaagaaagctttgggcaaatatggtcctgccgatgtggaagacactacaggaagtggagctacagatagtaaagatgatgatgacattgacctctttggatctgatgatgaggaggtatggcgtcttctataaagaacatatcggccaggcgcagtggctcatgcctgtaatcccagcatgttgggaggctgaggcgggtggatcacgaggtcaggagttgaagaccagcctggccaagatggtgaaaccctgtctgtactaaaaatacaaaaaaatgtggcaggcatctgtaatcccagctactcaggcggctaaggcagagaattgcttgaacctaggaagcggaggttgcagtgagccaagatcgtgccactgcatccagcctgggcgacagagcgagactccgtcccaaaaaaaaaaa

SEQ ID NO: 448406 - DNA, 474 bp, Homo sapiens
  misc_feature (45)..(45): n is a, c, g, or t
tcatacgctgctctagaggatacaacttatgttctgacccacctnttgcaatgccctacgttggtataatcacatcaagtcttacgaaaaggaaaaggccagcctgccaggagtgaagaaagctttgggcaaatatggtcctgccgatgtggaagacactacaggaagtggagctacagatagtaaagatgatgatgacattgacctctttggatctgatgatgaggaggaaagtgaagaagcaaagaggctaagggaagaacgtcttgcacaatatgaatcaaagaaagccaaaaaacctgcacttgttgccaagtcttccatcttactagatgtgaaaccttgggatgatgagacagatatggcgaaattagaggagtgcgtcagaagcattcaagcagacggcttagtctggggctcatctaaactagttccggtgggtcagagccgaagttgtaccctcaagagtcagct

SEQ ID NO: 448407 - DNA, 316 bp, Homo sapiens
tcagatgatcatgatcatcgacctcttggtcttgtctttgatgacgcctgtgatgaatcatgacgcctaagaaagtgaagaagcaaagaggctaagggaagaacgtcttgcacaatatgaatcaaagaaagccaaaaaacctgcacttgttgccaagtcttccatcttactagatgtgaaaccttgggatgatgagacagatatggcgaaattagaggagtgcgtcagaagcattcaagcagacggcttagtctggggctcatctaaactagttccagtgggacacgaaaggacacgaatgggacacgaatgttca

SEQ ID NO: 448408 - DNA, 301 bp, Homo sapiens
ctggatttgaatcctggctttaatttatatgcctttttcaaattctgactggttgcatgatgaataaaatcaaatcaccatctttcggctgagttcgtgatggatttgcttttttctgattaagccagtcttttttgtgatgaccccactagctttaagcagaggaacaaccagctttctgaagtggattaattttttttctttacaggaaagtgaagaagcaaagaggctaagggaagaacgtcttgcacaatatgaatcaaagaaagccaaaaagttaggtcatttgtattttaacttc

SEQ ID NO: 448409 - DNA, 1390 bp, Homo sapiens
  misc_feature (1147)..(1147): n is a, c, g, or t
cgcagttccgccggaagtggccccagcctcgaggccgggcgtcttcggtcatctccggcgcttctagggctggttcccgtcatcttcgggagccgtggaggtacgaacttaagacatgcctattttattaatttacttccaaacgcaacgaaaggtccatggacaatttgtgggccatttaattcagggcccccaattcgtacgtggagaagtgggaatgcaaaagtactttgacctttaaccttcggtccggcgcggtggagggaaacgcctccgtctctatataaggaattttccggtctcttcgggtcctttttcctctcttcagcgtggggcgcccacaatttgcgcgctctctttctgctgctccccagctctcggatacagccgacaccatgggtttcggagacctgaaaagccctgccggcctccaggtgctcaacgattacctggcggacaagagctacatcgaggggtatgtgccatcacaagcagatgtggcagtatttgaagccgtgtccagcccaccgcctgccgacttgtgtcatgccctacgttggtataatcacatcaagtcttacgaaaaggaaaaggccagcctgccaggagtgaagaaagctttgggcaaatatggtcctgccgatgtggaagacactacaggaagtggagctacagatagtaaagatgatgatgacattgacctctttggatctgatgatgaggaggaaagtgaagaagcaaagaggctaagggaagaacgtcttgcacaatatgaatcaaagaaagccaaaaaacctgcacttgttgccaagtcttccatcttactagatgtgaaaccttgggatgatgagacagatatggcgaaattagaggagtgcgtcagaagcattcaagcagacggcttagtctggggctcatctaaactagttccagtgggatacggaattaagaaacttcaaatacagtgtgtagttgaagatgataaagttggaacagatatgctggaggagcagatcactgcttttgaggactatgtgcagtccatggatgtggctgctttcaacaagatctaaaatccatcctggatcatggcatttaaataaaagattgaaagattaaaaaaaaaaaaaaaaaaaaaaacaaaaanaacaaaaaaaaaaaaaaaacaaaaaaaaacaaaaaaaacacacacaacacacaaaaaaaaaaaaaccaccaaaaaaaaaaacaaaaaacaacaacaatcaacaccaagccacccacagagacaaaaacgacacaagaaagccaacgagagagaaagagaaaagcgcgatacggacagcaagcaagcaaagacgaaagaaaaaaaaagaaaagcgggaacagatcaagaaagaagacaagaccg

SEQ ID NO: 448410 - DNA, 1419 bp, Homo sapiens
  misc_feature (1147)..(1147): n is a, c, g, or t
  misc_feature (1183)..(1183): n is a, c, g, or t
cgcagttccgccggaagtggccccagcctcgaggccgggcgtcttcggtcatctccggcgcttctagggctggttcccgtcatcttcgggagccgtggaggtacgaacttaagacatgcctattttattaatttacttccaaacgcaacgaaaggtccatggacaatttgtgggccatttaattcagggcccccaattcgtacgtggagaagtgggaatgcaaaagtactttgacctttaaccttcggtccggcgcggtggagggaaacgcctccgtctctatataaggaattttccggtctcttcgggtcctttttcctctcttcagcgtggggcgcccacaatttgcgcgctctctttctgctgctccccagctctcggatacagccgacaccatgggtttcggagacctgaaaagccctgccggcctccaggtgctcaacgattacctggcggacaagagctacatcgaggggtatgtgccatcacaagcagatgtggcagtatttgaagccgtgtccagcccaccgcctgccgacttgtgtcatgccctacgttggtataatcacatcaagtcttacgaaaaggaaaaggccagcctgccaggagtgaagaaagctttgggcaaatatggtcctgccgatgtggaagacactacaggaagtggagctacagatagtaaagatgatgatgacattgacctctttggatctgatgatgaggaggaaagtgaagaagcaaagaggctaagggaagaacgtcttgcacaatatgaatcaaagaaagccaaaaaacctgcacttgttgccaagtcttccatcttactagatgtgaaaccttgggatgatgagacagatatggcgaaattagaggagtgcgtcagaagcattcaagcagacggcttagtctggggctcatctaaactagttccagtgggatacggaattaagaaacttcaaatacagtgtgtagttgaagatgataaagttggaacagatatgctggaggagcagatcactgcttttgaggactatgtgcagtccatggatgtggctgctttcaacaagatctaaaatccatcctggatcatggcatttaaataaaagattgaaagattaaaaaaaaaaaaaaaaaaaaaaacaaaaanaacaaaaaaaaaaaaaaaacaaaaaaaaacaaaaancccttggggcccgcttggcccaagggaattttagattgggcaaggttattcctggggcccgaatttggggctaattggccaatttccccttatgggggggcggattaacattcaagggccggtgttttaacacggtggggctgggaaaacccttggcttacccaatttaaatggcttgggagttcccaacaagttggccaccctgaatgggcaatggaaattggagcggtattttt

SEQ ID NO: 448411 - DNA, 1263 bp, Homo sapiens
cgcagttccgccggaagtggccccagcctcgaggccgggcgtcttcggtcatctccggcgcttctagggctggttcccgtcatcttcgggagccgtggaggtacgaacttaagacatgcctattttattaatttacttccaaacgcaacgaaaggtccatggacaatttgtgggccatttaattcagggcccccaattcgtacgtggagaagtgggaatgcaaaagtactttgacctttaaccttcggtccggcgcggtggagggaaacgcctccgtctctatataaggaattttccggtctcttcgggtcctttttcctctcttcagcgtggggcgcccacaatttgcgcgctctctttctgctgctccccagctctcggatacagccgacaccatgggtttcggagacctgaaaagccctgccggcctccaggtgctcaacgattacctggcggacaagagctacatcgaggggtatgtgccatcacaagcagatgtggcagtatttgaagccgtgtccagcccaccgcctgccgacttgtgtcatgccctacgttggtataatcacatcaagtcttacgaaaaggaaaaggccagcctgccaggagtgaagaaagctttgggcaaatatggtcctgccgatgtggaagacactacaggaagtggagctacagatagtaaagatgatgatgacattgacctctttggatctgatgatgaggaggaaagtgaagaagcaaagaggctaagggaagaacgtcttgcacaatatgaatcaaagaaagccaaaaaacctgcacttgttgccaagtcttccatcttactagatgtgaaaccttgggatgatgagacagatatggcgaaattagaggagtgcgtcagaagcattcaagcagacggcttagtctggggctcatctaaactagttccagtgggatacggaattaagaaacttcaaatacagtgtgtagttgaagatgataaagttggaacagatatgctggaggagcagatcactgcttttgaggactatgtgcagtccatggatgtggctgctttcaacaagatctaaaatccatcctggatcatggcatttaaataaaagattgaaagattaccgggccggttaaataagtctggggtccacaaaaaaaaagtgtggcccgcccaagaaataaccctgggcggggccagaagcagtgaggtccaagctgacggagggtcccaaaaggcgggggaaacagtgtgttcagcaccaccgg

SEQ ID NO: 448412 - DNA, 1181 bp, Homo sapiens
  misc_feature (1158)..(1158): n is a, c, g, or t
cgcagttccgccggaagtggccccagcctcgaggccgggcgtcttcggtcatctccggcgcttctagggctggttcccgtcatcttcgggagccgtggaggtacgaacttaagacatgcctattttattaatttacttccaaacgcaacgaaaggtccatggacaatttgtgggccatttaattcagggcccccaattcgtacgtggagaagtgggaatgcaaaagtactttgacctttaaccttcggtccggcgcggtggagggaaacgcctccgtctctatataaggaattttccggtctcttcgggtcctttttcctctcttcagcgtggggcgcccacaatttgcgcgctctctttctgctgctccccagctctcggatacagccgacaccatgggtttcggagacctgaaaagccctgccggcctccaggtgctcaacgattacctggcggacaagagctacatcgaggggtatgtgccatcacaagcagatgtggcagtatttgaagccgtgtccagcccaccgcctgccgacttgtgtcatgccctacgttggtataatcacatcaagtcttacgaaaaggaaaaggccagcctgccaggagtgaagaaagctttgggcaaatatggtcctgccgatgtggaagacactacaggaagtggagctacagatagtaaagatgatgatgacattgacctctttggatctgatgatgaggaggaaagtgaagaagcaaagaggctaagggaagaacgtcttgcacaatatgaatcaaagaaagccaaaaaacctgcacttgttgccaagtcttccatcttactagatgtgaaaccttgggatgatgagacagatatggcgaaattagaggagtgcgtcagaagcattcaagcagacggcttagtctggggctcatctaaactagttccagtgggatacggaattaagaaacttcaaatacagtgtgtagttgaagatgataaagttggaacagatatgctggaggagcagatcactgcttttgaggactatgtgcagtccatggatgtggctgctttcaacaagatctaaaatccatcctggatcatggcatttaaataaaagattgaaagattataaaaaaaaaaaacaaccctccaagaaaatattaaacccncctttttgaaatccattcgcgcg

SEQ ID NO: 448413 - DNA, 1491 bp, Homo sapiens
cgcagttccgccggaagtggccccagcctcgaggccgggcgtcttcggtcatctccggcgcttctagggctggttcccgtcatcttcgggagccgtggaggtacgaacttaagacatgcctattttattaatttacttccaaacgcaacgaaaggtccatggacaatttgtgggccatttaattcagggcccccaattcgtacgtggagaagtgggaatgcaaaagtactttgacctttaaccttcggtccggcgcggtggagggaaacgcctccgtctctatataaggaattttccggtctcttcgggtcctttttcctctcttcagcgtggggcgcccacaatttgcgcgctctctttctgctgctccccagctctcggatacagccgacaccatgggtttcggagacctgaaaagccctgccggcctccaggtgctcaacgattacctggcggacaagagctacatcgaggggtatgtgccatcacaagcagatgtggcagtatttgaagccgtgtccagcccaccgcctgccgacttgtgtcatgccctacgttggtataatcacatcaagtcttacgaaaaggaaaaggccagcctgccaggagtgaagaaagctttgggcaaatatggtcctgccgatgtggaagacactacaggaagtggagctacagatagtaaagatgatgatgacattgacctctttggatctgatgatgaggaggaaagtgaagaagcaaagaggctaagggaagaacgtcttgcacaatatgaatcaaagaaagccaaaaaacctgcacttgttgccaagtcttccatcttactagatgtgaaaccttgggatgatgagacagatatggcgaaattagaggagtgcgtcagaagcattcaagcagacggcttagtctggggctcatctaaactagttccagtgggatacggaattaagaaacttcaaatacagtgtgtagttgaagatgataaagttggaacagatatgctggaggagcagatcactgcttttgaggactatgtgcagtccatggatgtggctgctttcaacaagatctaaaatccatcctggatcatggcatttaaataaaagattgaaagattaaaaacatcaaaacacacaatcaaaaacaaaataaaaaaaaaaataaaaacacaaaagcacccacatcactcatacatatgcccgcctaccatactactcacacgcaactgacctctccaacccgtatcacatccccatccgcgccactcgcgaatgtcactaccatcctactacatcaccaaatattcgcacctagctaatacacacctactctactctaacactaaaagactaccctaaaaatactacatacagccacttccaactttatgctcactacaaacacaacaacaccacaacctctcactctaacacaactcttatcaaataccaacactaaacgaccacctgctctctacctctactctcacta

SEQ ID NO: 448414 - DNA, 1354 bp, Homo sapiens
cgcagttccgccggaagtggccccagcctcgaggccgggcgtcttcggtcatctccggcgcttctagggctggttcccgtcatcttcgggagccgtggaggtacgaacttaagacatgcctattttattaatttacttccaaacgcaacgaaaggtccatggacaatttgtgggccatttaattcagggcccccaattcgtacgtggagaagtgggaatgcaaaagtactttgacctttaaccttcggtccggcgcggtggagggaaacgcctccgtctctatataaggaattttccggtctcttcgggtcctttttcctctcttcagcgtggggcgcccacaatttgcgcgctctctttctgctgctccccagctctcggatacagccgacaccatgggtttcggagacctgaaaagccctgccggcctccaggtgctcaacgattacctggcggacaagagctacatcgaggggtatgtgccatcacaagcagatgtggcagtatttgaagccgtgtccagcccaccgcctgccgacttgtgtcatgccctacgttggtataatcacatcaagtcttacgaaaaggaaaaggccagcctgccaggagtgaagaaagctttgggcaaatatggtcctgccgatgtggaagacactacaggaagtggagctacagatagtaaagatgatgatgacattgacctctttggatctgatgatgaggaggaaagtgaagaagcaaagaggctaagggaagaacgtcttgcacaatatgaatcaaagaaagccaaaaaacctgcacttgttgccaagtcttccatcttactagatgtgaaaccttgggatgatgagacagatatggcgaaattagaggagtgcgtcagaagcattcaagcagacggcttagtctggggctcatctaaactagttccagtgggatacggaattaagaaacttcaaatacagtgtgtagttgaagatgataaagttggaacagatatgctggaggagcagatcactgcttttgaggactatgtgcagtccatggatgtggctgctttcaacaagatctaaaatccatcctggatcatggcatttaaataaaagattgaaagattaaaaaaaaaaaaacaaaaaaaaacaaaaaaaacacacacaacacacaaaaaaaaaaaaaccaccaaaaaaaaaaacaaaaaacaacaacaatcaacaccaagccacccacagagacaaaaacgacacaagaaagccaacgagagagaaagagaaaagcgcgatacggacagcaagcaagcaaagacgaaagaaaaaaaaagaaaagcgggaacagatcaagaaagaagacaagaccg

SEQ ID NO: 448415 - DNA, 889 bp, Homo sapiens
cgcagttccgccggaagtggccccagcctcgaggccgggcgtcttcggtcatctccggcgcttctagggctggttcccgtcatcttcgggagccgtggaggtggggcgcccacaatttgcgcgctctctttctgctgctccccagctctcggatacagccgacaccatgggtttcggagacctgaaaagccctgccggcctccaggtgctcaacgattacctggcggacaagagctacatcgaggggtatgtgccatcacaagcagatgtggcagtatttgaagccgtgtccagcccaccgcctgccgacttgtgtcatgccctacgttggtataatcacatcaagtcttacgaaaaggaaaaggccagcctgccaggagtgaagaaagctttgggcaaatatggtcctgccgatgtggaagacactacaggaagtggagctacagatagtaaagatgatgatgacattgacctctttggatctgatgatgaggaggaaagtgaagaagcaaagaggctaagggaagaacgtcttgcacaatatgaatcaaagaaagccaaaaaacctgcacttgttgccaagtcttccatcttactagatgtgaaaccttgggatgatgagacagatatggcgaaattagaggagtgcgtcagaagcattcaagcagacggcttagtctggggctcatctaaactagttccagtgggatacggaattaagaaacttcaaatacagtgtgtagttgaagatgataaagttggaacagatatgctggaggagcagatcactgcttttgaggactatgtgcagtccatggatgtggctgctttcaacaagatctaaaatccatcctggatcatggcatttaaataaaagattgaaagatta

SEQ ID NO: 448416 - DNA, 924 bp, Homo sapiens
  misc_feature (45)..(45): n is a, c, g, or t
tcatacgctgctctagaggatacaacttatgttctgacccacctnttgcagtttattttactgtgtggtagtgcattcttatgttctgacccactcttatgttctgacccacccttatgttctgacccacctcaggtggggcgcccacaatttgcgcgctctctttctgctgctccccagctctcggatacagccgacaccatgggtttcggagacctgaaaagccctgccggcctccaggtgctcaacgattacctggcggacaagagctacatcgaggggtatgtgccatcacaagcagatgtggcagtatttgaagccgtgtccagcccaccgcctgccgacttgtgtcatgccctacgttggtataatcacatcaagtcttacgaaaaggaaaaggccagcctgccaggagtgaagaaagctttgggcaaatatggtcctgccgatgtggaagacactacaggaagtggagctacagatagtaaagatgatgatgacattgacctctttggatctgatgatgaggaggaaagtgaagaagcaaagaggctaagggaagaacgtcttgcacaatatgaatcaaagaaagccaaaaaacctgcacttgttgccaagtcttccatcttactagatgtgaaaccttgggatgatgagacagatatggcgaaattagaggagtgcgtcagaagcattcaagcagacggcttagtctggggctcatctaaactagttccagtgggatacggaattaagaaacttcaaatacagtgtgtagttgaagatgataaagttggaacagatatgctggaggagcagatcactgcttttgaggactatgtgcagtccatggatgtggctgctttcaacaagatctaaaatccatcctggatcatggcatttaaataaaagattgaaagatta

SEQ ID NO: 448417 - DNA, 898 bp, Homo sapiens
ctagacctgccatttctcacacacagatttaggaatgaccaacttgtaccctcccagcgtttagcacaacacaatgacacccttaatttgacaatctgcttcctctaatatatccccagtctaaggcatttaaaattaaacagctcttcaaaccctctcggatacagccgacaccatgggtttcggagacctgaaaagccctgccggcctccaggtgctcaacgattacctggcggacaagagctacatcgaggggtatgtgccatcacaagcagatgtggcagtatttgaagccgtgtccagcccaccgcctgccgacttgtgtcatgccctacgttggtataatcacatcaagtcttacgaaaaggaaaaggccagcctgccaggagtgaagaaagctttgggcaaatatggtcctgccgatgtggaagacactacaggaagtggagctacagatagtaaagatgatgatgacattgacctctttggatctgatgatgaggaggaaagtgaagaagcaaagaggctaagggaagaacgtcttgcacaatatgaatcaaagaaagccaaaaaacctgcacttgttgccaagtcttccatcttactagatgtgaaaccttgggatgatgagacagatatggcgaaattagaggagtgcgtcagaagcattcaagcagacggcttagtctggggctcatctaaactagttccagtgggatacggaattaagaaacttcaaatacagtgtgtagttgaagatgataaagttggaacagatatgctggaggagcagatcactgcttttgaggactatgtgcagtccatggatgtggctgctttcaacaagatctaaaatccatcctggatcatggcatttaaataaaagattgaaagatta

SEQ ID NO: 448418 - DNA, 963 bp, Homo sapiens
cgcagttccgccggaagtggccccagcctcgaggccgggcgtcttcggtcatctccggcgcttctagggctggttcccgtcatcttcgggagccgtggaggtacgaacttaagacatgcctattttattaatttacttccaaacgcaacgaaaggtccatggacaatttgtgggccatttaattcagggcccccaattcgtacgtggagaagtgggaatgcaaaagtactttgacctttaaccttcggtccggcgcggtggagggaaacgcctccgtctctatataaggaattttccggtctcttcgggtcctttttcctctcttcagcgtggggcgcccacaatttgcgcgctctctttctgctgctccccagctctcggatacagccgacaccatgggtttcggagacctgaaaagccctgccggcctccaggtgctcaacgattacctggcggacaagagctacatcgaggggtatgtgccatcacaagcagatgtggcagtatttgaagccgtgtccagcccaccgcctgccgacttgtgtcatgccctacgttggtataatcacatcaagtcttacgaaaaggaaaaggccagcctgccaggagtgaagaaagctttgggcaaatatggtcctgccgatgtggaagacactacaggaagtggagctacagatagtaaagatgatgatgacattgacctctttggatctgatgatgaggaggaaagtgaagaagcaaagaggctaagggaagaacgtcttgcacaatatgaatcaaagaaagccaaaaaacctgcacttgttgccaagtcttccatcttactagatgtgaaaccttgggatgatgagacagatatggcgaaattagaggagtgcgtcagaagcattcaagcagacggcttagtctggggctcatctaaactagttccagtgggacacgaatgttcaggtaccgagctcc

SEQ ID NO: 448419 - DNA, 953 bp, Homo sapiens
cgcagttccgccggaagtggccccagcctcgaggccgggcgtcttcggtcatctccggcgcttctagggctggttcccgtcatcttcgggagccgtggaggtacgaacttaagacatgcctattttattaatttacttccaaacgcaacgaaaggtccatggacaatttgtgggccatttaattcagggcccccaattcgtacgtggagaagtgggaatgcaaaagtactttgacctttaaccttcggtccggcgcggtggagggaaacgcctccgtctctatataaggaattttccggtctcttcgggtcctttttcctctcttcagcgtggggcgcccacaatttgcgcgctctctttctgctgctccccagctctcggatacagccgacaccatgggtttcggagacctgaaaagccctgccggcctccaggtgctcaacgattacctggcggacaagagctacatcgaggggtatgtgccatcacaagcagatgtggcagtatttgaagccgtgtccagcccaccgcctgccgacttgtgtcatgccctacgttggtataatcacatcaagtcttacgaaaaggaaaaggccagcctgccaggagtgaagaaagctttgggcaaatatggtcctgccgatgtggaagacactacaggaagtggagctacagatagtaaagatgatgatgacattgacctctttggatctgatgatgaggaggaaagtgaagaagcaaagaggctaagggaagaacgtcttgcacaatatgaatcaaagaaagccaaaaaacctgcacttgttgccaagtcttccatcttactagatgtgaaaccttgggatgatgagacagatatggcgaaattagaggagtgcgtcagaagcattcaagcagacggcttagtctggggctcatctaaactagttccagtggtagtaagactcaatacg

SEQ ID NO: 448420 - DNA, 970 bp, Homo sapiens
cgcagttccgccggaagtggccccagcctcgaggccgggcgtcttcggtcatctccggcgcttctagggctggttcccgtcatcttcgggagccgtggaggtacgaacttaagacatgcctattttattaatttacttccaaacgcaacgaaaggtccatggacaatttgtgggccatttaattcagggcccccaattcgtacgtggagaagtgggaatgcaaaagtactttgacctttaaccttcggtccggcgcggtggagggaaacgcctccgtctctatataaggaattttccggtctcttcgggtcctttttcctctcttcagcgtggggcgcccacaatttgcgcgctctctttctgctgctccccagctctcggatacagccgacaccatgggtttcggagacctgaaaagccctgccggcctccaggtgctcaacgattacctggcggacaagagctacatcgaggggtatgtgccatcacaagcagatgtggcagtatttgaagccgtgtccagcccaccgcctgccgacttgtgtcatgccctacgttggtataatcacatcaagtcttacgaaaaggaaaaggccagcctgccaggagtgaagaaagctttgggcaaatatggtcctgccgatgtggaagacactacaggaagtggagctacagatagtaaagatgatgatgacattgacctctttggatctgatgatgaggaggaaagtgaagaagcaaagaggctaagggaagaacgtcttgcacaatatgaatcaaagaaagccaaaaaacctgcacttgttgccaagtcttccatcttactagatgtgaaaccttgggatgatgagacagatatggcgaaattagaggagtgcgtcagaagcattcaagcagacggcttagtctggggctcatctaaactagttccggtgggtcagagccgaagttgtaccctcaagagtcagct

SEQ ID NO: 448421 - DNA, 837 bp, Homo sapiens
agcgggctagatgttttctgtcagggtatggtgcgaacgatgaggccccgcacaaggtgctggctcgtgaggttccggaatacatccgggacggcacgcggtcccggaaaccctggaagagaccggttgcggtccttgaggtggctcaacgaattaccgttctcggacgagtcatcttagatcgatgcggtatgctgctactacagaattgagcatgtggcagtatttgaagccgtgtccagcccaccgcctgccgacttgtgtcatgccctacgttggtataatcacatcaagtcttacgaaaaggaaaaggccagcctgccaggagtgaagaaagctttgggcaaatatggtcctgccgatgtggaagacactacaggaagtggagctacagatagtaaagatgatgatgacattgacctctttggatctgatgatgaggaggaaagtgaagaagcaaagaggctaagggaagaacgtcttgcacaatatgaatcaaagaaagccaaaaaacctgcacttgttgccaagtcttccatcttactagatgtgaaaccttgggatgatgagacagatatggcgaaattagaggagtgcgtcagaagcattcaagcagacggcttagtctggggctcatctaaactagttccagtgggatacggaattaagaaacttcaaatacagtgtgtagttgaagatgataaagttggaacagatatgctggaggagcagatcactgcttttgaggactatgtgcagtccatggatgtggctgctttcaacaagatctaaaatccatcctggatcatggcatttaaataaaagattgaaagatta

SEQ ID NO: 448422 - DNA, 831 bp, Homo sapiens
gatcagtgtagcgcgggcagctgcgtatagcggtgcccagcacgaagtccttgtagataagcacggcccagcacgaccgatcgggctgttcgtgaattaactcatacacgccccggcgagtcatgccgcgattgttgcaccagcgaatcggctcgcagtcaccatacactccaagataagaatgatatagtcgacgtcgcgagccaagatgtggcagtatttgaagccgtgtccagcccaccgcctgccgacttgtgtcatgccctacgttggtataatcacatcaagtcttacgaaaaggaaaaggccagcctgccaggagtgaagaaagctttgggcaaatatggtcctgccgatgtggaagacactacaggaagtggagctacagatagtaaagatgatgatgacattgacctctttggatctgatgatgaggaggaaagtgaagaagcaaagaggctaagggaagaacgtcttgcacaatatgaatcaaagaaagccaaaaaacctgcacttgttgccaagtcttccatcttactagatgtgaaaccttgggatgatgagacagatatggcgaaattagaggagtgcgtcagaagcattcaagcagacggcttagtctggggctcatctaaactagttccagtgggatacggaattaagaaacttcaaatacagtgtgtagttgaagatgataaagttggaacagatatgctggaggagcagatcactgcttttgaggactatgtgcagtccatggatgtggctgctttcaacaagatctaaaatccatcctggatcatggcatttaaataaaagattgaaagatta

SEQ ID NO: 448423 - DNA, 894 bp, Homo sapiens
tgaagattcgtgtcctctcatcatcgtcatcctcatcctcatccagacttgcccttttgtcatcagatgtgctggtctcagactcctcctcctcccgagccaggagcttcttaaaaacttgaaactcctcaacagaagtacaggctgtcctggccaaaaactcagcttctgaaactctgagaatgtccttgagcaatgggttagggatctgtgtctgccccttcttatcaggggtttggtaccgtcccaggcgctccaggtaaatgtgtctctggacacgaatgttcatgaacattcagcccaccgcctgccgacttgtgtcatgccctacgttggtataatcacatcaagtcttacgaaaaggaaaaggccagcctgccaggagtgaagaaagctttgggcaaatatggtcctgccgatgtggaagacactacaggaagtggagctacagatagtaaagatgatgatgacattgacctctttggatctgatgatgaggaggaaagtgaagaagcaaagaggctaagggaagaacgtcttgcacaatatgaatcaaagaaagccaaaaaacctgcacttgttgccaagtcttccatcttactagatgtgaaaccttgggatgatgagacagatatggcgaaattagaggagtgcgtcagaagcattcaagcagacggcttagtctggggctcatctaaactagttccagtgggatacggaattaagaaacttcaaatacagtgtgtagttgaagatgataaagttggaacagatatgctggaggagcagatcactgcttttgaggactatgtgcagtccatggatgtggctgctttcaacaagatctaaaatccatcctggatcatggcatttaaataaaagattgaaagatta

SEQ ID NO: 448424 - DNA, 819 bp, Homo sapiens
tttctacatctcttgcgcgtggcgcgccacaatatgtcgctgatctgctgctgcctgctcagctactgcggatctgctgatgactaggtgtttgggattatcatgcaaatgccctgcgggcgctcgaggtgcgcacggtatgaactggagtgacaatgagctcctcaaggcgtatgtgccattcatcagcagaagtgcgagcgattcgcaatcttgtataacagcccaccgcctgccgacttgtgtcatgccctacgttggtataatcacatcaagtcttacgaaaaggaaaaggccagcctgccaggagtgaagaaagctttgggcaaatatggtcctgccgatgtggaagacactacaggaagtggagctacagatagtaaagatgatgatgacattgacctctttggatctgatgatgaggaggaaagtgaagaagcaaagaggctaagggaagaacgtcttgcacaatatgaatcaaagaaagccaaaaaacctgcacttgttgccaagtcttccatcttactagatgtgaaaccttgggatgatgagacagatatggcgaaattagaggagtgcgtcagaagcattcaagcagacggcttagtctggggctcatctaaactagttccagtgggatacggaattaagaaacttcaaatacagtgtgtagttgaagatgataaagttggaacagatatgctggaggagcagatcactgcttttgaggactatgtgcagtccatggatgtggctgctttcaacaagatctaaaatccatcctggatcatggcatttaaataaaagattgaaagatta

SEQ ID NO: 448425 - DNA, 1092 bp, Homo sapiens
cgcagttccgccggaagtggccccagcctcgaggccgggcgtcttcggtcatctccggcgcttctagggctggttcccgtcatcttcgggagccgtggaggtacgaacttaagacatgcctattttattaatttacttccaaacgcaacgaaaggtccatggacaatttgtgggccatttaattcagggcccccaattcgtacgtggagaagtgggaatgcaaaagtactttgacctttaaccttcggtccggcgcggtggagggaaacgcctccgtctctatataaggaattttccggtctcttcgggtcctttttcctctcttcagcgtggggcgcccacaatttgcgcgctctctttctgctgctccccagctctcggatacagccgacaccatgggtttcggagacctgaaaagccctgccggcctccaggtgctcaacgattacctggcggacaagagctacatcgaggggtatgtgccatcacaagcagatgtggcagtatttgaagccgtgtcatgccctacgttggtataatcacatcaagtcttacgaaaaggaaaaggccagcctgccaggagtgaagaaagctttgggcaaatatggtcctgccgatgtggaagacactacaggaagtggagctacagatagtaaagatgatgatgacattgacctctttggatctgatgatgaggaggaaagtgaagaagcaaagaggctaagggaagaacgtcttgcacaatatgaatcaaagaaagccaaaaaacctgcacttgttgccaagtcttccatcttactagatgtgaaaccttgggatgatgagacagatatggcgaaattagaggagtgcgtcagaagcattcaagcagacggcttagtctggggctcatctaaactagttccagtgggatacggaattaagaaacttcaaatacagtgtgtagttgaagatgataaagttggaacagatatgctggaggagcagatcactgcttttgaggactatgtgcagtccatggatgtggctgctttcaacaagatctaaaatccatcctggatcatggcatttaaataaaagattgaaagatta

SEQ ID NO: 448426 - DNA, 1018 bp, Homo sapiens
cgcagttccgccggaagtggccccagcctcgaggccgggcgtcttcggtcatctccggcgcttctagggctggttcccgtcatcttcgggagccgtggaggtacgaacttaagacatgcctattttattaatttacttccaaacgcaacgaaaggtccatggacaatttgtgggccatttaattcagggcccccaattcgtacgtggagaagtgggaatgcaaaagtactttgacctttaaccttcggtccggcgcggtggagggaaacgcctccgtctctatataaggaattttccggtctcttcgggtcctttttcctctcttcagcgtggggcgcccacaatttgcgcgctctctttctgctgctccccagctctcggatacagccgacaccatgggtttcggagacctgaaaagccctgccggcctccaggtgctcaacgattacctggcggacaagagctacatcgaggggtatgtgccatcacaagcagatgtggcagtatttgaagccgtgtccagcccaccgcctgccgacttgtgtcatgccctacgttggtataatcacatcaagtcttacgaaaaggaaaaggccagcctgccaggagtgaagaaagctttgggcaaatatggtcctgccgatgtggaagacactacaggaagtggagctacagatagtaaagatgatgatgacattgacctctttggatctgatgatgaggaggaaagtgaagaagcaaagaggctaagggaagaacgtcttgcacaatatgaatcaaagaaagccaaaaatgatgagacagatatggcgaaattagaggagtgcgtcagaagcattcaagcagacggcttagtctggggctcatctaaactagttccagtgggatacggaattaagaaacttcaaatacagtgcctcttgacttcacatcctgaactgccaccatatgttcgtaacaaccaattccttctgtttacatcgatgtccatcgctccgctttccctgctcataccaca

SEQ ID NO: 448427 - DNA, 1364 bp, Homo sapiens
cgcagttccgccggaagtggccccagcctcgaggccgggcgtcttcggtcatctccggcgcttctagggctggttcccgtcatcttcgggagccgtggaggtacgaacttaagacatgcctattttattaatttacttccaaacgcaacgaaaggtccatggacaatttgtgggccatttaattcagggcccccaattcgtacgtggagaagtgggaatgcaaaagtactttgacctttaaccttcggtccggcgcggtggagggaaacgcctccgtctctatataaggaattttccggtctcttcgggtcctttttcctctcttcagcgtggggcgcccacaatttgcgcgctctctttctgctgctccccagctctcggatacagccgacaccatgggtttcggagacctgaaaagccctgccggcctccaggtgctcaacgattacctggcggacaagagctacatcgaggggtatgtgccatcacaagcagatgtggcagtatttgaagccgtgtccagcccaccgcctgccgacttgtgtcatgccctacgttggtataatcacatcaagtcttacgaaaaggaaaaggccaggtagaacatggacagcagcaattcaacttttccccacactgccctgccaatgtgcctcgaccttgacctggggggcccacctctggggtgagagggtggctcattcattcagtccttggccattcttctgaaactgccaacaagggtggaagtttggggaagtggactccagttcactaagaatggaactgagcatacttaatgaaatctcaaacagaaatgttcatactgaaagagtaaatcatacctgccaggagtgaagaaagctttgggcaaatatggtcctgccgatgtggaagacactacaggaagtggagctacagatagtaaagatgatgatgacattgacctctttggatctgatgatgaggaggaaagtgaagaagcaaagaggctaagggaagaacgtcttgcacaatatgaatcaaagaaagccaaaaaacctgcacttgttgccaagtcttccatcttactagatgtgaaaccttgggatgatgagacagatatggcgaaattagaggagtgcgtcagaagcattcaagcagacggcttagtctggggctcatctaaactagttccagtgggatacggaattaagaaacttcaaatacagtgtgtagttgaagatgataaagttggaacagatatgctggaggagcagatcactgcttttgaggactatgtgcagtccatggatgtggctgctttcaacaagatctaaaatccatcctggatcatggcatttaaataaaagattgaaagatta

SEQ ID NO: 448428 - DNA, 1090 bp, Homo sapiens
cgcagttccgccggaagtggccccagcctcgaggccgggcgtcttcggtcatctccggcgcttctagggctggttcccgtcatcttcgggagccgtggagctctcggatacagccgacaccatgggtttcggagacctgaaaagccctgccggcctccaggtgctcaacgattacctggcggacaagagctacatcgaggggtatgtgccatcacaagcagatgtggcagtatttgaagccgtgtccagcccaccgcctgccgacttgtgtcatgccctacgttggtataatcacatcaagtcttacgaaaaggaaaaggccaggtagaacatggacagcagcaattcaacttttccccacactgccctgccaatgtgcctcgaccttgacctggggggcccacctctggggtgagagggtggctcattcattcagtccttggccattcttctgaaactgccaacaagggtggaagtttggggaagtggactccagttcactaagaatggaactgagcatacttaatgaaatctcaaacagaaatgttcatactgaaagagtaaatcatacctgccaggagtgaagaaagctttgggcaaatatggtcctgccgatgtggaagacactacaggaagtggagctacagatagtaaagatgatgatgacattgacctctttggatctgatgatgaggaggaaagtgaagaagcaaagaggctaagggaagaacgtcttgcacaatatgaatcaaagaaagccaaaaaacctgcacttgttgccaagtcttccatcttactagatgtgaaaccttgggatgatgagacagatatggcgaaattagaggagtgcgtcagaagcattcaagcagacggcttagtctggggctcatctaaactagttccagtgggatacggaattaagaaacttcaaatacagtgtgtagttgaagatgataaagttggaacagatatgctggaggagcagatcactgcttttgaggactatgtgcagtccatggatgtggctgctttcaacaagatctaaaatccatcctggatcatggcatttaaataaaagattgaaagatta

SEQ ID NO: 448429 - DNA, 577 bp, Homo sapiens
gcctttttcctctcttcagcgtggggcgccccacgctgaagagaggaaaaaggccagcctgccaggagtgaagaaagctttgggcaaatatggtcctgccgatgtggaagacactacaggaagtggagctacagatagtaaagatgatgatgacattgacctctttggatctgatgatgaggaggaaagtgaagaagcaaagaggctaagggaagaacgtcttgcacaatatgaatcaaagaaagccaaaaaacctgcacttgttgccaagtcttccatcttactagatgtgaaaccttgggatgatgagacagatatggcgaaattagaggagtgcgtcagaagcattcaagcagacggcttagtctggggctcatctaaactagttccagtgggatacggaattaagaaacttcaaatacagtgtgtagttgaagatgataaagttggaacagatatgctggaggagcagatcactgcttttgaggactatgtgcagtccatggatgtggctgctttcaacaagatctaaaatccatcctggatcatggcatttaaataaaagattgaaagatta

SEQ ID NO: 448430 - DNA, 551 bp, Homo sapiens
caatagtggttgaatttaaatgtttttcaagcctgccaggagtgaagaaagctttgggcaaatatggtcctgccgatgtggaagacactacaggaagtggagctacagatagtaaagatgatgatgacattgacctctttggatctgatgatgaggaggaaagtgaagaagcaaagaggctaagggaagaacgtcttgcacaatatgaatcaaagaaagccaaaaaacctgcacttgttgccaagtcttccatcttactagatgtgaaaccttgggatgatgagacagatatggcgaaattagaggagtgcgtcagaagcattcaagcagacggcttagtctggggctcatctaaactagttccagtgggatacggaattaagaaacttcaaatacagtgtgtagttgaagatgataaagttggaacagatatgctggaggagcagatcactgcttttgaggactatgtgcagtccatggatgtggctgctttcaacaagatctaaaatccatcctggatcatggcatttaaataaaagattgaaagatta

SEQ ID NO: 448431 - DNA, 631 bp, Homo sapiens
ctagccaggaacagccaggttcttaaaacacgagagttctagggaggacagcaaatggagccattctgattctgacaaaaagtccagacccaggctggctagacccctgggcctgccaggagtgaagaaagctttgggcaaatatggtcctgccgatgtggaagacactacaggaagtggagctacagatagtaaagatgatgatgacattgacctctttggatctgatgatgaggaggaaagtgaagaagcaaagaggctaagggaagaacgtcttgcacaatatgaatcaaagaaagccaaaaaacctgcacttgttgccaagtcttccatcttactagatgtgaaaccttgggatgatgagacagatatggcgaaattagaggagtgcgtcagaagcattcaagcagacggcttagtctggggctcatctaaactagttccagtgggatacggaattaagaaacttcaaatacagtgtgtagttgaagatgataaagttggaacagatatgctggaggagcagatcactgcttttgaggactatgtgcagtccatggatgtggctgctttcaacaagatctaaaatccatcctggatcatggcatttaaataaaagattgaaagatta

SEQ ID NO: 448432 - DNA, 793 bp, Homo sapiens
cgcagttccgccggaagtggccccagcctcgaggccgggcgtcttcggtcatctccggcgcttctagggctggttcccgtcatcttcgggagccgtggagctctcggatacagccgacaccatgggtttcggagacctgaaaagccctgccggcctccaggtgctcaacgattacctggcggacaagagctacatcgaggggtatgtgccatcacaagcagatgtggcagtatttgaagccgtgtccagcccaccgcctgccgacttgtgtcatgccctacgttggtataatcacatcaagtcttacgaaaaggaaaaggccagagacactacaggaagtggagctacagatagtaaagatgatgatgacattgacctctttggatctgatgatgaggaggaaagtgaagaagcaaagaggctaagggaagaacgtcttgcacaatatgaatcaaagaaagccaaaaaacctgcacttgttgccaagtcttccatcttactagatgtgaaaccttgggatgatgagacagatatggcgaaattagaggagtgcgtcagaagcattcaagcagacggcttagtctggggctcatctaaactagttccagtgggatacggaattaagaaacttcaaatacagtgtgtagttgaagatgataaagttggaacagatatgctggaggagcagatcactgcttttgaggactatgtgcagtccatggatgtggctgctttcaacaagatctaaaatccatcctggatcatggcatttaaataaaagattgaaagatta

SEQ ID NO: 448433 - DNA, 793 bp, Homo sapiens
cgcagttccgccggaagtggccccagcctcgaggccgggcgtcttcggtcatctccggcgcttctagggctggttcccgtcatcttcgggagccgtggagctctcggatacagccgacaccatgggtttcggagacctgaaaagccctgccggcctccaggtgctcaacgattacctggcggacaagagctacatcgaggggtatgtgccatcacaagcagatgtggcagtatttgaagccgtgtccagcccaccgcctgccgacttgtgtcatgccctacgttggtataatcacatcaagtcttacgaaaaggaaaaggccagcctgccaggagtgaagaaagctttgggcaaatatggtcctgccgatgtggaagacactacaggaagtggagctacagatagtaaagatgatgatgacattgacctctttggatctgatgatgaggaggaaagtgaagaagcaaagaggctaagggaagaacgtcttgcacaatatgaatcaaagaaagccaaaaatgatgagacagatatggcgaaattagaggagtgcgtcagaagcattcaagcagacggcttagtctggggctcatctaaactagttccagtgggatacggaattaagaaacttcaaatacagtgtgtagttgaagatgataaagttggaacagatatgctggaggagcagatcactgcttttgaggactatgtgcagtccatggatgtggctgctttcaacaagatctaaaatccatcctggatcatggcatttaaataaaagattgaaagatta

SEQ ID NO: 448434 - DNA, 572 bp, Homo sapiens
gcgacgtgcagatcctaatgacatctgccgggtacacaggctacatctttaaacaggacccaaagtttgggagaaagggtcaattcactcctcataagaccccacaggctttcagatgccaaggtgcatggtgttctcatatggaaaacctgccacctactcccatacccctaattcctgaccccctgaatccctgctcaccatttataccacgtcttgcacaatatgaatcaaagaaagccaaaaaacctgcacttgttgccaagtcttccatcttactagatgtgaaaccttgggatgatgagacagatatggcgaaattagaggagtgcgtcagaagcattcaagcagacggcttagtctggggctcatctaaactagttccagtgggatacggaattaagaaacttcaaatacagtgtgtagttgaagatgataaagttggaacagatatgctggaggagcagatcactgcttttgaggactatgtgcagtccatggatgtggctgctttcaacaagatctaaaatccatcctggatcatggcatttaaataaaagattgaaagatta

SEQ ID NO: 448435 - DNA, 489 bp, Homo sapiens
gaggaaaagcccggggagacgttctatccctaaccctcttgcttcttcacttggcctcctacactcatcgagatccaaagaggtcaacgtcatcatcatctttactatctgtagctccacttcctgtagtgtctaccacaatatgaatcaaagaaagccaaaaaacctgcacttgttgccaagtcttccatcttactagatgtgaaaccttgggatgatgagacagatatggcgaaattagaggagtgcgtcagaagcattcaagcagacggcttagtctggggctcatctaaactagttccagtgggatacggaattaagaaacttcaaatacagtgtgtagttgaagatgataaagttggaacagatatgctggaggagcagatcactgcttttgaggactatgtgcagtccatggatgtggctgctttcaacaagatctaaaatccatcctggatcatggcatttaaataaaagattgaaagatta

SEQ ID NO: 448436 - DNA, 657 bp, Homo sapiens
cggacgcgtgggtcgacccacgcgtccggaaagtgaagaagcaaagaggctaagggaagaacgtcttgcacaatatgaatcaaagaaagccaaaaaacctgcacttgttgccaagtcttccatcttactagatgtgaaaccttgggatgatgagacagatatggcgaaattagaggagtgcgtcagaagcattcaagcagacggcttagtctggggctcatctaaactagttccagtgggatacggaattaagaaacttcaaatacagtgtgtagttgaagatgataaagttggaacagatatgctggaggagcagatcactgcttttgaggactatgtgcagtccatggatgtggctgctttcaacaagatctaaaatccatcctggatcatggcatttaaataaaagattgaaagattaaaaaaaaaaaaacaaaaaaaaacaaaaaaaacacacacaacacacaaaaaaaaaaaaaccaccaaaaaaaaaaacaaaaaacaacaacaatcaacaccaagccacccacagagacaaaaacgacacaagaaagccaacgagagagaaagagaaaagcgcgatacggacagcaagcaagcaaagacgaaagaaaaaaaaagaaaagcgggaacagatcaagaaagaagacaagaccg

SEQ ID NO: 448437 - DNA, 521 bp, Homo sapiens
acaaagctccagtttccctgaaggctctggcattatctgcctgggtcactgctgtatccccagcatctagtccagggcctagcacacagtagatgctcagtaaacatggatgagcccctgaaaggcaagagtgttttgaaagctcccaagaactttccacaactgtctctggagcccagctctctgctgcacttagtctaaacctgtctctaaggtgcagacagatgcatcatctgctagtgtcttccacactcatctgttgtcccctaagtaggaagtatgaggtgggagggcagaggtttccaaatatttattgctcatctaaactagttccagtgggatacggaattaagaaacttcaaatacagtgtgtagttgaagatgataaagttggaacagatatgctggaggagcagatcactgcttttgaggactatgtgcagtccatggatgtggctgctttcaacaagatctaaaatccatcctggatcatggcatttaaataaaagattgaaagatta

SEQ ID NO: 448438 - DNA, 140 bp, Homo sapiens
agatatggcgaaattagaggagtgcgtcagaagcattcaagcagacggcttagtctggggctcatgtgagtttaggctttgcctttttttttttgaaactaacatctggaatttgcctacagtttcaacctttcctacaa

SEQ ID NO: 448439 - DNA, 844 bp, Homo sapiens
cgcagttccgccggaagtggccccagcctcgaggccgggcgtcttcggtcatctccggcgcttctagggctggttcccgtcatcttcgggagccgtggagctctcggatacagccgacaccatgggtttcggagacctgaaaagccctgccggcctccaggtgctcaacgattacctggcggacaagagctacatcgaggggtatgtgccatcacaagcagatgtggcagtatttgaagccgtgtccagcccaccgcctgccgacttgtgtcatgccctacgttggtataatcacatcaagtcttacgaaaaggaaaaggccagcctgccaggagtgaagaaagctttgggcaaatatggtcctgccgatgtggaagacactacaggaagtggagctacagatagtaaagatgatgatgacattgacctctttggatctgatgatgaggaggaaagtgaagaagcaaagaggctaagggaagaacgtcttgcacaatatgaatcaaagaaagccaaaaaacctgcacttgttgccaagtcttccatcttactagatgtgaaaccttgggatgatgagacagatatggcgaaattagaggagtgcgtcagaagcattcaagcagacggcttagtctggggctcatctaaactagttccagtgggatacggaattaagaaacttcaaatacagtgtgtagttgaagatgataaagttggaacagatatgctggaggagcagatcactgcttttgaggactatgtgcagtccatggatgtggctgctttcaacaagatctaaaatccatcctggatcatggcatttaaataaaagattgaaagatta

SEQ ID NO: 448440 - DNA, 720 bp, Homo sapiens
cgcagttccgccggaagtggccccagcctcgaggccgggcgtcttcggtcatctccggcgcttctagggctggttcccgtcatcttcgggagccgtggagctctcggatacagccgacaccatgggtttcggagacctgaaaagccctgccggcctccaggtgctcaacgattacctggcggacaagagctacatcgaggggtatgtgccatcacaagcagatgtggcagtatttgaagccgtgtccagcccaccgcctgccgacttgtgtcatgccctacgttggtataatcacatcaagtcttacgaaaaggaaaaggccagcctgccaggagtgaagaaagctttgggcaaatatggtcctgccgatgtggaagacactacaggaagtggagctacagatagtaaagatgatgatgacattgacctctttggatctgatgatgaggaggaaagtgaagaagcaaagaggctaagggaagaacgtcttgcacaatatgaatcaaagaaagccaaaaaacctgcacttgttgccaagtcttccatcttactagatgtgaaaccttgggatgatgagacagatatggcgaaattagaggagtgcgtcagaagcattcaagcagacggcttagtctggggctcattctaaactagtttccagtggggatccggaatttaagaaactttcaaaatcacgtggggtagtctgaaagaatgata

SEQ ID NO: 448441 - DNA, 465 bp, Homo sapiens
  misc_feature (21)..(21): n is a, c, g, or t
  misc_feature (437)..(437): n is a, c, g, or t
tcatcactgttctccacaccnccaccagaggatctctgaaaaatgcaaatctgatgccctacgttggtataatcacatcaagtcttacgaaaaggaaaaggccagcctgccaggagtgaagaaagctttgggcaaatatggtcctgccgatgtggaagacactacaggaagtggagctacagatagtaaagatgatgatgacattgacctctttggatctgatgatgaggaggaaagtgaagaagcaaagaggctaagggaagaacgtcttgcacaatatgaatcaaagaaagccaaaaaacctgcacttgttgccaagtcttccatcttactagatgtgaaaccttgggatgatgagacagatatggcgaaattagaggagtgcgtcagaagcattcaagcagacggcttagtctggggctcatctaaactagttncagtggactcaaatggtgccgagctcga

SEQ ID NO: 448442 - DNA, 1118 bp, Homo sapiens
cgcagttccgccggaagtggccccagcctcgaggccgggcgtcttcggtcatctccggcgcttctagggctggttcccgtcatcttcgggagccgtggaggtacgaacttaagacatgcctattttattaatttacttccaaacgcaacgaaaggtccatggacaatttgtgggccatttaattcagggcccccaattcgtacgtggagaagtgggaatgcaaaagtactttgacctttaaccttcggtccggcgcggtggagggaaacgcctccgtctctatataaggaattttccggtctcttcgggtcctttttcctctcttcagcgtggggcgcccacaatttgcgcgctctctttctgctgctccccagctctcggatacagccgacaccatgggtttcggagacctgaaaagccctgccggcctccaggtgctcaacgattacctggcggacaagagctacatcgaggggtatgtgccatcacaagcagatgtggcagtatttgaagccgtgtccagcccaccgcctgccgacttgtgtcatgccctacgttggtataatcacatcaagtcttacgaaaaggaaaaggccagcctgccaggagtgaagaaagctttgggcaaatatggtcctgccgatgtggaagacactacaggaagtggagctacagatagtaaagatgatgatgacattgacctctttggatctgatgatgaggaggaaagtgaagaagcaaagaggctaagggaagaacgtcttgcacaatatgaatcaaagaaagccaaaaaacctgcacttgttgccaagtcttccatcttactagatgtgaaaccttgggatgatgagacagatatggcgaaattagaggagtgcgtcagaagcattcaagcagacggcttagtctggggctcatctaaactagttccagtgggatacggaattaagaaacttcaaatacagtgtgtagttgaagatgataaagttggaacagatatgctggaggagcagatcactgcttttgaggactatgtgcagtccatggatgtggctgctttcaacaagatctaaaatccatcctggatcatggcatttaaataaaagattgaaagatta

SEQ ID NO: 448443 - DNA, 1269 bp, Homo sapiens
  misc_feature (1140)..(1140): n is a, c, g, or t
  misc_feature (1156)..(1156): n is a, c, g, or t
  misc_feature (1165)..(1165): n is a, c, g, or t
  misc_feature (1188)..(1188): n is a, c, g, or t
  misc_feature (1195)..(1195): n is a, c, g, or t
  misc_feature (1210)..(1210): n is a, c, g, or t
cgcagttccgccggaagtggccccagcctcgaggccgggcgtcttcggtcatctccggcgcttctagggctggttcccgtcatcttcgggagccgtggaggtacgaacttaagacatgcctattttattaatttacttccaaacgcaacgaaaggtccatggacaatttgtgggccatttaattcagggcccccaattcgtacgtggagaagtgggaatgcaaaagtactttgacctttaaccttcggtccggcgcggtggagggaaacgcctccgtctctatataaggaattttccggtctcttcgggtcctttttcctctcttcagcgtggggcgcccacaatttgcgcgctctctttctgctgctccccagctctcggatacagccgacaccatgggtttcggagacctgaaaagccctgccggcctccaggtgctcaacgattacctggcggacaagagctacatcgaggggtatgtgccatcacaagcagatgtggcagtatttgaagccgtgtccagcccaccgcctgccgacttgtgtcatgccctacgttggtataatcacatcaagtcttacgaaaaggaaaaggccagcctgccaggagtgaagaaagctttgggcaaatatggtcctgccgatgtggaagacactacaggaagtggagctacagatagtaaagatgatgatgacattgacctctttggatctgatgatgaggaggaaagtgaagaagcaaagaggctaagggaagaacgtcttgcacaatatgaatcaaagaaagccaaaaaacctgcacttgttgccaagtcttccatcttactagatgtgaaaccttgggatgatgagacagatatggcgaaattagaggagtgcgtcagaagcattcaagcagacggcttagtctggggctcatctaaactagttccagtgggatacggaattaagaaacttcaaatacagtgtgtagttgaagatgataaagttggaacagatatgctggaggagcagatcactgcttttgaggactatgtgcagtccatggatgtggctgctttcaacaagatctaaaatccatcctggatcatggcatttaaataaaagattgaaagattaggagattaaaaaaaaaaaactngggtttttgggggggnaaagggttnaaagggctggttatgtctcgccnttttgtnaagggaatggggccnaaaggggtaatgaacggggttgtagagaggtagaaaaagagagataaaaagggagataa

SEQ ID NO: 448444 - DNA, 1244 bp, Homo sapiens
cgcagttccgccggaagtggccccagcctcgaggccgggcgtcttcggtcatctccggcgcttctagggctggttcccgtcatcttcgggagccgtggaggtacgaacttaagacatgcctattttattaatttacttccaaacgcaacgaaaggtccatggacaatttgtgggccatttaattcagggcccccaattcgtacgtggagaagtgggaatgcaaaagtactttgacctttaaccttcggtccggcgcggtggagggaaacgcctccgtctctatataaggaattttccggtctcttcgggtcctttttcctctcttcagcgtggggcgcccacaatttgcgcgctctctttctgctgctccccagctctcggatacagccgacaccatgggtttcggagacctgaaaagccctgccggcctccaggtgctcaacgattacctggcggacaagagctacatcgaggggtatgtgccatcacaagcagatgtggcagtatttgaagccgtgtccagcccaccgcctgccgacttgtgtcatgccctacgttggtataatcacatcaagtcttacgaaaaggaaaaggccagcctgccaggagtgaagaaagctttgggcaaatatggtcctgccgatgtggaagacactacaggaagtggagctacagatagtaaagatgatgatgacattgacctctttggatctgatgatgaggaggaaagtgaagaagcaaagaggctaagggaagaacgtcttgcacaatatgaatcaaagaaagccaaaaaacctgcacttgttgccaagtcttccatcttactagatgtgaaaccttgggatgatgagacagatatggcgaaattagaggagtgcgtcagaagcattcaagcagacggcttagtctggggctcatctaaactagttccagtgggatacggaattaagaaacttcaaatacagtgtgtagttgaagatgataaagttggaacagatatgctggaggagcagatcactgcttttgaggactatgtgcagtccatggatgtggctgctttcaacaagatctaaaatccatcctggatcatggcatttaaataaaagattgaaagattaaaaaaaaaaaaaaaaaaagcggcgcagattcgatatcagcttatcgatccgtgacctcgaggggccgtaccatcgcctatagtagtcgatactcactgcgtcgttacactcgtgactggaacctgc

SEQ ID NO: 448445 - DNA, 1293 bp, Homo sapiens
cgcagttccgccggaagtggccccagcctcgaggccgggcgtcttcggtcatctccggcgcttctagggctggttcccgtcatcttcgggagccgtggaggtacgaacttaagacatgcctattttattaatttacttccaaacgcaacgaaaggtccatggacaatttgtgggccatttaattcagggcccccaattcgtacgtggagaagtgggaatgcaaaagtactttgacctttaaccttcggtccggcgcggtggagggaaacgcctccgtctctatataaggaattttccggtctcttcgggtcctttttcctctcttcagcgtggggcgcccacaatttgcgcgctctctttctgctgctccccagctctcggatacagccgacaccatgggtttcggagacctgaaaagccctgccggcctccaggtgctcaacgattacctggcggacaagagctacatcgaggggtatgtgccatcacaagcagatgtggcagtatttgaagccgtgtccagcccaccgcctgccgacttgtgtcatgccctacgttggtataatcacatcaagtcttacgaaaaggaaaaggccagcctgccaggagtgaagaaagctttgggcaaatatggtcctgccgatgtggaagacactacaggaagtggagctacagatagtaaagatgatgatgacattgacctctttggatctgatgatgaggaggaaagtgaagaagcaaagaggctaagggaagaacgtcttgcacaatatgaatcaaagaaagccaaaaaacctgcacttgttgccaagtcttccatcttactagatgtgaaaccttgggatgatgagacagatatggcgaaattagaggagtgcgtcagaagcattcaagcagacggcttagtctggggctcatctaaactagttccagtgggatacggaattaagaaacttcaaatacagtgtgtagttgaagatgataaagttggaacagatatgctggaggagcagatcactgcttttgaggactatgtgcagtccatggatgtggctgctttcaacaagatctaaaatccatcctggatcatggcatttaaataaaagattgaaagattatggttatgctttaataagatgccggtccgggaaaaacaaaaaaaaaaagggggggcaaaacccggggggcgatggccgtttgaagggccatggggagaaaaagggggggtaaagggggaaaagggggtggggacctggggggaggcacaaagcggaaaggtgggttcggtggaaa

SEQ ID NO: 448446 - DNA, 1169 bp, Homo sapiens
cgcagttccgccggaagtggccccagcctcgaggccgggcgtcttcggtcatctccggcgcttctagggctggttcccgtcatcttcgggagccgtggaggtacgaacttaagacatgcctattttattaatttacttccaaacgcaacgaaaggtccatggacaatttgtgggccatttaattcagggcccccaattcgtacgtggagaagtgggaatgcaaaagtactttgacctttaaccttcggtccggcgcggtggagggaaacgcctccgtctctatataaggaattttccggtctcttcgggtcctttttcctctcttcagcgtggggcgcccacaatttgcgcgctctctttctgctgctccccagctctcggatacagccgacaccatgggtttcggagacctgaaaagccctgccggcctccaggtgctcaacgattacctggcggacaagagctacatcgaggggtatgtgccatcacaagcagatgtggcagtatttgaagccgtgtccagcccaccgcctgccgacttgtgtcatgccctacgttggtataatcacatcaagtcttacgaaaaggaaaaggccagcctgccaggagtgaagaaagctttgggcaaatatggtcctgccgatgtggaagacactacaggaagtggagctacagatagtaaagatgatgatgacattgacctctttggatctgatgatgaggaggaaagtgaagaagcaaagaggctaagggaagaacgtcttgcacaatatgaatcaaagaaagccaaaaaacctgcacttgttgccaagtcttccatcttactagatgtgaaaccttgggatgatgagacagatatggcgaaattagaggagtgcgtcagaagcattcaagcagacggcttagtctggggctcatctaaactagttccagtgggatacggaattaagaaacttcaaatacagtgtgtagttgaagatgataaagttggaacagatatgctggaggagcagatcactgcttttgaggactatgtgcagtccatggatgtggctgctttcaacaagatctaaaatccatcctggatcatggcatttaaataaaagattgaaagattaattaaaaaatcaccttttaaacaagaaacggaaggcatttgatgcaaactt

SEQ ID NO: 448447 - DNA, 839 bp, Homo sapiens
  misc_feature (45)..(45): n is a, c, g, or t
tcatacgctgctctagaggatacaacttatgttctgacccacctnttgcagtggggcgcccacaatttgcgcgctctctttctgctgctccccagctctcggatacagccgacaccatgggtttcggagacctgaaaagccctgccggcctccaggtgctcaacgattacctggcggacaagagctacatcgaggggtatgtgccatcacaagcagatgtggcagtatttgaagccgtgtccagcccaccgcctgccgacttgtgtcatgccctacgttggtataatcacatcaagtcttacgaaaaggaaaaggccagcctgccaggagtgaagaaagctttgggcaaatatggtcctgccgatgtggaagacactacaggaagtggagctacagatagtaaagatgatgatgacattgacctctttggatctgatgatgaggaggaaagtgaagaagcaaagaggctaagggaagaacgtcttgcacaatatgaatcaaagaaagccaaaaaacctgcacttgttgccaagtcttccatcttactagatgtgaaaccttgggatgatgagacagatatggcgaaattagaggagtgcgtcagaagcattcaagcagacggcttagtctggggctcatctaaactagttccagtgggatacggaattaagaaacttcaaatacagtgtgtagttgaagatgataaagttggaacagatatgctggaggagcagatcactgcttttgaggactatgtgcagtccatggatgtggctgctttcaacaagatctaaaatccatcctggatcatggcatttaaataaaagattgaaagatta

SEQ ID NO: 448448 - DNA, 1065 bp, Homo sapiens
cgcagttccgccggaagtggccccagcctcgaggccgggcgtcttcggtcatctccggcgcttctagggctggttcccgtcatcttcgggagccgtggaggtacgaacttaagacatgcctattttattaatttacttccaaacgcaacgaaaggtccatggacaatttgtgggccatttaattcagggcccccaattcgtacgtggagaagtgggaatgcaaaagtactttgacctttaaccttcggtccggcgcggtggagggaaacgcctccgtctctatataaggaattttccggtctcttcgggtcctttttcctctcttcagcgtggggcgcccacaatttgcgcgctctctttctgctgctccccagctctcggatacagccgacaccatgggtttcggagacctgaaaagccctgccggcctccaggtgctcaacgattacctggcggacaagagctacatcgaggggtatgtgccatcacaagcagatgtggcagtatttgaagccgtgtccagcccaccgcctgccgacttgtgtcatgccctacgttggtataatcacatcaagtcttacgaaaaggaaaaggccagcctgccaggagtgaagaaagctttgggcaaatatggtcctgccgatgtggaagacactacaggaagtggagctacagatagtaaagatgatgatgacattgacctctttggatctgatgatgaggaggaaagtgaagaagcaaagaggctaagggaagaacgtcttgcacaatatgaatcaaagaaagccaaaaaacctgcacttgttgccaagtcttccatcttactagatgtgaaaccttgggatgatgagacagatatggcgaaattagaggagtgcgtcagaagcattcaagcagacggcttagtctggggctcatctaaactagttccagtgggatacggaattaagaaacttcaaatacagtgcttttgaggactatgtgcagtccatggatgtggctgctttcaacaagatctaaaatccatcctggatcatggcatttaaataaaagattgaaagatta

SEQ ID NO: 448449 - DNA, 958 bp, Homo sapiens
  misc_feature (930)..(930): n is a, c, g, or t
cgcagttccgccggaagtggccccagcctcgaggccgggcgtcttcggtcatctccggcgcttctagggctggttcccgtcatcttcgggagccgtggaggtacgaacttaagacatgcctattttattaatttacttccaaacgcaacgaaaggtccatggacaatttgtgggccatttaattcagggcccccaattcgtacgtggagaagtgggaatgcaaaagtactttgacctttaaccttcggtccggcgcggtggagggaaacgcctccgtctctatataaggaattttccggtctcttcgggtcctttttcctctcttcagcgtggggcgcccacaatttgcgcgctctctttctgctgctccccagctctcggatacagccgacaccatgggtttcggagacctgaaaagccctgccggcctccaggtgctcaacgattacctggcggacaagagctacatcgaggggtatgtgccatcacaagcagatgtggcagtatttgaagccgtgtccagcccaccgcctgccgacttgtgtcatgccctacgttggtataatcacatcaagtcttacgaaaaggaaaaggccagcctgccaggagtgaagaaagctttgggcaaatatggtcctgccgatgtggaagacactacaggaagtggagctacagatagtaaagatgatgatgacattgacctctttggatctgatgatgaggaggaaagtgaagaagcaaagaggctaagggaagaacgtcttgcacaatatgaatcaaagaaagccaaaaaacctgcacttgttgccaagtcttccatcttactagatgtgaaaccttgggatgatgagacagatatggcgaaattagaggagtgcgtcagaagcattcaagcagacggcttagtctggggctcatctaaactagttncagtggactcaaatggtgccgagctcga

SEQ ID NO: 448450 - DNA, 950 bp, Homo sapiens
  misc_feature (928)..(928): n is a, c, g, or t
  misc_feature (934)..(934): n is a, c, g, or t
cgcagttccgccggaagtggccccagcctcgaggccgggcgtcttcggtcatctccggcgcttctagggctggttcccgtcatcttcgggagccgtggaggtacgaacttaagacatgcctattttattaatttacttccaaacgcaacgaaaggtccatggacaatttgtgggccatttaattcagggcccccaattcgtacgtggagaagtgggaatgcaaaagtactttgacctttaaccttcggtccggcgcggtggagggaaacgcctccgtctctatataaggaattttccggtctcttcgggtcctttttcctctcttcagcgtggggcgcccacaatttgcgcgctctctttctgctgctccccagctctcggatacagccgacaccatgggtttcggagacctgaaaagccctgccggcctccaggtgctcaacgattacctggcggacaagagctacatcgaggggtatgtgccatcacaagcagatgtggcagtatttgaagccgtgtccagcccaccgcctgccgacttgtgtcatgccctacgttggtataatcacatcaagtcttacgaaaaggaaaaggccagcctgccaggagtgaagaaagctttgggcaaatatggtcctgccgatgtggaagacactacaggaagtggagctacagatagtaaagatgatgatgacattgacctctttggatctgatgatgaggaggaaagtgaagaagcaaagaggctaagggaagaacgtcttgcacaatatgaatcaaagaaagccaaaaaacctgcacttgttgccaagtcttccatcttactagatgtgaaaccttgggatgatgagacagatatggcgaaattagaggagtgcgtcagaagcattcaagcagacggcttagtctggggctcatctaactagtnccagtnggatacagtagggaga

SEQ ID NO: 448451 - DNA, 1167 bp, Homo sapiens
cgcagttccgccggaagtggccccagcctcgaggccgggcgtcttcggtcatctccggcgcttctagggctggttcccgtcatcttcgggagccgtggaggtacgaacttaagacatgcctattttattaatttacttccaaacgcaacgaaaggtccatggacaatttgtgggccatttaattcagggcccccaattcgtacgtggagaagtgggaatgcaaaagtactttgacctttaaccttcggtccggcgcggtggagggaaacgcctccgtctctatataaggaattttccggtctcttcgggtcctttttcctctcttcagcgtggggcgcccacaatttgcgcgctctctttctgctgctccccagctctcggatacagccgacaccatgggtttcggagacctgaaaagccctgccggcctccaggtgctcaacgattacctggcggacaagagctacatcgaggggtatgtgccatcacaagcagatgtggcagtatttgaagccgtgtccagcccaccgcctgccgacttgtgtcatgccctacgttggtataatcacatcaagtcttacgaaaaggaaaaggccagcctgccaggagtgaagaaagctttgggcaaatatggtcctgccgatgtggaagacactacaggaagtggagctacagatagtaaagatgatgatgacattgacctctttggatctgatgatgaggaggaaagtgaagaagcaaagaggctaagggaagaacgtcttgcacaatatgaatcaaagaaagccaaaaaacctgcacttgttgccaagtcttccatcttactagatgtgaaaccttgggatgatgagacagatatggcgaaattagaggagtgcgtccgaggctcagctgactgctaagacctgggccacatctaactagttcccggggatcggaatcagaactcaaatacaggggtagtcgacgaggtaagttggaccgaccgctggcggagcatcagctagagaccagcacgacaggcagggccgacacacaccaacccccgaaaggtacgacgacgcacggcacaacaaacaacacaaactgacgccggccgcacaccaacacggagccccaaaacacactaccgaacagcaagcataccaacggcaccacacccaccaa

SEQ ID NO: 448452 - DNA, 755 bp, Homo sapiens
cagcccccgcaagacgaccgactgcatttcctggggtggggccagctgagagtccctgagattacatggtctgtcttgccattctcaattcatgccctgccataaacccctcccgcgctgccacgtcttgcgggggctgccggcagcccccgcaagacagcccaccgcctgccgacttgtgtcatgccctacgttggtataatcacatcaagtcttacgaaaaggaaaaggccagcctgccaggagtgaagaaagctttgggcaaatatggtcctgccgatgtggaagacactacaggaagtggagctacagatagtaaagatgatgatgacattgacctctttggatctgatgatgaggaggaaagtgaagaagcaaagaggctaagggaagaacgtcttgcacaatatgaatcaaagaaagccaaaaaacctgcacttgttgccaagtcttccatcttactagatgtgaaaccttgggatgatgagacagatatggcgaaattagaggagtgcgtcagaagcattcaagcagacggcttagtctggggctcatctaaactagttccagtgggatacggaattaagaaacttcaaatacagtgtgtagttgaagatgataaagttggaacagatatgctggaggagcagatcactgcttttgaggactatgtgcagtccatggatgtggctgctttcaacaagatctaaaatccatcctggatcatggcatttaaataaaagattgaaagatta

SEQ ID NO: 448453 - DNA, 716 bp, Homo sapiens
cacgagggccacatccatggactgcacatagtcctcaaaagcagtgatctgctcctccagcatatctgttccaactttatcatcttcaactacacactgtatttgaagtttcttaattcagcccaccgcctgccgacttgtgtcatgccctacgttggtataatcacatcaagtcttacgaaaaggaaaaggccagcctgccaggagtgaagaaagctttgggcaaatatggtcctgccgatgtggaagacactacaggaagtggagctacagatagtaaagatgatgatgacattgacctctttggatctgatgatgaggaggaaagtgaagaagcaaagaggctaagggaagaacgtcttgcacaatatgaatcaaagaaagccaaaaaacctgcacttgttgccaagtcttccatcttactagatgtgaaaccttgggatgatgagacagatatggcgaaattagaggagtgcgtcagaagcattcaagcagacggcttagtctggggctcatctaaactagttccagtgggatacggaattaagaaacttcaaatacagtgtgtagttgaagatgataaagttggaacagatatgctggaggagcagatcactgcttttgaggactatgtgcagtccatggatgtggctgctttcaacaagatctaaaatccatcctggatcatggcatttaaataaaagattgaaagatta

SEQ ID NO: 448454 - DNA, 1067 bp, Homo sapiens
cgcagttccgccggaagtggccccagcctcgaggccgggcgtcttcggtcatctccggcgcttctagggctggttcccgtcatcttcgggagccgtggaggtacgaacttaagacatgcctattttattaatttacttccaaacgcaacgaaaggtccatggacaatttgtgggccatttaattcagggcccccaattcgtacgtggagaagtgggaatgcaaaagtactttgacctttaaccttcggtccggcgcggtggagggaaacgcctccgtctctatataaggaattttccggtctcttcgggtcctttttcctctcttcagcgtggggcgcccacaatttgcgcgctctctttctgctgctccccagctctcggatacagccgacaccatgggtttcggagacctgaaaagccctgccggcctccaggtgctcaacgattacctggcggacaagagctacatcgaggggtatgtgccatcacaagcagatgtggcagtatttgaagccgtgtccagcccaccgcctgccgacttgtgtcatgccctacgttggtataatcacatcaagtcttacgaaaaggaaaaggccagcctgccaggagtgaagaaagctttgggcaaatatggtcctgccgatgtggaagacactacaggaagtggagctacagatagtaaagatgatgatgacattgacctctttggatctgatgatgaggaggaaagtgaagaagcaaagaggctaagggaagaacgtcttgcacaatatgaatcaaagaaagccaaaaatgatgagacagatatggcgaaattagaggagtgcgtcagaagcattcaagcagacggcttagtctggggctcatctaaactagttccagtgggatacggaattaagaaacttcaaatacagtgtgtagttgaagatgataaagttggaacagatatgctggaggagcagatcactgcttttgaggactatgtgcagtccatggatgtggctgctttcaacaagatctaaaatccatcctggatcatggcatttaaataaaagattgaaagatta

SEQ ID NO: 448455 - DNA, 818 bp, Homo sapiens
cgcagttccgccggaagtggccccagcctcgaggccgggcgtcttcggtcatctccggcgcttctagggctggttcccgtcatcttcgggagccgtggaggtacgaacttaagacatgcctattttattaatttacttccaaacgcaacgaaaggtccatggacaatttgtgggccatttaattcagggcccccaattcgtacgtggagaagtgggaatgcaaaagtactttgacctttaaccttcggtccggcgcggtggagggaaacgcctccgtctctatataaggaattttccggtctcttcgggtcctttttcctctcttcagcgtggggcgcccacaatttgcgcgctctctttctgctgctccccagctctcggatacagccgacaccatgggtttcggagacctgaaaagccctgccggcctccaggtgctcaacgattacctggcggacaagagctacatcgaggggtatgtgccatcacaagcagatgtggcagtatttgaagccgtgtccagcccaccgcctgccgacttgtgtcatgccctacgttggtataatcacatcaagtcttacgaaaaggaaaaggccagcctgccaggagtgaagaaagctttgggcaaatatggtcctgccgatgtggaagacactacaggaagtggagctacagatagtaaagatgatgatgacattgacctctttggatctgatgatgaggaggaaagtgaagaagcaaagaggctaagggaagaacgtcttgcacaatatgaatcaaagaaagccaaaaagttaggtcatttgtattttaacttc

SEQ ID NO: 448456 - DNA, 1067 bp, Homo sapiens
cgcagttccgccggaagtggccccagcctcgaggccgggcgtcttcggtcatctccggcgcttctagggctggttcccgtcatcttcgggagccgtggaggtacgaacttaagacatgcctattttattaatttacttccaaacgcaacgaaaggtccatggacaatttgtgggccatttaattcagggcccccaattcgtacgtggagaagtgggaatgcaaaagtactttgacctttaaccttcggtccggcgcggtggagggaaacgcctccgtctctatataaggaattttccggtctcttcgggtcctttttcctctcttcagcgtggggcgcccacaatttgcgcgctctctttctgctgctccccagctctcggatacagccgacaccatgggtttcggagacctgaaaagccctgccggcctccaggtgctcaacgattacctggcggacaagagctacatcgaggggtatgtgccatcacaagcagatgtggcagtatttgaagccgtgtccagcccaccgcctgccgacttgtgtcatgccctacgttggtataatcacatcaagtcttacgaaaaggaaaaggccagagacactacaggaagtggagctacagatagtaaagatgatgatgacattgacctctttggatctgatgatgaggaggaaagtgaagaagcaaagaggctaagggaagaacgtcttgcacaatatgaatcaaagaaagccaaaaaacctgcacttgttgccaagtcttccatcttactagatgtgaaaccttgggatgatgagacagatatggcgaaattagaggagtgcgtcagaagcattcaagcagacggcttagtctggggctcatctaaactagttccagtgggatacggaattaagaaacttcaaatacagtgtgtagttgaagatgataaagttggaacagatatgctggaggagcagatcactgcttttgaggactatgtgcagtccatggatgtggctgctttcaacaagatctaaaatccatcctggatcatggcatttaaataaaagattgaaagatta

SEQ ID NO: 448457 - DNA, 1032 bp, Homo sapiens
cgcagttccgccggaagtggccccagcctcgaggccgggcgtcttcggtcatctccggcgcttctagggctggttcccgtcatcttcgggagccgtggaggtacgaacttaagacatgcctattttattaatttacttccaaacgcaacgaaaggtccatggacaatttgtgggccatttaattcagggcccccaattcgtacgtggagaagtgggaatgcaaaagtactttgacctttaaccttcggtccggcgcggtggagggaaacgcctccgtctctatataaggaattttccggtctcttcgggtcctttttcctctcttcagcgtggggcgcccacaatttgcgcgctctctttctgctgctccccagctctcggatacagccgacaccatgggtttcggagacctgaaaagccctgccggcctccaggtgctcaacgattacctggcggacaagagctacatcgaggggtatgtgccatcacaagcagatgtggcagtatttgaagccgtgtccagcccaccgcctgccgacttgtgtcatgccctacgttggtataatcacatcaagtcttacgaaaaggaaaaggccagcctgccaggagtgaagaaagctttgggcaaatatggtcctgccgatgtggaagacactacaggaagtggagctacagatagtaaagatgatgatgacattgacctctttggatctgatgatgaggaggtatggcgtcttctataaagaacatatcggccaggcgcagtggctcatgcctgtaatcccagcatgttgggaggctgaggcgggtggatcacgaggtcaggagttgaagaccagcctggccaagatggtgaaaccctgtctgtactaaaaatacaaaaaaatgtggcaggcatctgtaatcccagctactcaggcggctaaggcagagaattgcttgaacctaggaagcggaggttgcagtgagccaagatcgtgccactgcatccagcctgggcgacagagcgagactccgtcccaaaaaaaaaaa

SEQ ID NO: 448458 - DNA, 890 bp, Homo sapiens
aacttggcatggggcggggcctctgggaggcgtggcctccggccggctcctctgctgttgccaagggaaactgccgcgaggaggcggaaggagcagaggaccggcagccggcgtcgaggcggggcgcgggaacgacggcggccatggcggcctcggggcccgggtgtcgcagctggtgcttgtgtcccgaggtgccatccgccaccttcttcactgcgctgctctcgctgctggtttccgggcctcgcctgttcctgtgcaggctccaaggagtcctccagggtccccatgccctgagagaatttctagggaagtcatctcacttggccttctgaaggtcctccctaagagtctcctgacaaaagttacttattgaacacctctatgtgccaggctctgtgttgggtactttgatcaatgcccctgtttcagtctcatctgtactcacggcagccctgtggagtacggtgtactggcccagcttacagatgcagaaagcgagacgttctgccatcagataaagtcacgtggctctttagtaacacggacaaggctcctcgccaaggaactcgtggcagaagagggcagcagttggcagtagctgccgatgtctgtccccagctccaccattcctccctgtggctgtgccgtgctcgtggtttcagtgtccgtgtgtccatgtgtctgcccttcaggagctcgcagctggtgtgcttggcggtcccaggcctgtgtagtgtctctcccctgctgcgggcgcccccaccccgattcctctccccagaagcggtgggatgggcccccatgaactgcagcagcatgctgaggtgtccatgttgtctgcctttgtataaagaaacagcctctgaaaaaaaaagaaaaagtcgacg

SEQ ID NO: 448459 - DNA, 1831 bp, Homo sapiens
aacttggcatggggcggggcctctgggaggcgtggcctccggccggctcctctgctgttgccaagggaaactgccgcgaggaggcggaaggagcagaggaccggcagccggcgtcgaggcggggcgcgggaacgacggcggccatggcggcctcggggcccgggtgtcgcagctggtgcttgtgtcccgaggtgccatccgccaccttcttcactgcgctgctctcgctgctggtttccgggcctcgcctgttcctgctgcagcagcccctggcgccctcgggcctcacgctgaagtccgaggcccttcgcaactggcaagtttacaggctggtaacctacatctttgtctacgagaatcccatctccctgctctgcggcgctatcatcatctggcgctttgctggcaatttcgagagaaccgtgggcaccgtccgccactgcttcttcaccgtgatcttcgccatcttctccgctatcatcttcctgtcattcgaggctgtgtcatcactgtcaaagctgggggaagtggaggatgccagaggtttcaccccagtggcctttgccatgctgggagtcaccaccgtccgttctcggatgaggcgggccctggtgtttggcatggttgtgccctcagtcctggttccgtggctcctgctgggtgcctcgtggctcattccccagacctctttcctcagtaatgtctgcgggctgtccatcgggctggcctatggcctcacctactgctattccatcgacctctcagagcgagtggcgctgaagctcgatcagaccttccccttcagcctgatgaggaggatatccgtgttcaagtacgtctcagggtcttcagccgagaggagggcagcccagagccggaaactgaacccggtgcctggctcctaccccacacagagctgccaccctcacctgtccccaagccaccctgtgtcccagacgcagcacgccagtggtcagaagctggcctcctggccctcctgcacccccgggcacatgcccaccttgcctccgtaccagcctgcctccggcctgtgctatgtgcagaaccactttggtccaaaccccacctcctccagtgtctacccagcttctgcgggcacctccctgggcatccagccccccacgcctgtgaacagccctggcacggtgtattctggggccttgggcacaccaggggctgcaggctccaaggagtcctccagggtccccatgccctgagagaatttctagggaagtcatctcacttggccttctgaaggtcctccctaagagtctcctgacaaaagttacttattgaacacctctatgtgccaggctctgtgttgggtactttgatcaatgcccctgtttcagtctcatctgtactcacggcagccctgtggagtacggtgtactggcccagcttacagatgcagaaagcgagacgttctgccatcagataaagtcacgtggctctttagtaacacggacaaggctcctcgccaaggaactcgtggcagaagagggcagcagttggcagtagctgccgatgtctgtccccagctccaccattcctccctgtggctgtgccgtgctcgtggtttcagtgtccgtgtgtccatgtgtctgcccttcaggagctcgcagctggtgtgcttggcggtcccaggcctgtgtagtgtctctcccctgctgcgggcgcccccaccccgattcctctccccagaagcggtgggatgggcccccatgaactgcagcagcatgctgaggtgtccatgttgtctgcctttgtataaagaaacagcctctgaaaaaaaaagaaaaagtcgacg

SEQ ID NO: 448460 - DNA, 869 bp, Homo sapiens
aacttggcatggggcggggcctctgggaggcgtggcctccggccggctcctctgctgttgccaagggaaactgccgcgaggaggcggaaggagcagaggaccggcagccggcgtcgaggcggggcgcgggaacgacggcggccatggcggcctcggggcccgggtgtcgcagctggtgcttgtgtcccgaggtgccatccgccaccttcttcactgcgctgctctcgctgctggtttccgggcctcgcctgttcctgtgcaggctccaaggagtcctccagggtccccatgccctgagagaatttctagggaagtcatctcacttggccttctgaaggtcctccctaagagtctcctgacaaaagttacttattgaacacctctatgtgccaggctctgtgttgggtactttgatcaatgcccctgtttcagtctcatctgtactcacggcagccctgtggagtacggtgtactggcccagcttacagatgcagaaagcgagacgttctgccatcagataaagtcacgtggctctttagtaacacggacaaggctcctcgccaaggaactcgtggcagaagagggcagcagttggcagtagctgccgatgtctgtccccagctccaccattcctccctgtggctgtgccgtgctcgtggtttcagtgtccgtgtgtccatgtgtctgcccttcaggagctcgcagctggtgtgcttggcggtcccaggcctgtgtagtgtctctcccctgctgcgggcgcccccaccccgattcctctccccagaagcggtgggatgggcccccatgaactgcagcagcatgctgaggtgtccatgttgtctgcctttgtataaagaaacagcctctga

SEQ ID NO: 448461 - DNA, 549 bp, Homo sapiens
ccctgtggagtacggtgtactggcccagcttacagatgcagaaagcgagacgttctgccatcagataaagtcacgtggctctttagtaacacggacaaggctcctcgccaaggaactcgtggcagaagagggcagcagttggcagtagctgccgatgtctgtccccagctccaccattcctccctgtggctgtgccgtgctcgtggtttcagtgtccgtgtgtccatgcgtccgccactgcttcttcaccgtgatcttcgccatcttctccgctatcatcttcctgtcattcgaggctgtgtcatcactgtcaaagctgggggaagtggaggatgccagaggtttcaccccagtggcctttgccatgctgggagtcaccaccgtccgttctcggatgaggcgggccctggtgtttggcatggttgtgccctcagtcctggttccgtggctcctgctgggtgcctcgtggctcattccccagacctctttcctcagtaatgtctgcgggctgtccatcgggctggcctgtatccttcctagcagagagct

SEQ ID NO: 448462 - DNA, 1932 bp, Homo sapiens
aacttggcatggggcggggcctctgggaggcgtggcctccggccggctcctctgctgttgccaagggaaactgccgcgaggaggcggaaggagcagaggaccggcagccggcgtcgaggcggggcgcgggaacgacggcggccatggcggcctcggggcccgggtgtcgcagctggtgcttgtgtcccgaggtgccatccgccaccttcttcactgcgctgctctcgctgctggtttccgggcctcgcctgttcctgctgcagcagcccctggcgccctcgggcctcacgctgaagtccgaggcccttcgcaactggcaagccactatggaaggaggggtcaggattacagcagaggagactggcacacagagtgttaagtgacacccactcaatccaccccgaagctgttacacttaattaaccctcaaactgcccagtgagtttacaggctggtaacctacatctttgtctacgagaatcccatctccctgctctgcggcgctatcatcatctggcgctttgctggcaatttcgagagaaccgtgggcaccgtccgccactgcttcttcaccgtgatcttcgccatcttctccgctatcatcttcctgtcattcgaggctgtgtcatcactgtcaaagctgggggaagtggaggatgccagaggtttcaccccagtggcctttgccatgctgggagtcaccaccgtccgttctcggatgaggcgggccctggtgtttggcatggttgtgccctcagtcctggttccgtggctcctgctgggtgcctcgtggctcattccccagacctctttcctcagtaatgtctgcgggctgtccatcgggctggcctatggcctcacctactgctattccatcgacctctcagagcgagtggcgctgaagctcgatcagaccttccccttcagcctgatgaggaggatatccgtgttcaagtacgtctcagggtcttcagccgagaggagggcagcccagagccggaaactgaacccggtgcctggctcctaccccacacagagctgccaccctcacctgtccccaagccaccctgtgtcccagacgcagcacgccagtggtcagaagctggcctcctggccctcctgcacccccgggcacatgcccaccttgcctccgtaccagcctgcctccggcctgtgctatgtgcagaaccactttggtccaaaccccacctcctccagtgtctacccagcttctgcgggcacctccctgggcatccagccccccacgcctgtgaacagccctggcacggtgtattctggggccttgggcacaccaggggctgcaggctccaaggagtcctccagggtccccatgccctgagagaatttctagggaagtcatctcacttggccttctgaaggtcctccctaagagtctcctgacaaaagttacttattgaacacctctatgtgccaggctctgtgttgggtactttgatcaatgcccctgtttcagtctcatctgtactcacggcagccctgtggagtacggtgtactggcccagcttacagatgcagaaagcgagacgttctgccatcagataaagtcacgtggctctttagtaacacggacaaggctcctcgccaaggaactcgtggcagaagagggcagcagttggcagtagctgccgatgtctgtccccagctccaccattcctccctgtggctgtgccgtgctcgtggtttcagtgtccgtgtgtccatgtgtctgcccttcaggagctcgcagctggtgtgcttggcggtcccaggcctgtgtagtgtctctcccctgctgcgggcgcccccaccccgattcctctccccagaagcggtgggatgggcccccatgaactgcagcagcatgctgaggtgtccatgttgtctgcctttgtataaagaaacagcctctga

SEQ ID NO: 448463 - DNA, 1020 bp, Homo sapiens
aacttggcatggggcggggcctctgggaggcgtggcctccggccggctcctctgctgttgccaagggaaactgccgcgaggaggcggaaggagcagaggaccggcagccggcgtcgaggcggggcgcgggaacgacggcggccatggcggcctcggggcccgggtgtcgcagctggtgcttgtgtcccgaggtgccatccgccaccttcttcactgcgctgctctcgctgctggtttccgggcctcgcctgttcctgctgcagcagcccctggcgccctcgggcctcacgctgaagtccgaggcccttcgcaactggcaagtttacaggctggtaacctacatctttgtctacgagaatcccatctccctgctctgcggcgctatcatcatctggcgctttgctggcaatttcgagagaaccgtgggcaccgtccgccactgcttcttcaccgtgatcttcgccatcttctccgctatcatcttcctgtcattcgaggctgtgtcatcactgtcaaagctgggggaagtggaggatgccagaggtttcaccccagtggcctttgccatgctgggagtcaccaccgtccgttctcggatgaggcgggccctggtgtttggcatggttgtgccctcagtcctggttccgtggctcctgctgggtgcctcgtggctcattccccagacctctttcctcagtaatgtctgcgggctgtccatcgggctggcctatggcctcacctactgctattccatcgacctctcagagcgagtggcgctgaagctcgatcagaccttccccttcagcctgatgaggaggatatccgtgttcaagtacgtctcagggtcttcagccgagaggagggcagcccagagccggaaactgaacccggtgcctggctcctaccccacacagagctgccaccctcacctgtccccaagcgcctcgtccaactgctggtgaaggcccaccaggatgcccagcgccacgtagctgcagggacccactcggggtaccgagc

SEQ ID NO: 448464 - DNA, 908 bp, Homo sapiens
aacttggcatggggcggggcctctgggaggcgtggcctccggccggctcctctgctgttgccaagggaaactgccgcgaggaggcggaaggagcagaggaccggcagccggcgtcgaggcggggcgcgggaacgacggcggccatggcggcctcggggcccgggtgtcgcagctggtgcttgtgtcccgaggtgccatccgccaccttcttcactgcgctgctctcgctgctggtttccgggcctcgcctgttcctgctgcagcagcccctggcgccctcgggcctcacgctgaagtccgaggcccttcgcaactggcaagtttacaggctggtaacctacatctttgtctacgagaatcccatctccctgctctgcggcgctatcatcatctggcgctttgctggcaatttcgagagaaccgtgggcaccgtccgccactgcttcttcaccgtgatcttcgccatcttctccgctatcatcttcctgtcattcgaggctgtgtcatcactgtcaaagctgggggaagtggaggatgccagaggtttcaccccagtggcctttgccatgctgggagtcaccaccgtccgttctcggatgaggcgggccctggtgtttggcatggttgtgccctcagtcctggttccgtggctcctgctgggtgcctcgtggctcattccccagacctctttcctcagtaatgtctgcgggctgtccatcgggctggcctatggcctcacctactgctattccatcgacctctcccctgctgcgggcgcccccaccccgattcctctccccagaagcggtgggatgggcccccatgaactgcagcagcatgctgaggtgtccatgttgtctgcctttgtataaagaaacagcctctgaaaaaaaaagaaaaagtcgacg

SEQ ID NO: 448465 - DNA, 432 bp, Homo sapiens
tgttaagtgacacccactcaatccaccccgaagctgttacacttaattaaccctcaaactgcccagtgaggtaggtcagtatgaaaacctgaaaaaggattataaagcactttacaaattcagagactgccctctaccgaaaagtattatttttttccctctggaagtcagttaccgctaagagttgcaccaggcctggggaagtgtagggattagatattcatgcctctcctttgaggctctgggtccttcattgttgaacgcactgcttgtattgcctcctgctgcgactcactggctctcacttctctgtcacggaggggggctctctgcctttcctaggcggcttataacctggcttccctcctgggagcaacccgccgccaggcctctaacccgactccctctgcagtttacaggctggtaacctac

SEQ ID NO: 448466 - DNA, 1810 bp, Homo sapiens
aacttggcatggggcggggcctctgggaggcgtggcctccggccggctcctctgctgttgccaagggaaactgccgcgaggaggcggaaggagcagaggaccggcagccggcgtcgaggcggggcgcgggaacgacggcggccatggcggcctcggggcccgggtgtcgcagctggtgcttgtgtcccgaggtgccatccgccaccttcttcactgcgctgctctcgctgctggtttccgggcctcgcctgttcctgctgcagcagcccctggcgccctcgggcctcacgctgaagtccgaggcccttcgcaactggcaagtttacaggctggtaacctacatctttgtctacgagaatcccatctccctgctctgcggcgctatcatcatctggcgctttgctggcaatttcgagagaaccgtgggcaccgtccgccactgcttcttcaccgtgatcttcgccatcttctccgctatcatcttcctgtcattcgaggctgtgtcatcactgtcaaagctgggggaagtggaggatgccagaggtttcaccccagtggcctttgccatgctgggagtcaccaccgtccgttctcggatgaggcgggccctggtgtttggcatggttgtgccctcagtcctggttccgtggctcctgctgggtgcctcgtggctcattccccagacctctttcctcagtaatgtctgcgggctgtccatcgggctggcctatggcctcacctactgctattccatcgacctctcagagcgagtggcgctgaagctcgatcagaccttccccttcagcctgatgaggaggatatccgtgttcaagtacgtctcagggtcttcagccgagaggagggcagcccagagccggaaactgaacccggtgcctggctcctaccccacacagagctgccaccctcacctgtccccaagccaccctgtgtcccagacgcagcacgccagtggtcagaagctggcctcctggccctcctgcacccccgggcacatgcccaccttgcctccgtaccagcctgcctccggcctgtgctatgtgcagaaccactttggtccaaaccccacctcctccagtgtctacccagcttctgcgggcacctccctgggcatccagccccccacgcctgtgaacagccctggcacggtgtattctggggccttgggcacaccaggggctgcaggctccaaggagtcctccagggtccccatgccctgagagaatttctagggaagtcatctcacttggccttctgaaggtcctccctaagagtctcctgacaaaagttacttattgaacacctctatgtgccaggctctgtgttgggtactttgatcaatgcccctgtttcagtctcatctgtactcacggcagccctgtggagtacggtgtactggcccagcttacagatgcagaaagcgagacgttctgccatcagataaagtcacgtggctctttagtaacacggacaaggctcctcgccaaggaactcgtggcagaagagggcagcagttggcagtagctgccgatgtctgtccccagctccaccattcctccctgtggctgtgccgtgctcgtggtttcagtgtccgtgtgtccatgtgtctgcccttcaggagctcgcagctggtgtgcttggcggtcccaggcctgtgtagtgtctctcccctgctgcgggcgcccccaccccgattcctctccccagaagcggtgggatgggcccccatgaactgcagcagcatgctgaggtgtccatgttgtctgcctttgtataaagaaacagcctctga

SEQ ID NO: 448467 - DNA, 1040 bp, Homo sapiens
  misc_feature (882)..(882): n is a, c, g, or t
  misc_feature (892)..(892): n is a, c, g, or t
  misc_feature (911)..(911): n is a, c, g, or t
  misc_feature (917)..(917): n is a, c, g, or t
  misc_feature (920)..(920): n is a, c, g, or t
  misc_feature (926)..(926): n is a, c, g, or t
  misc_feature (931)..(931): n is a, c, g, or t
  misc_feature (940)..(940): n is a, c, g, or t
aacttggcatggggcggggcctctgggaggcgtggcctccggccggctcctctgctgttgccaagggaaactgccgcgaggaggcggaaggagcagaggaccggcagccggcgtcgaggcggggcgcgggaacgacggcggccatggcggcctcggggcccgggtgtcgcagctggtgcttgtgtcccgaggtgccatccgccaccttcttcactgcgctgctctcgctgctggtttccgggcctcgcctgttcctgctgcagcagcccctggcgccctcgggcctcacgctgaagtccgaggcccttcgcaactggcaagtttacaggctggtaacctacatctttgtctacgagaatcccatctccctgctctgcggcgctatcatcatctggcgctttgctggcaatttcgagagaaccgtgggcaccgtccgccactgcttcttcaccgtgatcttcgccatcttctccgctatcatcttcctgtcattcgaggctgtgtcatcactgtcaaagctgggggaagtggaggatgccagaggtttcaccccagtggcctttgccatgctgggagtcaccaccgtccgttctcggatgaggcgggccctggtgtttggcatggttgtgccctcagtcctggttccgtggctcctgctgggtgcctcgtggctcattccccagacctctttcctcagtaatgtctgcgggctgtccatcgggctggcctatggcctcacctactgctattccatcgacctctcagagcgagtggcgctgaagctcgatcagaccttccccttcagcctgatgaggaggatatccgtgttcaagtacgtctcagggtcttcagccgagaggagggcagcccagagccggaaantgacccgggnctggtcctaaccaaaaganttgcanctnactgtnccaangcacctgtntccagagcgacagcatggtcaaaagcggggcctgggctcctggagcccggggatggcccttgtccggcaaacatgcacagctggtatcgtgacaccattg

SEQ ID NO: 448468 - DNA, 1853 bp, Homo sapiens
aacttggcatggggcggggcctctgggaggcgtggcctccggccggctcctctgctgttgccaagggaaactgccgcgaggaggcggaaggagcagaggaccggcagccggcgtcgaggcggggcgcgggaacgacggcggccatggcggcctcggggcccgggtgtcgcagctggtgcttgtgtcccgaggtgccatccgccaccttcttcactgcgctgctctcgctgctggtttccgggcctcgcctgttcctgctgcagcagcccctggcgccctcgggcctcacgctgaagtccgaggcccttcgcaactggcaagtttacaggctggtaacctacatctttgtctacgagaatcccatctccctgctctgcggcgctatcatcatctggcgctttgctggcaatttcgagagaaccgtgggcaccgtccgccactgcttcttcaccgtgatcttcgccatcttctccgctatcatcttcctgtcattcgaggctgtgtcatcactgtcaaagctgggggaagtggaggatgccagaggtttcaccccagtggcctttgccatgctgggagtcaccaccgtccgttctcggatgaggcgggccctggtgtttggcatggttgtgccctcagtcctggttccgtggctcctgctgggtgcctcgtggctcattccccagacctctttcctcagtaatgtctgcgggctgtccatcgggctggcctatggcctcacctactgctattccatcgacctctcagagcgagtggcgctgaagctcgatcagaccttccccttcagcctgatgaggaggatatccgtgttcaagtacgtctcagggtcttcagccgagaggagggcagcccagagccggaaactgaacccggtgcctggctcctaccccacacagagctgccaccctcacctgtccccaagccaccctgtgtcccagacgcagcacgccagtggtcagaagctggcctcctggccctcctgcacccccgggcacatgcccaccttgcctccgtaccagcctgcctccggcctgtgctatgtgcagaaccactttggtccaaaccccacctcctccagtgtctacccagcttctgcgggcacctccctgggcatccagccccccacgcctgtgaacagccctggcacggtgtattctggggccttgggcacaccaggggctgcaggctccaaggagtcctccagggtccccatgccctgagagaatttctagggaagtcatctcacttggccttctgaaggtcctccctaagagtctcctgacaaaagttacttattgaacacctctatgtgccaggctctgtgttgggtactttgatcaatgcccctgtttcagtctcatctgtactcacggcagccctgtggagtacggtgtactggcccagcttacagatgcagaaagcgagacgttctgccatcagataaagtcacgtggctctttagtaacacggacaaggctcctcgccaaggaactcgtggcagaagagggcagcagttggcagtagctgccgatgtctgtccccagctccaccattcctccctgtggctgtgccgtgctcgtggtttcagtgtccgtgtgtccatgtgtctgcccttcaggaacaccaggggctgcaggctccaaggagtcctccagggtccccatgccctgagagaatttctagggaagtcatctcacttggccttctgaaggtcctccctaagagtccccaccccgattcctctccccagaagcggtgggatgggcccccatgaactgcagcagcatgctgaggtgtccatgttgtctgcctttgtataaagaaacagcctctga

SEQ ID NO: 448469 - DNA, 1396 bp, Homo sapiens
gtgacgggcacctgtagtcccagctactctggaggctgaggcaggagaatggtgtgatctgggaggcggagcttgcagtgagccaagatcacaccactgcactccagcctgggctgctagagtgagactccatctcaaaaaaaaaaacaaacctttggctctgggtttcccctgagctgcaaactccagccagagtgtgcagcgtgctaagcatgaaggcttctgtagagtgagtgggaacctgtgttctccccggggagtgttcggccctcctccctttgctgcctccagtttcacttaacacgccaacctcagatggcctcacctactgctattccatcgacctctcagagcgagtggcgctgaagctcgatcagaccttccccttcagcctgatgaggaggatatccgtgttcaagtacgtctcagggtcttcagccgagaggagggcagcccagagccggaaactgaacccggtgcctggctcctaccccacacagagctgccaccctcacctgtccccaagccaccctgtgtcccagacgcagcacgccagtggtcagaagctggcctcctggccctcctgcacccccgggcacatgcccaccttgcctccgtaccagcctgcctccggcctgtgctatgtgcagaaccactttggtccaaaccccacctcctccagtgtctacccagcttctgcgggcacctccctgggcatccagccccccacgcctgtgaacagccctggcacggtgtattctggggccttgggcacaccaggggctgcaggctccaaggagtcctccagggtccccatgccctgagagaatttctagggaagtcatctcacttggccttctgaaggtcctccctaagagtctcctgacaaaagttacttattgaacacctctatgtgccaggctctgtgttgggtactttgatcaatgcccctgtttcagtctcatctgtactcacggcagccctgtggagtacggtgtactggcccagcttacagatgcagaaagcgagacgttctgccatcagataaagtcacgtggctctttagtaacacggacaaggctcctcgccaaggaactcgtggcagaagagggcagcagttggcagtagctgccgatgtctgtccccagctccaccattcctccctgtggctgtgccgtgctcgtggtttcagtgtccgtgtgtccatgtgtctgcccttcaggagctcgcagctggtgtgcttggcggtcccaggcctgtgtagtgtctctcccctgctgcgggcgcccccaccccgattcctctccccagaagcggtgggatgggcccccatgaactgcagcagcatgctgaggtgtccatgttgtctgcctttgtataaagaaacagcctctga

SEQ ID NO: 448470 - DNA, 1095 bp, Homo sapiens
aacttggcatggggcggggcctctgggaggcgtggcctccggccggctcctctgctgttgccaagggaaactgccgcgaggaggcggaaggagcagaggaccggcagccggcgtcgaggcggggcgcgggaacgacggcggccatggcggcctcggggcccgggtgtcgcagctggtgcttgtgtcccgaggtgccatccgccaccttcttcactgcgctgctctcgctgctggtttccgggcctcgcctgttcctgctgcagcagcccctggcgccctcgggcctcacgctgaagtccgaggcccttcgcaactggcaagtttacaggctggtaacctacatctttgtctacgagaatcccatctccctgctctgcggcgctatcatcatctggcgctttgctggcaatttcgagagaaccgtgggcaccgtccgccactgcttcttcaccgtgatcttcgccatcttctccgctatcatcttcctgtcattcgaggctgtgtcatcactgtcaaagctgggggaagtggaggatgccagaggtttcaccccagtggcctttgccatgctgggagtcaccaccgtccgttctcggatgaggcgggccctggtgtttggcatggttgtgccctcagtcctggttccgtggctcctgctgggtgcctcgtggctcattccccagacctctttcctcagtaatgtctgcgggctgtccatcgggctggcctatggcctcacctactgctattccatcgacctctcagagcgagtggcgctgaagctcgatcagaccttccccttcagcctgatgaggaggatatccgtgttcaagtacgtctcagggtcttcagccgagaggagggcagcccagagccggaagtaagtgacagaactcttaagtgctgttaaatcttttttaaaaaaaaaattattttttttttttgagacggagtctcactctgtcacccaggctggagtgcagtggcacagtcataactcactgcagcctcaaacttctgggtttaagcagtcctcctacctcagcctcttaagtacctgggactagaagcatatgccaccagacctggctaatt

SEQ ID NO: 448471 - DNA, 549 bp, Homo sapiens
caaagttgaagaaactgagaaagttgtgaataaaatttatctggaggttaccaatattaatattttaaaatattaatacttaatattttaatctatgtttttaggtttgtgttccgcccttcttacataattgtcattgtaggattatcattgttcatctgagccaaggaccaccctgaaatatcccttgtgctatggtctcatgcaagggtttcccatgcctgtgagtgtgtttgtgatcccacatgtatcaggtgcctggctgctctgggacttgcagtaattgtctcttgtttgtttcaggtgtgatcccctgggcccgtttgttgtcgggggagaagacttagacccttttgggtgagtactgctggggaggtggcagcaacacaacttgcttttgtggcttttcagccccagctcatcttctaattttagagttttcggtcagtctcttcctttggggtggaggaggcagttgttgctgagcagctgagaaagcactgccacatacgctgcccctccacacctagagcggtgcaggagagcact

SEQ ID NO: 448472 - DNA, 3234 bp, Homo sapiens
agcggggcttccccgccccgccccgtccccgggcgtctccattttggtctcaggtgtggactcggcaagaaccagcgcaagagggaagcggagttatagctaccccggccgcggagccggctcactgcactacccccgcccccttctttcctccagacgccgaagtcgcgggcgctcatggcgggcctggaggtactgttcgcatcggcagcgccggccatcacctgcaggcaggacgcgctcgtctgcttcttgcattgggaagtggtgacacacggttactgcggcttgggtgtcggtgaccagccgggtcccaatgataagaagtcagaactgctgccagctgggtggaacaacaataaagacctgtatgtcctccggtatgagtataaggatgggtccagaaagctccttgtgaaagccatcaccgtggagagcagcatgatcctcaatgtgctggaatatggctcacagcaagtggcagacttgaccctgaacttggatgattatatcgatgcagaacacctgggtgacttccacaggacctacaagaacagtgaggagcttcggtctcgtattgtgtctggaatcatcacacctatccatgagcagtgggaaaaggctaatgtaagcagtccccaccgggagttcccccctgctaccgccagagaggtggacccactccggattcctccacaccacccacacaccagtcggcagcctccctggtgtgatcccctgggcccgtttgttgtcgggggagaagacttagacccttttgggcctcggagaggtggcatgattgtggatcccctgagatctggcttcccaagagcacttattgacccttcctcaggcctcccgaaccgacttcctccaggcgctgtgcccccaggagctcgctttgacccctttggacccattgggaccagcccacccggacctaacccagaccatctccccccgccgggctacgatgacatgtacctgtgaaggcctcaagaatgtaacatcccaggcttccctccattctcctggagctgccaccgctgtccccatcagcaaccatgttcttgcaggctgggggcaagggattctgctcatgtgtttgcagaccggctgggatagcctccccaccccttatcagagccaagacacctgctgcagctctccacctagctgcagatagctcccaaagagaaatcagtgtgtctctttcaccatcagctcctcccctttcaccaccagctcctctccacttcccaagggagactccggcaaccttcagcaacatatatcctcgaccagatgcagtgctataagaacagaacgcattttggatgttattattaagaaccaaatgtcaatacagaattcatgttgccggtttcccacttttctttttacattaatgcatagctgcttccatttatgagactttagagtttgagtttctgtagggctgaatgactctttttcctgcccagggcccattcttgcttctcaggcaccttccgtttattaattgccattgctcctgacatcactaagatgggtccccttctggctgcatgaatggaaatgagtgactggaaatcccataggccacaagaatgactttcacaagggcaggaacattgtggaaagactgcatcattctgatgaggcaaaatcctccagctattcctgtctgggccagttttgtaggtccatctgtgcatgggcagcagtagtcaaaaagccaaggaaaaaacagagcagacctgaaggctaatcttatttttgccactaacttagtgaatgaccctaagcaagttccttctcctcttagggccttgtgccaagcctatgaaattggaggtggctttcctgctctaaagcattttgatgtctcattctgtgtttggtaacccctataaactggggcagaggaaaagaatgatggttcaaggccatacttcccttgaaccttgtgtggttcttgcctaactctgtggtttttggaccccatggggcccagacagagcacaggagcatgggctgcctctgagtgtggtgttgaacttcgggaggagcagggagccctgcaccttgtgtcctggcccacctgacctttggtgttctccggatccttttcagcccgaggcctgacagacgcgggcagtgatgagccctgttctggagtggaaagagcacgatagagcaccaggctaagaggcacgagatcaaggcggtagtcacttccgctctgcagctagcatttcaaccatatgtggatcctttcatttctcagctccctggattccttcccctaaattaggacctattatttacctgtaggtaagcaagctactgtagctcttctgaggtatctgccaggctgttttctgtagcctcagattgcctatctgcttagcctgagaacaggtagatgaaaactaaactgatgcctaggcccagggtcagtctcagatggaagctgggcctgggtggggaggctagcatgcgtggctccctgggtatttctgtcagtccccatggcaagcagtgatttagtaaaacaccccagagtcagggaagccaaccaccttgaaacctttagaacatctctgctttggagaaagacccagagatcaggcagaggtgcagattcaatcattactcataacctttgagagctggcaaatgggaggagtgttagtctttgttttggaattggaccattcttgcaaccaaaaggacttagagcagtttgctcataaagacatcctttattataaaaggaagtatttaaaggatgatagagaccatcagatagaagcagggaaggtagataacttttaggaccttgatgtgaggaaaagataaaatttaaacaataaatttgccacttagattttctagcagcaaagtccgaaaagatagttatatacaaaattctgttttctgaaaacaaaattgtgattcaccttcagaattggccattttttttgtgagtttccttgcatcaaggacactgagaaacacagtcattgtcttaggtgttctatgggaggaagtgaatagagcctttaggaacttcctggtcaagcttatggtgcttattttgatctgggccacttccctccttccagtcatgagtaatcatcaaggagcaagttggagtgtttcaggtgtatattttgtagaacccaaaagattggagccttaacaataaacatcagcactaagtga

SEQ ID NO: 448473 - DNA, 4898 bp, Homo sapiens
agcggggcttccccgccccgccccgtccccgggcgtctccattttggtctcaggtgtggactcggcaagaaccagcgcaagagggaagcggagttatagctaccccggccgcggagccggctcactgcactacccccgcccccttctttcctccagacgccgaagtcgcgggcgctcatggcgggcctggaggtactgttcgcatcggcagcgccggccatcacctgcaggcaggacgcgctcgtctgcttcttgcattgggaagtggtgacacacggttactgcggcttgggtgtcggtgaccagccgggtcccaatgataagaagtcagaactgctgccagctgggtggaacaacaataaagacctgtatgtcctccggtatgagtataaggatgggtccagaaagctccttgtgaaagccatcaccgtggagagcagcatgatcctcaatgtgctggaatatggctcacagcaagtggcagacttgaccctgaacttggatgattatatcgatgcagaacacctgggtgacttccacaggacctacaagaacagtgaggagcttcggtctcgtattgtgtctggaatcatcacacctatccatgagcagtgggaaaaggctaatgtaagcagtccccaccgggagttcccccctgctaccgccagagaggtggacccactccggattcctccacaccacccacacaccagtcggcagcctccctggtgtgatcccctgggcccgtttgttgtcgggggagaagacttagacccttttgggcctcggagaggtggcatgattgtggatcccctgagatctggcttcccaagagcacttattgacccttcctcaggcctcccgaaccgacttcctccaggcgctgtgcccccaggagctcgctttgacccctttggacccattgggaccagcccacccggacctaacccagaccatctccccccgccgggctacgatgacatgtacctgtgaaggcctcaagaatgtaacatcccaggcttccctccattctcctggagctgccaccgctgtccccatcagcaaccatgttcttgcaggctgggggcaagggattctgctcatgtgtttgcagaccggctgggatagcctccccaccccttatcagagccaagacacctgctgcagctctccacctagctgcagatagctcccaaagagaaatcagtgtgtctctttcaccatcagctcctcccctttcaccaccagctcctctccacttcccaagggagactccggcaaccttcagcaacatatatcctcgaccagatgcagtgctataagaacagaacgcattttggatgttattattaagaaccaaatgtcaatacagaattcatgttgccggtttcccacttttctttttacattaatgcatagctgcttccatttatgagactttagagtttgagtttctgtagggctgaatgactctttttcctgcccagggcccattcttgcttctcaggcaccttccgtttattaattgccattgctcctgacatcactaagatgggtccccttctggctgcatgaatggaaatgagtgactggaaatcccataggccacaagaatgactttcacaagggcaggaacattgtggaaagactgcatcattctgatgaggcaaaatcctccagctattcctgtctgggccagttttgtaggtccatctgtgcatgggcagcagtagtcaaaaagccaaggaaaaaacagagcagacctgaaggctaatcttatttttgccactaacttagtgaatgaccctaagcaagttccttctcctcttagggccttgtgccaagcctatgaaattggaggtggctttcctgctctaaagcattttgatgtctcattctgtgtttggtaacccctataaactggggcagaggaaaagaatgatggttcaaggccatacttcccttgaaccttgtgtggttcttgcctaactctgtggtttttggaccccatggggcccagacagagcacaggagcatgggctgcctctgagtgtggtgttgaacttcgggaggagcagggagccctgcaccttgtgtcctggcccacctgacctttggtgttctccggatccttttcagcccgaggcctgacagacgcgggcagtgatgagccctgttctggagtggaaagagcacgatagagcaccaggctaagaggcacgagatcaaggcggtagtcacttccgctctgcagctagcatttcaaccatatgtggatcctttcatttctcagctccctggattccttcccctaaattaggacctattatttacctgtaggtaagcaagctactgtagctcttctgaggtatctgccaggctgttttctgtagcctcagattgcctatctgcttagcctgagaacaggtagatgaaaactaaactgatgcctaggcccagggtcagtctcagatggaagctgggcctgggtggggaggctagcatgcgtggctccctgggtatttctgtcagtccccatggcaagcagtgatttagtaaaacaccccagagtcagggaagccaaccaccttgaaacctttagaacatctctgctttggagaaagacccagagatcaggcagaggtgcagattcaatcattactcataacctttgagagctggcaaatgggaggagtgttagtctttgttttggaattggaccattcttgcaaccaaaaggacttagagcagtttgctcataaagacatcctttattataaaaggaagtatttaaaggatgatagagaccatcagatagaagcagggaaggtagataacttttaggaccttgatgtgaggaaaagataaaatttaaacaataaatttgccacttagattttctagcagcaaagtccgaaaagatagttatatacaaaattctgttttctgaaaacaaaattgtgattcaccttcagaattggccattttttttgtgagtttccttgcatcaaggacactgagaaacacagtcattgtcttaggtgttctatgggaggaagtgaatagagcctttaggaacttcctggtcaagcttatggtgcttattttgatctgggccacttccctccttccagtcatgagtaatcatcaaggagcaagttggagtgtttcaggtgtatattttgtagaacccaaaagattggagccttaacaataaacatcagcactaagtgacctgttcctccttttttaaatagcagctttattgagatataatttacatacccataatttacatacctgtttaaagtatacaattcagtggatttagtatgttcacagtgttgcacatccaccaccatttctaattcctgaacattttcaccacctcaaaaagaaaccacacacccattggcatgactccccattcccttgctcccagccccaggcaaccactaacatctgtctctaaagatttttctcttttttctggacagttctcataagtggaatcactcagtattatggccttttgtgtctggcttctttcatttcatgtgatgttttcaagattcattcatgctgtagcatgtatccatggtatggatatatcacattttgcttatccttttatcagttgatggacagttgggttgtttctacaaaaaggctattatgagtaatgcagccaagaacatttgtgtaccagtttttgagttttcagttgtttgagtttcagatgttttcagttcatttgggtatataccaaggagtggaattgctggttcacatggtagctctatattctactttgtgaggaattgtcagactgttttccacggaagctgcaccattttacatttccactggtaatttatgagggttccagtttccccacatcttcaccaactcttgttatttttcatgcttatggccatcctagttagcgtgaagtagcatctcattgtggtcttctcttccattttttaaaaaagaattttgacctacaccaagcaaggcagagaccagagtcagtcccccttggggagcaatctgtggttttgataatcaccaccttgggatgaacatggctggtgagctgcagagcagttgatttgacttttggggatggttctaggctggatgtgatacagggcaggttttgtctctagagaaagttctcatgaccttcaggtctaatgagattcagatcatcactttggtttggtttgaaatttctttgtttatccagtgaattacaagtagaataaagatctggttctaaattgtcttttggtggtgaagtgccatagaccatttcggaccatttctatgatgtaccagcagcccccacatcacacctcctcttccttggcttgtctcttccccaattcttagagttagcagtgtttcttactgcattcatctcctcagtcataagtgtctgtcaacctccgttgtgaagtcatgagtctcttgagactgaaactccaagaatgtattgtgctcacagtggcgatggtgttcctgtgctggatggtcagtggttgttgacatgtagttagaaaataggtagcaagttccacgcagcctcactctttggaacctagtttctcctatggcctccctttctactgttgttaataacattctattaatgatccatgcctctcttcacaggaggaatattagaatctatggagcagttagtattctttgtcacctaaatttgtctacttctgtacatttccaataaggcaccaccagggcaagggaagattccccacatgtatatccccagctgtttctgtcataaaacttgcatgtgtataaaccactattgactttttgcaccaaagggaggatttcaaggggacatccaagtccccagcccttta

SEQ ID NO: 448474 - DNA, 3601 bp, Homo sapiens
  misc_feature (3246)..(3246): n is a, c, g, or t
agcggggcttccccgccccgccccgtccccgggcgtctccattttggtctcaggtgtggactcggcaagaaccagcgcaagagggaagcggagttatagctaccccggccgcggagccggctcactgcactacccccgcccccttctttcctccagacgccgaagtcgcgggcgctcatggcgggcctggaggtactgttcgcatcggcagcgccggccatcacctgcaggcaggacgcgctcgtctgcttcttgcattgggaagtggtgacacacggttactgcggcttgggtgtcggtgaccagccgggtcccaatgataagaagtcagaactgctgccagctgggtggaacaacaataaagacctgtatgtcctccggtatgagtataaggatgggtccagaaagctccttgtgaaagccatcaccgtggagagcagcatgatcctcaatgtgctggaatatggctcacagcaagtggcagacttgaccctgaacttggatgattatatcgatgcagaacacctgggtgacttccacaggacctacaagaacagtgaggagcttcggtctcgtattgtgtctggaatcatcacacctatccatgagcagtgggaaaaggctaatgtaagcagtccccaccgggagttcccccctgctaccgccagagaggtggacccactccggattcctccacaccacccacacaccagtcggcagcctccctggtgtgatcccctgggcccgtttgttgtcgggggagaagacttagacccttttgggcctcggagaggtggcatgattgtggatcccctgagatctggcttcccaagagcacttattgacccttcctcaggcctcccgaaccgacttcctccaggcgctgtgcccccaggagctcgctttgacccctttggacccattgggaccagcccacccggacctaacccagaccatctccccccgccgggctacgatgacatgtacctgtgaaggcctcaagaatgtaacatcccaggcttccctccattctcctggagctgccaccgctgtccccatcagcaaccatgttcttgcaggctgggggcaagggattctgctcatgtgtttgcagaccggctgggatagcctccccaccccttatcagagccaagacacctgctgcagctctccacctagctgcagatagctcccaaagagaaatcagtgtgtctctttcaccatcagctcctcccctttcaccaccagctcctctccacttcccaagggagactccggcaaccttcagcaacatatatcctcgaccagatgcagtgctataagaacagaacgcattttggatgttattattaagaaccaaatgtcaatacagaattcatgttgccggtttcccacttttctttttacattaatgcatagctgcttccatttatgagactttagagtttgagtttctgtagggctgaatgactctttttcctgcccagggcccattcttgcttctcaggcaccttccgtttattaattgccattgctcctgacatcactaagatgggtccccttctggctgcatgaatggaaatgagtgactggaaatcccataggccacaagaatgactttcacaagggcaggaacattgtggaaagactgcatcattctgatgaggcaaaatcctccagctattcctgtctgggccagttttgtaggtccatctgtgcatgggcagcagtagtcaaaaagccaaggaaaaaacagagcagacctgaaggctaatcttatttttgccactaacttagtgaatgaccctaagcaagttccttctcctcttagggccttgtgccaagcctatgaaattggaggtggctttcctgctctaaagcattttgatgtctcattctgtgtttggtaacccctataaactggggcagaggaaaagaatgatggttcaaggccatacttcccttgaaccttgtgtggttcttgcctaactctgtggtttttggaccccatggggcccagacagagcacaggagcatgggctgcctctgagtgtggtgttgaacttcgggaggagcagggagccctgcaccttgtgtcctggcccacctgacctttggtgttctccggatccttttcagcccgaggcctgacagacgcgggcagtgatgagccctgttctggagtggaaagagcacgatagagcaccaggctaagaggcacgagatcaaggcggtagtcacttccgctctgcagctagcatttcaaccatatgtggatcctttcatttctcagctccctggattccttcccctaaattaggacctattatttacctgtaggtaagcaagctactgtagctcttctgaggtatctgccaggctgttttctgtagcctcagattgcctatctgcttagcctgagaacaggtagatgaaaactaaactgatgcctaggcccagggtcagtctcagatggaagctgggcctgggtggggaggctagcatgcgtggctccctgggtatttctgtcagtccccatggcaagcagtgatttagtaaaacaccccagagtcagggaagccaaccaccttgaaacctttagaacatctctgctttggagaaagacccagagatcaggcagaggtgcagattcaatcattactcataacctttgagagctggcaaatgggaggagtgttagtctttgttttggaattggaccattcttgcaaccaaaaggacttagagcagtttgctcataaagacatcctttattataaaaggaagtatttaaaggatgatagagaccatcagatagaagcagggaaggtagataacttttaggaccttgatgtgaggaaaagataaaatttaaacaataaatttgccacttagattttctagcagcaaagtccgaaaagatagttatatacaaaattctgttttctgaaaacaaaattgtgattcaccttcagaattggccattttttttgtgagtttccttgcatcaaggacactgagaaacacagtcattgtcttaggtgttctatgggaggaagtgaatagagcctttaggaacttcctggtcaagcttatggtgcttattttgatctgggccacttccctccttccagtcatgagtaatcatcaaggagcaagttggagtgtttcaggtgtatattttgtagaacccaaaagattggagccttaacaataaacatcagcactaagtgaaaaaaaaaaaanaaaaaaaaaaaaatgtgtgtgtggggcgcgcccttgggccctggaaaaagtttttataacccttctcgttggggggcgcgggggcccccgttgggttaggtgtgcgacaacgtgggcgcataacggtggttcccaaaggagaaactccggcgcccatagactatagtgtggcgggggattttcctcaccaaatataaaaagagcgcccgcgggggaaccccgaaggcgtttctgtgaaacaatctccggagatgggggagctccgagggggacacataacgggggacttctttcaacgcgggggagttcacaggagaggaacccgtattttaaatttgccccggggtgggtgggt

SEQ ID NO: 448475 - DNA, 2520 bp, Homo sapiens
agcggggcttccccgccccgccccgtccccgggcgtctccattttggtctcaggtgtggactcggcaagaaccagcgcaagagggaagcggagttatagctaccccggccgcggagccggctcactgcactacccccgcccccttctttcctccagacgccgaagtcgcgggcgctcatggcgggcctggaggtactgttcgcatcggcagcgccggccatcacctgcaggcaggacgcgctcgtctgcttcttgcattgggaagtggtgacacacggttactgcggcttgggtgtcggtgaccagccgggtcccaatgataagaagtcagaactgctgccagctgggtggaacaacaataaagacctgtatgtcctccggtatgagtataaggatgggtccagaaagctccttgtgaaagccatcaccgtggagagcagcatgatcctcaatgtgctggaatatggctcacagcaagtggcagacttgaccctgaacttggatgattatatcgatgcagaacacctgggtgacttccacaggacctacaagaacagtgaggagcttcggtctcgtattgtgtctggaatcatcacacctatccatgagcagtgggaaaaggctaatgtaagcagtccccaccgggagttcccccctgctaccgccagagaggtggacccactccggattcctccacaccacccacacaccagtcggcagcctccctggtgtgatcccctgggcccgtttgttgtcgggggagaagacttagacccttttgggcctcggagaggtggcatgattgtggatcccctgagatctggcttcccaagagcacttattgacccttcctcaggcctcccgaaccgacttcctccaggcgctgtgcccccaggagctcgctttgacccctttggacccattgggaccagcccacccggacctaacccagaccatctccccccgccgggctacgatgacatgtacctgtgaaggcctcaagaatgtaacatcccaggcttccctccattctcctggagctgccaccgctgtccccatcagcaaccatgttcttgcaggctgggggcaagggattctgctcatgtgtttgcagaccggctgggatagcctccccaccccttatcagagccaagacacctgctgcagctctccacctagctgcagatagctcccaaagagaaatcagtgtgtctctttcaccatcagctcctcccctttcaccaccagctcctctccacttcccaagggagactccggcaaccttcagcaacatatatcctcgaccagatgcagtgctataagaacagaacgcattttggatgttattattaagaaccaaatgtcaatacagaattcatgttgccggtttcccacttttctttttacattaatgcatagctgcttccatttatgagactttagagtttgagtttctgtagggctgaatgactctttttcctgcccagggcccattcttgcttctcaggcaccttccgtttattaattgccattgctcctgacatcactaagatgggtccccttctggctgcatgaatggaaatgagtgactggaaatcccataggccacaagaatgactttcacaagggcaggaacattgtggaaagactgcatcattctgatgaggcaaaatcctccagctattcctgtctgggccagttttgtaggtccatctgtgcatgggcagcagtagtcaaaaagccaaggaaaaaacagagcagacctgaaggctaatcttatttttgccactaacttagtgaatgaccctaagcaagttccttctcctcttagggccttgtgccaagcctatgaaattggaggtggctttcctgctctaaagcattttgatgtctcattctgtgtttggtaacccctataaactggggcagaggaaaagaatgatggttcaaggccatacttcccttgaaccttgtgtggttcttgcctaactctgtggtttttggaccccatggggcccagacagagcacaggagcatgggctgcctctgagtgtggtgttgaacttcgggaggagcagggagccctgcaccttgtgtcctggcccacctgacctttggtgttctccggatccttttcagcccgaggcctgacagacgcgggcagtgatgagccctgttctggagtggaaagagcacgatagagcaccaggctaagaggcacgagatcaaggcggtagtcacttccgctctgcagctagcatttcaaccatatgtggatcctttcatttctcagctccctggattccttcccctaaattaggacctattatttacctgtagctgaaatgtacctcctggggaacatcaaaaggagtccattctccaggagagaccagcaggcccagatggagggcctccctgactttgtcaggagcaagagacatactatggaggagaaggtgatcaaggcctgcatcatgcccacagaaatacaataaagccctcaccctttcctgtgta

SEQ ID NO: 448476 - DNA, 2370 bp, Homo sapiens
agcggggcttccccgccccgccccgtccccgggcgtctccattttggtctcaggtgtggactcggcaagaaccagcgcaagagggaagcggagttatagctaccccggccgcggagccggctcactgcactacccccgcccccttctttcctccagacgccgaagtcgcgggcgctcatggcgggcctggaggtactgttcgcatcggcagcgccggccatcacctgcaggcaggacgcgctcgtctgcttcttgcattgggaagtggtgacacacggttactgcggcttgggtgtcggtgaccagccgggtcccaatgataagaagtcagaactgctgccagctgggtggaacaacaataaagacctgtatgtcctccggtatgagtataaggatgggtccagaaagctccttgtgaaagccatcaccgtggagagcagcatgatcctcaatgtgctggaatatggctcacagcaagtggcagacttgaccctgaacttggatgattatatcgatgcagaacacctgggtgacttccacaggacctacaagaacagtgaggagcttcggtctcgtattgtgtctggaatcatcacacctatccatgagcagtgggaaaaggctaatgtaagcagtccccaccgggagttcccccctgctaccgccagagaggtggacccactccggattcctccacaccacccacacaccagtcggcagcctccctggtgtgatcccctgggcccgtttgttgtcgggggagaagacttagacccttttgggcctcggagaggtggcatgattgtggatcccctgagatctggcttcccaagagcacttattgacccttcctcaggcctcccgaaccgacttcctccaggcgctgtgcccccaggagctcgctttgacccctttggacccattgggaccagcccacccggacctaacccagaccatctccccccgccgggctacgatgacatgtacctgtgaaggcctcaagaatgtaacatcccaggcttccctccattctcctggagctgccaccgctgtccccatcagcaaccatgttcttgcaggctgggggcaagggattctgctcatgtgtttgcagaccggctgggatagcctccccaccccttatcagagccaagacacctgctgcagctctccacctagctgcagatagctcccaaagagaaatcagtgtgtctctttcaccatcagctcctcccctttcaccaccagctcctctccacttcccaagggagactccggcaaccttcagcaacatatatcctcgaccagatgcagtgctataagaacagaacgcattttggatgttattattaagaaccaaatgtcaatacagaattcatgttgccggtttcccacttttctttttacattaatgcatagctgcttccatttatgagactttagagtttgagtttctgtagggctgaatgactctttttcctgcccagggcccattcttgcttctcaggcaccttccgtttattaattgccattgctcctgacatcactaagatgggtccccttctggctgcatgaatggaaatgagtgactggaaatcccataggccacaagaatgactttcacaagggcaggaacattgtggaaagactgcatcattctgatgaggcaaaatcctccagctattcctgtctgggccagttttgtaggtccatctgtgcatgggcagcagtagtcaaaaagccaaggaaaaaacagagcagacctgaaggctaatcttatttttgccactaacttagtgaatgaccctaagcaagttccttctcctcttagggccttgtgccaagcctatgaaattggaggtggctttcctgctctaaagcattttgatgtctcattctgtgtttggtaacccctataaactggggcagaggaaaagaatgatggttcaaggccatacttcccttgaaccttgtgtggttcttgcctaactctgtggtttttggaccccatggggcccagacagagcacaggagcatgggctgcctctgagtgtggtgttgaacttcgggaggagcagggagccctgcaccttgtgtcctggcccacctgacctttggtgttctccggatccttttcagcccgaggcctgacagacgcgggcagtgatgagccctgttctggagtggaaagagcacgatagaagcctttaggaacttcctggtcaagcttatggtgcttattttgatctgggccacttccctccttccagtcatgagtaatcatcaaggagcaagttggagtgtttcaggtgtatattttgtagaacccaaaagattggagccttaacaataaacatcagcactaagtga

SEQ ID NO: 448477 - DNA, 3214 bp, Homo sapiens
ttccatcatcctgggccctcacctctggcataggctcttggtagtgggggcccagacagggaggcacctgccacctgcttcccttctcagccacccacagccctcatagggcagaatgggactcttgctgatgtagacgccgaagtcgcgggcgctcatggcgggcctggaggtactgttcgcatcggcagcgccggccatcacctgcaggcaggacgcgctcgtctgcttcttgcattgggaagtggtgacacacggttactgcggcttgggtgtcggtgaccagccgggtcccaatgataagaagtcagaactgctgccagctgggtggaacaacaataaagacctgtatgtcctccggtatgagtataaggatgggtccagaaagctccttgtgaaagccatcaccgtggagagcagcatgatcctcaatgtgctggaatatggctcacagcaagtggcagacttgaccctgaacttggatgattatatcgatgcagaacacctgggtgacttccacaggacctacaagaacagtgaggagcttcggtctcgtattgtgtctggaatcatcacacctatccatgagcagtgggaaaaggctaatgtaagcagtccccaccgggagttcccccctgctaccgccagagaggtggacccactccggattcctccacaccacccacacaccagtcggcagcctccctggtgtgatcccctgggcccgtttgttgtcgggggagaagacttagacccttttgggcctcggagaggtggcatgattgtggatcccctgagatctggcttcccaagagcacttattgacccttcctcaggcctcccgaaccgacttcctccaggcgctgtgcccccaggagctcgctttgacccctttggacccattgggaccagcccacccggacctaacccagaccatctccccccgccgggctacgatgacatgtacctgtgaaggcctcaagaatgtaacatcccaggcttccctccattctcctggagctgccaccgctgtccccatcagcaaccatgttcttgcaggctgggggcaagggattctgctcatgtgtttgcagaccggctgggatagcctccccaccccttatcagagccaagacacctgctgcagctctccacctagctgcagatagctcccaaagagaaatcagtgtgtctctttcaccatcagctcctcccctttcaccaccagctcctctccacttcccaagggagactccggcaaccttcagcaacatatatcctcgaccagatgcagtgctataagaacagaacgcattttggatgttattattaagaaccaaatgtcaatacagaattcatgttgccggtttcccacttttctttttacattaatgcatagctgcttccatttatgagactttagagtttgagtttctgtagggctgaatgactctttttcctgcccagggcccattcttgcttctcaggcaccttccgtttattaattgccattgctcctgacatcactaagatgggtccccttctggctgcatgaatggaaatgagtgactggaaatcccataggccacaagaatgactttcacaagggcaggaacattgtggaaagactgcatcattctgatgaggcaaaatcctccagctattcctgtctgggccagttttgtaggtccatctgtgcatgggcagcagtagtcaaaaagccaaggaaaaaacagagcagacctgaaggctaatcttatttttgccactaacttagtgaatgaccctaagcaagttccttctcctcttagggccttgtgccaagcctatgaaattggaggtggctttcctgctctaaagcattttgatgtctcattctgtgtttggtaacccctataaactggggcagaggaaaagaatgatggttcaaggccatacttcccttgaaccttgtgtggttcttgcctaactctgtggtttttggaccccatggggcccagacagagcacaggagcatgggctgcctctgagtgtggtgttgaacttcgggaggagcagggagccctgcaccttgtgtcctggcccacctgacctttggtgttctccggatccttttcagcccgaggcctgacagacgcgggcagtgatgagccctgttctggagtggaaagagcacgatagagcaccaggctaagaggcacgagatcaaggcggtagtcacttccgctctgcagctagcatttcaaccatatgtggatcctttcatttctcagctccctggattccttcccctaaattaggacctattatttacctgtaggtaagcaagctactgtagctcttctgaggtatctgccaggctgttttctgtagcctcagattgcctatctgcttagcctgagaacaggtagatgaaaactaaactgatgcctaggcccagggtcagtctcagatggaagctgggcctgggtggggaggctagcatgcgtggctccctgggtatttctgtcagtccccatggcaagcagtgatttagtaaaacaccccagagtcagggaagccaaccaccttgaaacctttagaacatctctgctttggagaaagacccagagatcaggcagaggtgcagattcaatcattactcataacctttgagagctggcaaatgggaggagtgttagtctttgttttggaattggaccattcttgcaaccaaaaggacttagagcagtttgctcataaagacatcctttattataaaaggaagtatttaaaggatgatagagaccatcagatagaagcagggaaggtagataacttttaggaccttgatgtgaggaaaagataaaatttaaacaataaatttgccacttagattttctagcagcaaagtccgaaaagatagttatatacaaaattctgttttctgaaaacaaaattgtgattcaccttcagaattggccattttttttgtgagtttccttgcatcaaggacactgagaaacacagtcattgtcttaggtgttctatgggaggaagtgaatagagcctttaggaacttcctggtcaagcttatggtgcttattttgatctgggccacttccctccttccagtcatgagtaatcatcaaggagcaagttggagtgtttcaggtgtatattttgtagaacccaaaagattggagccttaacaataaacatcagcactaagtga

SEQ ID NO: 448478 - DNA, 3064 bp, Homo sapiens
ttccatcatcctgggccctcacctctggcataggctcttggtagtgggggcccagacagggaggcacctgccacctgcttcccttctcagccacccacagccctcatagggcagaatgggactcttgctgatgtagccgggtcccaatgataagaagtcagaactgctgccagctgggtggaacaacaataaagacctgtatgtcctccggtatgagtataaggatgggtccagaaagctccttgtgaaagccatcaccgtggagagcagcatgatcctcaatgtgctggaatatggctcacagcaagtggcagacttgaccctgaacttggatgattatatcgatgcagaacacctgggtgacttccacaggacctacaagaacagtgaggagcttcggtctcgtattgtgtctggaatcatcacacctatccatgagcagtgggaaaaggctaatgtaagcagtccccaccgggagttcccccctgctaccgccagagaggtggacccactccggattcctccacaccacccacacaccagtcggcagcctccctggtgtgatcccctgggcccgtttgttgtcgggggagaagacttagacccttttgggcctcggagaggtggcatgattgtggatcccctgagatctggcttcccaagagcacttattgacccttcctcaggcctcccgaaccgacttcctccaggcgctgtgcccccaggagctcgctttgacccctttggacccattgggaccagcccacccggacctaacccagaccatctccccccgccgggctacgatgacatgtacctgtgaaggcctcaagaatgtaacatcccaggcttccctccattctcctggagctgccaccgctgtccccatcagcaaccatgttcttgcaggctgggggcaagggattctgctcatgtgtttgcagaccggctgggatagcctccccaccccttatcagagccaagacacctgctgcagctctccacctagctgcagatagctcccaaagagaaatcagtgtgtctctttcaccatcagctcctcccctttcaccaccagctcctctccacttcccaagggagactccggcaaccttcagcaacatatatcctcgaccagatgcagtgctataagaacagaacgcattttggatgttattattaagaaccaaatgtcaatacagaattcatgttgccggtttcccacttttctttttacattaatgcatagctgcttccatttatgagactttagagtttgagtttctgtagggctgaatgactctttttcctgcccagggcccattcttgcttctcaggcaccttccgtttattaattgccattgctcctgacatcactaagatgggtccccttctggctgcatgaatggaaatgagtgactggaaatcccataggccacaagaatgactttcacaagggcaggaacattgtggaaagactgcatcattctgatgaggcaaaatcctccagctattcctgtctgggccagttttgtaggtccatctgtgcatgggcagcagtagtcaaaaagccaaggaaaaaacagagcagacctgaaggctaatcttatttttgccactaacttagtgaatgaccctaagcaagttccttctcctcttagggccttgtgccaagcctatgaaattggaggtggctttcctgctctaaagcattttgatgtctcattctgtgtttggtaacccctataaactggggcagaggaaaagaatgatggttcaaggccatacttcccttgaaccttgtgtggttcttgcctaactctgtggtttttggaccccatggggcccagacagagcacaggagcatgggctgcctctgagtgtggtgttgaacttcgggaggagcagggagccctgcaccttgtgtcctggcccacctgacctttggtgttctccggatccttttcagcccgaggcctgacagacgcgggcagtgatgagccctgttctggagtggaaagagcacgatagagcaccaggctaagaggcacgagatcaaggcggtagtcacttccgctctgcagctagcatttcaaccatatgtggatcctttcatttctcagctccctggattccttcccctaaattaggacctattatttacctgtaggtaagcaagctactgtagctcttctgaggtatctgccaggctgttttctgtagcctcagattgcctatctgcttagcctgagaacaggtagatgaaaactaaactgatgcctaggcccagggtcagtctcagatggaagctgggcctgggtggggaggctagcatgcgtggctccctgggtatttctgtcagtccccatggcaagcagtgatttagtaaaacaccccagagtcagggaagccaaccaccttgaaacctttagaacatctctgctttggagaaagacccagagatcaggcagaggtgcagattcaatcattactcataacctttgagagctggcaaatgggaggagtgttagtctttgttttggaattggaccattcttgcaaccaaaaggacttagagcagtttgctcataaagacatcctttattataaaaggaagtatttaaaggatgatagagaccatcagatagaagcagggaaggtagataacttttaggaccttgatgtgaggaaaagataaaatttaaacaataaatttgccacttagattttctagcagcaaagtccgaaaagatagttatatacaaaattctgttttctgaaaacaaaattgtgattcaccttcagaattggccattttttttgtgagtttccttgcatcaaggacactgagaaacacagtcattgtcttaggtgttctatgggaggaagtgaatagagcctttaggaacttcctggtcaagcttatggtgcttattttgatctgggccacttccctccttccagtcatgagtaatcatcaaggagcaagttggagtgtttcaggtgtatattttgtagaacccaaaagattggagccttaacaataaacatcagcactaagtga

SEQ ID NO: 448479 - DNA, 3151 bp, Homo sapiens
agcggggcttccccgccccgccccgtccccgggcgtctccattttggtctcaggtgtggactcggcaagaaccagcgcaagagggaagcggagttatagctaccccggccgcggagccggctcactgcactacccccgcccccttctttcctccagacgccgaagtcgcgggcgctcatggcgggcctggaggtactgttcgcatcggcagcgccggccatcacctgcaggcaggacgcgctcgtctgcttcttgcattgggaagtggtgacacacggttactgcggcttgggtgtcggtgaccagccgggtcccaatgataagaagtcagaactgctgccagctgggtggaacaacaataaagacctgtatgtcctccggtatgagtataaggatgggtccagaaagctccttgtgaaagccatcaccgtggagagcagcatgatcctcaatgtgctggacctacaagaacagtgaggagcttcggtctcgtattgtgtctggaatcatcacacctatccatgagcagtgggaaaaggctaatgtaagcagtccccaccgggagttcccccctgctaccgccagagaggtggacccactccggattcctccacaccacccacacaccagtcggcagcctccctggtgtgatcccctgggcccgtttgttgtcgggggagaagacttagacccttttgggcctcggagaggtggcatgattgtggatcccctgagatctggcttcccaagagcacttattgacccttcctcaggcctcccgaaccgacttcctccaggcgctgtgcccccaggagctcgctttgacccctttggacccattgggaccagcccacccggacctaacccagaccatctccccccgccgggctacgatgacatgtacctgtgaaggcctcaagaatgtaacatcccaggcttccctccattctcctggagctgccaccgctgtccccatcagcaaccatgttcttgcaggctgggggcaagggattctgctcatgtgtttgcagaccggctgggatagcctccccaccccttatcagagccaagacacctgctgcagctctccacctagctgcagatagctcccaaagagaaatcagtgtgtctctttcaccatcagctcctcccctttcaccaccagctcctctccacttcccaagggagactccggcaaccttcagcaacatatatcctcgaccagatgcagtgctataagaacagaacgcattttggatgttattattaagaaccaaatgtcaatacagaattcatgttgccggtttcccacttttctttttacattaatgcatagctgcttccatttatgagactttagagtttgagtttctgtagggctgaatgactctttttcctgcccagggcccattcttgcttctcaggcaccttccgtttattaattgccattgctcctgacatcactaagatgggtccccttctggctgcatgaatggaaatgagtgactggaaatcccataggccacaagaatgactttcacaagggcaggaacattgtggaaagactgcatcattctgatgaggcaaaatcctccagctattcctgtctgggccagttttgtaggtccatctgtgcatgggcagcagtagtcaaaaagccaaggaaaaaacagagcagacctgaaggctaatcttatttttgccactaacttagtgaatgaccctaagcaagttccttctcctcttagggccttgtgccaagcctatgaaattggaggtggctttcctgctctaaagcattttgatgtctcattctgtgtttggtaacccctataaactggggcagaggaaaagaatgatggttcaaggccatacttcccttgaaccttgtgtggttcttgcctaactctgtggtttttggaccccatggggcccagacagagcacaggagcatgggctgcctctgagtgtggtgttgaacttcgggaggagcagggagccctgcaccttgtgtcctggcccacctgacctttggtgttctccggatccttttcagcccgaggcctgacagacgcgggcagtgatgagccctgttctggagtggaaagagcacgatagagcaccaggctaagaggcacgagatcaaggcggtagtcacttccgctctgcagctagcatttcaaccatatgtggatcctttcatttctcagctccctggattccttcccctaaattaggacctattatttacctgtaggtaagcaagctactgtagctcttctgaggtatctgccaggctgttttctgtagcctcagattgcctatctgcttagcctgagaacaggtagatgaaaactaaactgatgcctaggcccagggtcagtctcagatggaagctgggcctgggtggggaggctagcatgcgtggctccctgggtatttctgtcagtccccatggcaagcagtgatttagtaaaacaccccagagtcagggaagccaaccaccttgaaacctttagaacatctctgctttggagaaagacccagagatcaggcagaggtgcagattcaatcattactcataacctttgagagctggcaaatgggaggagtgttagtctttgttttggaattggaccattcttgcaaccaaaaggacttagagcagtttgctcataaagacatcctttattataaaaggaagtatttaaaggatgatagagaccatcagatagaagcagggaaggtagataacttttaggaccttgatgtgaggaaaagataaaatttaaacaataaatttgccacttagattttctagcagcaaagtccgaaaagatagttatatacaaaattctgttttctgaaaacaaaattgtgattcaccttcagaattggccattttttttgtgagtttccttgcatcaaggacactgagaaacacagtcattgtcttaggtgttctatgggaggaagtgaatagagcctttaggaacttcctggtcaagcttatggtgcttattttgatctgggccacttccctccttccagtcatgagtaatcatcaaggagcaagttggagtgtttcaggtgtatattttgtagaacccaaaagattggagccttaacaataaacatcagcactaagtga

SEQ ID NO: 448480 - DNA, 2831 bp, Homo sapiens
aggcctgggtggtgaatcggccgagggtggagagcagcatgatcctcaatgtgctggaatatggctcacagcaagtggcagacttgaccctgaacttggatgattatatcgatgcagaacacctgggtgacttccacaggacctacaagaacagtgaggagcttcggtctcgtattgtgtctggaatcatcacacctatccatgagcagtgggaaaaggctaatgtaagcagtccccaccgggagttcccccctgctaccgccagagaggtggacccactccggattcctccacaccacccacacaccagtcggcagcctccctggtgtgatcccctgggcccgtttgttgtcgggggagaagacttagacccttttgggcctcggagaggtggcatgattgtggatcccctgagatctggcttcccaagagcacttattgacccttcctcaggcctcccgaaccgacttcctccaggcgctgtgcccccaggagctcgctttgacccctttggacccattgggaccagcccacccggacctaacccagaccatctccccccgccgggctacgatgacatgtacctgtgaaggcctcaagaatgtaacatcccaggcttccctccattctcctggagctgccaccgctgtccccatcagcaaccatgttcttgcaggctgggggcaagggattctgctcatgtgtttgcagaccggctgggatagcctccccaccccttatcagagccaagacacctgctgcagctctccacctagctgcagatagctcccaaagagaaatcagtgtgtctctttcaccatcagctcctcccctttcaccaccagctcctctccacttcccaagggagactccggcaaccttcagcaacatatatcctcgaccagatgcagtgctataagaacagaacgcattttggatgttattattaagaaccaaatgtcaatacagaattcatgttgccggtttcccacttttctttttacattaatgcatagctgcttccatttatgagactttagagtttgagtttctgtagggctgaatgactctttttcctgcccagggcccattcttgcttctcaggcaccttccgtttattaattgccattgctcctgacatcactaagatgggtccccttctggctgcatgaatggaaatgagtgactggaaatcccataggccacaagaatgactttcacaagggcaggaacattgtggaaagactgcatcattctgatgaggcaaaatcctccagctattcctgtctgggccagttttgtaggtccatctgtgcatgggcagcagtagtcaaaaagccaaggaaaaaacagagcagacctgaaggctaatcttatttttgccactaacttagtgaatgaccctaagcaagttccttctcctcttagggccttgtgccaagcctatgaaattggaggtggctttcctgctctaaagcattttgatgtctcattctgtgtttggtaacccctataaactggggcagaggaaaagaatgatggttcaaggccatacttcccttgaaccttgtgtggttcttgcctaactctgtggtttttggaccccatggggcccagacagagcacaggagcatgggctgcctctgagtgtggtgttgaacttcgggaggagcagggagccctgcaccttgtgtcctggcccacctgacctttggtgttctccggatccttttcagcccgaggcctgacagacgcgggcagtgatgagccctgttctggagtggaaagagcacgatagagcaccaggctaagaggcacgagatcaaggcggtagtcacttccgctctgcagctagcatttcaaccatatgtggatcctttcatttctcagctccctggattccttcccctaaattaggacctattatttacctgtaggtaagcaagctactgtagctcttctgaggtatctgccaggctgttttctgtagcctcagattgcctatctgcttagcctgagaacaggtagatgaaaactaaactgatgcctaggcccagggtcagtctcagatggaagctgggcctgggtggggaggctagcatgcgtggctccctgggtatttctgtcagtccccatggcaagcagtgatttagtaaaacaccccagagtcagggaagccaaccaccttgaaacctttagaacatctctgctttggagaaagacccagagatcaggcagaggtgcagattcaatcattactcataacctttgagagctggcaaatgggaggagtgttagtctttgttttggaattggaccattcttgcaaccaaaaggacttagagcagtttgctcataaagacatcctttattataaaaggaagtatttaaaggatgatagagaccatcagatagaagcagggaaggtagataacttttaggaccttgatgtgaggaaaagataaaatttaaacaataaatttgccacttagattttctagcagcaaagtccgaaaagatagttatatacaaaattctgttttctgaaaacaaaattgtgattcaccttcagaattggccattttttttgtgagtttccttgcatcaaggacactgagaaacacagtcattgtcttaggtgttctatgggaggaagtgaatagagcctttaggaacttcctggtcaagcttatggtgcttattttgatctgggccacttccctccttccagtcatgagtaatcatcaaggagcaagttggagtgtttcaggtgtatattttgtagaacccaaaagattggagccttaacaataaacatcagcactaagtga

SEQ ID NO: 448481 - DNA, 2973 bp, Homo sapiens
gccctgtgcccctacaccctcacctctttctaatggggtggtaaacgaggaggggcaactcagatgcctaagaagcttgggcccaaatctcagagacagcgtggggctgttgcccccctcacccaggtccagcaggcggcctgttcccccacttataaacaggccaagcgcaatgccaggagctatcagggccgccgccgccgccgtcgttgcagccagaataccacttccagggttcctagccaactgcaagcagttgactcttcatctgcttcctgcaggacctacaagaacagtgaggagcttcggtctcgtattgtgtctggaatcatcacacctatccatgagcagtgggaaaaggctaatgtaagcagtccccaccgggagttcccccctgctaccgccagagaggtggacccactccggattcctccacaccacccacacaccagtcggcagcctccctggtgtgatcccctgggcccgtttgttgtcgggggagaagacttagacccttttgggcctcggagaggtggcatgattgtggatcccctgagatctggcttcccaagagcacttattgacccttcctcaggcctcccgaaccgacttcctccaggcgctgtgcccccaggagctcgctttgacccctttggacccattgggaccagcccacccggacctaacccagaccatctccccccgccgggctacgatgacatgtacctgtgaaggcctcaagaatgtaacatcccaggcttccctccattctcctggagctgccaccgctgtccccatcagcaaccatgttcttgcaggctgggggcaagggattctgctcatgtgtttgcagaccggctgggatagcctccccaccccttatcagagccaagacacctgctgcagctctccacctagctgcagatagctcccaaagagaaatcagtgtgtctctttcaccatcagctcctcccctttcaccaccagctcctctccacttcccaagggagactccggcaaccttcagcaacatatatcctcgaccagatgcagtgctataagaacagaacgcattttggatgttattattaagaaccaaatgtcaatacagaattcatgttgccggtttcccacttttctttttacattaatgcatagctgcttccatttatgagactttagagtttgagtttctgtagggctgaatgactctttttcctgcccagggcccattcttgcttctcaggcaccttccgtttattaattgccattgctcctgacatcactaagatgggtccccttctggctgcatgaatggaaatgagtgactggaaatcccataggccacaagaatgactttcacaagggcaggaacattgtggaaagactgcatcattctgatgaggcaaaatcctccagctattcctgtctgggccagttttgtaggtccatctgtgcatgggcagcagtagtcaaaaagccaaggaaaaaacagagcagacctgaaggctaatcttatttttgccactaacttagtgaatgaccctaagcaagttccttctcctcttagggccttgtgccaagcctatgaaattggaggtggctttcctgctctaaagcattttgatgtctcattctgtgtttggtaacccctataaactggggcagaggaaaagaatgatggttcaaggccatacttcccttgaaccttgtgtggttcttgcctaactctgtggtttttggaccccatggggcccagacagagcacaggagcatgggctgcctctgagtgtggtgttgaacttcgggaggagcagggagccctgcaccttgtgtcctggcccacctgacctttggtgttctccggatccttttcagcccgaggcctgacagacgcgggcagtgatgagccctgttctggagtggaaagagcacgatagagcaccaggctaagaggcacgagatcaaggcggtagtcacttccgctctgcagctagcatttcaaccatatgtggatcctttcatttctcagctccctggattccttcccctaaattaggacctattatttacctgtaggtaagcaagctactgtagctcttctgaggtatctgccaggctgttttctgtagcctcagattgcctatctgcttagcctgagaacaggtagatgaaaactaaactgatgcctaggcccagggtcagtctcagatggaagctgggcctgggtggggaggctagcatgcgtggctccctgggtatttctgtcagtccccatggcaagcagtgatttagtaaaacaccccagagtcagggaagccaaccaccttgaaacctttagaacatctctgctttggagaaagacccagagatcaggcagaggtgcagattcaatcattactcataacctttgagagctggcaaatgggaggagtgttagtctttgttttggaattggaccattcttgcaaccaaaaggacttagagcagtttgctcataaagacatcctttattataaaaggaagtatttaaaggatgatagagaccatcagatagaagcagggaaggtagataacttttaggaccttgatgtgaggaaaagataaaatttaaacaataaatttgccacttagattttctagcagcaaagtccgaaaagatagttatatacaaaattctgttttctgaaaacaaaattgtgattcaccttcagaattggccattttttttgtgagtttccttgcatcaaggacactgagaaacacagtcattgtcttaggtgttctatgggaggaagtgaatagagcctttaggaacttcctggtcaagcttatggtgcttattttgatctgggccacttccctccttccagtcatgagtaatcatcaaggagcaagttggagtgtttcaggtgtatattttgtagaacccaaaagattggagccttaacaataaacatcagcactaagtga

SEQ ID NO: 448482 - DNA, 1982 bp, Homo sapiens
agcggggcttccccgccccgccccgtccccgggcgtctccattttggtctcaggtgtggactcggcaagaaccagcgcaagagggaagcggagttatagctaccccggccgcggagccggctcactgcactacccccgcccccttctttcctccagacgccgaagtcgcgggcgctcatggcgggcctggaggtactgttcgcatcggcagcgccggccatcacctgcaggcaggacgcgctcgtctgcttcttgcattgggaagtggtgacacacggttactgcggcttgggtgtcggtgaccagccgggtcccaatgataagaagtcagaactgctgccagctgggtggaacaacaataaagacctgtatgtcctccggtatgagtataaggatgggtccagaaagctccttgtgaaagccatcaccgtggagagcagcatgatcctcaatgtgctggaatatggctcacagcaagtggcagacttgaccctgaacttggatgattatatcgatgcagaacacctgggtgacttccacaggacctacaagaacagtgaggagcttcggtctcgtattgtgtctggaatcatcacacctatccatgagcagtgggaggtggacccactccggattcctccacaccacccacacaccagtcggcagcctccctggtgtgatcccctgggcccgtttgttgtcgggggagaagacttagacccttttgggcctcggagaggtggcatgattgtggatcccctgagatctggcttcccaagagcacttattgacccttcctcaggcctcccgaaccgacttcctccaggcgctgtgcccccaggagctcgctttgacccctttggacccattgggaccagcccacccggcccgaggcctgacagacgcgggcagtgatgagccctgttctggagtggaaagagcacgatagagcaccaggctaagaggcacgagatcaaggcggtagtcacttccgctctgcagctagcatttcaaccatatgtggatcctttcatttctcagctccctggattccttcccctaaattaggacctattatttacctgtaggtaagcaagctactgtagctcttctgaggtatctgccaggctgttttctgtagcctcagattgcctatctgcttagcctgagaacaggtagatgaaaactaaactgatgcctaggcccagggtcagtctcagatggaagctgggcctgggtggggaggctagcatgcgtggctccctgggtatttctgtcagtccccatggcaagcagtgatttagtaaaacaccccagagtcagggaagccaaccaccttgaaacctttagaacatctctgctttggagaaagacccagagatcaggcagaggtgcagattcaatcattactcataacctttgagagctggcaaatgggaggagtgttagtctttgttttggaattggaccattcttgcaaccaaaaggacttagagcagtttgctcataaagacatcctttattataaaaggaagtatttaaaggatgatagagaccatcagatagaagcagggaaggtagataacttttaggaccttgatgtgaggaaaagataaaatttaaacaataaatttgccacttagattttctagcagcaaagtccgaaaagatagttatatacaaaattctgttttctgaaaacaaaattgtgattcaccttcagaattggccattttttttgtgagtttccttgcatcaaggacactgagaaacacagtcattgtcttaggtgttctatgggaggaagtgaatagagcctttaggaacttcctggtcaagcttatggtgcttattttgatctgggccacttccctccttccagtcatgagtaatcatcaaggagcaagttggagtgtttcaggtgtatattttgtagaacccaaaagattggagccttaacaataaacatcagcactaagtga

SEQ ID NO: 448483 - DNA, 906 bp, Homo sapiens
agcggggcttccccgccccgccccgtccccgggcgtctccattttggtctcaggtgtggactcggcaagaaccagcgcaagagggaagcggagttatagctaccccggccgcggagccggctcactgcactacccccgcccccttctttcctccagacgccgaagtcgcgggcgctcatggcgggcctggaggtactgttcgcatcggcagcgccggccatcacctgcaggcaggacgcgctcgtctgcttcttgcattgggaagtggtgacacacggttactgcggcttgggtgtcggtgaccagccgggtcccaatgataagaagtcagaactgctgccagctgggtggaacaacaataaagacctgtatgtcctccggtatgagtataaggatgggtccagaaagctccttgtgaaagccatcaccgtggagagcagcatgatcctcaatgtgctggaatatggctcacagcaagtggcagacttgaccctgaacttggatgattatatcgatgcagaacacctgggtgacttccacaggacctacaagaacagtgaggagcttcggtctcgtattgtgtctggaatcatcacacctatccatgagcagtgggaaaaggctaatgtaagcagtccccaccgggagttcccccctgctaccgccagagaggtggacccactccggattccctagctgcagatagctcccaaagagaaatcagtgtgtctctttcaccatcagctcctcccctttcaccaccagctcctctccacttcccaagggagactccggcaaccttcagcaacatatatcctcgaccagatgcagtgctataagaacagaacgcattttggatgttattattaagaaccaaatgtcaatacagaattcatgttgccggtt

SEQ ID NO: 448484 - DNA, 791 bp, Homo sapiens
agcggggcttccccgccccgccccgtccccgggcgtctccattttggtctcaggtgtggactcggcaagaaccagcgcaagagggaagcggagttatagctaccccggccgcggagccggctcactgcactacccccgcccccttctttcctccagacgccgaagtcgcgggcgctcatggcgggcctggaggtactgttcgcatcggcagcgccggccatcacctgcaggcaggacgcgctcgtctgcttcttgcattgggaagtggtgacacacggttactgcggcttgggtgtcggtgaccagccgggtcccaatgataagaagtcagaactgctgccagctgggtggaacaacaataaagacctgtatgtcctccggtatgagtataaggatgggtccagaaagctccttgtgaaagccatcaccgtggagagcagcatgatcctcaatgtgctggaatatggctcacagcaagtggcagacttgaccctgaacttggatgattatatcgatgcagaacacctgggtgacttccacaggacctacaagaacagtgaggagcttcggtctcgtattgtgtctggaatcatcagcaaccatgttcttgccccctttgaccttccccaaaggatggtcacacaccagcactttatacacttctggctcacaggaaagtgtctgcagtaggggacccagagtcccaggcccctggagttgttttcggcaggggccttgtctctcactgcatttggtcaggggggcatgaataaaggctacaggctccaaaa

SEQ ID NO: 448485 - DNA, 551 bp, Homo sapiens
agcggggcttccccgccccgccccgtccccgggcgtctccattttggtctcaggtgtggactcggcaagaaccagcgcaagagggaagcggagttatagctaccccggccgcggagccggctcactgcactacccccgcccccttctttcctccagacgccgaagtcgcgggcgctcatggcgggcctggaggtactgttcgcatcggcagcgccggccatcacctgcaggcaggacgcgctcgtctgcttcttgcattgggaagtggtgacacacggttactgcggcttgggtgtcggtgaccagccgggtcccaatgataagaagtcagaactgcctagctgcagatagctcccaaagagaaatcagtgtgtctctttcaccatcagctcctcccctttcaccaccagctcctctccacttcccaagggagactccggcaaccttcagcaacatatatcctcgaccagatgcagtgctataagaacagaacgcattttggatgttattattaagaaccaaatgtcaatacagaattcatgttgccggtt

SEQ ID NO: 448486 - DNA, 258 bp, Homo sapiens
actcaggtatgctgagaagtaggacctgatggcagcttggttcagtgtggcagcaatgaaggtttctagccccaggcacagagctgccgctgccttcacctgttgctgccaggagagtggagcctcctccagggccctgcctgatttctccctggagccttctaggagcttcctatccctcagtgcctctctttccccagctccactctggggaggactcaaagtaggaggaactaacaattcttgaaagttaagtat

SEQ ID NO: 448487 - DNA, 3221 bp, Homo sapiens
aacttaaggtctaggtacgaggcctgggttttggtctcaggtgtggactcggcaagaaccagcgcaagagggaagcggagttatagctaccccggccgcggagccggctcactgcactacccccgcccccttctttcctccagacgccgaagtcgcgggcgctcatggcgggcctggaggtactgttcgcatcggcagcgccggccatcacctgcaggcaggacgcgctcgtctgcttcttgcattgggaagtggtgacacacggttactgcggcttgggtgtcggtgaccagccgggtcccaatgataagaagtcagaactgctgccagctgggtggaacaacaataaagacctgtatgtcctccggtatgagtataaggatgggtccagaaagctccttgtgaaagccatcaccgtggagagcagcatgatcctcaatgtgctggaatatggctcacagcaagtggcagacttgaccctgaacttggatgattatatcgatgcagaacacctgggtgacttccacaggacctacaagaacagtgaggagcttcggtctcgtattgtgtctggaatcatcacacctatccatgagcagtgggaaaaggctaatgtaagcagtccccaccgggagttcccccctgctaccgccagagaggtggacccactccggattcctccacaccacccacacaccagtcggcagcctccctggtgtgatcccctgggcccgtttgttgtcgggggagaagacttagacccttttgggcctcggagaggtggcatgattgtggatcccctgagatctggcttcccaagagcacttattgacccttcctcaggcctcccgaaccgacttcctccaggcgctgtgcccccaggagctcgctttgacccctttggacccattgggaccagcccacccggacctaacccagaccatctccccccgccgggctacgatgacatgtacctgtgaaggcctcaagaatgtaacatcccaggcttccctccattctcctggagctgccaccgctgtccccatcagcaaccatgttcttgcaggctgggggcaagggattctgctcatgtgtttgcagaccggctgggatagcctccccaccccttatcagagccaagacacctgctgcagctctccacctagctgcagatagctcccaaagagaaatcagtgtgtctctttcaccatcagctcctcccctttcaccaccagctcctctccacttcccaagggagactccggcaaccttcagcaacatatatcctcgaccagatgcagtgctataagaacagaacgcattttggatgttattattaagaaccaaatgtcaatacagaattcatgttgccggtttcccacttttctttttacattaatgcatagctgcttccatttatgagactttagagtttgagtttctgtagggctgaatgactctttttcctgcccagggcccattcttgcttctcaggcaccttccgtttattaattgccattgctcctgacatcactaagatgggtccccttctggctgcatgaatggaaatgagtgactggaaatcccataggccacaagaatgactttcacaagggcaggaacattgtggaaagactgcatcattctgatgaggcaaaatcctccagctattcctgtctgggccagttttgtaggtccatctgtgcatgggcagcagtagtcaaaaagccaaggaaaaaacagagcagacctgaaggctaatcttatttttgccactaacttagtgaatgaccctaagcaagttccttctcctcttagggccttgtgccaagcctatgaaattggaggtggctttcctgctctaaagcattttgatgtctcattctgtgtttggtaacccctataaactggggcagaggaaaagaatgatggttcaaggccatacttcccttgaaccttgtgtggttcttgcctaactctgtggtttttggaccccatggggcccagacagagcacaggagcatgggctgcctctgagtgtggtgttgaacttcgggaggagcagggagccctgcaccttgtgtcctggcccacctgacctttggtgttctccggatccttttcagcccgaggcctgacagacgcgggcagtgatgagccctgttctggagtggaaagagcacgatagagcaccaggctaagaggcacgagatcaaggcggtagtcacttccgctctgcagctagcatttcaaccatatgtggatcctttcatttctcagctccctggattccttcccctaaattaggacctattatttacctgtaggtaagcaagctactgtagctcttctgaggtatctgccaggctgttttctgtagcctcagattgcctatctgcttagcctgagaacaggtagatgaaaactaaactgatgcctaggcccagggtcagtctcagatggaagctgggcctgggtggggaggctagcatgcgtggctccctgggtatttctgtcagtccccatggcaagcagtgatttagtaaaacaccccagagtcagggaagccaaccaccttgaaacctttagaacatctctgctttggagaaagacccagagatcaggcagaggtgcagattcaatcattactcataacctttgagagctggcaaatgggaggagtgttagtctttgttttggaattggaccattcttgcaaccaaaaggacttagagcagtttgctcataaagacatcctttattataaaaggaagtatttaaaggatgatagagaccatcagatagaagcagggaaggtagataacttttaggaccttgatgtgaggaaaagataaaatttaaacaataaatttgccacttagattttctagcagcaaagtccgaaaagatagttatatacaaaattctgttttctgaaaacaaaattgtgattcaccttcagaattggccattttttttgtgagtttccttgcatcaaggacactgagaaacacagtcattgtcttaggtgttctatgggaggaagtgaatagagcctttaggaacttcctggtcaagcttatggtgcttattttgatctgggccacttccctccttccagtcatgagtaatcatcaaggagcaagttggagtgtttcaggtgtatattttgtagaacccaaaagattggagccttaacaataaacatcagcactaagtga

SEQ ID NO: 448488 - DNA, 1389 bp, Homo sapiens
agcggggcttccccgccccgccccgtccccgggcgtctccattttggtctcaggtgtggactcggcaagaaccagcgcaagagggaagcggagttatagctaccccggccgcggagccggctcactgcactacccccgcccccttctttcctccagacgccgaagtcgcgggcgctcatggcgggcctggaggtactgttcgcatcggcagcgccggccatcacctgcaggcaggacgcgctcgtctgcttcttgcattgggaagtggtgacacacggttactgcggcttgggtgtcggtgaccagccgggtcccaatgataagaagtcagaactgctgccagctgggtggaacaacaataaagacctgtatgtcctccggtatgagtataaggatgggtccagaaagctccttgtgaaagccatcaccgtggagagcagcatgatcctcaatgtgctggaatatggctcacagcaagtggcagacttgaccctgaacttggatgattatatcgatgcagaacacctgggtgacttccacaggacctacaagaacagtgaggagcttcggtctcgtattgtgtctggaatcatcacacctatccatgagcagtgggaaaaggctaatgtaagcagtccccaccgggagttcccccctgctaccgccagagaggtggacccactccggattcctccacaccacccacacaccagtcggcagcctccctggtgtgatcccctgggcccgtttgttgtcgggggagaagacttagacccttttgggcctcggagaggtggcatgattgtggatcccctgagatctggcttcccaagagcacttattgacccttcctcaggcctcccgaaccgacttcctccaggcgctgtgcccccaggagctcgctttgacccctttggacccattgggaccagcccacccggacctaacccagaccatctccccccgccgggctacgatgacatgtacctgtgaaggcctcaagaatgtaacatcccaggcttccctccattctcctggagctgccaccgctgtccccatcagcaaccatgttcttgcaggctgggggcaagggattctgctcatgtgtttgcagaccggctgggatagcctccccaccccttatcagagccaagacacctgctgcagctctccacctagctgcagatagctcccaaagagaaatcagtgtgtctctttcaccatcagctcctcccctttcaccaccagctcctctccacttcccaagggagactccggcaaccttcagcaacatatatcctcgaccagatgcagtgctataagaacagaacgcattttggatgttattattaagaaccaaatgtcaatacagaattcatgttgccggtt

SEQ ID NO: 448489 - DNA, 2036 bp, Homo sapiens
agcggggcttccccgccccgccccgtccccgggcgtctccattttggtctcaggtgtggactcggcaagaaccagcgcaagagggaagcggagttatagctaccccggccgcggagccggctcactgcactacccccgcccccttctttcctccagacgccgaagtcgcgggcgctcatggcgggcctggaggtactgttcgcatcggcagcgccggccatcacctgcaggcaggacgcgctcgtctgcttcttgcattgggaagtggtgacacacggttactgcggcttgggtgtcggtgaccagccgggtcccaatgataagaagtcagaactgctgccagctgggtggaacaacaataaagacctgtatgtcctccggtatgagtataaggatgggtccagaaagctccttgtgaaagccatcaccgtggagagcagcatgatcctcaatgtgctggaatatggctcacagcaagtggcagacttgaccctgaacttggatgattatatcgatgcagaacacctgggtgacttccacaggacctacaagaacagtgaggagcttcggtctcgtattgtgtctggaatcatcacacctatccatgagcagtgggaaaaggctaatgtaagcagtccccaccgggagttcccccctgctaccgccagagaggtggacccactccggattcctccacaccacccacacaccagtcggcagcctccctggtgtgatcccctgggcccgtttgttgtcgggggagaagacttagacccttttgggcctcggagaggtggcatgattgtggatcccctgagatctggcttcccaagagcacttattgacccttcctcaggcctcccgaaccgacttcctccaggcgctgtgcccccaggagctcgctttgacccctttggacccattgggaccagcccacccggcccgaggcctgacagacgcgggcagtgatgagccctgttctggagtggaaagagcacgatagagcaccaggctaagaggcacgagatcaaggcggtagtcacttccgctctgcagctagcatttcaaccatatgtggatcctttcatttctcagctccctggattccttcccctaaattaggacctattatttacctgtaggtaagcaagctactgtagctcttctgaggtatctgccaggctgttttctgtagcctcagattgcctatctgcttagcctgagaacaggtagatgaaaactaaactgatgcctaggcccagggtcagtctcagatggaagctgggcctgggtggggaggctagcatgcgtggctccctgggtatttctgtcagtccccatggcaagcagtgatttagtaaaacaccccagagtcagggaagccaaccaccttgaaacctttagaacatctctgctttggagaaagacccagagatcaggcagaggtgcagattcaatcattactcataacctttgagagctggcaaatgggaggagtgttagtctttgttttggaattggaccattcttgcaaccaaaaggacttagagcagtttgctcataaagacatcctttattataaaaggaagtatttaaaggatgatagagaccatcagatagaagcagggaaggtagataacttttaggaccttgatgtgaggaaaagataaaatttaaacaataaatttgccacttagattttctagcagcaaagtccgaaaagatagttatatacaaaattctgttttctgaaaacaaaattgtgattcaccttcagaattggccattttttttgtgagtttccttgcatcaaggacactgagaaacacagtcattgtcttaggtgttctatgggaggaagtgaatagagcctttaggaacttcctggtcaagcttatggtgcttattttgatctgggccacttccctccttccagtcatgagtaatcatcaaggagcaagttggagtgtttcaggtgtatattttgtagaacccaaaagattggagccttaacaataaacatcagcactaagtga

SEQ ID NO: 448490 - DNA, 1709 bp, Homo sapiens
  misc_feature (1449)..(1449): n is a, c, g, or t
agcggggcttccccgccccgccccgtccccgggcgtctccattttggtctcaggtgtggactcggcaagaaccagcgcaagagggaagcggagttatagctaccccggccgcggagccggctcactgcactacccccgcccccttctttcctccagacgccgaagtcgcgggcgctcatggcgggcctggaggtactgttcgcatcggcagcgccggccatcacctgcaggcaggacgcgctcgtctgcttcttgcattgggaagtggtgacacacggttactgcggcttgggtgtcggtgaccagccgggtcccaatgataagaagtcagaactgctgccagctgggtggaacaacaataaagacctgtatgtcctccggtatgagtataaggatgggtccagaaagctccttgtgaaagccatcaccgtggagagcagcatgatcctcaatgtgctggaatatggctcacagcaagtggcagacttgaccctgaacttggatgattatatcgatgcagaacacctgggtgacttccacaggacctacaagaacagtgaggagcttcggtctcgtattgtgtctggaatcatcacacctatccatgagcagtgggaaaaggctaatgtaagcagtccccaccgggagttcccccctgctaccgccagagaggtggacccactccggattcctccacaccacccacacaccagtcggcagcctccctggtgtgatcccctgggcccgtttgttgtcgggggagaagacttagacccttttgggcctcggagaggtggcatgattgtggatcccctgagatctggcttcccaagagcacttattgacccttcctcaggcctcccgaaccgacttcctccaggcgctgtgcccccaggagctcgctttgacccctttggacccattgggaccagcccacccggacctaacccagaccatctccccccgccgggctacgatgacatgtacctgtgaaggcctcaagaatgtaacatcccaggcttccctccattctcctggagctgccaccgctgtccccatcagcaaccatgttcttgcaggctgggggcaagggattctgctcatgtgtttgcagaccggctgggatagcctccccaccccttatcagagccaagacacctgctgcagctctccacctagctgcagatagctcccaaagagaaatcagtgtgtctctttcaccatcagctcctcccctttcaccaccagctcctctccacttcccaagggagactccggcaaccttcagcaacatatatcctcgaccagatgcagtgctataagaacagaacgcattttggatgttattattaagaaccaaatgtcaatacagaattcatgttgccggttaaaaaaaaaaaaaaaaaaaaaaaaaaaaaaaaaaaaaaaaaaaaaaaaaaaaaaaaaaanaaaaaaaaaaaaaaaaaaaaaaagaaaaaaaaaaaaaaaaagaaaaaaaaacgaaacacgacagaacaagaaaaaacaacaaaccaaacaagagagaaacagacaacgaaggaaacgaggaggcggggcgcgcggacatccgacgcccaccgcagcggaggagcgggcaagcaaccacacgaccacccaaacaaaagcagggggcgcacgcaagccgcgcgcgggcgcccaccgcaggacgagaacaccatcaaaaaacc

SEQ ID NO: 448491 - DNA, 3120 bp, Homo sapiens
agcggggcttccccgccccgccccgtccccgggcgtctccattttggtctcaggtgtggactcggcaagaaccagcgcaagagggaagcggagttatagctaccccggccgcggagccggctcactgcactacccccgcccccttctttcctccagacgccgaagtcgcgggcgctcatggcgggcctggagccgggtcccaatgataagaagtcagaactgctgccagctgggtggaacaacaataaagacctgtatgtcctccggtatgagtataaggatgggtccagaaagctccttgtgaaagccatcaccgtggagagcagcatgatcctcaatgtgctggaatatggctcacagcaagtggcagacttgaccctgaacttggatgattatatcgatgcagaacacctgggtgacttccacaggacctacaagaacagtgaggagcttcggtctcgtattgtgtctggaatcatcacacctatccatgagcagtgggaaaaggctaatgtaagcagtccccaccgggagttcccccctgctaccgccagagaggtggacccactccggattcctccacaccacccacacaccagtcggcagcctccctggtgtgatcccctgggcccgtttgttgtcgggggagaagacttagacccttttgggcctcggagaggtggcatgattgtggatcccctgagatctggcttcccaagagcacttattgacccttcctcaggcctcccgaaccgacttcctccaggcgctgtgcccccaggagctcgctttgacccctttggacccattgggaccagcccacccggacctaacccagaccatctccccccgccgggctacgatgacatgtacctgtgaaggcctcaagaatgtaacatcccaggcttccctccattctcctggagctgccaccgctgtccccatcagcaaccatgttcttgcaggctgggggcaagggattctgctcatgtgtttgcagaccggctgggatagcctccccaccccttatcagagccaagacacctgctgcagctctccacctagctgcagatagctcccaaagagaaatcagtgtgtctctttcaccatcagctcctcccctttcaccaccagctcctctccacttcccaagggagactccggcaaccttcagcaacatatatcctcgaccagatgcagtgctataagaacagaacgcattttggatgttattattaagaaccaaatgtcaatacagaattcatgttgccggtttcccacttttctttttacattaatgcatagctgcttccatttatgagactttagagtttgagtttctgtagggctgaatgactctttttcctgcccagggcccattcttgcttctcaggcaccttccgtttattaattgccattgctcctgacatcactaagatgggtccccttctggctgcatgaatggaaatgagtgactggaaatcccataggccacaagaatgactttcacaagggcaggaacattgtggaaagactgcatcattctgatgaggcaaaatcctccagctattcctgtctgggccagttttgtaggtccatctgtgcatgggcagcagtagtcaaaaagccaaggaaaaaacagagcagacctgaaggctaatcttatttttgccactaacttagtgaatgaccctaagcaagttccttctcctcttagggccttgtgccaagcctatgaaattggaggtggctttcctgctctaaagcattttgatgtctcattctgtgtttggtaacccctataaactggggcagaggaaaagaatgatggttcaaggccatacttcccttgaaccttgtgtggttcttgcctaactctgtggtttttggaccccatggggcccagacagagcacaggagcatgggctgcctctgagtgtggtgttgaacttcgggaggagcagggagccctgcaccttgtgtcctggcccacctgacctttggtgttctccggatccttttcagcccgaggcctgacagacgcgggcagtgatgagccctgttctggagtggaaagagcacgatagagcaccaggctaagaggcacgagatcaaggcggtagtcacttccgctctgcagctagcatttcaaccatatgtggatcctttcatttctcagctccctggattccttcccctaaattaggacctattatttacctgtaggtaagcaagctactgtagctcttctgaggtatctgccaggctgttttctgtagcctcagattgcctatctgcttagcctgagaacaggtagatgaaaactaaactgatgcctaggcccagggtcagtctcagatggaagctgggcctgggtggggaggctagcatgcgtggctccctgggtatttctgtcagtccccatggcaagcagtgatttagtaaaacaccccagagtcagggaagccaaccaccttgaaacctttagaacatctctgctttggagaaagacccagagatcaggcagaggtgcagattcaatcattactcataacctttgagagctggcaaatgggaggagtgttagtctttgttttggaattggaccattcttgcaaccaaaaggacttagagcagtttgctcataaagacatcctttattataaaaggaagtatttaaaggatgatagagaccatcagatagaagcagggaaggtagataacttttaggaccttgatgtgaggaaaagataaaatttaaacaataaatttgccacttagattttctagcagcaaagtccgaaaagatagttatatacaaaattctgttttctgaaaacaaaattgtgattcaccttcagaattggccattttttttgtgagtttccttgcatcaaggacactgagaaacacagtcattgtcttaggtgttctatgggaggaagtgaatagagcctttaggaacttcctggtcaagcttatggtgcttattttgatctgggccacttccctccttccagtcatgagtaatcatcaaggagcaagttggagtgtttcaggtgtatattttgtagaacccaaaagattggagccttaacaataaacatcagcactaagtga

SEQ ID NO: 448492 - DNA, 1043 bp, Homo sapiens
agcggggcttccccgccccgccccgtccccgggcgtctccattttggtctcaggtgtggactcggcaagaaccagcgcaagagggaagcggagttatagctaccccggccgcggagccggctcactgcactacccccgcccccttctttcctccagacgccgaagtcgcgggcgctcatggcgggcctggaggtactgttcgcatcggcagcgccggccatcacctgcaggcaggacgcgctcgtctgcttcttgcattgggaagtggtgacacacggttactgcggcttgggtgtcggtgaccagccgggtcccaatgataagaagtcagaactgctgccagctgggtggaacaacaataaagacctgtatgtcctccggtatgagtataaggatgggtccagaaagctccttgtgaaagccatcaccgtggagagcagcatgatcctcaatgtgctggaatatggctcacagcaagtggcagacttgaccctgaacttggatgattatatcgatgcagaacacctgggtgacttccacaggacctacaagaacagtgaggagcttcggtctcgtattgtgtctggaatcatcacacctatccatgagcagtgggaaaaggctaatgtaagcagtccccaccgggagttcccccctgctaccgccagagaggtggacccactccggattcctccacaccacccacacaccagtcggcagcctccctggtgtgatcccctgggcccgtttgttgtcgggggagaagacttagacccttttgggcctcggagaggtggcatgattgtggatcccctgagatctggcttcccaagagcacttattgacccttcctcaggcctcccgaaccgacttcctccaggcgctgtgcccccaggagctcgctttgacccctttggacccattgggaccagcccacccggacctaacccagaccatctccccccgccgggctacgatgacatgtacctgatgactttggcttcttctcgtcgtcggagagcggtgccccggaggcggcggag

SEQ ID NO: 448493 - DNA, 3180 bp, Homo sapiens
agcggggcttccccgccccgccccgtccccgggcgtctccattttggtctcaggtgtggactcggcaagaaccagcgcaagagggaagcggagttatagctaccccggccgcggagccggctcactgcactacccccgcccccttctttcctccagacgccgaagtcgcgggcgctcatggcgggcctggaggtactgttcgcatcggcagcgccggccatcacctgcaggcaggacgcgctcgtctgcttcttgcattgggaagtggtgacacacggttactgcggcttgggtgtcggtgaccagccgggtcccaatgataagaagtcagaactgctgccagctgggtggaacaacaataaagacctgtatgtcctccggtatgagtataaggatgggtccagaaagctccttgtgaaagccatcaccgtggagagcagcatgatcctcaatgtgctggaatatggctcacagcaagtggcagacttgaccctgaacttggatgattatatcgatgcagaacacctgggtgacttccacaggacctacaagaacagtgaggagcttcggtctcgtattgtgtctggaatcatcacacctatccatgagcagtgggaggtggacccactccggattcctccacaccacccacacaccagtcggcagcctccctggtgtgatcccctgggcccgtttgttgtcgggggagaagacttagacccttttgggcctcggagaggtggcatgattgtggatcccctgagatctggcttcccaagagcacttattgacccttcctcaggcctcccgaaccgacttcctccaggcgctgtgcccccaggagctcgctttgacccctttggacccattgggaccagcccacccggacctaacccagaccatctccccccgccgggctacgatgacatgtacctgtgaaggcctcaagaatgtaacatcccaggcttccctccattctcctggagctgccaccgctgtccccatcagcaaccatgttcttgcaggctgggggcaagggattctgctcatgtgtttgcagaccggctgggatagcctccccaccccttatcagagccaagacacctgctgcagctctccacctagctgcagatagctcccaaagagaaatcagtgtgtctctttcaccatcagctcctcccctttcaccaccagctcctctccacttcccaagggagactccggcaaccttcagcaacatatatcctcgaccagatgcagtgctataagaacagaacgcattttggatgttattattaagaaccaaatgtcaatacagaattcatgttgccggtttcccacttttctttttacattaatgcatagctgcttccatttatgagactttagagtttgagtttctgtagggctgaatgactctttttcctgcccagggcccattcttgcttctcaggcaccttccgtttattaattgccattgctcctgacatcactaagatgggtccccttctggctgcatgaatggaaatgagtgactggaaatcccataggccacaagaatgactttcacaagggcaggaacattgtggaaagactgcatcattctgatgaggcaaaatcctccagctattcctgtctgggccagttttgtaggtccatctgtgcatgggcagcagtagtcaaaaagccaaggaaaaaacagagcagacctgaaggctaatcttatttttgccactaacttagtgaatgaccctaagcaagttccttctcctcttagggccttgtgccaagcctatgaaattggaggtggctttcctgctctaaagcattttgatgtctcattctgtgtttggtaacccctataaactggggcagaggaaaagaatgatggttcaaggccatacttcccttgaaccttgtgtggttcttgcctaactctgtggtttttggaccccatggggcccagacagagcacaggagcatgggctgcctctgagtgtggtgttgaacttcgggaggagcagggagccctgcaccttgtgtcctggcccacctgacctttggtgttctccggatccttttcagcccgaggcctgacagacgcgggcagtgatgagccctgttctggagtggaaagagcacgatagagcaccaggctaagaggcacgagatcaaggcggtagtcacttccgctctgcagctagcatttcaaccatatgtggatcctttcatttctcagctccctggattccttcccctaaattaggacctattatttacctgtaggtaagcaagctactgtagctcttctgaggtatctgccaggctgttttctgtagcctcagattgcctatctgcttagcctgagaacaggtagatgaaaactaaactgatgcctaggcccagggtcagtctcagatggaagctgggcctgggtggggaggctagcatgcgtggctccctgggtatttctgtcagtccccatggcaagcagtgatttagtaaaacaccccagagtcagggaagccaaccaccttgaaacctttagaacatctctgctttggagaaagacccagagatcaggcagaggtgcagattcaatcattactcataacctttgagagctggcaaatgggaggagtgttagtctttgttttggaattggaccattcttgcaaccaaaaggacttagagcagtttgctcataaagacatcctttattataaaaggaagtatttaaaggatgatagagaccatcagatagaagcagggaaggtagataacttttaggaccttgatgtgaggaaaagataaaatttaaacaataaatttgccacttagattttctagcagcaaagtccgaaaagatagttatatacaaaattctgttttctgaaaacaaaattgtgattcaccttcagaattggccattttttttgtgagtttccttgcatcaaggacactgagaaacacagtcattgtcttaggtgttctatgggaggaagtgaatagagcctttaggaacttcctggtcaagcttatggtgcttattttgatctgggccacttccctccttccagtcatgagtaatcatcaaggagcaagttggagtgtttcaggtgtatattttgtagaacccaaaagattggagccttaacaataaacatcagcactaagtga

SEQ ID NO: 448494 - DNA, 2773 bp, Homo sapiens
acttcccaccgggaggacttctcaccgggatttagcggggtgatgcctgttgggggccagtgccctcctaattggggggtaggggctaggctggagtggtaaaaggctcagaaaaatcctgcgaagaaaaaaacttctgaggtaataaataggattatcccgtgggaagtcgactccccaccgggagttcccccctgctaccgccagagaggtggacccactccggattcctccacaccacccacacaccagtcggcagcctccctggtgtgatcccctgggcccgtttgttgtcgggggagaagacttagacccttttgggcctcggagaggtggcatgattgtggatcccctgagatctggcttcccaagagcacttattgacccttcctcaggcctcccgaaccgacttcctccaggcgctgtgcccccaggagctcgctttgacccctttggacccattgggaccagcccacccggacctaacccagaccatctccccccgccgggctacgatgacatgtacctgtgaaggcctcaagaatgtaacatcccaggcttccctccattctcctggagctgccaccgctgtccccatcagcaaccatgttcttgcaggctgggggcaagggattctgctcatgtgtttgcagaccggctgggatagcctccccaccccttatcagagccaagacacctgctgcagctctccacctagctgcagatagctcccaaagagaaatcagtgtgtctctttcaccatcagctcctcccctttcaccaccagctcctctccacttcccaagggagactccggcaaccttcagcaacatatatcctcgaccagatgcagtgctataagaacagaacgcattttggatgttattattaagaaccaaatgtcaatacagaattcatgttgccggtttcccacttttctttttacattaatgcatagctgcttccatttatgagactttagagtttgagtttctgtagggctgaatgactctttttcctgcccagggcccattcttgcttctcaggcaccttccgtttattaattgccattgctcctgacatcactaagatgggtccccttctggctgcatgaatggaaatgagtgactggaaatcccataggccacaagaatgactttcacaagggcaggaacattgtggaaagactgcatcattctgatgaggcaaaatcctccagctattcctgtctgggccagttttgtaggtccatctgtgcatgggcagcagtagtcaaaaagccaaggaaaaaacagagcagacctgaaggctaatcttatttttgccactaacttagtgaatgaccctaagcaagttccttctcctcttagggccttgtgccaagcctatgaaattggaggtggctttcctgctctaaagcattttgatgtctcattctgtgtttggtaacccctataaactggggcagaggaaaagaatgatggttcaaggccatacttcccttgaaccttgtgtggttcttgcctaactctgtggtttttggaccccatggggcccagacagagcacaggagcatgggctgcctctgagtgtggtgttgaacttcgggaggagcagggagccctgcaccttgtgtcctggcccacctgacctttggtgttctccggatccttttcagcccgaggcctgacagacgcgggcagtgatgagccctgttctggagtggaaagagcacgatagagcaccaggctaagaggcacgagatcaaggcggtagtcacttccgctctgcagctagcatttcaaccatatgtggatcctttcatttctcagctccctggattccttcccctaaattaggacctattatttacctgtaggtaagcaagctactgtagctcttctgaggtatctgccaggctgttttctgtagcctcagattgcctatctgcttagcctgagaacaggtagatgaaaactaaactgatgcctaggcccagggtcagtctcagatggaagctgggcctgggtggggaggctagcatgcgtggctccctgggtatttctgtcagtccccatggcaagcagtgatttagtaaaacaccccagagtcagggaagccaaccaccttgaaacctttagaacatctctgctttggagaaagacccagagatcaggcagaggtgcagattcaatcattactcataacctttgagagctggcaaatgggaggagtgttagtctttgttttggaattggaccattcttgcaaccaaaaggacttagagcagtttgctcataaagacatcctttattataaaaggaagtatttaaaggatgatagagaccatcagatagaagcagggaaggtagataacttttaggaccttgatgtgaggaaaagataaaatttaaacaataaatttgccacttagattttctagcagcaaagtccgaaaagatagttatatacaaaattctgttttctgaaaacaaaattgtgattcaccttcagaattggccattttttttgtgagtttccttgcatcaaggacactgagaaacacagtcattgtcttaggtgttctatgggaggaagtgaatagagcctttaggaacttcctggtcaagcttatggtgcttattttgatctgggccacttccctccttccagtcatgagtaatcatcaaggagcaagttggagtgtttcaggtgtatattttgtagaacccaaaagattggagccttaacaataaacatcagcactaagtga

SEQ ID NO: 448495 - DNA, 1277 bp, Homo sapiens
actctctaattccaccgctacaggcctcggagaggtggcatgattgtggatcccctgagatctggcttcccaagagcacttattgacccttcctcaggcctcccgaaccgacttcctccaggcgctgtgcccccaggagctcgctttgacccctttggacccattgggaccagcccacccggcccgaggcctgacagacgcgggcagtgatgagccctgttctggagtggaaagagcacgatagagcaccaggctaagaggcacgagatcaaggcggtagtcacttccgctctgcagctagcatttcaaccatatgtggatcctttcatttctcagctccctggattccttcccctaaattaggacctattatttacctgtaggtaagcaagctactgtagctcttctgaggtatctgccaggctgttttctgtagcctcagattgcctatctgcttagcctgagaacaggtagatgaaaactaaactgatgcctaggcccagggtcagtctcagatggaagctgggcctgggtggggaggctagcatgcgtggctccctgggtatttctgtcagtccccatggcaagcagtgatttagtaaaacaccccagagtcagggaagccaaccaccttgaaacctttagaacatctctgctttggagaaagacccagagatcaggcagaggtgcagattcaatcattactcataacctttgagagctggcaaatgggaggagtgttagtctttgttttggaattggaccattcttgcaaccaaaaggacttagagcagtttgctcataaagacatcctttattataaaaggaagtatttaaaggatgatagagaccatcagatagaagcagggaaggtagataacttttaggaccttgatgtgaggaaaagataaaatttaaacaataaatttgccacttagattttctagcagcaaagtccgaaaagatagttatatacaaaattctgttttctgaaaacaaaattgtgattcaccttcagaattggccattttttttgtgagtttccttgcatcaaggacactgagaaacacagtcattgtcttaggtgttctatgggaggaagtgaatagagcctttaggaacttcctggtcaagcttatggtgcttattttgatctgggccacttccctccttccagtcatgagtaatcatcaaggagcaagttggagtgtttcaggtgtatattttgtagaacccaaaagattggagccttaacaataaacatcagcactaagtga

SEQ ID NO: 448496 - DNA, 872 bp, Homo sapiens
  misc_feature (462)..(462): n is a, c, g, or t
  misc_feature (477)..(477): n is a, c, g, or t
  misc_feature (480)..(481): n is a, c, g, or t
  misc_feature (487)..(487): n is a, c, g, or t
  misc_feature (508)..(508): n is a, c, g, or t
  misc_feature (519)..(519): n is a, c, g, or t
  misc_feature (522)..(522): n is a, c, g, or t
  misc_feature (538)..(539): n is a, c, g, or t
  misc_feature (543)..(543): n is a, c, g, or t
  misc_feature (545)..(545): n is a, c, g, or t
  misc_feature (569)..(569): n is a, c, g, or t
  misc_feature (587)..(587): n is a, c, g, or t
  misc_feature (598)..(598): n is a, c, g, or t
  misc_feature (600)..(601): n is a, c, g, or t
  misc_feature (615)..(615): n is a, c, g, or t
  misc_feature (635)..(636): n is a, c, g, or t
  misc_feature (643)..(643): n is a, c, g, or t
  misc_feature (668)..(668): n is a, c, g, or t
  misc_feature (674)..(674): n is a, c, g, or t
  misc_feature (680)..(680): n is a, c, g, or t
  misc_feature (685)..(685): n is a, c, g, or t
  misc_feature (696)..(698): n is a, c, g, or t
  misc_feature (709)..(709): n is a, c, g, or t
  misc_feature (711)..(712): n is a, c, g, or t
  misc_feature (714)..(715): n is a, c, g, or t
  misc_feature (718)..(718): n is a, c, g, or t
  misc_feature (723)..(726): n is a, c, g, or t
  misc_feature (728)..(728): n is a, c, g, or t
  misc_feature (746)..(746): n is a, c, g, or t
  misc_feature (751)..(751): n is a, c, g, or t
  misc_feature (765)..(766): n is a, c, g, or t
  misc_feature (768)..(768): n is a, c, g, or t
  misc_feature (771)..(771): n is a, c, g, or t
  misc_feature (773)..(775): n is a, c, g, or t
  misc_feature (778)..(779): n is a, c, g, or t
  misc_feature (789)..(789): n is a, c, g, or t
  misc_feature (796)..(796): n is a, c, g, or t
  misc_feature (805)..(805): n is a, c, g, or t
  misc_feature (809)..(809): n is a, c, g, or t
  misc_feature (829)..(829): n is a, c, g, or t
agcggggcttccccgccccgccccgtccccgggcgtctccattttggtctcaggtgtggactcggcaagaaccagcgcaagagggaagcggagttatagctaccccggccgcggagccggctcactgcactacccccgcccccttctttcctccagacgccgaagtcgcgggcgctcatggcgggcctggaggtactgttcgcatcggcagcgccggccatcacctgcaggcaggacgcgctcgtctgcttcttgcattgggaagtggtgacacacggttactgcggcttgggtgtcggtgaccagccgggtcccaatgataagaagtcagaactgctgccagctgggtggaacaacaataaagacctgtatgtcctccggtatgagtataaggatgggtccagaaagctccttgtgaaagccatcaccgtggagagcagcatgatcctcaatgtgctggtngaatatagggtgcanggnngtgggnactttacgcgcgctgacactnggatgatatantcngcgatagcgcaagcgnntagngngagcttgcccacgggcgcctcgcncgcccacagtgcagggcngcttagagtgntnngtacttagtagtantgtgccctgcctggcagcgnntgctggnctagcgagcagtaggagcaccacgnggtgcnttgtancggcngttgggggccnnngggccgtttgngnngnntanatccnnnngngccgccgccggtggggcnccccntaaaaaaaaaaaannanccncnnnccnncccgccgcgngccgttnggggcgggntggngttggttgttgctgggggtngggggggcgttttgtttgttggggggggcgcccgcgtttccgc

SEQ ID NO: 448497 - DNA, 1866 bp, Homo sapiens
ggacgcgtgggtcgacccacgcgtcgccacgcgtcgcggctctgcgacatccgcagcctcatttaccagagggagccagggctgcagcctcatctgtttgcggatcagaacccgagctgtgcttgtggctgcggctgctaactggctgcgcacagggagctgtcaccatgcctcactcgtacccagccctttctgctgagcagaagaaggagttgtctgacattgccctgcggattgtagccccgggcaaaggcattctggctgcggatgagtctgtaggcagcatggccaagcggctgagccaaattggggtggaaaacacagaggagaaccgccggctgtaccgccaggtcctgttcagtgctgatgaccgtgtgaaaaagtgcattggaggcgtcattttcttccatgagaccctctaccagaaagatgataatggtgttcccttcgtccgaaccatccaggataagggcatcgtcgtgggcatcaaggttgacaagggtgtggtgcctctagctgggactgatggagaaaccaccactcaagggctggatgggctctcagaacgctgtgcccaatacaagaaggatggtgctgactttgccaagtggcgctgtgtgctgaaaatcagtgagcgtacaccctctgcacttgccattctggagaacgccaacgtgctggcccgttatgccagtatctgccagcagaatggcattgtgcctattgtggaacctgaaatattgcctgatggagaccacgacctcaaacgttgtcagtatgttacagagaaggtcttggctgctgtgtacaaggccctgagtgaccatcatgtatacctggaggggaccctgctcaagcccaacatggtgaccccgggccatgcctgtcccatcaagtataccccagaggagattgccatggcaactgtcactgccctgcgtcgcactgtgcccccagctgtcccaggagtgaccttcctgtctgggggtcagagcgaagaagaggcatcattcaacctcaatgccatcaaccgctgcccccttccccgaccctgggcgcttaccttctcctatgggcgtgccctgcaagcctctgcactcaatgcctggcgagggcaacgggacaatgctggggctgccactgaggagttcatcaagcgggctgaggtgaatgggcttgcagcccagggcaagtatgaaggcagtggagaagatggtggagcagcagcacagtcactctacattgccaaccatgcctactgagtatccactccataccacagcccttggcccagccatctgcacccacttttgcttgtagtcatggccagggccaaatagctatgcagagcagagatgccttcacctggcaccaacttgtcttcctttctctcttcccttcccctctctcattgctgcacctgggaccataggatgggaggatagggagcccctcatgactgagggcagaagaaattgctagaagtcagaacaggatggctgggtctccccctacctcttccagctcccacaattttcccatgatgaggtagcttctccctgggctctccttcttgcctgccctgtctcctgggatcagagggtagtacagaagccctgactcatgccttgagtacataccatacagcaaataaatggtagcaaaacaaaaaaaaaaaaacaacaaaataaacacaacaaacaaaacacaaacacacacaacaacaacaacaacacacaaacaacaaacaaaaaacacacaaacaaagaaaaacacaacaaaacacacaaaacacacacaaaaaacaaacacagccacaagacacgccagagcgccggggcggcccctcctccccatcccccccgg

SEQ ID NO: 448498 - DNA, 1660 bp, Homo sapiens
ggacgcgtgggtcgacccacgcgtcgccacgcgtcgcggctctgcgacatccgcagcctcatttaccagagggagccagggctgcagcctcatctgtttgcggatcagaacccgagctgtgcttgtggctgcggctgctaactggctgcgcacagggagctgtcaccatgcctcactcgtacccagccctttctgctgagcagaagaaggagttgtctgacattgccctgcggattgtagccccgggcaaaggcattctggctgcggatgagtctgtaggcagcatggccaagcggctgagccaaattggggtggaaaacacagaggagaaccgccggctgtaccgccaggtcctgttcagtgctgatgaccgtgtgaaaaagtgcattggaggcgtcattttcttccatgagaccctctaccagaaagatgataatggtgttcccttcgtccgaaccatccaggataagggcatcgtcgtgggcatcaaggttgacaagggtgtggtgcctctagctgggactgatggagaaaccaccactcaagggctggatgggctctcagaacgctgtgcccaatacaagaaggatggtgctgactttgccaagtggcgctgtgtgctgaaaatcagtgagcgtacaccctctgcacttgccattctggagaacgccaacgtgctggcccgttatgccagtatctgccagcagaatggcattgtgcctattgtggaacctgaaatattgcctgatggagaccacgacctcaaacgttgtcagtatgttacagagaaggtcttggctgctgtgtacaaggccctgagtgaccatcatgtatacctggaggggaccctgctcaagcccaacatggtgaccccgggccatgcctgtcccatcaagtataccccagaggagattgccatggcaactgtcactgccctgcgtcgcactgtgcccccagctgtcccaggagtgaccttcctgtctgggggtcagagcgaagaagaggcatcattcaacctcaatgccatcaaccgctgcccccttccccgaccctgggcgcttaccttctcctatgggcgtgccctgcaagcctctgcactcaatgcctggcgagggcaacgggacaatgctggggctgccactgaggagttcatcaagcgggctgaggtgaatgggcttgcagcccagggcaagtatgaaggcagtggagaagatggtggagcagcagcacagtcactctacattgccaaccatgcctactgagtatccactccataccacagcccttggcccagccatctgcacccacttttgcttgtagtcatggccagggccaaatagctatgcagagcagagatgccttcacctggcaccaactgcacctgggaccataggatgggaggatagggagcccctcatgactgagggcagaagaaattgctagaagtcagaacaggatggctgggtctccccctacctcttccagctcccacaattttcccatgatgaggtagcttctccctgggctctccttcttgcctgccctgtctcctgggatcagagggtagtacagaagccctgactcatgccttgagtacataccatacagcaaataaatggtagcaaaacattctactttgcctgtctgttttacacatcaa

SEQ ID NO: 448499 - DNA, 1620 bp, Homo sapiens
  misc_feature (1)..(3): n is a, c, g, or t
  misc_feature (5)..(5): n is a, c, g, or t
  misc_feature (8)..(8): n is a, c, g, or t
  misc_feature (13)..(13): n is a, c, g, or t
nnngnggntgggnttactctagaatggcaagtgcagagggtgtacgctcactgattttcagcacacagcgcacaggggagctgtcaccatgcctcactcgtacccagccctttctgctgagcagaagaaggagttgtctgacattgccctgcggattgtagccccgggcaaaggcattctggctgcggatgagtctgtaggcagcatggccaagcggctgagccaaattggggtggaaaacacagaggagaaccgccggctgtaccgccaggtcctgttcagtgctgatgaccgtgtgaaaaagtgcattggaggcgtcattttcttccatgagaccctctaccagaaagatgataatggtgttcccttcgtccgaaccatccaggataagggcatcgtcgtgggcatcaaggttgacaagggtgtggtgcctctagctgggactgatggagaaaccaccactcaagggctggatgggctctcagaacgctgtgcccaatacaagaaggatggtgctgactttgccaagtggcgctgtgtgctgaaaatcagtgagcgtacaccctctgcacttgccattctggagaacgccaacgtgctggcccgttatgccagtatctgccagcagaatggcattgtgcctattgtggaacctgaaatattgcctgatggagaccacgacctcaaacgttgtcagtatgttacagagaaggtcttggctgctgtgtacaaggccctgagtgaccatcatgtatacctggaggggaccctgctcaagcccaacatggtgaccccgggccatgcctgtcccatcaagtataccccagaggagattgccatggcaactgtcactgccctgcgtcgcactgtgcccccagctgtcccaggagtgaccttcctgtctgggggtcagagcgaagaagaggcatcattcaacctcaatgccatcaaccgctgcccccttccccgaccctgggcgcttaccttctcctatgggcgtgccctgcaagcctctgcactcaatgcctggcgagggcaacgggacaatgctggggctgccactgaggagttcatcaagcgggctgaggtgaatgggcttgcagcccagggcaagtatgaaggcagtggagaagatggtggagcagcagcacagtcactctacattgccaaccatgcctactgagtatccactccataccacagcccttggcccagccatctgcacccacttttgcttgtagtcatggccagggccaaatagctatgcagagcagagatgccttcacctggcaccaacttgtcttcctttctctcttcccttcccctctctcattgctgcacctgggaccataggatgggaggatagggagcccctcatgactgagggcagaagaaattgctagaagtcagaacaggatggctgggtctccccctacctcttccagctcccacaattttcccatgatgaggtagcttctccctgggctctccttcttgcctgccctgtctcctgggatcagagggtagtacagaagccctgactcatgccttgagtacataccatacagcaaataaatggtagcaaaacattctactttgcctgtctgttttacacatcaa

SEQ ID NO: 448500 - DNA, 1633 bp, Homo sapiens
ggacgcgtgggtcgacccacgcgtcgccacgcgtcgcggacgcgtggtcgacccacgcgtcggccagggctgcagcctcatctgtttgcggatcagaacccgagctgtgcttgtggctgcggctgctaactggctgcgcacagggagctgtcaccatgcctcactcgtacccagccctttctgctgagcagaagaaggagttgtctgacattgccctgcggattgtagccccgggcaaaggcattctggctgcggatgagtctgtaggcagcatggccaagcggctgagccaaattggggtggaaaacacagaggagaaccgccggctgtaccgccaggtcctgttcagtgctgatgaccgtgtgaaaaagtgcattggaggcgtcattttcttccatgagaccctctaccagaaagatgataatggtgttcccttcgtccgaaccatccaggataagggcatcgtcgtgggcatcaaggttgacaagggtgtggtgcctctagctgggactgatggagaaaccaccactcaagggctggatgggctctcagaacgctgtgcccaatacaagaaggatggtgctgactttgccaagtggcgctgtgtggtgctggcccgttatgccagtatctgccagcagaatggcattgtgcctattgtggaacctgaaatattgcctgatggagaccacgacctcaaacgttgtcagtatgttacagagaaggtcttggctgctgtgtacaaggccctgagtgaccatcatgtatacctggaggggaccctgctcaagcccaacatggtgaccccgggccatgcctgtcccatcaagtataccccagaggagattgccatggcaactgtcactgccctgcgtcgcactgtgcccccagctgtcccaggagtgaccttcctgtctgggggtcagagcgaagaagaggcatcattcaacctcaatgccatcaaccgctgcccccttccccgaccctgggcgcttaccttctcctatgggcgtgccctgcaagcctctgcactcaatgcctggcgagggcaacgggacaatgctggggctgccactgaggagttcatcaagcgggctgaggtgaatgggcttgcagcccagggcaagtatgaaggcagtggagaagatggtggagcagcagcacagtcactctacattgccaaccatgcctactgagtatccactccataccacagcccttggcccagccatctgcacccacttttgcttgtagtcatggccagggccaaatagctatgcagagcagagatgccttcacctggcaccaacttgtcttcctttctctcttcccttcccctctctcattgctgcacctgggaccataggatgggaggatagggagcccctcatgactgagggcagaagaaattgctagaagtcagaacaggatggctgggtctccccctacctcttccagctcccacaattttcccatgatgaggtagcttctccctgggctctccttcttgcctgccctgtctcctgggatcagagggtagtacagaagccctgactcatgccttgagtacataccatacagcaaataaatggtagcaaaacattctactttgcctgtctgttttacacatcaa

SEQ ID NO: 448501 - DNA, 1119 bp, Homo sapiens
ggacgcgtgggtcgacccacgcgtcgccacgcgtcgcggctctgcgacatccgcagcctcatttaccagagggagccagggctgcagcctcatctgtttgcggatcagaacccgagctgtgcttgtggctgcggctgctaactggctgcgcacagggagctgtcaccatgcctcactcgtacccagccctttctgctgagcagaagaaggagttgtctgacattgccctgcggattgtagccccgggcaaaggcattctggctgcggatgagtctgtaggcagcatggccaagcggctgagccaaattggggtggaaaacacagaggagaaccgccggctgtaccgccaggtcctgttcagtgctgatgaccgtgtgaaaaagtgcattggaggcgtcattttcttccatgagaccctctaccagaaagatgataatggtgttcccttcgtccgaaccatccaggataagggcatcgtcgtgggcatcaaggttgacaagggtgtggtgcctctagctgggactgatggagaaaccaccactcaagggctggatgggctctcagaacgctgtgcccaatacaagaaggatggtgctgactttgccaagtggcgctgtgtgctgaaaatcagtgagcgtacaccctctgcacttgccattctggagaacgccaacgtgctggcccgttatgccagtatctgccagcagaatggcattgtgcctattgtggaacctgaaatattgcctgatggagaccacgacctcaaacgttgtcagtatgttacagagaaggtcttggctgctgtgtacaaggccctgagtgaccatcatgtatacgcacctgggaccataggatgggaggatagggagcccctcatgactgagggcagaagaaattgctagaagtcagaacaggatggctgggtctccccctacctcttccagctcccacaattttcccatgatgaggtagcttctccctgggctctccttcttgcctgccctgtctcctgggatcagagggtagtacagaagccctgactcatgccttgagtacataccatacagcaaataaatggtagcaaaacattctactttgcctgtctgttttacacatcaa

SEQ ID NO: 448502 - DNA, 661 bp, Homo sapiens
  misc_feature (134)..(134): n is a, c, g, or t
atcaaaaggttcaaatcttgttgttaatttaaagcacaatggtgaaattggtcaggcaattaagggtatggatataagaaaagccaggaagtatttgaaagatgtcattttacagaaacagtgtgtaccattcngacgttacaatggtggagttggcaggtgtgcgcaggccaagcaatggggctggacacaaggttggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggtggcccagaagaaaaagatatcccagaagaaactgaagaaacaaaaacttatggcacgggagtaaattcagcattaaaataaatgtaattaaaaggaaaaaaaaaatcctgggatcagagggtagtacagaagccctgactcatgccttgagtacataccatacagcaaataaatggtagcaaaacattctactttgcctgtctgttttacacatcaa

SEQ ID NO: 448503 - DNA, 1699 bp, Homo sapiens
ggacgcgtgggtcgacccacgcgtcgccacgcgtcgcggctctgcgacatccgcagcctcatttaccagagggagccagggctgcagcctcatctgtttgcggatcagaacccgagctgtgcttgtggctgcggctgctaactggctgcgcacagggagctgtcaccatgcctcactcgtacccagccctttctgctgagcagaagaaggagttgtctgacattgccctgcggattgtagccccgggcaaaggcattctggctgcggatgagtctgtaggcagcatggccaagcggctgagccaaattggggtggaaaacacagaggagaaccgccggctgtaccgccaggtcctgttcagtgctgatgaccgtgtgaaaaagtgcattggaggcgtcattttcttccatgagaccctctaccagaaagatgataatggtgttcccttcgtccgaaccatccaggataagggcatcgtcgtgggcatcaaggttgacaagggtgtggtgcctctagctgggactgatggagaaaccaccactcaagggctggatgggctctcagaacgctgtgcccaatacaagaaggatggtgctgactttgccaagtggcgctgtgtgctgaaaatcagtgagcgtacaccctctgcacttgccattctggagaacgccaacgtgctggcccgttatgccagtatctgccagcagaatggcattgtgcctattgtggaacctgaaatattgcctgatggagaccacgacctcaaacgttgtcagtatgttacagagaaggtcttggctgctgtgtacaaggccctgagtgaccatcatgtatacctggaggggaccctgctcaagcccaacatggtgaccccgggccatgcctgtcccatcaagtataccccagaggagattgccatggcaactgtcactgccctgcgtcgcactgtgcccccagctgtcccaggagtgaccttcctgtctgggggtcagagcgaagaagaggcatcattcaacctcaatgccatcaaccgctgcccccttccccgaccctgggcgcttaccttctcctatgggcgtgccctgcaagcctctgcactcaatgcctggcgagggcaacgggacaatgctggggctgccactgaggagttcatcaagcgggctgaggtgaatgggcttgcagcccagggcaagtatgaaggcagtggagaagatggtggagcagcagcacagtcactctacattgccaaccatgcctactgagtatccactccataccacagcccttggcccagccatctgcacccacttttgcttgtagtcatggccagggccaaatagctatgcagagcagagatgccttcacctggcaccaacttgtcttcctttctctcttcccttcccctctctcattgctgcacctgggaccataggatgggaggatagggagcccctcatgactgagggcagaagaaattgctagaagtcagaacaggatggctgggtctccccctacctcttccagctcccacaattttcccatgatgaggtagcttctccctgggctctccttcttgcctgccctgtctcctgggatcagagggtagtacagaagccctgactcatgccttgagtacataccatacagcaaataaatggtagcaaaacattctactttgcctgtctgttttacacatcaa

SEQ ID NO: 448504 - DNA, 1687 bp, Homo sapiens
ggacgcgtgggtcgacccacgcgtcgccacgcgtcgcggacgcgtggtcgacccacgcgtcggccagggctgcagcctcatctgtttgcggatcagaacccgagctgtgcttgtggctgcggctgctaactggctgcgcacagggagctgtcaccatgcctcactcgtacccagccctttctgctgagcagaagaaggagttgtctgacattgccctgcggattgtagccccgggcaaaggcattctggctgcggatgagtctgtaggcagcatggccaagcggctgagccaaattggggtggaaaacacagaggagaaccgccggctgtaccgccaggtcctgttcagtgctgatgaccgtgtgaaaaagtgcattggaggcgtcattttcttccatgagaccctctaccagaaagatgataatggtgttcccttcgtccgaaccatccaggataagggcatcgtcgtgggcatcaaggttgacaagggtgtggtgcctctagctgggactgatggagaaaccaccactcaagggctggatgggctctcagaacgctgtgcccaatacaagaaggatggtgctgactttgccaagtggcgctgtgtgctgaaaatcagtgagcgtacaccctctgcacttgccattctggagaacgccaacgtgctggcccgttatgccagtatctgccagcagaatggcattgtgcctattgtggaacctgaaatattgcctgatggagaccacgacctcaaacgttgtcagtatgttacagagaaggtcttggctgctgtgtacaaggccctgagtgaccatcatgtatacctggaggggaccctgctcaagcccaacatggtgaccccgggccatgcctgtcccatcaagtataccccagaggagattgccatggcaactgtcactgccctgcgtcgcactgtgcccccagctgtcccaggagtgaccttcctgtctgggggtcagagcgaagaagaggcatcattcaacctcaatgccatcaaccgctgcccccttccccgaccctgggcgcttaccttctcctatgggcgtgccctgcaagcctctgcactcaatgcctggcgagggcaacgggacaatgctggggctgccactgaggagttcatcaagcgggctgaggtgaatgggcttgcagcccagggcaagtatgaaggcagtggagaagatggtggagcagcagcacagtcactctacattgccaaccatgcctactgagtatccactccataccacagcccttggcccagccatctgcacccacttttgcttgtagtcatggccagggccaaatagctatgcagagcagagatgccttcacctggcaccaacttgtcttcctttctctcttcccttcccctctctcattgctgcacctgggaccataggatgggaggatagggagcccctcatgactgagggcagaagaaattgctagaagtcagaacaggatggctgggtctccccctacctcttccagctcccacaattttcccatgatgaggtagcttctccctgggctctccttcttgcctgccctgtctcctgggatcagagggtagtacagaagccctgactcatgccttgagtacataccatacagcaaataaatggtagcaaaacattctactttgcctgtctgttttacacatcaa

SEQ ID NO: 448505 - DNA, 1755 bp, Homo sapiens
ggacgcgtgggtcgacccacgcgtcgccacgcgtcgcggctctgcgacatccgcagcctcatttaccagagggagccagggctgcagcctcatctgtttgcggatcagaacccgagctgtgcttgtggctgcggctgctaactggctgcgcacagaagctgagagaagagggtggcaataagtacttttgcctcattctgaagccttggaaggagctgtcaccatgcctcactcgtacccagccctttctgctgagcagaagaaggagttgtctgacattgccctgcggattgtagccccgggcaaaggcattctggctgcggatgagtctgtaggcagcatggccaagcggctgagccaaattggggtggaaaacacagaggagaaccgccggctgtaccgccaggtcctgttcagtgctgatgaccgtgtgaaaaagtgcattggaggcgtcattttcttccatgagaccctctaccagaaagatgataatggtgttcccttcgtccgaaccatccaggataagggcatcgtcgtgggcatcaaggttgacaagggtgtggtgcctctagctgggactgatggagaaaccaccactcaagggctggatgggctctcagaacgctgtgcccaatacaagaaggatggtgctgactttgccaagtggcgctgtgtgctgaaaatcagtgagcgtacaccctctgcacttgccattctggagaacgccaacgtgctggcccgttatgccagtatctgccagcagaatggcattgtgcctattgtggaacctgaaatattgcctgatggagaccacgacctcaaacgttgtcagtatgttacagagaaggtcttggctgctgtgtacaaggccctgagtgaccatcatgtatacctggaggggaccctgctcaagcccaacatggtgaccccgggccatgcctgtcccatcaagtataccccagaggagattgccatggcaactgtcactgccctgcgtcgcactgtgcccccagctgtcccaggagtgaccttcctgtctgggggtcagagcgaagaagaggcatcattcaacctcaatgccatcaaccgctgcccccttccccgaccctgggcgcttaccttctcctatgggcgtgccctgcaagcctctgcactcaatgcctggcgagggcaacgggacaatgctggggctgccactgaggagttcatcaagcgggctgaggtgaatgggcttgcagcccagggcaagtatgaaggcagtggagaagatggtggagcagcagcacagtcactctacattgccaaccatgcctactgagtatccactccataccacagcccttggcccagccatctgcacccacttttgcttgtagtcatggccagggccaaatagctatgcagagcagagatgccttcacctggcaccaacttgtcttcctttctctcttcccttcccctctctcattgctgcacctgggaccataggatgggaggatagggagcccctcatgactgagggcagaagaaattgctagaagtcagaacaggatggctgggtctccccctacctcttccagctcccacaattttcccatgatgaggtagcttctccctgggctctccttcttgcctgccctgtctcctgggatcagagggtagtacagaagccctgactcatgccttgagtacataccatacagcaaataaatggtagcaaaacattctactttgcctgtctgttttacacatcaa

SEQ ID NO: 448506 - DNA, 1047 bp, Homo sapiens
  misc_feature (13)..(13): n is a, c, g, or t
ttgaggaggaaanaccatggaaatgatggtccgttatgtcagtatctggcagtagaatggcattgtgcctattgtggaacctgaaatattgcctgatggagaccacgacctcaaacgttgtcagtatgttacagagaaggtcttggctgctgtgtacaaggccctgagtgaccatcatgtatacctggaggggaccctgctcaagcccaacatggtgaccccgggccatgcctgtcccatcaagtataccccagaggagattgccatggcaactgtcactgccctgcgtcgcactgtgcccccagctgtcccaggagtgaccttcctgtctgggggtcagagcgaagaagaggcatcattcaacctcaatgccatcaaccgctgcccccttccccgaccctgggcgcttaccttctcctatgggcgtgccctgcaagcctctgcactcaatgcctggcgagggcaacgggacaatgctggggctgccactgaggagttcatcaagcgggctgaggtgaatgggcttgcagcccagggcaagtatgaaggcagtggagaagatggtggagcagcagcacagtcactctacattgccaaccatgcctactgagtatccactccataccacagcccttggcccagccatctgcacccacttttgcttgtagtcatggccagggccaaatagctatgcagagcagagatgccttcacctggcaccaacttgtcttcctttctctcttcccttcccctctctcattgctgcacctgggaccataggatgggaggatagggagcccctcatgactgagggcagaagaaattgctagaagtcagaacaggatggctgggtctccccctacctcttccagctcccacaattttcccatgatgaggtagcttctccctgggctctccttcttgcctgccctgtctcctgggatcagagggtagtacagaagccctgactcatgccttgagtacataccatacagcaaataaatggtagcaaaacattctactttgcctgtctgttttacacatcaa

SEQ ID NO: 448507 - DNA, 465 bp, Homo sapiens
ggacgcgtgggtcgacccacgcgtcgccacgcgtcgcggacgcgtggtcgacccacgcgtcggccagggctgcagcctcatctgtttgcggatcagaacccgagctgtgcttgtggctgcggctgctaactggctgcgcacagtgtcttcctttctctcttcccttcccctctctcattgctgcacctgggaccataggatgggaggatagggagcccctcatgactgagggcagaagaaattgctagaagtcagaacaggatggctgggtctccccctacctcttccagctcccacaattttcccatgatgaggtagcttctccctgggctctccttcttgcctgccctgtctcctgggatcagagggtagtacagaagccctgactcatgccttgagtacataccatacagcaaataaatggtagcaaaacattctactttgcctgtctgttttacacatcaa

SEQ ID NO: 448508 - DNA, 2665 bp, Homo sapiens
ctataaattaaggatcccagctacttaattgacttatgcttcctagttcgttgcccagccaccaccgtctctccaaaaacccgaggtctcgctaaaatcatcatggattcacttggcgccgtcagcactcgacttgggtttgatcttttcaaagagctgaagaaaacaaatgatggcaacatcttcttttcccctgtgggcatcttgactgcaattggcatggtcctcctggggacccgaggagccaccgcttcccagttggaggaggtgtttcactctgaaaaagagacgaagagctcaagaataaaggctgaagaaaaagaggtgattgagaacacagaagcagtacatcaacaattccaaaagtttttgactgaaataagcaaactcactaatgattatgaactgaacataaccaacaggctgtttggagaaaaaacatacctcttccttcaaaaatacttagattatgttgaaaaatattatcatgcatctctggaacctgttgattttgtaaatgcagccgatgaaagtcgaaagaagattaattcctgggttgaaagcaaaacaaatgaaaaaatcaaggacttgttcccagatggctctattagtagctctaccaagctggtgctggtgaacatggtttattttaaagggcaatgggacagggagtttaagaaagaaaatactaaggaagagaaattttggatgaataagagcacaagtaaatctgtacagatgatgacacagagccattcctttagcttcactttcctggaggacttgcaggccaaaattctagggattccatataaaaacaacgacctaagcatgtttgtgcttctgcccaacgacatcgatggcctggagaagataatagataaaataagtcctgagaaattggtagagtggactagtccagggcatatggaagaaagaaaggtgaatctgcacttgccccggtttgaggtggaggacggttacgatctagaggcggtcctggctgccatggggatgggcgatgccttcagtgagcacaaagccgactactcgggaatgtcgtcaggctccgggttgtacgcccagaagttcctgcacagttcctttgtggcagtaactgaggaaggcaccgaggctgcagctgccaccggcataggctttactgtcacatccgccccaggtcatgaaaatgttcactgcaatcatcccttcctgttcttcatcaggcacaatgaatccaacagcatcctcttcttcggcagattttcttctccttaagatgatcgttgccatggcattgctgcttttagcaaaaaacaactaccagtgttactcatatgattatgaaaatcgtccattcttttaaatgttgtctcacttgcatttccagtcttggccatcaaatcaatgatttaatgactccaataatgtgtgtgtttataaccatcctcgaaagtgaaatgtccttttttttgtgccatgcgtaaggtgagtcaaaccaaacctcattgataatctcccctttggtttcctttgaaagtaaattggtatcttgtagttttgtgcacacgaaaggagagaaagtttctccagtaaagagtacgaactagtaattttggggggtctctctaattctggtattttgacatgttataatacgcaagtaaaataaaacaatagtttactcagctcatgttactattccccaacagatattgtggcaaatcacacataggaaagaggatttgggaatacagtagcaaaacataaattaaaactcaaatgcccaggacaaaataaaacaatataccagatggagaggatgcccgtattttcatcttccattctaacattatccattgttagatgcataagcattttgatattgtgtaataaatgtggtatttgagaagataaatgatgtagttgatcagtaatcctcctctatcacctttttagactttgtaaggtaaatatttggactaacttttagaaaagtttccctttttttctccatttacatttttctggtttttttttttttttttgagtgaggtacgagtattaccaaatgatattttctgaagatgctttttggaaagctctgaatctatacctaatgctcttaattattggcttgtttcatttttttcctccagtttttaacaagatcacataactggcttatttttaacagctttgtcaaactacaatttacatgccgtaaaatgtacacactgtaattttataattcattgacttttagtaaattttctagcgttatgcatcgccacaatccagttttagaatatttccatgaccctaagaagtttcctcatgtctattaatattcccaatcctaggcaccactgagttgttttctgtctttataagtttttctttctacatcttatataaatggaatcataatacatgtagtattttgtgtctggcgtcttgcacttagcatggtgttcttgaggttcatctgttgtagtatgtattgatacttaggatttttttattgccgaatactattccattgcatggaaaagacctattttatttctaggttcaccagttgagggacatttggattgttcccacttcttgggctgttaggaataatgttgctctgaacatgtaaataaagatctttgtgttc

SEQ ID NO: 448509 - DNA, 630 bp, Homo sapiens
ctataaattaaggatcccagctacttaattgacttatgcttcctagttcgttgcccagccaccaccgtctctccaaaaacccgaggtctcgctaaaatcatcatggattcacttggcgccgtcagcactcgacttgggtttgatcttttcaaagagctgaagaaaacaaatgatggcaacatcttcttttcccctgtgggcatcttgactgcaattggcatggtcctcctggggacccgaggagccaccgcttcccagttggaggaggtgtttcactctgaaaaagagacgaagagctcaagaataaaggctgaagaaaaagaggtggtaagaataaaggctgaaggaaaagaggtggggagatgtgttttacaaacttcagtagagttgcattttaggtgtggggtctctggggaaaaggactgagaaaggcatgaaagcaatattgttgctttactattaagcaataataatcaccatagacaaatattgttgtaaggattatacaataataataaccccttaatattgagaagagaccttaggtgtaatggacaataccgctatgatagaactggtaaaggctaatagacagaaaagttcccatagcagagtggatgggttttggag

SEQ ID NO: 448510 - DNA, 1176 bp, Homo sapiens
ctataaattaaggatcccagctacttaattgacttatgcttcctagttcgttgcccagccaccaccgtctctccaaaaacccgaggtctcgctaaaatcatcatggattcacttggcgccgtcagcactcgacttgggtttgatcttttcaaagagctgaagaaaacaaatgatggcaacatcttcttttcccctgtgggcatcttgactgcaattggcatggtcctcctggggacccgaggagccaccgcttcccagttggaggaggtgtttcactctgaaaaagagacgaagagctcaagaataaaggctgaagaaaaagaggtgattgagaacacagaagcagtacatcaacaattccaaaagtttttgactgaaataagcaaactcactaatgattatgaactgaacataaccaacaggctgtttggagaaaaaacatacctcttccttcaaaaatacttagattatgttgaaaaatattatcatgcatctctggaacctgttgattttgtaaatgcagccgatgaaagtcgaaagaagattaattcctgggttgaaagcaaaacaaatgaaaaaatcaaggacttgttcccagatggctctattagtagctctaccaagctggtgctggtgaacatggtttattttaaagggcaatgggacagggagtttaagaaagaaaatactaaggaagagaaattttggatgaataagagcacaagtaaatctgtacagatgatgacacagagccattcctttagcttcactttcctggaggacttgcaggccaaaattctagggattccatataaaaacaacgacctaagcatgtttgtgcttctgcccaacgacatcgatggcctggagaaggtaaacgcttacacctccttattctttctttcatttcctaaggctttttgtctcagggcttctgagtaggagctggtggccagcagtgtcaaatagaaagtgtttctcactctccagcagctacagatggatgtctactggggagcattaaatagtatgggtcaggtttattgagaacaactaatcctagaatgtttgggatgaactaaaatgaacatttaagattatatgggagtcctaacgatcacccaccattctgagaaatggttggtatctatggacccctttcctggaaaaaagaaa

SEQ ID NO: 448511 - DNA, 628 bp, Homo sapiens
atatctttagttttcccacgtgtggagataaaaaagtgggagataattctataacagctttaacacacacacacacacacacacacacacacacacacacgaaaaatcagaggtaaacgcagacctttttctgattttgcaaggagataatgtcacctcatataccaccgaggtttctttcagaagcgtccactctcccctgactgattctgtgtgaggttttctcttctctgagcaccacagtaatattttctatctcttccaggtgtttcactctgaaaaagagacgaagagctcaagaataaaggctgaagaaaaagaggtggtaagaataaaggctgaaggaaaagaggtggggagatgtgttttacaaacttcagtagagttgcattttaggtgtggggtctctggggaaaaggactgagaaaggcatgaaagcaatattgttgctttactattaagcaataataatcaccatagacaaatattgttgtaaggattatacaataataataaccccttaatattgagaagagaccttaggtgtaatggacaataccgctatgatagaactggtaaaggctaatagacagaaaagttcccatagcagagtggatgggttttggag

SEQ ID NO: 448512 - DNA, 3122 bp, Homo sapiens
ctataaattaaggatcccagctacttaattgacttatgcttcctagttcgttgcccagccaccaccgtctctccaaaaacccgaggtctcgctaaaatcatcatggattcacttggcgccgtcagcactcgacttgggtttgatcttttcaaagagctgaagaaaacaaatgatggcaacatcttcttttcccctgtgggcatcttgactgcaattggcatggtcctcctggggacccgaggagccaccgcttcccagttggaggaggtgtttcactctgaaaaagagacgaagagctcaagaataaaggctgaagaaaaagaggtgattgagaacacagaagcagtacatcaacaattccaaaagtttttgactgaaataagcaaactcactaatgattatgaactgaacataaccaacaggctgtttggagaaaaaacatacctcttccttcaaaaatacttagattatgttgaaaaatattatcatgcatctctggaacctgttgattttgtaaatgcagccgatgaaagtcgaaagaagattaattcctgggttgaaagcaaaacaaatgaaaaaatcaaggacttgttcccagatggctctattagtagctctaccaagctggtgctggtgaacatggtttattttaaagggcaatgggacagggagtttaagaaagaaaatactaaggaagagaaattttggatgaataagagcacaagtaaatctgtacagatgatgacacagagccattcctttagcttcactttcctggaggacttgcaggccaaaattctagggattccatataaaaacaacgacctaagcatgtttgtgcttctgcccaacgacatcgatggcctggagaagataatagataaaataagtcctgagaaattggtagagtggactagtccagggcatatggaagaaagaaaggtgaatctgcacttgccccggtttgaggtggaggacggttacgatctagaggcggtcctggctgccatggggatgggcgatgccttcagtgagcacaaagccgactactcgggaatgtcgtcaggctccgggttgtacgcccagaagttcctgcacagttcctttgtggcagtaactgaggaaggcaccgaggctgcagctgccaccggcataggctttactgtcacatccgccccaggtcatgaaaatgttcactgcaatcatcccttcctgttcttcatcaggcacaatgaatccaacagcatcctcttcttcggcagattttcttctccttaagatgatcgttgccatggcattgctgcttttagcaaaaaacaactaccagtgttactcatatgattatgaaaatcgtccattcttttaaatgttgtctcacttgcatttccagtcttggccatcaaatcaatgatttaatgactccaataatgtgtgtgtttataaccatcctcgaaagtgaaatgtccttttttttgtgccatgcgtaaggtgagtcaaaccaaacctcattgataatctcccctttggtttcctttgaaagtaaattggtatcttgtagttttgtgcacacgaaaggagagaaagtttctccagtaaagagtacgaactagtaattttggggggtctctctaattctggtattttgacatgttataatacgcaagtaaaataaaacaatagtttactcagctcatgttactattccccaacagatattgtggcaaatcacacataggaaagaggatttgggaatacagtagcaaaacataaattaaaactcaaatgcccaggacaaaataaaacaatataccagatggagaggatgcccgtattttcatcttccattctaacattatccattgttagatgcataagcattttgatattgtgtaataaatgtggtatttgagaagataaatgatgtagttgatcagtaatcctcctctatcacctttttagactttgtaaggtaaatatttggactaacttttagaaaagtttccctttttttctccatttacatttttctggtttttttttttttttttgagtgaggtacgagtattaccaaatgatattttctgaagatgctttttggaaagctctgaatctatacctaatgctcttaattattggcttgtttcatttttttcctccagtttttaacaagatcacataactggcttatttttaacagctttgtcaaactacaatttacatgccgtaaaatgtacacactgtaattttataattcattgacttttagtaaattttctagcgttatgcatcgccacaatccagttttagaatatttccatgaccctaagaagtttcctcatgtctattaatattcccaatcctaggcaccactgagttgttttctgtctttataagtttttctttctacatcttatataaatggaatcataatacatgtagtattttgtgtctggcgtcttgcacttagcatggtgttcttgaggttcatctgttgtagtatgtattgatacttaggatttttttattgccgaatactattccattgcatggaaaagacctattttatttctaggttcaccagttgagggacatttggattgttcccacttcttgggctgttaggaataatgttgctctgaacatgtaaataaagatctttgtgttcacatatgttttcatttctgttggggagattcctaggctagaaattgctgggccatatgaaaaatcaatagttagctttgtaagaaacagtcaaactgttttccaacgtgacattttatattcccaccaggaatgtttaaaactagtgtcttcaaatcctcaccaacatccaggattgtgtctttatgattatagccatttttgtaggtacaaagtggcatctcatggtggttttaatttgcatttccataatatctaattaggttgagctttttttatgtgcttattggccatttgtttgactttgtttggtgaaatgtatacaaatcatttgctcatttttaatttgggttgtctgtcttgtcttctcattttattgagttaaatgagttcttaataatctctggcttacaagtccttaatttatcaaatatatgatacgtggacatttcctcata

SEQ ID NO: 448513 - DNA, 2878 bp, Homo sapiens
ctataaattaaggatcccagctacttaattgacttatgcttcctagttcgttgcccagccaccaccgtctctccaaaaacccgaggtctcgctaaaatcatcatggattcacttggcgccgtcagcactcgacttgggtttgatcttttcaaagagctgaagaaaacaaatgatggcaacatcttcttttcccctgtgggcatcttgactgcaattggcatggtcctcctggggacccgaggagccaccgcttcccagttggaggaggtgtttcactctgaaaaagagacgaagagctcaagaataaaggctgaagaaaaagaggtgattgagaacacagaagcagtacatcaacaattccaaaagtttttgactgaaataagcaaactcactaatgattatgaactgaacataaccaacaggctgtttggagaaaaaacatacctcttccttcaaaaatacttagattatgttgaaaaatattatcatgcatctctggaacctgttgattttgtaaatgcagccgatgaaagtcgaaagaagattaattcctgggttgaaagcaaaacaaatgatgtggaaactgaggcacagagagtttaaataacttgcccaagattcctcagctgataagaggcaaactggatgctaacagaggcatctgaccccagagtctggactcttaaccatgaaccttaatttatccactgggataaataggcgatgggcaaaatgagaacctccccgtcgattctgccagcaaaccctttgtcagcaaggccctcagaaaaaatcaaggacttgttcccagatggctctattagtagctctaccaagctggtgctggtgaacatggtttattttaaagggcaatgggacagggagtttaagaaagaaaatactaaggaagagaaattttggatgaataagagcacaagtaaatctgtacagatgatgacacagagccattcctttagcttcactttcctggaggacttgcaggccaaaattctagggattccatataaaaacaacgacctaagcatgtttgtgcttctgcccaacgacatcgatggcctggagaagataatagataaaataagtcctgagaaattggtagagtggactagtccagggcatatggaagaaagaaaggtgaatctgcacttgccccggtttgaggtggaggacggttacgatctagaggcggtcctggctgccatggggatgggcgatgccttcagtgagcacaaagccgactactcgggaatgtcgtcaggctccgggttgtacgcccagaagttcctgcacagttcctttgtggcagtaactgaggaaggcaccgaggctgcagctgccaccggcataggctttactgtcacatccgccccaggtcatgaaaatgttcactgcaatcatcccttcctgttcttcatcaggcacaatgaatccaacagcatcctcttcttcggcagattttcttctccttaagatgatcgttgccatggcattgctgcttttagcaaaaaacaactaccagtgttactcatatgattatgaaaatcgtccattcttttaaatgttgtctcacttgcatttccagtcttggccatcaaatcaatgatttaatgactccaataatgtgtgtgtttataaccatcctcgaaagtgaaatgtccttttttttgtgccatgcgtaaggtgagtcaaaccaaacctcattgataatctcccctttggtttcctttgaaagtaaattggtatcttgtagttttgtgcacacgaaaggagagaaagtttctccagtaaagagtacgaactagtaattttggggggtctctctaattctggtattttgacatgttataatacgcaagtaaaataaaacaatagtttactcagctcatgttactattccccaacagatattgtggcaaatcacacataggaaagaggatttgggaatacagtagcaaaacataaattaaaactcaaatgcccaggacaaaataaaacaatataccagatggagaggatgcccgtattttcatcttccattctaacattatccattgttagatgcataagcattttgatattgtgtaataaatgtggtatttgagaagataaatgatgtagttgatcagtaatcctcctctatcacctttttagactttgtaaggtaaatatttggactaacttttagaaaagtttccctttttttctccatttacatttttctggtttttttttttttttttgagtgaggtacgagtattaccaaatgatattttctgaagatgctttttggaaagctctgaatctatacctaatgctcttaattattggcttgtttcatttttttcctccagtttttaacaagatcacataactggcttatttttaacagctttgtcaaactacaatttacatgccgtaaaatgtacacactgtaattttataattcattgacttttagtaaattttctagcgttatgcatcgccacaatccagttttagaatatttccatgaccctaagaagtttcctcatgtctattaatattcccaatcctaggcaccactgagttgttttctgtctttataagtttttctttctacatcttatataaatggaatcataatacatgtagtattttgtgtctggcgtcttgcacttagcatggtgttcttgaggttcatctgttgtagtatgtattgatacttaggatttttttattgccgaatactattccattgcatggaaaagacctattttatttctaggttcaccagttgagggacatttggattgttcccacttcttgggctgttaggaataatgttgctctgaacatgtaaataaagatctttgtgttc

SEQ ID NO: 448514 - DNA, 530 bp, Homo sapiens
ttatgtcctttgatattgtgtgctctgttaatttgttgcagagcacaagtaaatctgtacagatgatgacacagagccattcctttagcttcactttcctggaggacttgcaggccaaaattctagggattccatataaaaacaacgacctaagcatgtttgtgcttctgcccaacgacatcgatggcctggagaaggtaaacgcttacacctccttattctttctttcatttcctaaggctttttgtctcagggcttctgagtaggagctggtggccagcagtgtcaaatagaaagtgtttctcactctccagcagctacagatggatgtctactggggagcattaaatagtatgggtcaggtttattgagaacaactaatcctagaatgtttgggatgaactaaaatgaacatttaagattatatgggagtcctaacgatcacccaccattctgagaaatggttggtatctatggacccctttcctggaaaaaagaaatcacatatgcatatatacaaccagttctgc

SEQ ID NO: 448515 - DNA, 867 bp, Homo sapiens
gtgcggtggcactcacggaatctcgggtcttctgacgtgccgggcgggaagatgtcatcattgccaagaagagcgaaagtacaggtccaggatgtggtactgaaagatgaattttcttcattctctgagttatcatctgcctctgaagaagatgacaaggaagatagtgcctgggagccccaaaagaaagttcccagaagccgtaaacagccccctcccaaggaatccaaaccaaagaggatgcctcgggtgaagaagaatgccccacagatcagtgatggctcagaagtcgttgttgttaaggaggagctgaatagctctgtggctattgctgatactgctttagaagacagaaaaaataaattggatactgtacagactctgaaaacagccaagacaaaacagaaatgtgcagcgcagccacatacagttcgaaggactaaaaagctgaaagttgaagaagaaaccagcaaagccagcaacttagagggtgagagtaatagttcagagacaccatccacaagcactgtgtggggaggtacatgcaagaaggaagagaatgacgatgactttacatttggtcagtccgctttaaagaaaatcaagactgagacatatcctcaggggcagcctgtcaagtttccagcaaatgccaatagtactaaagaggaggtggaaatgaattgggacatggtacaggttttatctgagagaactaatattgaaccttgggtttgtgccaacatcattcgtctctttaatgatgataacacaattcccttcattatacgttatagaaaagagctcattaataaccttgatgctgattccttgagagaagttcagcaaaccctagaagagctacgg

SEQ ID NO: 448516 - DNA, 1370 bp, Homo sapiens
gtacccctttttattttgcttaggtagatcaaattctaagttgatcttttctagcagcagggtcagagtctagtgatcgtttttaaaatggcttagatgctacctttcttttctgagaactcagtgtgatataatccttataagatattgacagctaattttatggattatcctaccgggacagtggaacctaagtagtttgaagacgagaaattgttttgattcagaagcaatgggttcactagtgaaaggaaagatcccacgatcgtaagtggtaaatgtttatatttgttgaataactctctgaaaaaaggaaataaagtagattagccttggtaagaggtggcttaagagtggttttatgatctaagttttatttgaaaaatgtgtgaaacttgtttaaggtaaatgtgagaattaataaaggaattgagaagaaagatatttgatcgttttttgaataacatttacctaattaagaagttaactacttttctgaggcatcttttttatccctctccgttttcctcctcccaaaagaagttgttcttgattttaaaagtttgataaattaacaaggttgaaatttgaatatgatatacattgaattaagatttgttcagggctttcttaattcagttctcaagtatgaatttctcaggtctgaattttttaggtagaaaattctcaagtatgaatttcttttctagcaattgcagagcctgtttttgctgtggtcaaagctgactgatagactgtggtttaagtcaacttattcaaaaatgtcttcaaccctgctggtcgagacaagaaatctttatggggtagttggagctgaaagcaggttaggcacctattaaaacatcacagaacaggttagattgtggtttgaagaactggatattccccaatgttttaactgagtttatgtgcctaagtcttcaaaatggggtttatagtatcaagtgaggctgtttggttcttctgaaaacacactcattttctgacacatggctagactttatgccaggtacatgctatttttgaaaagctcttttttaagaggtaactgtttattaaaacaatctgtttcaccaaatatgttagccctgtaaaattgacatttacaaaagtttgaagaaaacaaatttgggaaagttaataattcgcctttctatcttcaaggattcaaattgaccgttttttctcctttttttgtcttttaacttactgtaattatgccccaatagttcgggtgcagtggtcacgcctataatcccagcactttgagaggctgaggtgggaggattgtttgagtccaggagtttgagaccagcctgggcctcatagcaagacccctgtcttaaaaa

SEQ ID NO: 448517 - DNA, 3794 bp, Homo sapiens
gttcgctggctgttccgagaatcagtccgggtcacgttggtgcctctcctttcctgttctgattggttgcttacgtgagcgtgactactttcttgcctcatgattggctgaaatcagtagcgtcatcggcggccgggagggcggagggacgagggaagtcggcgagagggagactgggttgggggaggggttcaggcctgttccccgcggctgcggcagcaccagggccggccgccaccgcctctagaacgcggaggaggtgggtcctgggaagcgggatgtccatcgctccagcttggtggtgaatgctgaggagagtcactgttgctgcagtctgtgccacccggaggaagttgtgtgaggccgggcgggagctcgcggcgctctggggaatcgaaacgcggggtcggtgcgaagactctgctgctgccagaccctttcctattctggccatgcctggaaggaacaaggcgaagtctacctgcagctgccctgacctgcagcccaatggacaggatctgggcgagaacagccgggttgcccgtctaggagcggatgaatctgaggaagagggacggagggggtctctcagtaatgctggggaccctgagatcgtcaagtctcccagcgaccccaagcaataccgatacatcaaattacagaatggcttgcaggcacttctgatttcagacctaagtaatatggaaggtaaaacaggaaatacaacagatgatgaagaagaagaggaggtggaggaagaagaagaagatgatgatgaagattctggagctgaaatagaagatgacgatgaagagggttttgatgatgaagatgagtttgatgatgaacatgatgatgatcttgatactgaggataatgaattggaagaattagaagagagagcagaagctagaaaaaaaactactgaaaaacagtctgcagcggctctttgtgttggagttgggagtttcgctgatccagatgacctgccggggctggcacactttttggagcacatggtattcatgggtagtttgaaatatccagatgagaatggatttgatgccttcctgaagaagcatgggggtagtgataatgcctcaactgattgtgaacgcactgtctttcagtttgatgtccagaggaagtacttcaaggaagctcttgatagatgggcgcagttcttcatccacccactaatgatcagagatgcaattgaccgtgaagttgaagctgttgatagtgaatatcaacttgcaaggccttctgatgcaaacagaaaggaaatgttgtttggaagccttgctagacctggccatcctatgggaaaatttttttggggaaatgctgagacgctcaagcatgagccaagaaagaataatattgatacacatgctagattgagagaattctggatgcgttactactcttctcattacatgactttagtggttcaatccaaagaaacactggatactttggaaaagtgggtgactgaaatcttctctcagataccaaacaatgggttacccagaccaaactttggccatttaacggatccatttgacacaccagcatttaacaaactttatagagttgttccaatcagaaaaattcatgctctgaccatcacatgggcacttcctcctcaacagcaacattacagggtgaagccacttcattatatatcctggctggttggacatgaaggcaaaggcagcattctttctttccttaggaaaaaatgctgggctcttgcactgtttggtggaaatggtgagacaggatttgagcaaaattctacttattcagtgttcagcatttctattacattgactgatgagggttatgaacatttttatgaggttgcttacactgtctttcagtatttaaaaatgctgcagaagctaggcccagaaaaaagaatttttgaagagattcggaaaattgaggataatgaatttcattaccaagaacagacagatccagttgagtatgtggaaaacatgtgtgagaacatgcagctgtacccattgcaggacattctcactggagatcagcttctttttgaatacaagccagaagtcattggtgaagccttgaatcagctagttcctcaaaaagcaaatcttgttttactgtctggtgctaatgagggaaaatgtgacctcaaggagaaatggtttggaactcaatatagtatagaagatattgaaaactcttgggctgaactgtggaatagtaatttcgaattaaatccagatcttcatcttccagctgaaaacaagtacatagccacggactttacgttgaaggctttcgattgcccggaaacagaatacccagttaaaattgtgaatactccacaaggttgcctgtggtataagaaagacaacaaattcaaaatccccaaagcatatatacgtttccatctaatttcaccgttgatacagaaatctgcagcaaatgtggtcctctttgatatctttgtcaatatccttacgcataaccttgcggaaccagcttatgaagcagatgtggcacagctggagtataaactggtagctggagaacatggtttaattattcgagtgaaaggatttaaccacaaactacctctactgtttcagctcattattgactacttagctgagttcaattccacaccagctgtctttacaatgataactgagcagttgaagaagacctactttaacatcctcatcaagcctgagactttggccaaagatgtacggcttttaatcttggaatatgcccgttggtctatgattgacaagtaccaggctttgatggacggcctttcccttgagtctctgctgagcttcgtcaaagaattcaaatcccagctctttgtggagggcctggtacaagggaatgtcacaagcacagaatctatggatttcctgaaatatgttgttgacaaactaaacttcaagcctctggagcaggagatgcctgtgcagttccaggtggtagagctgcccagtggccaccatctatgcaaagtgaaagctctgaacaagggtgatgccaactctgaagtcactgtgtactaccagtcaggtaccaggagtctaagagaatatacgcttatggagctgcttgtgatgcacatggaagaaccttgttttgacttccttcgaaccaagcagacccttgggtaccatgtctaccctacctgtaggaacacatccgggattctaggattttctgtcactgtggggactcaggcaaccaaatacaattctgaagttgttgataagaagatagaagagtttctttctagctttgaggagaagattgagaacctcactgaagaggcattcaacacccaggtcacagctctcatcaagctgaaggagtgtgaggatacccaccttggggaggaggtggataggaactggaatgaagtggttacacagcagtacctctttgaccgccttgcccacgagattgaagcactgaagtcattctcaaaatcagacctggtcaactggttcaaggcccatagagggccaggaagtaaaatgctcagcgttcatgttgttggatatgggaagtatgaactggaagaggatggtaccccttctagtgaggattcaaattcttcttgtgaagtgatgcagctgacctacctgccaacctctcctctgctggcagattgtatcatccccattactgatatcagggctttcacaacaacactcaaccttctcccctaccataaaatagtcaaataaataaactgcagtcacgttggcctgaagcaatgt

SEQ ID NO: 448518 - DNA, 923 bp, Homo sapiens
gcctgttgggacactctcttatcctccaccgctacaacgaatctatggatttcctgaaatatgttgttgacaaactaaacttcaagcctctggagcaggagatgcctgtgcagttccaggtggtagagctgcccagtggccaccatctatgcaaagtgaaagctctgaacaagggtgatgccaactctgaagtcactgtgtactaccagtcaggtaccaggagtctaagagaatatacgcttatggagctgcttgtgatgcacatggaagaaccttgttttgacttccttcgaaccaagcagacccttgggtaccatgtctaccctacctgtaggaacacatccgggattctaggattttctgtcactgtggggactcaggcaaccaaatacaattctgaagttgttgataagaagatagaagagtttctttctagctttgaggagaagattgagaacctcactgaagaggcattcaacacccaggtcacagctctcatcaagctgaaggagtgtgaggatacccaccttggggaggaggtggataggaactggaatgaagtggttacacagcagtacctctttgaccgccttgcccacgagattgaagcactgaagtcattctcaaaatcagacctggtcaactggttcaaggcccatagagggccaggaagtaaaatgctcagcgttcatgttgttggatatgggaagtatgaactggaagaggatggtaccccttctagtgaggattcaaattcttcttgtgaagtgatgcagctgacctacctgccaacctctcctctgctggcagattgtatcatccccattactgatatcagggctttcacaacaacactcaaccttctcccctaccataaaatagtcaaataaataaactgcagtcacgttggcctgaagcaatgt

SEQ ID NO: 448519 - DNA, 707 bp, Homo sapiens
  misc_feature (86)..(86): n is a, c, g, or t
  misc_feature (93)..(93): n is a, c, g, or t
tcccttttcttcagcaggtccaggtttaggaatttcccttgggcctcttgattccatggaaacctgtttgacttcatcgaccaagnagacctnggtaccatgtctaccctacctgtaggaacacatccgggattctaggattttctgtcactgtggggactcaggcaaccaaatacaattctgaagttgttgataagaagatagaagagtttctttctagctttgaggagaagattgagaacctcactgaagaggcattcaacacccaggtcacagctctcatcaagctgaaggagtgtgaggatacccaccttggggaggaggtggataggaactggaatgaagtggttacacagcagtacctctttgaccgccttgcccacgagattgaagcactgaagtcattctcaaaatcagacctggtcaactggttcaaggcccatagagggccaggaagtaaaatgctcagcgttcatgttgttggatatgggaagtatgaactggaagaggatggtaccccttctagtgaggattcaaattcttcttgtgaagtgatgcagctgacctacctgccaacctctcctctgctggcagattgtatcatccccattactgatatcagggctttcacaacaacactcaaccttctcccctaccataaaatagtcaaataaataaactgcagtcacgttggcctgaagcaatgt

SEQ ID NO: 448520 - DNA, 1227 bp, Homo sapiens
  misc_feature (86)..(86): n is a, c, g, or t
  misc_feature (93)..(93): n is a, c, g, or t
tcccttttcttcagcaggtccaggtttaggaatttcccttgggcctcttgattccatggaaacctgtttgacttcatcgaccaagnagacctnggtaccatgtctaccctacctgtaggaacacatccgggattctaggattttctgtcactgtggggactcaggcaaccaaatacaattctgaagttgttgataagaagatagaagagtttctttctagctttgaggagaagattgagaacctcactgaagaggcattcaacacccaggtcacagctctcatcaagctgaaggagtgtgaggatacccaccttggggaggaggtggataggaactggaatgaagtggttacacagcagtacctctttgaccgccttgcccacgagattgaagcactgaagtcattctcaaaatcagacctggtcaactggttcaaggcccatagagggccaggaagtaaaatgctcagcgttcatgttgttggatatgggaagtatgaactggaagaggatggtaccccttctagtgaggattcaaattcttcttgtgaagtgatgcagctgacctacctgccaacctctcctctgctggcagattgtatcatccccattactgatatcagggctttcacaacaacactcaaccttctcccctaccataaaatagtcaaataaataaactgcagtcacgttggcctgaagcaatgtgtattttaaaatgtgtttgtttgtattttatggagttagttatactactgccttagggcttccattgaagttttgcactggcatcatagcatttgatttactttttatcctttgttgagactaataaacccagggttactgtaggagctggcaaaggaaaattagcagaatgggccaagcgagaccagaaagcctgcagcagcactttgagaagccctggcctgtgtcctctcagactgagaatctacttcttgaaaggccttacgtaaccagtatattgaataactaactaaatgctaggtactaatacctgtttttttaatgtatttttaaataaaaaagatgatagatagatagatagatatagttctgtatttcccttcagaatgagccatctgctgctgtggcattcattttattctatctatctatctatttttgttcactgtggggtggggatctataaatacacactcttcccaaaccctctaaggcaataaaacatttttggataaaatgt

SEQ ID NO: 448521 - DNA, 183 bp, Homo sapiens
gacaaccttctcttttcagtcaggtaccaggagtctaagagaatatacgcttatggagctgcttgtgatgcacatggaagaaccttgttttgacttccttcgaaccaagcagacccttggcttctcccctaccataaaatagtcaaataaataaactgcagtcacgttggcctgaagcaatgt

SEQ ID NO: 448522 - DNA, 922 bp, Homo sapiens
taatctgatactgttttcccatcttacattgtgataaaaatggtctctctttagaaacacatcctttatagaactttgaccaaacatttctttattctgaagattcatttctaataacaaaactttgagtgttttttttctgccctctgtacagagatgtacggcttttaatcttggaatatgcccgttggtctatgattgacaagtaccaggctttgatggacggcctttcccttgagtctctgctgagcttcgtcaaagaattcaaatcccagctctttgtggagggcctggtacaagggaatgtcacaagcacagtgagtgtgagatgctctgtaggccaggtctgaatgcagttgtgaactctggaattgccatagttctttcctaaaggggaagctgtagttttggcaggccagcattatcatattctgtttagaagggaacctgacccctctgatgctgggcagctttcttcttaagatgaagactgctgggctgggaatgatggctcacgcctgtaatttcagcattttgggaggccaaggcagaagcattacttaaggtcaggatttcgagaccagtccaggcaacacagtgagaactcatccctacaaaaaataaaaaattagccaggcatggtggcacatgcctatagtctccgctacttgggaggctgaggtggaaggatcatttgagcccaggagtttggggctacagcatgctatgattgcaccacagtattccagcctgggcaacagagtaagaccctgtctcaaaagaaaagaaataaagaaagagagagagaaaaatagattgctggtaatagactaggattttgagtgaaatgggtttggcgtatctatactgtttgttacctttgttgaagattgtatgtggaaaccatgaacagtttagtata

SEQ ID NO: 448523 - DNA, 892 bp, Homo sapiens
gttcgctggctgttccgagaatcagtccgggtcacgttggtgcctctcctttcctgttctgattggttgcttacgtgagcgtgactactttcttgcctcatgattggctgaaatcagtagcgtcatcggcggccgggagggcggagggacgagggaagtcggcgagagggagactgggttgggggaggggttcaggcctgttccccgcggctgcggcagcaccagggccggccgccaccgcctctagaacgcggaggaggtgggtcctgggaagcgggatgtccatcgctccagcttggtggtgaatgctgaggagagtcactgttgctgcagtctgtgccacccggaggaagttgtgtgaggccgggcgggagctcgcggcgctctggggaatcgaaacgcggggtcggtgcgaagactctgctgctgccagaccctttcctattctggccatgcctggaaggaacaaggcgaagtctacctgcagctgccctgacctgcagcccaatggacaggatctgggcgagaacagccgggttgcccgtctaggagcggatgaatctgaggaagagggacggagggggtctctcagtaatgctggggaccctgagatcgtcaagtctcccagcgaccccaagcaataccgagagatgatctcactgtgtcacccaggctgtactgcagtggtgccatcatagctcactgcagcatcgaacttctaggctcaagtgatcctcctgcctgtgccgcccaaagtgttggaattacaggcatgagccactgcttctagatggatgtcttttattggcgggggggaaagccctatatacgtatatatgtattttttactaattctaaaactgctaacccaagcaggacaaaatttaattga

SEQ ID NO: 448524 - DNA, 4255 bp, Homo sapiens
gttcgctggctgttccgagaatcagtccgggtcacgttggtgcctctcctttcctgttctgattggttgcttacgtgagcgtgactactttcttgcctcatgattggctgaaatcagtagcgtcatcggcggccgggagggcggagggacgagggaagtcggcgagagggagactgggttgggggaggggttcaggcctgttccccgcggctgcggcagcaccagggccggccgccaccgcctctagaacgcggaggaggtgggtcctgggaagcgggatgtccatcgctccagcttggtggtgaatgctgaggagagtcactgttgctgcagtctgtgccacccggaggaagttgtgtgaggccgggcgggagctcgcggcgctctggggaatcgaaacgcggggtcggtgcgaagactctgctgctgccagaccctttcctattctggccatgcctggaaggaacaaggcgaagtctacctgcagctgccctgacctgcagcccaatggacaggatctgggcgagaacagccgggttgcccgtctaggagcggatgaatctgaggaagagggacggagggggtctctcagtaatgctggggaccctgagatcgtcaagtctcccagcgaccccaagcaataccgatacatcaaattacagaatggcttgcaggcacttctgatttcagacctaagtaatatggaaggtaaaacaggaaatacaacagatgatgaagaagaagaggaggtggaggaagaagaagaagatgatgatgaagattctggagctgaaatagaagatgacgatgaagagggttttgatgatgaagatgagtttgatgatgaacatgatgatgatcttgatactgaggataatgaattggaagaattagaagagagagcagaagctagaaaaaaaactactgaaaaacagtctgcagcggctctttgtgttggagttgggagtttcgctgatccagatgacctgccggggctggcacactttttggagcacatggtattcatgggtagtttgaaatatccagatgagaatggatttgatgccttcctgaagaagcatgggggtagtgataatgcctcaactgattgtgaacgcactgtctttcagtttgatgtccagaggaagtacttcaaggaagctcttgatagatgggcgcagttcttcatccacccactaatgatcagagatgcaattgaccgtgaagttgaagctgttgatagtgaatatcaacttgcaaggccttctgatgcaaacagaaaggaaatgttgtttggaagccttgctagacctggccatcctatgggaaaatttttttggggaaatgctgagacgctcaagcatgagccaagaaagaataatattgatacacatgctagattgagagaattctggatgcgttactactcttctcattacatgactttagtggttcaatccaaagaaacactggatactttggaaaagtgggtgactgaaatcttctctcagataccaaacaatgggttacccagaccaaactttggccatttaacggatccatttgacacaccagcatttaacaaactttatagagttgttccaatcagaaaaattcatgctctgaccatcacatgggcacttcctcctcaacagcaacattacagggtgaagccacttcattatatatcctggctggttggacatgaaggcaaaggcagcattctttctttccttaggaaaaaatgctgggctcttgcactgtttggtggaaatggtgagacaggatttgagcaaaattctacttattcagtgttcagcatttctattacattgactgatgagggttatgaacatttttatgaggttgcttacactgtctttcagtatttaaaaatgctgcagaagctaggcccagaaaaaaggtaataaacacttcctggaatgaggccaggagccagtcctggtatatttgaggcttcaggctgccggtagacatgctttagtcttgccttgatggtttttcaggcattttctgctctatttcctttattgactccatatccttatccctctacatgtgattgtatactaaggctttacacatatgtgggcagtccctttattttcacgcttctcttttattgttgatgcttctattgagaattttttaaacttttattctaggttcaggggtatatgtgcaggtttgttatgtaggtaaacttgtgtcacggtggtttgttgtacagattattttgtcacccaggtactaagcctactacccaatagttaccttttctgatcctctccctcctcccgcccttctccctcaagtaggcagaaattttaatgtatcttctaattatagttttctccttcacagaatttttgaagagattcggaaaattgaggataatgaatttcattaccaagaacagacagatccagttgagtatgtggaaaacatgtgtgagaacatgcagctgtacccattgcaggacattctcactggagatcagcttctttttgaatacaagccagaagtcattggtgaagccttgaatcagctagttcctcaaaaagcaaatcttgttttactgtctggtgctaatgagggaaaatgtgacctcaaggagaaatggtttggaactcaatatagtatagaagatattgaaaactcttgggctgaactgtggaatagtaatttcgaattaaatccagatcttcatcttccagctgaaaacaagtacatagccacggactttacgttgaaggctttcgattgcccggaaacagaatacccagttaaaattgtgaatactccacaaggttgcctgtggtataagaaagacaacaaattcaaaatccccaaagcatatatacgtttccatctaatttcaccgttgatacagaaatctgcagcaaatgtggtcctctttgatatctttgtcaatatccttacgcataaccttgcggaaccagcttatgaagcagatgtggcacagctggagtataaactggtagctggagaacatggtttaattattcgagtgaaaggatttaaccacaaactacctctactgtttcagctcattattgactacttagctgagttcaattccacaccagctgtctttacaatgataactgagcagttgaagaagacctactttaacatcctcatcaagcctgagactttggccaaagatgtacggcttttaatcttggaatatgcccgttggtctatgattgacaagtaccaggctttgatggacggcctttcccttgagtctctgctgagcttcgtcaaagaattcaaatcccagctctttgtggagggcctggtacaagggaatgtcacaagcacagaatctatggatttcctgaaatatgttgttgacaaactaaacttcaagcctctggagcaggagatgcctgtgcagttccaggtggtagagctgcccagtggccaccatctatgcaaagtgaaagctctgaacaagggtgatgccaactctgaagtcactgtgtactaccagtcaggtaccaggagtctaagagaatatacgcttatggagctgcttgtgatgcacatggaagaaccttgttttgacttccttcgaaccaagcagacccttgggtaccatgtctaccctacctgtaggaacacatccgggattctaggattttctgtcactgtggggactcaggcaaccaaatacaattctgaagttgttgataagaagatagaagagtttctttctagctttgaggagaagattgagaacctcactgaagaggcattcaacacccaggtcacagctctcatcaagctgaaggagtgtgaggatacccaccttggggaggaggtggataggaactggaatgaagtggttacacagcagtacctctttgaccgccttgcccacgagattgaagcactgaagtcattctcaaaatcagacctggtcaactggttcaaggcccatagagggccaggaagtaaaatgctcagcgttcatgttgttggatatgggaagtatgaactggaagaggatggtaccccttctagtgaggattcaaattcttcttgtgaagtgatgcagctgacctacctgccaacctctcctctgctggcagattgtatcatccccattactgatatcagggctttcacaacaacactcaaccttctcccctaccataaaatagtcaaataaataaactgcagtcacgttggcctgaagcaatgt

SEQ ID NO: 448525 - DNA, 3044 bp, Homo sapiens
agcggatttgagcaaaattctacttattcagtgttcagcatttctattacattgacgatgaagagggttttgatgatgaagatgagtttgatgatgaacatgatgatgatcttgatactgaggataatgaattggaagaattagaagagagagcagaagctagaaaaaaaactactgaaaaacagtctgcagcggctctttgtgttggagttgggagtttcgctgatccagatgacctgccggggctggcacactttttggagcacatggtattcatgggtagtttgaaatatccagatgagaatggatttgatgccttcctgaagaagcatgggggtagtgataatgcctcaactgattgtgaacgcactgtctttcagtttgatgtccagaggaagtacttcaaggaagctcttgatagatgggcgcagttcttcatccacccactaatgatcagagatgcaattgaccgtgaagttgaagctgttgatagtgaatatcaacttgcaaggccttctgatgcaaacagaaaggaaatgttgtttggaagccttgctagacctggccatcctatgggaaaatttttttggggaaatgctgagacgctcaagcatgagccaagaaagaataatattgatacacatgctagattgagagaattctggatgcgttactactcttctcattacatgactttagtggttcaatccaaagaaacactggatactttggaaaagtgggtgactgaaatcttctctcagataccaaacaatgggttacccagaccaaactttggccatttaacggatccatttgacacaccagcatttaacaaactttatagagttgttccaatcagaaaaattcatgctctgaccatcacatgggcacttcctcctcaacagcaacattacagggtgaagccacttcattatatatcctggctggttggacatgaaggcaaaggcagcattctttctttccttaggaaaaaatgctgggctcttgcactgtttggtggaaatggtgagacaggatttgagcaaaattctacttattcagtgttcagcatttctattacattgactgatgagggttatgaacatttttatgaggttgcttacactgtctttcagtatttaaaaatgctgcagaagctaggcccagaaaaaagaatttttgaagagattcggaaaattgaggataatgaatttcattaccaagaacagacagatccagttgagtatgtggaaaacatgtgtgagaacatgcagctgtacccattgcaggacattctcactggagatcagcttctttttgaatacaagccagaagtcattggtgaagccttgaatcagctagttcctcaaaaagcaaatcttgttttactgtctggtgctaatgagggaaaatgtgacctcaaggagaaatggtttggaactcaatatagtatagaagatattgaaaactcttgggctgaactgtggaatagtaatttcgaattaaatccagatcttcatcttccagctgaaaacaagtacatagccacggactttacgttgaaggctttcgattgcccggaaacagaatacccagttaaaattgtgaatactccacaaggttgcctgtggtataagaaagacaacaaattcaaaatccccaaagcatatatacgtttccatctaatttcaccgttgatacagaaatctgcagcaaatgtggtcctctttgatatctttgtcaatatccttacgcataaccttgcggaaccagcttatgaagcagatgtggcacagctggagtataaactggtagctggagaacatggtttaattattcgagtgaaaggatttaaccacaaactacctctactgtttcagctcattattgactacttagctgagttcaattccacaccagctgtctttacaatgataactgagcagttgaagaagacctactttaacatcctcatcaagcctgagactttggccaaagatgtacggcttttaatcttggaatatgcccgttggtctatgattgacaagtaccaggctttgatggacggcctttcccttgagtctctgctgagcttcgtcaaagaattcaaatcccagctctttgtggagggcctggtacaagggaatgtcacaagcacagaatctatggatttcctgaaatatgttgttgacaaactaaacttcaagcctctggagcaggagatgcctgtgcagttccaggtggtagagctgcccagtggccaccatctatgcaaagtgaaagctctgaacaagggtgatgccaactctgaagtcactgtgtactaccagtcaggtaccaggagtctaagagaatatacgcttatggagctgcttgtgatgcacatggaagaaccttgttttgacttccttcgaaccaagcagacccttgggtaccatgtctaccctacctgtaggaacacatccgggattctaggattttctgtcactgtggggactcaggcaaccaaatacaattctgaagttgttgataagaagatagaagagtttctttctagctttgaggagaagattgagaacctcactgaagaggcattcaacacccaggtcacagctctcatcaagctgaaggagtgtgaggatacccaccttggggaggaggtggataggaactggaatgaagtggttacacagcagtacctctttgaccgccttgcccacgagattgaagcactgaagtcattctcaaaatcagacctggtcaactggttcaaggcccatagagggccaggaagtaaaatgctcagcgttcatgttgttggatatgggaagtatgaactggaagaggatggtaccccttctagtgaggattcaaattcttcttgtgaagtgatgcagctgacctacctgccaacctctcctctgctggcagattgtatcatccccattactgatatcagggctttcacaacaacactcaaccttctcccctaccataaaatagtcaaataaataaactgcagtcacgttggcctgaagcaatgt

SEQ ID NO: 448526 - DNA, 3666 bp, Homo sapiens
gttcgctggctgttccgagaatcagtccgggtcacgttggtgcctctcctttcctgttctgattggttgcttacgtgagcgtgactactttcttgcctcatgattggctgaaatcagtagcgtcatcggcggccgggagggcggagggacgagggaagtcggcgagagggagactgggttgggggaggggttcaggcctgttccccgcggctgcggcagcaccagggccggccgccaccgcctctagaacgcggaggaggtgggtcctgggaagcgggatgtccatcgctccagcttggtggtgaatgctgaggagagtcactgttgctgcagtctgtgccacccggaggaagttgtgtgaggccgggcgggagctcgcggcgctctggggaatcgaaacgcggggtcggtgcgaagactctgctgctgccagaccctttcctattctggccatgcctggaaggaacaaggcgaagtctacctgcagctgccctgacctgcagcccaatggacaggatctgggcgagaacagccgggttgcccgtctaggagcggatgaatctgaggaagagggacggagggggtctctcagtaatgctggggaccctgagatcgtcaagtctcccagcgaccccaagcaataccgatacatcaaattacagaatggcttgcaggcacttctgatttcagacctaagtaatatggaaggtaaaacaggaaatacaacagatgatgaagaagaagaggaggtggaggaagaagaagaagatgatgatgaagattctggagctgaaatagaagatgacgatgaagagggttttgatgatgaagatgagtttgatgatgaacatgatgatgatcttgatactgaggataatgaattggaagaattagaagagagagcagaagctagaaaaaaaactactgaaaaacagtctgcagcggctctttgtgttggagttgggagtttcgctgatccagatgacctgccggggctggcacactttttggagcacatggtattcatgggtagtttgaaatatccagatgagaatggatttgatgccttcctgaagaagcatgggggtagtgataatgcctcaactgattgtgaacgcactgtctttcagtttgatgtccagaggaagtacttcaaggaagctcttgatagatgggcgcagttcttcatccacccactaatgatcagagatgcaattgaccgtgaagttgaagctgttgatagtgaatatcaacttgcaaggccttctgatgcaaacagaaaggaaatgttgtttggaagccttgctagacctggccatcctatgggaaaatttttttggggaaatgctgagacgctcaagcatgagccaagaaagaataatattgatacacatgctagattgagagaattctggatgcgttactactcttctcattacatgactttagtggttcaatccaaagaaacactggatactttggaaaagtgggtgactgaaatcttctctcagataccaaacaatgggttacccagaccaaactttggccatttaacggatccatttgacacaccagcatttaacaaactttatagagttgttccaatcagaaaaattcatgctctgaccatcacatgggcacttcctcctcaacagcaacattacagggtgaagccacttcattatatatcctggctggttggacatgaaggcaaaggcagcattctttctttccttaggaaaaaatgctgggctcttgcactgtttggtggaaatggtgagacaggatttgagcaaaattctacttattcagtgttcagcatttctattacattgactgatgagggttatgaacatttttatgaggttgcttacactgtctttcagtatttaaaaatgctgcagaagctaggcccagaaaaaagaatttttgaagagattcggaaaattgaggataatgaatttcattaccaagaacagacagatccagttgagtatgtggaaaacatgtgtgagaacatgcagctgtacccattgcaggacattctcactggagatcagcttctttttgaatacaagccagaagtcattggtgaagccttgaatcagctagttcctcaaaaagcaaatcttgttttactgtctggtgctaatgagggaaaatgtgacctcaaggagaaatggtttggaactcaatatagtatagaagatattgaaaactcttgggctgaactgtggaatagtaatttcgaattaaatccagatcttcatcttccagctgaaaacaagtacatagccacggactttacgttgaaggctttcgattgcccggaaacagaatacccagttaaaattgtgaatactccacaaggttgcctgtggtataagaaagacaacaaattcaaaatccccaaagcatatatacgtttccatctaatttcaccgttgatacagaaatctgcagcaaatgtggtcctctttgatatctttgtcaatatccttacgcataaccttgcggaaccagcttatgaagcagatgtggcacagctggagtataaactggtagctggagaacatggtttaattattcgagtgaaaggatttaaccacaaactacctagatgtacggcttttaatcttggaatatgcccgttggtctatgattgacaagtaccaggctttgatggacggcctttcccttgagtctctgctgagcttcgtcaaagaattcaaatcccagctctttgtggagggcctggtacaagggaatgtcacaagcacagaatctatggatttcctgaaatatgttgttgacaaactaaacttcaagcctctggagcaggagatgcctgtgcagttccaggtggtagagctgcccagtggccaccatctatgcaaagtgaaagctctgaacaagggtgatgccaactctgaagtcactgtgtactaccagtcaggtaccaggagtctaagagaatatacgcttatggagctgcttgtgatgcacatggaagaaccttgttttgacttccttcgaaccaagcagacccttgggtaccatgtctaccctacctgtaggaacacatccgggattctaggattttctgtcactgtggggactcaggcaaccaaatacaattctgaagttgttgataagaagatagaagagtttctttctagctttgaggagaagattgagaacctcactgaagaggcattcaacacccaggtcacagctctcatcaagctgaaggagtgtgaggatacccaccttggggaggaggtggataggaactggaatgaagtggttacacagcagtacctctttgaccgccttgcccacgagattgaagcactgaagtcattctcaaaatcagacctggtcaactggttcaaggcccatagagggccaggaagtaaaatgctcagcgttcatgttgttggatatgggaagtatgaactggaagaggatggtaccccttctagtgaggattcaaattcttcttgtgaagtgatgcagctgacctacctgccaacctctcctctgctggcagattgtatcatccccattactgatatcagggctttcacaacaacactcaaccttctcccctaccataaaatagtcaaataaataaactgcagtcacgttggcctgaagcaatgt

SEQ ID NO: 448527 - DNA, 3784 bp, Homo sapiens
gttcgctggctgttccgagaatcagtccgggtcacgttggtgcctctcctttcctgttctgattggttgcttacgtgagcgtgactactttcttgcctcatgattggctgaaatcagtagcgtcatcggcggccgggagggcggagggacgagggaagtcggcgagagggagactgggttgggggaggggttcaggcctgttccccgcggctgcggcagcaccagggccggccgccaccgcctctagaacgcggaggaggtgggtcctgggaagcgggatgtccatcgctccagcttggtggtgaatgctgaggagagtcactgttgctgcagtctgtgccacccggaggaagttgtgtgaggccgggcgggagctcgcggcgctctggggaatcgaaacgcggggtcggtgcgaagactctgctgctgccagaccctttcctattctggccatgcctggaaggaacaaggcgaagtctacctgcagctgccctgacctgcagcccaatggacaggatctgggcgagaacagccgggttgcccgtctaggagcggatgaatctgaggaagagggacggagggggtctctcagtaatgctggggaccctgagatcgtcaagtctcccagcgaccccaagcaataccgatacatcaaattacagaatggcttgcaggcacttctgatttcagacctaagtaatatggaaggtaaaacaggaaatacaacagatgatgaagaagaagaggaggtggaggaagaagaagaagatgatgatgaagattctggagctgaaatagaagatgacgatgaagagggttttgatgatgaagatgagtttgatgatgaacatgatgatgatcttgatactgaggataatgaattggaagaattagaagagagagcagaagctagaaaaaaaactactgaaaaacagtctgcagcggctctttgtgttggagttgggagtttcgctgatccagatgacctgccggggctggcacactttttggagcacatggtattcatgggtagtttgaaatatccagatgagaatggatttgatgccttcctgaagaagcatgggggtagtgataatgcctcaactgattgtgaacgcactgtctttcagtttgatgtccagaggaagtacttcaaggaagctcttgatagatgggcgcagttcttcatccacccactaatgatcagagatgcaattgaccgtgaagttgaagctgttgatagtgaatatcaacttgcaaggccttctgatgcaaacagaaaggaaatgttgtttggaagccttgctagacctggccatcctatgggaaaatttttttggggaaatgctgagacgctcaagcatgagccaagaaagaataatattgatacacatgctagattgagagaattctggatgcgttactactcttctcattacatgactttagtggttcaatccaaagaaacactggatactttggaaaagtgggtgactgaaatcttctctcagataccaaacaatgggttacccagaccaaactttggccatttaacggatccatttgacacaccagcatttaacaaactttatagagttgttccaatcagaaaaattcatgctctgaccatcacatgggcacttcctcctcaacagcaacattacagggtgaagccacttcattatatatcctggctggttggacatgaaggcaaaggcagcattctttctttccttaggaaaaaatgctgggctcttgcactgtttggtggaaatggtgagacaggatttgagcaaaattctacttattcagtgttcagcatttctattacattgactgatgagggttatgaacatttttatgaggttgcttacactgtctttcagtatttaaaaatgctgcagaagctaggcccagaaaaaagaatttttgaagagattcggaaaattgaggataatgaatttcattaccaagaacagacagatccagttgagtatgtggaaaacatgtgtgagaacatgcagctgtacccattgcaggacattctcactggagatcagcttctttttgaatacaagccagaagtcattggtgaagccttgaatcagctagttcctcaaaaagcaaatcttgttttactgtctggtgctaatgagggaaaatgtgacctcaaggagaaatggtttggaactcaatatagtatagaagatattgaaaactcttgggctgaactgtggaatagtaatttcgaattaaatccagatcttcatcttccagctgaaaacaagtacatagccacggactttacgttgaaggctttcgattgcccggaaacagaatacccagttaaaattgtgaatactccacaaggttgcctgtggtataagaaagacaacaaattcaaaatccccaaagcatatatacgtttccatctaatttcaccgttgatacagaaatctgcagcaaatgtggtcctctttgatatctttgtcaatatccttacgcataaccttgcggaaccagcttatgaagcagatgtggcacagctggagtataaactggtagctggagaacatggtttaattattcgagtgaaaggatttaaccacaaactacctctactgtttcagctcattattgactacttagctgagttcaattccacaccagctgtctttacaatgataactgagcagttgaagaagacctactttaacatcctcatcaagcctgagactttggccaaagatgtacggcttttaatcttggaatatgcccgttggtctatgattgacaagtaccaggctttgatggacggcctttcccttgagtctctgctgagcttcgtcaaagaattcaaatcccagctctttgtggagggcctggtacaagggaatgtcacaagcacagaatctatggatttcctgaaatatgttgttgacaaactaaacttcaagcctctggagcaggagatgcctgtgcagttccaggtggtagagctgcccagtggccaccatctatgcaaagtgaaagctctgaacaagggtgatgccaactctgaagtcactgtgtactaccagtcaggtaccaggagtctaagagaatatacgcttatggagctgcttgtggcccatggagaactggtagcatacttcgaaccagcagacctgggtaccatgtctaccctacctgtaggaacacatccgggattctaggattttctgtcactgtggggactcaggcaaccaaatacaattctgaagttgttgataagaagatagaagagtttctttctagctttgaggagaagattgagaacctcactgaagaggcattcaacacccaggtcacagctctcatcaagctgaaggagtgtgaggatacccaccttggggaggaggtggataggaactggaatgaagtggttacacagcagtacctctttgaccgccttgcccacgagattgaagcactgaagtcattctcaaaatcagacctggtcaactggttcaaggcccatagagggccaggaagtaaaatgctcagcgttcatgttgttggatatgggaagtatgaactggaagaggatggtaccccttctagtgaggattcaaattcttcttgtgaagtgatgcagctgacctacctgccaacctctcctctgctggcagattgtatcatccccattactgatatcagggctttcacaacaacactcaaccttctcccctaccataaaatagtcaaataaataaactgcagtcacgttggcctgaagcaatgt

SEQ ID NO: 448528 - DNA, 3845 bp, Homo sapiens
gttcgctggctgttccgagaatcagtccgggtcacgttggtgcctctcctttcctgttctgattggttgcttacgtgagcgtgactactttcttgcctcatgattggctgaaatcagtagcgtcatcggcggccgggagggcggagggacgagggaagtcggcgagagggagactgggttgggggaggggttcaggcctgttccccgcggctgcggcagcaccagggccggccgccaccgcctctagaacgcggaggaggtgggtcctgggaagcgggatgtccatcgctccagcttggtggtgaatgctgaggagagtcactgttgctgcagtctgtgccacccggaggaagttgtgtgaggccgggcgggagctcgcggcgctctggggaatcgaaacgcggggtcggtgcgaagactctgctgctgccagaccctttcctattctggccatgcctggaaggaacaaggcgaagtctacctgcagctgccctgacctgcagcccaatggacaggatctgggcgagaacagccgggttgcccgtctaggagcggatgaatctgaggaagagggacggagggggtctctcagtaatgctggggaccctgagatcgtcaagtctcccagcgaccccaagcaataccgatacatcaaattacagaatggcttgcaggcacttctgatttcagacctaagtaatatggaaggtaaaacaggaaatacaacagatgatgaagaagaagaggaggtggaggaagaagaagaagatgatgatgaagattctggagctgaaatagaagatgacgatgaagagggttttgatgatgaagatgagtttgatgatgaacatgatgatgatcttgatactgaggataatgaattggaagaattagaagagagagcagaagctagaaaaaaaactactgaaaaacagtctgcagcggctctttgtgttggagttgggagtttcgctgatccagatgacctgccggggctggcacactttttggagcacatggtattcatgggtagtttgaaatatccagatgagaatggatttgatgccttcctgaagaagcatgggggtagtgataatgcctcaactgattgtgaacgcactgtctttcagtttgatgtccagaggaagtacttcaaggaagctcttgatagatgggcgcagttcttcatccacccactaatgatcagagatgcaattgaccgtgaagttgaagctgttgatagtgaatatcaacttgcaaggccttctgatgcaaacagaaaggaaatgttgtttggaagccttgctagacctggccatcctatgggaaaatttttttggggaaatgctgagacgctcaagcatgagccaagaaagaataatattgatacacatgctagattgagagaattctggatgcgttactactcttctcattacatgactttagtggttcaatccaaagaaacactggatactttggaaaagtgggtgactgaaatcttctctcagataccaaacaatgggttacccagaccaaactttggccatttaacggatccatttgacacaccagcatttaacaaactttatagagttgttccaatcagaaaaattcatgctctgaccatcacatgggcacttcctcctcaacagcaacattacagggtgaagccacttcattatatatcctggctggttggacatgaaggcaaaggcagcattctttctttccttaggaaaaaatgctgggctcttgcactgtttggtggaaatggtgagacaggatttgagcaaaattctacttattcagtgttcagcatttctattacattgactgatgagggttatgaacatttttatgaggttgcttacactgtctttcagtatttaaaaatgctgcagaagctaggcccagaaaaaagaatttttgaagagattcggaaaattgaggataatgaatttcattaccaagaacagacagatccagttgagtatgtggaaaacatgtgtgagaacatgcagctgtacccattgcaggacattctcactggagatcagcttctttttgaatacaagccagaagtcattggtgaagccttgaatcagctagttcctcaaaaagcaaatcttgttttactgtctggtgctaatgagggaaaatgtgacctcaaggagaaatggtttggaactcaatatagtatagaagatattgaaaactcttgggctgaactgtggaatagtaatttcgaattaaatccagatcttcatcttccagctgaaaacaagtacatagccacggactttacgttgaaggctttcgattgcccggaaacagaatacccagttaaaattgtgaatactccacaaggttgcctgtggtataagaaagacaacaaattcaaaatccccaaagcatatatacgtttccatctaatttcaccgttgatacagaaatctgcagcaaatgtggtcctctttgatatctttgtcaatatccttacgcataaccttgcggaaccagcttatgaagcagatgtggcacagctggagtataaactggtagctggagaacatggtttaattattcgagtgaaaggatttaaccacaaactacctctactgtttcagctcattattgactacttagctgagttcaattccacaccagctgtctttacaatgataactgagcagttgaagaagacctactttaacatcctcatcaagcctgagactttggccaaagatgtacggcttttaatcttggaatatgcccgttggtctatgattgacaagtaccaggctttgatggacggcctttcccttgagtctctgctgagcttcgtcaaagaattcaaatcccagctctttgtggagggcctggtacaagggaatgtcacaagcacagaatctatggatttcctgaaatatgttgttgacaaactaaacttcaagcctctggagcaggagatgcctgtgcagttccaggtggtagagctgcccagtggccaccatctatgcaaagtgaaagctctgaacaagggtgatgccaactctgaagtcactgtgtactaccagtcaggtaccaggagtctaagagaatatacgcttatggagctgcttgtgatgcacatggaagaaccttgttttgacttccttcgaaccaagcagacccttgggtaccatgtctaccctacctgtaggaacacatccgggattctaggattttctgtcactgtggggactcaggcaaccaaatacaattctgaagttgttgataagaagatagaagagtttctttctagctttgaggagaagattgagaacctcactgaagaggcattcaacacccaggtcacagctctcatcaagctgaaggagtgtgaggatacccaccttggggaggaggtggataggaactggaatgaagtggttacacagcagtacctctttgaccgccttgcccacgagattgaagcactgaagtcattctcaaaatcagacctggtcaactggttcaaggcccatagagggccaggaagtaaaatgctcagcgttcatgttgttggatatgggaagtatgaactggaagaggatggtaccccttctagtgaggattcaaattcttcttgtgaagtgatgcagctgacctacctgccaacctctcctctgctggcagattgtatcatccccacagagagagcgtccttcccagggacgccgctgaccgctgagggatctctgggatgcccgtctttcccagccggtggctccagctgccgctgcttggggggtagggcgggcggcggggccagctcctgcacggagtccaccccacagaga

SEQ ID NO: 448529 - DNA, 4261 bp, Homo sapiens
gttcgctggctgttccgagaatcagtccgggtcacgttggtgcctctcctttcctgttctgattggttgcttacgtgagcgtgactactttcttgcctcatgattggctgaaatcagtagcgtcatcggcggccgggagggcggagggacgagggaagtcggcgagagggagactgggttgggggaggggttcaggcctgttccccgcggctgcggcagcaccagggccggccgccaccgcctctagaacgcggaggaggtgggtcctgggaagcgggatgtccatcgctccagcttggtggtgaatgctgaggagagtcactgttgctgcagtctgtgccacccggaggaagttgtgtgaggccgggcgggagctcgcggcgctctggggaatcgaaacgcggggtcggtgcgaagactctgctgctgccagaccctttcctattctggccatgcctggaaggaacaaggcgaagtctacctgcagctgccctgacctgcagcccaatggacaggatctgggcgagaacagccgggttgcccgtctaggagcggatgaatctgaggaagagggacggagggggtctctcagtaatgctggggaccctgagatcgtcaagtctcccagcgaccccaagcaataccgatacatcaaattacagaatggcttgcaggcacttctgatttcagacctaagtaatatggaaggtaaaacaggaaatacaacagatgatgaagaagaagaggaggtggaggaagaagaagaagatgatgatgaagattctggagctgaaatagaagatgacgatgaagagggttttgatgatgaagatgagtttgatgatgaacatgatgatgatcttgatactgaggataatgaattggaagaattagaagagagagcagaagctagaaaaaaaactactgaaaaacagtctgcagcggctctttgtgttggagttgggagtttcgctgatccagatgacctgccggggctggcacactttttggagcacatggtattcatgggtagtttgaaatatccagatgagaatggatttgatgccttcctgaagaagcatgggggtagtgataatgcctcaactgattgtgaacgcactgtctttcagtttgatgtccagaggaagtacttcaaggaagctcttgatagatgggcgcagttcttcatccacccactaatgatcagagatgcaattgaccgtgaagttgaagctgttgatagtgaatatcaacttgcaaggccttctgatgcaaacagaaaggaaatgttgtttggaagccttgctagacctggccatcctatgggaaaatttttttggggaaatgctgagacgctcaagcatgagccaagaaagaataatattgatacacatgctagattgagagaattctggatgcgttactactcttctcattacatgactttagtggttcaatccaaagaaacactggatactttggaaaagtgggtgactgaaatcttctctcagataccaaacaatgggttacccagaccaaactttggccatttaacggatccatttgacacaccagcatttaacaaactttatagagttgttccaatcagaaaaattcatgctctgaccatcacatgggcacttcctcctcaacagcaacattacagggtgaagccacttcattatatatcctggctggttggacatgaaggcaaaggcagcattctttctttccttaggaaaaaatgctgggctcttgcactgtttggtggaaatggtgagacaggatttgagcaaaattctacttattcagtgttcagcatttctattacattgactgatgagggttatgaacatttttatgaggttgcttacactgtctttcagtatttaaaaatgctgcagaagctaggcccagaaaaaagaatttttgaagagattcggaaaattgaggataatgaatttcattaccaagaacagacagatccagttgagtatgtggaaaacatgtgtgagaacatgcagctgtacccattgcaggacattctcactggagatcagcttctttttgaatacaagccagaagtcattggtgaagccttgaatcagctagttcctcaaaaagcaaatcttgttttactgtctggtgctaatgagggaaaatgtgacctcaaggagaaatggtttggaactcaatatagtatagaagatattgaaaactcttgggctgaactgtggaatagtaatttcgaattaaatccagatcttcatcttccagctgaaaacaagtacatagccacggactttacgttgaaggctttcgattgcccggaaacagaatacccagttaaaattgtgaatactccacaaggttgcctgtggtataagaaagacaacaaattcaaaatccccaaagcatatatacgtttccatctaatttcaccgttgatacagaaatctgcagcaaatgtggtcctctttgatatctttgtcaatatccttacgcataaccttgcggaaccagcttatgaagcagatgtggcacagctggagtataaactggtagctggagaacatggtttaattattcgagtgaaaggatttaaccacaaactacctctactgtttcagctcattattgactacttagctgagttcaattccacaccagctgtctttacaatgataactgagcagttgaagaagacctactttaacatcctcatcaagcctgagactttggccaaagatgtacggcttttaatcttggaatatgcccgttggtctatgattgacaagtaccaggctttgatggacggcctttcccttgagtctctgctgagcttcgtcaaagaattcaaatcccagctctttgtggagggcctggtacaagggaatgtcacaagcacagaatctatggatttcctgaaatatgttgttgacaaactaaacttcaagcctctggagcaggagatgcctgtgcagttccaggtggtagagctgcccagtggccaccatctatgcaaagtgaaagctctgaacaagggtgatgccaactctgaagtcactgtgtactaccagtcaggtaccaggagtctaagagaatatacgcttatggagctgcttgtgatgcacatggaagaaccttgttttgacttccttcgaaccaagcagacccttgggtaccatgtctaccctacctgtaggaacacatccgggattctaggattttctgtcactgtggggactcaggcaaccaaatacaattctgaagttgttgataagaagatagaagagtttctttctagctttgaggagaagattgagaacctcactgaagaggcattcaacacccaggtcacagctctcatcaagctgaaggagtgtgaggatacccaccttggggaggaggtggataggaactggaatgaagtggttacacagcagtacctctttgaccgccttgcccacgagattgaagcactgaagtcattctcaaaatcagacctggtcaactggttcaaggcccatagagggccaggaagatggtaccccttctagtgaggattcaaattcttcttgtgaagtgatgcagctgacctacctgccaacctctcctctgctggcagattgtatcatccccattactgatatcagggctttcacaacaacactcaaccttctcccctaccataaaatagtcaaataaataaactgcagtcacgttggcctgaagcaatgtgtattttaaaatgtgtttgtttgtattttatggagttagttatactactgccttagggcttccattgaagttttgcactggcatcatagcatttgatttactttttatcctttgttgagactaataaacccagggttactgtaggagctggcaaaggaaaattagcagaatgggccaagcgagaccagaaagcctgcagcagcactttgagaagccctggcctgtgtcctctcagactgagaatctacttcttgaaaggccttacgtaaccagtatattgaataactaactaaatgctaggtactaatacctgtttttttaatgtatttttaaataaaaaagatgatagatagatagatagatatagttctgtatttcccttcagaatgagccatctgctgctgtggcattcattttattctatctatctatctatttttgttcactgtggggtggggatctataaatacacactcttcccaaaccctctaaggcaataaaacatttttggataaaatgt

SEQ ID NO: 448530 - DNA, 3928 bp, Homo sapiens
gttcgctggctgttccgagaatcagtccgggtcacgttggtgcctctcctttcctgttctgattggttgcttacgtgagcgtgactactttcttgcctcatgattggctgaaatcagtagcgtcatcggcggccgggagggcggagggacgagggaagtcggcgagagggagactgggttgggggaggggttcaggcctgttccccgcggctgcggcagcaccagggccggccgccaccgcctctagaacgcggaggaggtgggtcctgggaagcgggatgtccatcgctccagcttggtggtgaatgctgaggagagtcactgttgctgcagtctgtgccacccggaggaagttgtgtgaggccgggcgggagctcgcggcgctctggggaatcgaaacgcggggtcggtgcgaagactctgctgctgccagaccctttcctattctggccatgcctggaaggaacaaggcgaagtctacctgcagctgccctgacctgcagcccaatggacaggatctgggcgagaacagccgggttgcccgtctaggagcggatgaatctgaggaagagggacggagggggtctctcagtaatgctggggaccctgagatcgtcaagtctcccagcgaccccaagcaataccgatacatcaaattacagaatggcttgcaggcacttctgatttcagacctaagtaatatggaaggtaaaacaggaaatacaacagatgatgaagaagaagaggaggtggaggaagaagaagaagatgatgatgaagattctggagctgaaatagaagatgacgatgaagagggttttgatgatgaagatgagtttgatgatgaacatgatgatgatcttgatactgaggataatgaattggaagaattagaagagagagcagaagctagaaaaaaaactactgaaaaacagtctgcagcggctctttgtgttggagttgggagtttcgctgatccagatgacctgccggggctggcacactttttggagcacatggtattcatgggtagtttgaaatatccagatgagaatggatttgatgccttcctgaagaagcatgggggtagtgataatgcctcaactgattgtgaacgcactgtctttcagtttgatgtccagaggaagtacttcaaggaagctcttgatagatgggcgcagttcttcatccacccactaatgatcagagatgcaattgaccgtgaagttgaagctgttgatagtgaatatcaacttgcaaggccttctgatgcaaacagaaaggaaatgttgtttggaagccttgctagacctggccatcctatgggaaaatttttttggggaaatgctgagacgctcaagcatgagccaagaaagaataatattgatacacatgctagattgagagaattctggatgcgttactactcttctcattacatgactttagtggttcaatccaaagaaacactggatactttggaaaagtgggtgactgaaatcttctctcagataccaaacaatgggttacccagaccaaactttggccatttaacggatccatttgacacaccagcatttaacaaactttatagagttgttccaatcagaaaaattcatgctctgaccatcacatgggcacttcctcctcaacagcaacattacagggtgaagccacttcattatatatcctggctggttggacatgaaggcaaaggcagcattctttctttccttaggaaaaaatgctgggctcttgcactgtttggtggaaatggtgagacaggatttgagcaaaattctacttattcagtgttcagcatttctattacattgactgatgagggttatgaacatttttatgaggttgcttacactgtctttcagtatttaaaaatgctgcagaagctaggcccagaaaaaagaatttttgaagagattcggaaaattgaggataatgaatttcattaccaagaacagacagatccagttgagtatgtggaaaacatgtgtgagaacatgcagctgtacccattgcaggacattctcactggagatcagcttctttttgaatacaagccagaagtcattggtgaagccttgaatcagctagttcctcaaaaagcaaatcttgttttactgtctggtgctaatgagggaaaatgtgacctcaaggagaaatggtttggaactcaatatagtatagaagatattgaaaactcttgggctgaactgtggaatagtaatttcgaattaaatccagatcttcatcttccagctgaaaacaagtacatagccacggactttacgttgaaggctttcgattgcccggaaacagaatacccagttaaaattgtgaatactccacaaggttgcctgtggtataagaaagacaacaaattcaaaatccccaaagcatatatacgtttccatctaatttcaccgttgatacagaaatctgcagcaaatgtggtcctctttgatatctttgtcaatatccttacgcataaccttgcggaaccagcttatgaagcagatgtggcacagctggagtataaactggtagctggagaacatggtttaattattcgagtgaaaggatttaaccacaaactacctctactgtttcagctcattattgactacttagctgagttcaattccacaccagctgtctttacaatgataactgagcagttgaagaagacctactttaacatcctcatcaagcctgagactttggccaaagatgtacggcttttaatcttggaatatgcccgttggtctatgattgacaagtaccaggctttgatggacggcctttcccttgagtctctgctgagcttcgtcaaagaattcaaatcccagctctttgtggagggcctggtacaagggaatgtcacaagcacagaatctatggatttcctgaaatatgttgttgacaaactaaacttcaagcctctggagcaggagatgcctgtgcagttccaggtggtagagctgcccagtggccaccatctatgcaaagtgaaagctctgaacaagggtgatgccaactctgaagtcactgtgtactaccagtcaggtaccaggagtctaagagaatatacgcttatggagctgcttgtgatgcacatggaagaaccttgttttgacttccttcgaaccaagcagacccttgggtaccatgtctaccctacctgtaggaacacatccgggattctaggattttctgtcactgtggggactcaggcaaccaaatacaattctgaagttgttgataagaagatagaagagtttctttctagctttgaggagaagattgagaacctcactgaagaggcattcaacacccaggtcacagctctcatcaagctgaaggagtgtgaggatacccaccttggggaggaggtggataggaactggaatgaagtggttacacagcagtacctctttgaccgccttgcccacgagattgaagcactgaagtcattctcaaaatcagacctggtcaactggttcaaggcccatagagggccaggaagtaaaatgctcagcgttcatgtgagtatgtttaactaactccatccattctagggttgtcatttactgagtgagtttgggtggttatcatcagaactcttaaacccctaaatctggtcagcatatttttcacttttgtctttgtcctctttcaggttgttggatatgggaagtatgaactggaagaggatggtaccccttctagtgaggattcaaattcttcttgtgaagtgatgcagctgacctacctgccaacctctcctctgctggcagattgtatcatccccattactgatatcagggctttcacaacaacactcaaccttctcccctaccataaaatagtcaaataaataaactgcagtcacgttggcctgaagcaatgt

SEQ ID NO: 448531 - DNA, 3514 bp, Homo sapiens
gttcgctggctgttccgagaatcagtccgggtcacgttggtgcctctcctttcctgttctgattggttgcttacgtgagcgtgactactttcttgcctcatgattggctgaaatcagtagcgtcatcggcggccgggagggcggagggacgagggaagtcggcgagagggagactgggttgggggaggggttcaggcctgttccccgcggctgcggcagcaccagggccggccgccaccgcctctagaacgcggaggaggtgggtcctgggaagcgggatgtccatcgctccagcttggtggtgaatgctgaggagagtcactgttgctgcagtctgtgccacccggaggaagttgtgtgaggccgggcgggagctcgcggcgctctggggaatcgaaacgcggggtcggtgcgaagactctgctgctgccagaccctttcctattctggccatgcctggaaggaacaaggcgaagtctacctgcagctgccctgacctgcagcccaatggacaggatctgggcgagaacagccgggttgcccgtctaggagcggatgaatctgaggaagagggacggagggggtctctcagtaatgctggggaccctgagatcgtcaagtctcccagcgaccccaagcaataccgatacatcaaattacagaatggcttgcaggcacttctgatttcagacctaagtaatatggaaggtaaaacaggaaatacaacagatgatgaagaagaagaggaggtggaggaagaagaagaagatgatgatgaagattctggagctgaaatagaagatgacgatgaagagggttttgatgatgaagatgagtttgatgatgaacatgatgatgatcttgatactgaggataatgaattggaagaattagaagagagagcagaagctagaaaaaaaactactgaaaaacagtctgcagcggctctttgtgttggagttgggagtttcgctgatccagatgacctgccggggctggcacactttttggagcacatggtattcatgggtagtttgaaatatccagatgagaatggatttgatgccttcctgaagaagcatgggggtagtgataatgcctcaactgattgtgaacgcactgtctttcagtttgatgtccagaggaagtacttcaaggaagctcttgatagatgggcgcagttcttcatccacccactaatgatcagagatgcaattgaccgtgaagttgaagctgttgatagtgaatatcaacttgcaaggccttctgatgcaaacagaaaggaaatgttgtttggaagccttgctagacctggccatcctatgggaaaatttttttggggaaatgctgagacgctcaagcatgagccaagaaagaataatattgatacacatgctagattgagagaattctggatgcgttactactcttctcattacatgactttagtggttcaatccaaagaaacactggatactttggaaaagtgggtgactgaaatcttctctcagataccaaacaatgggttacccagaccaaactttggccatttaacggatccatttgacacaccagcatttaacaaactttatagagttgttccaatcagaaaaattcatgctctgaccatcacatgggcacttcctcctcaacagcaacattacagggtgaagccacttcattatatatcctggctggttggacatgaaggcaaaggcagcattctttctttccttaggaaaaaatgctgggctcttgcactgtttggtggaaatggtgagacaggatttgagcaaaattctacttattcagtgttcagcatttctattacattgactgatgagggttatgaacatttttatgaggttgcttacactgtctttcagtatttaaaaatgctgcagaagctaggcccagaaaaaagaatttttgaagagattcggaaaattgaggataatgaatttcattaccaagaacagacagatccagttgagtatgtggaaaacatgtgtgagaacatgcagctgtacccattgcaggacattctcactggagatcagcttctttttgaatacaagccagaagtcattggtgaagccttgaatcagctagttcctcaaaaagcaaatcttgttttactgtctggtgctaatgagggaaaatgtgacctcaaggagaaatggtttggaactcaatatagtatagaagatattgaaaactcttgggctgaactgtggaatagtaatttcgaattaaatccagatcttcatcttccagctgaaaacaagtacatagccacggactttacgttgaaggctttcgattgcccggaaacagaatacccagttaaaattgtgaatactccacaaggttgcctgtggtataagaaagacaacaaattcaaaatccccaaagcatatatacgtttccatctaatttcaccgttgatacagaaatctgcagcaaatgtggtcctctttgatatctttgtcaatatccttacgcataaccttgcggaaccagcttatgaagcagatgtggcacagctggagtataaactggtagctggagaacatggtttaattattcgagtgaaaggatttaaccacaaactacctctactgtttcagctcattattgactacttagctgagttcaattccacaccagctgtctttacaatgataactgagcagttgaagaagacctactttaacatcctcatcaagcctgagactttggccaaagatgtacggcttttaatcttggaatatgcccgttggtctatgattgacaagtaccaggctttgatggacggcctttcccttgagtctctgctgagcttcgtcaaagaattcaaatcccagctctttgtggagggcctggtacaagggaatgtcacaagcacagtgagtgtgagatgctctgtaggccaggtctgaatgcagttgtgaactctggaattgccatagttctttcctaaaggggaagctgtagttttggcaggccagcattatcatattctgtttagaagggaacctgacccctctgatgctgggcagctttcttcttaagatgaagactgctgggctgggaatgatggctcacgcctgtaatttcagcattttgggaggccaaggcagaagcattacttaaggtcaggatttcgagaccagtccaggcaacacagtgagaactcatccctacaaaaaataaaaaattagccaggcatggtggcacatgcctatagtctccgctacttgggaggctgaggtggaaggatcatttgagcccaggagtttggggctacagcatgctatgattgcaccacagtattccagcctgggcaacagagtaagaccctgtctcaaaagaaaagaaataaagaaagagagagagaaaaatagattgctggtaatagactaggattttgagtgaaatgggtttggcgtatctatactgtttgttacctttgttgaagattgtatgtggaaaccatgaacagtttagtata

SEQ ID NO: 448532 - DNA, 2372 bp, Homo sapiens
gttcgctggctgttccgagaatcagtccgggtcacgttggtgcctctcctttcctgttctgattggttgcttacgtgagcgtgactactttcttgcctcatgattggctgaaatcagtagcgtcatcggcggccgggagggcggagggacgagggaagtcggcgagagggagactgggttgggggaggggttcaggcctgttccccgcggctgcggcagcaccagggccggccgccaccgcctctagaacgcggaggaggtgggtcctgggaagcgggatgtccatcgctccagcttggtggtgaatgctgaggagagtcactgttgctgcagtctgtgccacccggaggaagttgtgtgaggccgggcgggagctcgcggcgctctggggaatcgaaacgcggggtcggtgcgaagactctgctgctgccagaccctttcctattctggccatgcctggaaggaacaaggcgaagtctacctgcagctgccctgacctgcagcccaatggacaggatctgggcgagaacagccgggttgcccgtctaggagcggatgaatctgaggaagagggacggagggggtctctcagtaatgctggggaccctgagatcgtcaagtctcccagcgaccccaagcaataccgatacatcaaattacagaatggcttgcaggcacttctgatttcagacctaagtaatatggaaggtaaaacaggaaatacaacagatgatgaagaagaagaggaggtggaggaagaagaagaagatgatgatgaagattctggagctgaaatagaagatgacgatgaagagggttttgatgatgaagatgagtttgatgatgaacatgatgatgatcttgatactgaggataatgaattggaagaattagaagagagagcagaagctagaaaaaaaactactgaaaaacagtctgcagcggctctttgtgttggagttgggagtttcgctgatccagatgacctgccggggctggcacactttttggagcacatggtattcatgggtagtttgaaatatccagatgagaatggatttgatgccttcctgaagaagcatgggggtagtgataatgcctcaactgattgtgaacgcactgtctttcagtttgatgtccagaggaagtacttcaaggaagctcttgatagatgggcgcagttcttcatccacccactaatgatcagagatgcaattgaccgtgaagttgaagctgttgatagtgaatatcaacttgcaaggccttctgatgcaaacagaaaggaaatgttgtttggaagccttgctagacctggccatcctatgggaaaatttttttggggaaatgctgagacgctcaagcatgagccaagaaagaataatattgatacacatgctagattgagagaattctggatgcgttactactcttctcattacatgactttagtggttcaatccaaagaaacactggatactttggaaaagtgggtgactgaaatcttctctcagataccaaacaatgggttacccagaccaaactttggccatttaacggatccatttgacacaccagcatttaacaaactttatagagttgttccaatcagaaaaattcatgctctgaccatcacatgggcacttcctcctcaacagcaacattacagggtgaagccacttcattatatatcctggctggttggacatgaaggcaaaggcagcattctttctttccttaggaaaaagcaagtattcaattaataagtattttcagtatagcaatctctgaaaaatagtagacaataagtattatataatgcattcttttactttagctgccaggaagcctagaataaaatttaatgcttaattatagttattttaataacttacattattttaatggccatattatatttgtgtatttccttgtaagccaccttttagcccattgttggaagttatttgtacacaaaattttaaaaaatcataaatgaaattaatagattccagaattacataaaagaattagctctaatcaagaatttatatttgactgaatggtaaagaaatcaattatttaaatgccatggatctccaggctttcctaacccccaaggctagactttaatgaaaacttcattgggtaggtaaatcatagttaataggtgggactgcaaatggtatatgcagccatgttagcagaatgtttcctaagcattaaagcacctgtttaagtcacctatagccaaataatagaaatacaattttagaatcaagactaatatattaaagtaattccttgtttgatttttctataaatgaatagtatgagaatggaaggatagatgagacatttaaataagtattttt

SEQ ID NO: 448533 - DNA, 845 bp, Homo sapiens
agcggatttgagcaaaattctacttattcagtgttcagcatttctattacattgacgatgaagagggttttgatgatgaagatgagtttgatgatgaacatgatgatgatcttgatactgaggataatgaattggaagaattagaagagagagcagaagctagaaaaaaaactactgaaaaacagcaattgcagagcctgtttttgctgtggtcaaagctgactgatagactgtggtttaagtcaacttattcaaaaatgtcttcaaccctgctggtcgagacaagaaatctttatggggtagttggagctgaaagcaggttaggcacctattaaaacatcacagaacaggttagattgtggtttgaagaactggatattccccaatgttttaactgagtttatgtgcctaagtcttcaaaatggggtttatagtatcaagtgaggctgtttggttcttctgaaaacacactcattttctgacacatggctagactttatgccaggtacatgctatttttgaaaagctcttttttaagaggtaactgtttattaaaacaatctgtttcaccaaatatgttagccctgtaaaattgacatttacaaaagtttgaagaaaacaaatttgggaaagttaataattcgcctttctatcttcaaggattcaaattgaccgttttttctcctttttttgtcttttaacttactgtaattatgccccaatagttcgggtgcagtggtcacgcctataatcccagcactttgagaggctgaggtgggaggattgtttgagtccaggagtttgagaccagcctgggcctcatagcaagacccctgtcttaaaaa

SEQ ID NO: 448534 - DNA, 576 bp, Homo sapiens
ttacccagaccaaactttggccatttaacggatccatttgacacaccagcatttaacaaactttatagaggtttgtgaaccaaaagtttaaaactgtttgaaataatgttagcacattctctataacctaattgaagctgccaattttcattgaaaatgagaacacaacagaaaatacagctgggttggaaaggaagtagatgggcaatggagatctaattaataatagatagcagaccactgactagctgcagatcgattgattctggtgccctgctgctacttcagtctatttcatgctttctccttgttttacctttcttcccttttgttctctgttttgttaaattttcattcatgtttcattttatttatattctgctcttttgcctttaaatgaataaaaatagatgagagggaaaacactttggcaatcgtttccttttaaattcattgtgaaagtaatatttgctaaataaaaatataaaatgtcaagaaatgggagataaatcacccttaaatcttaccatgaagagaagtcatttgtatcggatttcttttttttttttttggaga

SEQ ID NO: 448535 - DNA, 470 bp, Homo sapiens
gtaccatgtctaccctacctgtaggaacacatccgggattctaggattttctgtcactgtggggactcaggcaaccaaatacaagtgagtgagtgagtgaatagatgagtgtaacctattatggacatggagagtaggggctacatgtgtttccttaaaccttgggcaaccctgaccaagcaggtttgctctatttagtcagtggaagctgggaagatgggggttgttatagatggtctgttccaggactgatcaatagttccagtggccctttcagacttgattcaagtcctgtggtcattgtgtggggcttgccagtgtttcttctcttcaggcagacctgaggacaagaagggaaaggatgcctgatctgacaggcattgctgaaacctgttagttttcagctttggaatggtcatacatggttgtgactgcttcattatgaggataccaggaaactgggctggagg

SEQ ID NO: 448536 - DNA, 569 bp, Homo sapiens
tcaggtaccaggagtctaagagaatatacgcttatggagctgcttgtggtaagtgcataaaggagatgctgaggttttcagcagcccctgacccactatgaggcccggccttttctgcctgggttagggacatggggtagtcagagatctgtgatttgaaggtgagatggtcatttactgttctcacccagtataagcctgggccaattaggaaaaaggcactaagggaggctggacttgggaggtatgtgaaacactctggggagagaaatggaggtttctctgctgggaggagttgggctgatgggcagtatgttgaattacagatgcacatggaagaaccttgttttgacttccttcgaaccaagcagacccttgggtaagtcagctggcagggccactgagctcaaataagggcctagggcttactttgcaggctgttcatcagatatccctactgagcagcctgttagagcttccttccatctcatagggtgatatttagtcatccaaacttttggaatttgtatctttgactgtaatcaggttttcagtttggtcaagtttca

SEQ ID NO: 448537 - DNA, 3998 bp, Homo sapiens
gttcgctggctgttccgagaatcagtccgggtcacgttggtgcctctcctttcctgttctgattggttgcttacgtgagcgtgactactttcttgcctcatgattggctgaaatcagtagcgtcatcggcggccgggagggcggagggacgagggaagtcggcgagagggagactgggttgggggaggggttcaggcctgttccccgcggctgcggcagcaccagggccggccgccaccgcctctagaacgcggaggaggtgggtcctgggaagcgggatgtccatcgctccagcttggtggtgaatgctgaggagagtcactgttgctgcagtctgtgccacccggaggaagttgtgtgaggccgggcgggagctcgcggcgctctggggaatcgaaacgcggggtcggtgcgaagactctgctgctgccagaccctttcctattctggccatgcctggaaggaacaaggcgaagtctacctgcagctgccctgacctgcagcccaatggacaggatctgggcgagaacagccgggttgcccgtctaggagcggatgaatctgaggaagagggacggagggggtctctcagtaatgctggggaccctgagatcgtcaagtctcccagcgaccccaagcaataccgatacatcaaattacagaatggcttgcaggcacttctgatttcagacctaagtaatatggaaggtaaaacaggaaatacaacagatgatgaagaagaagaggaggtggaggaagaagaagaagatgatgatgaagattctggagctgaaatagaagatgacgatgaagagggttttgatgatgaagatgagtttgatgatgaacatgatgatgatcttgatactgaggataatgaattggaagaattagaagagagagcagaagctagaaaaaaaactactgaaaaacagcaattgcagagcctgtttttgctgtggtcaaagctgactgatagactgtggtttaagtcaacttattcaaaaatgtcttcaaccctgctggtcgagacaagaaatctttatggggtagttggagctgaaagcaggtctgcacctgttcagcatttggcaggatggcaagcggaggagcagcagggtgaaactgacacagttctgtctgcagcggctctttgtgttggagttgggagtttcgctgatccagatgacctgccggggctggcacactttttggagcacatggtattcatgggtagtttgaaatatccagatgagaatggatttgatgccttcctgaagaagcatgggggtagtgataatgcctcaactgattgtgaacgcactgtctttcagtttgatgtccagaggaagtacttcaaggaagctcttgatagatgggcgcagttcttcatccacccactaatgatcagagatgcaattgaccgtgaagttgaagctgttgatagtgaatatcaacttgcaaggccttctgatgcaaacagaaaggaaatgttgtttggaagccttgctagacctggccatcctatgggaaaatttttttggggaaatgctgagacgctcaagcatgagccaagaaagaataatattgatacacatgctagattgagagaattctggatgcgttactactcttctcattacatgactttagtggttcaatccaaagaaacactggatactttggaaaagtgggtgactgaaatcttctctcagataccaaacaatgggttacccagaccaaactttggccatttaacggatccatttgacacaccagcatttaacaaactttatagagttgttccaatcagaaaaattcatgctctgaccatcacatgggcacttcctcctcaacagcaacattacagggtgaagccacttcattatatatcctggctggttggacatgaaggcaaaggcagcattctttctttccttaggaaaaaatgctgggctcttgcactgtttggtggaaatggtgagacaggatttgagcaaaattctacttattcagtgttcagcatttctattacattgactgatgagggttatgaacatttttatgaggttgcttacactgtctttcagtatttaaaaatgctgcagaagctaggcccagaaaaaagaatttttgaagagattcggaaaattgaggataatgaatttcattaccaagaacagacagatccagttgagtatgtggaaaacatgtgtgagaacatgcagctgtacccattgcaggacattctcactggagatcagcttctttttgaatacaagccagaagtcattggtgaagccttgaatcagctagttcctcaaaaagcaaatcttgttttactgtctggtgctaatgagggaaaatgtgacctcaaggagaaatggtttggaactcaatatagtatagaagatattgaaaactcttgggctgaactgtggaatagtaatttcgaattaaatccagatcttcatcttccagctgaaaacaagtacatagccacggactttacgttgaaggctttcgattgcccggaaacagaatacccagttaaaattgtgaatactccacaaggttgcctgtggtataagaaagacaacaaattcaaaatccccaaagcatatatacgtttccatctaatttcaccgttgatacagaaatctgcagcaaatgtggtcctctttgatatctttgtcaatatccttacgcataaccttgcggaaccagcttatgaagcagatgtggcacagctggagtataaactggtagctggagaacatggtttaattattcgagtgaaaggatttaaccacaaactacctctactgtttcagctcattattgactacttagctgagttcaattccacaccagctgtctttacaatgataactgagcagttgaagaagacctactttaacatcctcatcaagcctgagactttggccaaagatgtacggcttttaatcttggaatatgcccgttggtctatgattgacaagtaccaggctttgatggacggcctttcccttgagtctctgctgagcttcgtcaaagaattcaaatcccagctctttgtggagggcctggtacaagggaatgtcacaagcacagaatctatggatttcctgaaatatgttgttgacaaactaaacttcaagcctctggagcaggagatgcctgtgcagttccaggtggtagagctgcccagtggccaccatctatgcaaagtgaaagctctgaacaagggtgatgccaactctgaagtcactgtgtactaccagtcaggtaccaggagtctaagagaatatacgcttatggagctgcttgtgatgcacatggaagaaccttgttttgacttccttcgaaccaagcagacccttgggtaccatgtctaccctacctgtaggaacacatccgggattctaggattttctgtcactgtggggactcaggcaaccaaatacaattctgaagttgttgataagaagatagaagagtttctttctagctttgaggagaagattgagaacctcactgaagaggcattcaacacccaggtcacagctctcatcaagctgaaggagtgtgaggatacccaccttggggaggaggtggataggaactggaatgaagtggttacacagcagtacctctttgaccgccttgcccacgagattgaagcactgaagtcattctcaaaatcagacctggtcaactggttcaaggcccatagagggccaggaagtaaaatgctcagcgttcatgttgttggatatgggaagtatgaactggaagaggatggtaccccttctagtgaggattcaaattcttcttgtgaagtgatgcagctgacctacctgccaacctctcctctgctggcagattgtatcatccccattactgatatcagggctttcacaacaacactcaaccttctcccctaccataaaatagtcaaataaataaactgcagtcacgttggcctgaagcaatgt

SEQ ID NO: 448538 - DNA, 727 bp, Homo sapiens
gttcgctggctgttccgagaatcagtccgggtcacgttggtgcctctcctttcctgttctgattggttgcttacgtgagcgtgactactttcttgcctcatgattggctgaaatcagtagcgtcatcggcggccgggagggcggagggacgagggaagtcggcgagagggagactgggttgggggaggggttcaggcctgttccccgcggctgcggcagcaccagggccggccgccaccgcctctagaacgcggaggaggtgggtcctgggaagcgggatgtccatcgctccagcttggtggtgaatgctgaggagagtcactgttgctgcagtctgtgccacccggaggaagttgtgtgaggccgggcgggagctcgcggcgctctggggaatcgaaacgcggggtcggtgcgaagactctgctgctgccagaccctttcctattctggccatgcctggaaggaacaaggcgaagtctacctgcagctgccctgacctgcagcccaatggacaggatctgggcgagaacagccgggttgcccgtctaggagcggatgaatctgaggaagagggacggagggggtctctcagtaatgctggggaccctgagatcgtcaagtctcccagcgaccccaagcaataccgagtctccatctgtcacccatgctggagtgccatggcgcaatcttggctcactgcaacctcttcctccctggctcaagtgaa

SEQ ID NO: 448539 - DNA, 2120 bp, Homo sapiens
ccagtgatgaaggatccatgaatgcattcacaggaagggggtcacctggtaggggtcaaaagactaaagtctgtaccacaccttcatctggtcatgctgcatctgggaaggactcaagcagcagattggctgttacagaccccactcggcctggtgccaccaccaaaatcaccaccacctccacctacatttctgcctctacacttaaagttaacaagaaaaccaaagggctcattgatggccttactaagttttttacaccatcacctgatggtcgcagatcacgaggtgaaattatagactttacagatccagttgagtatgtggaaaacatgtgtgagaacatgcagctgtacccattgcaggacattctcactggagatcagcttctttttgaatacaagccagaagtcattggtgaagccttgaatcagctagttcctcaaaaagcaaatcttgttttactgtctggtgctaatgagggaaaatgtgacctcaaggagaaatggtttggaactcaatatagtatagaagatattgaaaactcttgggctgaactgtggaatagtaatttcgaattaaatccagatcttcatcttccagctgaaaacaagtacatagccacggactttacgttgaaggctttcgattgcccggaaacagaatacccagttaaaattgtgaatactccacaaggttgcctgtggtataagaaagacaacaaattcaaaatccccaaagcatatatacgtttccatctaatttcaccgttgatacagaaatctgcagcaaatgtggtcctctttgatatctttgtcaatatccttacgcataaccttgcggaaccagcttatgaagcagatgtggcacagctggagtataaactggtagctggagaacatggtttaattattcgagtgaaaggatttaaccacaaactacctctactgtttcagctcattattgactacttagctgagttcaattccacaccagctgtctttacaatgataactgagcagttgaagaagacctactttaacatcctcatcaagcctgagactttggccaaagatgtacggcttttaatcttggaatatgcccgttggtctatgattgacaagtaccaggctttgatggacggcctttcccttgagtctctgctgagcttcgtcaaagaattcaaatcccagctctttgtggagggcctggtacaagggaatgtcacaagcacagaatctatggatttcctgaaatatgttgttgacaaactaaacttcaagcctctggagcaggagatgcctgtgcagttccaggtggtagagctgcccagtggccaccatctatgcaaagtgaaagctctgaacaagggtgatgccaactctgaagtcactgtgtactaccagtcaggtaccaggagtctaagagaatatacgcttatggagctgcttgtgatgcacatggaagaaccttgttttgacttccttcgaaccaagcagacccttgggtaccatgtctaccctacctgtaggaacacatccgggattctaggattttctgtcactgtggggactcaggcaaccaaatacaattctgaagttgttgataagaagatagaagagtttctttctagctttgaggagaagattgagaacctcactgaagaggcattcaacacccaggtcacagctctcatcaagctgaaggagtgtgaggatacccaccttggggaggaggtggataggaactggaatgaagtggttacacagcagtacctctttgaccgccttgcccacgagattgaagcactgaagtcattctcaaaatcagacctggtcaactggttcaaggcccatagagggccaggaagtaaaatgctcagcgttcatgttgttggatatgggaagtatgaactggaagaggatggtaccccttctagtgaggattcaaattcttcttgtgaagtgatgcagctgacctacctgccaacctctcctctgctggcagattgtatcatccccattactgatatcagggctttcacaacaacactcaaccttctcccctaccataaaatagtcaaataaataaactgcagtcacgttggcctgaagcaatgt

SEQ ID NO: 448540 - DNA, 4314 bp, Homo sapiens
gttcgctggctgttccgagaatcagtccgggtcacgttggtgcctctcctttcctgttctgattggttgcttacgtgagcgtgactactttcttgcctcatgattggctgaaatcagtagcgtcatcggcggccgggagggcggagggacgagggaagtcggcgagagggagactgggttgggggaggggttcaggcctgttccccgcggctgcggcagcaccagggccggccgccaccgcctctagaacgcggaggaggtgggtcctgggaagcgggatgtccatcgctccagcttggtggtgaatgctgaggagagtcactgttgctgcagtctgtgccacccggaggaagttgtgtgaggccgggcgggagctcgcggcgctctggggaatcgaaacgcggggtcggtgcgaagactctgctgctgccagaccctttcctattctggccatgcctggaaggaacaaggcgaagtctacctgcagctgccctgacctgcagcccaatggacaggatctgggcgagaacagccgggttgcccgtctaggagcggatgaatctgaggaagagggacggagggggtctctcagtaatgctggggaccctgagatcgtcaagtctcccagcgaccccaagcaataccgatacatcaaattacagaatggcttgcaggcacttctgatttcagacctaagtaatatggaaggtaaaacaggaaatacaacagatgatgaagaagaagaggaggtggaggaagaagaagaagatgatgatgaagattctggagctgaaatagaagatgacgatgaagagggttttgatgatgaagatgagtttgatgatgaacatgatgatgatcttgatactgaggataatgaattggaagaattagaagagagagcagaagctagaaaaaaaactactgaaaaacagtctgcagcggctctttgtgttggagttgggagtttcgctgatccagatgacctgccggggctggcacactttttggagcacatggtattcatgggtagtttgaaatatccagatgagaatggatttgatgccttcctgaagaagcatgggggtagtgataatgcctcaactgattgtgaacgcactgtctttcagtttgatgtccagaggaagtacttcaaggaagctcttgatagatgggcgcagttcttcatccacccactaatgatcagagatgcaattgaccgtgaagttgaagctgttgatagtgaatatcaacttgcaaggccttctgatgcaaacagaaaggaaatgttgtttggaagccttgctagacctggccatcctatgggaaaatttttttggggaaatgctgagacgctcaagcatgagccaagaaagaataatattgatacacatgctagattgagagaattctggatgcgttactactcttctcattacatgactttagtggttcaatccaaagaaacactggatactttggaaaagtgggtgactgaaatcttctctcagataccaaacaatgggttacccagaccaaactttggccatttaacggatccatttgacacaccagcatttaacaaactttatagagttgttccaatcagaaaaattcatgctctgaccatcacatgggcacttcctcctcaacagcaacattacagggtgaagccacttcattatatatcctggctggttggacatgaaggcaaaggcagcattctttctttccttaggaaaaaatgctgggctcttgcactgtttggtggaaatggtgagacaggatttgagcaaaattctacttattcagtgttcagcatttctattacattgactgatgagggttatgaacatttttatgaggttgcttacactgtctttcagtatttaaaaatgctgcagaagctaggcccagaaaaaagaatttttgaagagattcggaaaattgaggataatgaatttcattaccaagaacagacagatccagttgagtatgtggaaaacatgtgtgagaacatgcagctgtacccattgcaggacattctcactggagatcagcttctttttgaatacaagccagaagtcattggtgaagccttgaatcagctagttcctcaaaaagcaaatcttgttttactgtctggtgctaatgagggaaaatgtgacctcaaggagaaatggtttggaactcaatatagtatagaagatattgaaaactcttgggctgaactgtggaatagtaatttcgaattaaatccagatcttcatcttccagctgaaaacaagtacatagccacggactttacgttgaaggctttcgattgcccggaaacagaatacccagttaaaattgtgaatactccacaaggttgcctgtggtataagaaagacaacaaattcaaaatccccaaagcatatatacgtttccatctaatttcaccgttgatacagaaatctgcagcaaatgtggtcctctttgatatctttgtcaatatccttacgcataaccttgcggaaccagcttatgaagcagatgtggcacagctggagtataaactggtagctggagaacatggtttaattattcgagtgaaaggatttaaccacaaactacctctactgtttcagctcattattgactacttagctgagttcaattccacaccagctgtctttacaatgataactgagcagttgaagaagacctactttaacatcctcatcaagcctgagactttggccaaagatgtacggcttttaatcttggaatatgcccgttggtctatgattgacaagtaccaggctttgatggacggcctttcccttgagtctctgctgagcttcgtcaaagaattcaaatcccagctctttgtggagggcctggtacaagggaatgtcacaagcacagaatctatggatttcctgaaatatgttgttgacaaactaaacttcaagcctctggagcaggagatgcctgtgcagttccaggtggtagagctgcccagtggccaccatctatgcaaagtgaaagctctgaacaagggtgatgccaactctgaagtcactgtgtactaccagtcaggtaccaggagtctaagagaatatacgcttatggagctgcttgtgatgcacatggaagaaccttgttttgacttccttcgaaccaagcagacccttgggtaccatgtctaccctacctgtaggaacacatccgggattctaggattttctgtcactgtggggactcaggcaaccaaatacaattctgaagttgttgataagaagatagaagagtttctttctagctttgaggagaagattgagaacctcactgaagaggcattcaacacccaggtcacagctctcatcaagctgaaggagtgtgaggatacccaccttggggaggaggtggataggaactggaatgaagtggttacacagcagtacctctttgaccgccttgcccacgagattgaagcactgaagtcattctcaaaatcagacctggtcaactggttcaaggcccatagagggccaggaagtaaaatgctcagcgttcatgttgttggatatgggaagtatgaactggaagaggatggtaccccttctagtgaggattcaaattcttcttgtgaagtgatgcagctgacctacctgccaacctctcctctgctggcagattgtatcatccccattactgatatcagggctttcacaacaacactcaaccttctcccctaccataaaatagtcaaataaataaactgcagtcacgttggcctgaagcaatgtgtattttaaaatgtgtttgtttgtattttatggagttagttatactactgccttagggcttccattgaagttttgcactggcatcatagcatttgatttactttttatcctttgttgagactaataaacccagggttactgtaggagctggcaaaggaaaattagcagaatgggccaagcgagaccagaaagcctgcagcagcactttgagaagccctggcctgtgtcctctcagactgagaatctacttcttgaaaggccttacgtaaccagtatattgaataactaactaaatgctaggtactaatacctgtttttttaatgtatttttaaataaaaaagatgatagatagatagatagatatagttctgtatttcccttcagaatgagccatctgctgctgtggcattcattttattctatctatctatctatttttgttcactgtggggtggggatctataaatacacactcttcccaaaccctctaaggcaataaaacatttttggataaaatgt

SEQ ID NO: 448541 - DNA, 4448 bp, Homo sapiens
gttcgctggctgttccgagaatcagtccgggtcacgttggtgcctctcctttcctgttctgattggttgcttacgtgagcgtgactactttcttgcctcatgattggctgaaatcagtagcgtcatcggcggccgggagggcggagggacgagggaagtcggcgagagggagactgggttgggggaggggttcaggcctgttccccgcggctgcggcagcaccagggccggccgccaccgcctctagaacgcggaggaggtgggtcctgggaagcgggatgtccatcgctccagcttggtggtgaatgctgaggagagtcactgttgctgcagtctgtgccacccggaggaagttgtgtgaggccgggcgggagctcgcggcgctctggggaatcgaaacgcggggtcggtgcgaagactctgctgctgccagaccctttcctattctggccatgcctggaaggaacaaggcgaagtctacctgcagctgccctgacctgcagcccaatggacaggatctgggcgagaacagccgggttgcccgtctaggagcggatgaatctgaggaagagggacggagggggtctctcagtaatgctggggaccctgagatcgtcaagtctcccagcgaccccaagcaataccgatacatcaaattacagaatggcttgcaggcacttctgatttcagacctaagtaatatggaaggtaaaacaggaaatacaacagatgatgaagaagaagaggaggtggaggaagaagaagaagatgatgatgaagattctggagctgaaatagaagatgacgatgaagagggttttgatgatgaagatgagtttgatgatgaacatgatgatgatcttgatactgaggataatgaattggaagaattagaagagagagcagaagctagaaaaaaaactactgaaaaacagtctgcagcggctctttgtgttggagttgggagtttcgctgatccagatgacctgccggggctggcacactttttggagcacatggtattcatgggtagtttgaaatatccagatgagaatggatttgatgccttcctgaagaagcatgggggtagtgataatgcctcaactgattgtgaacgcactgtctttcagtttgatgtccagaggaagtacttcaaggaagctcttgatagatgggcgcagttcttcatccacccactaatgatcagagatgcaattgaccgtgaagttgaagctgttgatagtgaatatcaacttgcaaggccttctgatgcaaacagaaaggaaatgttgtttggaagccttgctagacctggccatcctatgggaaaatttttttggggaaatgctgagacgctcaagcatgagccaagaaagaataatattgatacacatgctagattgagagaattctggatgcgttactactcttctcattacatgactttagtggttcaatccaaagaaacactggatactttggaaaagtgggtgactgaaatcttctctcagataccaaacaatgggttacccagaccaaactttggccatttaacggatccatttgacacaccagcatttaacaaactttatagagttgttccaatcagaaaaattcatgctctgaccatcacatgggcacttcctcctcaacagcaacattacagggtgaagccacttcattatatatcctggctggttggacatgaaggcaaaggcagcattctttctttccttaggaaaaaatgctgggctcttgcactgtttggtggaaatggtgagacaggatttgagcaaaattctacttattcagtgttcagcatttctattacattgactgatgagggttatgaacatttttatgaggttgcttacactgtctttcagtatttaaaaatgctgcagaagctaggcccagaaaaaagaatttttgaagagattcggaaaattgaggataatgaatttcattaccaagaacagacagatccagttgagtatgtggaaaacatgtgtgagaacatgcagctgtacccattgcaggacattctcactggagatcagcttctttttgaatacaagccagaagtcattggtgaagccttgaatcagctagttcctcaaaaagcaaatcttgttttactgtctggtgctaatgagggaaaatgtgacctcaaggagaaatggtttggaactcaatatagtatagaagatattgaaaactcttgggctgaactgtggaatagtaatttcgaattaaatccagatcttcatcttccagctgaaaacaagtacatagccacggactttacgttgaaggctttcgattgcccggaaacagaatacccagttaaaattgtgaatactccacaaggttgcctgtggtataagaaagacaacaaattcaaaatccccaaagcatatatacgtttccatctaatttcaccgttgatacagaaatctgcagcaaatgtggtcctctttgatatctttgtcaatatccttacgcataaccttgcggaaccagcttatgaagcagatgtggcacagctggagtataaactggtagctggagaacatggtttaattattcgagtgaaaggatttaaccacaaactacctctactgtttcagctcattattgactacttagctgagttcaattccacaccagctgtctttacaatgataactgagcagttgaagaagacctactttaacatcctcatcaagcctgagactttggccaaagatgtacggcttttaatcttggaatatgcccgttggtctatgattgacaagtaccaggctttgatggacggcctttcccttgagtctctgctgagcttcgtcaaagaattcaaatcccagctctttgtggagggcctggtacaagggaatgtcacaagcacagaatctatggatttcctgaaatatgttgttgacaaactaaacttcaagcctctggagcaggagatgcctgtgcagttccaggtggtagagctgcccagtggccaccatctatgcaaagtgaaagctctgaacaagggtgatgccaactctgaagtcactgtgtactaccagtcaggtaccaggagtctaagagaatatacgcttatggagctgcttgtgatgcacatggaagaaccttgttttgacttccttcgaaccaagcagacccttgggtaccatgtctaccctacctgtaggaacacatccgggattctaggattttctgtcactgtggggactcaggcaaccaaatacaattctgaagttgttgataagaagatagaagagtttctttctagctttgaggagaagattgagaacctcactgaagaggcattcaacacccaggtcacagctctcatcaagctgaaggagtgtgaggatacccaccttggggaggaggtggataggaactggaatgaagtggttacacagcagtacctctttgaccgccttgcccacgagattgaagcactgaagtcattctcaaaatcagacctggtcaactggttcaaggcccatagagggccaggaagtaaaatgctcagcgttcatgtgagtatgtttaactaactccatccattctagggttgtcatttactgagtgagtttgggtggttatcatcagaactcttaaacccctaaatctggtcagcatatttttcacttttgtctttgtcctctttcaggttgttggatatgggaagtatgaactggaagaggatggtaccccttctagtgaggattcaaattcttcttgtgaagtgatgcagctgacctacctgccaacctctcctctgctggcagattgtatcatccccattactgatatcagggctttcacaacaacactcaaccttctcccctaccataaaatagtcaaataaataaactgcagtcacgttggcctgaagcaatgtgtattttaaaatgtgtttgtttgtattttatggagttagttatactactgccttagggcttccattgaagttttgcactggcatcatagcatttgatttactttttatcctttgttgagactaataaacccagggttactgtaggagctggcaaaggaaaattagcagaatgggccaagcgagaccagaaagcctgcagcagcactttgagaagccctggcctgtgtcctctcagactgagaatctacttcttgaaaggccttacgtaaccagtatattgaataactaactaaatgctaggtactaatacctgtttttttaatgtatttttaaataaaaaagatgatagatagatagatagatatagttctgtatttcccttcagaatgagccatctgctgctgtggcattcattttattctatctatctatctatttttgttcactgtggggtggggatctataaatacacactcttcccaaaccctctaaggcaataaaacatttttggataaaatgt

SEQ ID NO: 448542 - DNA, 3474 bp, Homo sapiens
gttcgctggctgttccgagaatcagtccgggtcacgttggtgcctctcctttcctgttctgattggttgcttacgtgagcgtgactactttcttgcctcatgattggctgaaatcagtagcgtcatcggcggccgggagggcggagggacgagggaagtcggcgagagggagactgggttgggggaggggttcaggcctgttccccgcggctgcggcagcaccagggccggccgccaccgcctctagaacgcggaggaggtgggtcctgggaagcgggatgtccatcgctccagcttggtggtgaatgctgaggagagtcactgttgctgcagtctgtgccacccggaggaagttgtgtgaggccgggcgggagctcgcggcgctctggggaatcgaaacgcggggtcggtgcgaagactctgctgctgccagaccctttcctattctggccatgcctggaaggaacaaggcgaagtctacctgcagctgccctgacctgcagcccaatggacaggatctgggcgagaacagccgggttgcccgtctaggagcggatgaatctgaggaagagggacggagggggtctctcagtaatgctggggaccctgagatcgtcaagtctcccagcgaccccaagcaataccgatacatcaaattacagaatggcttgcaggcacttctgatttcagacctaagtaatatggaaggtaaaacaggaaatacaacagatgatgaagaagaagaggaggtggaggaagaagaagaagatgatgatgaagattctggagctgaaatagaagatgacgatgaagagggttttgatgatgaagatgagtttgatgatgaacatgatgatgatcttgatactgaggataatgaattggaagaattagaagagagagcagaagctagaaaaaaaactactgaaaaacagtctgcagcggctctttgtgttggagttgggagtttcgctgatccagatgacctgccggggctggcacactttttggagcacatggtattcatgggtagtttgaaatatccagatgagaatggatttgatgccttcctgaagaagcatgggggtagtgataatgcctcaactgattgtgaacgcactgtctttcagtttgatgtccagaggaagtacttcaaggaagctcttgatagatgggcgcagttcttcatccacccactaatgatcagagatgcaattgaccgtgaagttgaagctgttgatagtgaatatcaacttgcaaggccttctgatgcaaacagaaaggaaatgttgtttggaagccttgctagacctggccatcctatgggaaaatttttttggggaaatgctgagacgctcaagcatgagccaagaaagaataatattgatacacatgctagattgagagaattctggatgcgttactactcttctcattacatgactttagtggttcaatccaaagaaacactggatactttggaaaagtgggtgactgaaatcttctctcagataccaaacaatgggttacccagaccaaactttggccatttaacggatccatttgacacaccagcatttaacaaactttatagagttgttccaatcagaaaaattcatgctctgaccatcacatgggcacttcctcctcaacagcaacattacagggtgaagccacttcattatatatcctggctggttggacatgaaggcaaaggcagcattctttctttccttaggaaaaaatgctgggctcttgcactgtttggtggaaatggtgagacaggatttgagcaaaattctacttattcagtgttcagcatttctattacattgactgatgagggttatgaacatttttatgaggttgcttacactgtctttcagtatttaaaaatgctgcagaagctaggcccagaaaaaagaatttttgaagagattcggaaaattgaggataatgaatttcattaccaagaacagacagatccagttgagtatgtggaaaacatgtgtgagaacatgcagctgtacccattgcaggacattctcactggagatcagcttctttttgaatacaagccagaagtcattggtgaagccttgaatcagctagttcctcaaaaagcaaatcttgttttactgtctggtgctaatgagggaaaatgtgacctcaaggagaaatggtttggaactcaatatagtatagaagatattgaaaactcttgggctgaactgtggaatagtaatttcgaattaaatccagatcttcatcttccagctgaaaacaagtacatagccacggactttacgttgaaggctttcgattgcccggaaacagaatacccagttaaaattgtgaatactccacaaggttgcctgtggtataagaaagacaacaaattcaaaatccccaaagcatatatacgtttccatctaatttcaccgttgatacagaaatctgcagcaaatgtggtcctctttgatatctttgtcaatatccttacgcataaccttgcggaaccagcttatgaagcagatgtggcacagctggagtataaactggtagctggagaacatggtttaattattcgagtgaaaggatttaaccacaaactacctctactgtttcagctcattattgactacttagctgagttcaattccacaccagctgtctttacaatgataactgagcagttgaagaagacctactttaacatcctcatcaagcctgagactttggccaaagatgtacggcttttaatcttggaatatgcccgttggtctatgattgacaagtaccaggctttgatggacggcctttcccttgagtctctgctgagcttcgtcaaagaattcaaatcccagctctttgtggagggcctggtacaagggaatgtcacaagcacagaatctatggatttcctgaaatatgttgttgacaaactaaacttcaagcctctggagcaggagatgcctgtgcagttccaggtggtagagctgcccagtggccaccatctatgcaaagtgaaagctctgaacaagggtgatgccaactctgaagtcactgtgtactaccagtcaggtaccaggagtctaagagaatatacgcttatggagctgcttgtgatgcacatggaagaaccttgttttgacttccttcgaaccaagcagacccttgggtaccatgtctaccctacctgtaggaacacatccgggattctaggattttctgtcactgtggggactcaggcaaccaaatacaattctgaagttgttgataagaagatagaagagtttctttctagctttgaggagaagattgagaacctcactgaagaggcattcaacacccaggtcacagctctcatcaagctgaaggagtgtgaggataccctaccataaaatagtcaaataaataaacagcgatgcggccgtttttctcaaataaaaaattttagccgggtgttattta

SEQ ID NO: 448543 - DNA, 2534 bp, Homo sapiens
  misc_feature (2366)..(2366): n is a, c, g, or t
  misc_feature (2437)..(2437): n is a, c, g, or t
  misc_feature (2487)..(2487): n is a, c, g, or t
  misc_feature (2531)..(2531): n is a, c, g, or t
gttcgctggctgttccgagaatcagtccgggtcacgttggtgcctctcctttcctgttctgattggttgcttacgtgagcgtgactactttcttgcctcatgattggctgaaatcagtagcgtcatcggcggccgggagggcggagggacgagggaagtcggcgagagggagactgggttgggggaggggttcaggcctgttccccgcggctgcggcagcaccagggccggccgccaccgcctctagaacgcggaggaggtgggtcctgggaagcgggatgtccatcgctccagcttggtggtgaatgctgaggagagtcactgttgctgcagtctgtgccacccggaggaagttgtgtgaggccgggcgggagctcgcggcgctctggggaatcgaaacgcggggtcggtgcgaagactctgctgctgccagaccctttcctattctggccatgcctggaaggaacaaggcgaagtctacctgcagctgccctgacctgcagcccaatggacaggatctgggcgagaacagccgggttgcccgtctaggagcggatgaatctgaggaagagggacggagggggtctctcagtaatgctggggaccctgagatcgtcaagtctcccagcgaccccaagcaataccgatacatcaaattacagaatggcttgcaggcacttctgatttcagacctaagtaatatggaaggtaaaacaggaaatacaacagatgatgaagaagaagaggaggtggaggaagaagaagaagatgatgatgaagattctggagctgaaatagaagatgacgatgaagagggttttgatgatgaagatgagtttgatgatgaacatgatgatgatcttgatactgaggataatgaattggaagaattagaagagagagcagaagctagaaaaaaaactactgaaaaacagtctgcagcggctctttgtgttggagttgggagtttcgctgatccagatgacctgccggggctggcacactttttggagcacatggtattcatgggtagtttgaaatatccagatgagaatggatttgatgccttcctgaagaagcatgggggtagtgataatgcctcaactgattgtgaacgcactgtctttcagtttgatgtccagaggaagtacttcaaggaagctcttgatagatgggcgcagttcttcatccacccactaatgatcagagatgcaattgaccgtgaagttgaagctgttgatagtgaatatcaacttgcaaggccttctgatgcaaacagaaaggaaatgttgtttggaagccttgctagacctggccatcctatgggaaaatttttttggggaaatgctgagacgctcaagcatgagccaagaaagaataatattgatacacatgctagattgagagaattctggatgcgttactactcttctcattacatgactttagtggttcaatccaaagaaacactggatactttggaaaagtgggtgactgaaatcttctctcagataccaaacaatgggttacccagaccaaactttggccatttaacggatccatttgacacaccagcatttaacaaactttatagagttgttccaatcagaaaaattcatgctctgaccatcacatgggcacttcctcctcaacagcaacattacagggtgaagccacttcattatatatcctggctggttggacatgaaggcaaaggcagcattctttctttccttaggaaaaaatgctgggctcttgcactgtttggtggaaatggtgagacaggatttgagcaaaattctacttattcagtgttcagcatttctattacattgactgatgagggttatgaacatttttatgaggttgcttacactgtctttcagtatttaaaaatgctgcagaagctaggcccagaaaaaagaatttttgaagagattcggaaaattgaggataatgaatttcattaccaagaacagacagatccagttgagtatgtggaaaacatgtgtgagaacatgcagctgtacccattgcaggacattctcactggagatcagcttctttttgaatacaagccagaagtcattggtgaagccttgaatcagctagttcctcaaaaagcaaatcttgttttactgtctggtgctaatgagggaaaatgtgacctcaaggagaaatggtttggaactcaatatagtatagaagatattgaaaactcttgggctgaactgtggaatagtaatttcgaattaaatccagatcttcatcttccagctgaaaacaagtacatagccacggactttacgttgaaggctttcgattgcccggaaacagaatacccagttaaaattgtgaaataaccnttcccacaaaggggttgccctggtgggtaataaagaaaaggacaaacaaaattcaaaaaatcccccaaaangcatatatacgtttccatccaatttcaccgttgatacagaaatcctgcancaaatgtggggccccccctttggaaaaccctttggccaaataanccc

SEQ ID NO: 448544 - DNA, 1337 bp, Homo sapiens
gttcgctggctgttccgagaatcagtccgggtcacgttggtgcctctcctttcctgttctgattggttgcttacgtgagcgtgactactttcttgcctcatgattggctgaaatcagtagcgtcatcggcggccgggagggcggagggacgagggaagtcggcgagagggagactgggttgggggaggggttcaggcctgttccccgcggctgcggcagcaccagggccggccgccaccgcctctagaacgcggaggaggtgggtcctgggaagcgggatgtccatcgctccagcttggtggtgaatgctgaggagagtcactgttgctgcagtctgtgccacccggaggaagttgtgtgaggccgggcgggagctcgcggcgctctggggaatcgaaacgcggggtcggtgcgaagactctgctgctgccagaccctttcctattctggccatgcctggaaggaacaaggcgaagtctacctgcagctgccctgacctgcagcccaatggacaggatctgggcgagaacagccgggttgcccgtctaggagcggatgaatctgaggaagagggacggagggggtctctcagtaatgctggggaccctgagatcgtcaagtctcccagcgaccccaagcaataccgatacatcaaattacagaatggcttgcaggcacttctgatttcagacctaagtaatatggaaggtaaaacaggaaatacaacagatgatgaagaagaagaggaggtggaggaagaagaagaagatgatgatgaagattctggagctgaaatagaagatgacgatgaagagggttttgatgatgaagatgagtttgatgatgaacatgatgatgatcttgatactgaggataatgaattggaagaattagaagagagagcagaagctagaaaaaaaactactgaaaaacagggtgcgagtcatgtctgttttcttctaatttgggaattctttgggtaacttctaaactcaagctttattttttaatggcaaaaaggaagtatatagttatcttttggtcttcagtaaaggtctattctgtatcaggattacattttgaaaacattttcctccaattataaaagtagtaaatgctcattatataaactaatggaatataaagaaaacaaaaatataaaaatcacctatagctatatctctcagaggtaatcaacactcagaggtatttgaatttatgtgtatttgtatacattatatgttttaaaaacaaatactggtagatgaggagctgcagaattcttagcctggattagagaaataagagtatgttatccttggtgagactggaaaaag

SEQ ID NO: 448545 - DNA, 6380 bp, Homo sapiens
  misc_feature (4522)..(4522): n is a, c, g, or t
cccccggcggagccagctgctgctcttcggtgctggccccggtgccggccccgttgcccagggaacaggctcccggcagcccccgcggcccggagtccatcccgcctcctccggcccggcggggccgacgagtccggaggggctgccgcgggagcccccaggtttccctagatgacaaataaacattccttttcctgcgtgaagatagtctgtggaaaccttggccatggcatcgatatcagagcctgttacattcagagagttctgcccgttgtactatctcctcaatgccattccgacaaagatccagaagggtttccgctctatcgtggtctatctcacggccctcgacaccaacggggactacatcgcggtgggcagcagcatcggcatgctctatctgtactgccggcacctcaaccagatgaggaagtacaactttgaggggaagacggaatctatcactgtggtgaagctgctgagctgctttgatgacctggtggcagcaggcacagcctctggcagggttgcagtttttcaacttgtatcttcattgccagggagaaataaacagcttcggagatttgatgtcactggtattcacaaaaatagcattacagctctggcttggagccccaatggaatgaaattgttctctggagatgacaaaggcaaaattgtttattcttctctggatctagaccaggggctctgtaactcccagctggtgttggaggagccatcttccattgtgcagctggattatagccagaaagtgctgctggtctctactctgcaaagaagtctgctcttttacactgaagaaaagtctgtaaggcaaattggaacacaaccaaggaaaagtactgggaaatttggtgcttgttttataccaggactctgtaagcaaagtgatctaaccttgtatgcgtcacggcccgggctccggctatggaaggctgatgtccacgggactgttcaagccacgtttatcttaaaagatgcttttgccgggggagtcaagccttttgaactgcacccgcgtctggaatcccccaacagtggaagttgcagcttacctgagaggcacctggggcttgtttcatgtttctttcaagaaggctgggtgctgagttggaatgaatatagtatctatctcctagacacagtcaaccaggccacaattgctggtttggaaggatccggtgatattgtgtctgtttcgtgcacagaaaatgaaatatttttcttgaaaggagataggaacattataagaatttcaagcaggcctgaaggattaacatcaacagtgagagatggtctggagatgtctggatgctcagagcgtgtccacgtgcagcaagcggagaagctgccaggggccacagtttctgagacgaggctcagaggctcttccatggccagctccgtggccagcgagccaaggagcaggagcagctcgctcaactccaccgacagcggctccgggctcctgccccctgggctccaggccacccctgagctgggcaagggcagccagcccctgtcacagagattcaacgccatcagctcagaggactttgaccaggagcttgtcgtgaagcctatcaaagtgaaaaggaagaagaagaagaagaagacagaaggtggaagcaggagcacctgtcacagctccctggaatcgacaccctgctccgaatttcctggggacagtccccagtccttgaacacagacttgctgtcgatgacctcaagtgtcctgggcagtagcgtggatcagttaagtgcagagtctccagaccaggaaagcagcttcaatggtgaagtgaacggtgtcccacaggaaaatactgaccccgaaacgtttaatgtcctggaggtgtcaggatcaatgcctgattctctggctgaggaagatgacattagaactgaaatgccacactgtcaccatgcacatgggcgggagctgctcaatggagcgagggaagatgtgggaggcagtgatgtcacgggactcggagatgagccgtgtcctgcagatgatggaccaaatagcacacagttacccttccaagaacaggacagctctcctggggcgcatgatggggaagacatccaacccattggcccccaaagcactttttgtgaagtccccctcctgaactcactcactgtgccttccagcctcagctgggccccaagtgctgaacagtggctgcctgggaccagagctgatgaaggcagccccgtggagcccagccaagagcaggacatcctaaccagcatggaggcctctggccacctcagcacaaatctctggcatgctgtcactgatgatgacacaggtcagaaagaaatacccatttctgaacgtgtcttggggagtgtgggaggacagctgactccggtctctgccttggcagccagcactcacaagccctggcttgagcagcctccacgggatcagacattgacgtccagcgatgaggaggacatctatgcccacgggcttccttcttcatcctcagagacgagtgtgacagagctcggacctagttgctcccagcaggacctgagccggctgggtgcagaggacgccgggctgctcaagccagatcagtttgcagaaagctggatgggctactcgggtcccggctatggcatcctcagcttggtggtctccgagaagtatatctggtgcctggactacaaaggcggcctgttctgcagcgcgttgccgggcgccgggctgcgctggcagaagtttgaagatgctgtccagcaggtggcagtctcgccctcaggagcccttctctggaagattgaacagaaatctaaccgggcttttgcttgtgggaaagtcaccatcaaggggaagcggcactggtacgaagccctgccccaggcagtgtttgtggccctgagcgatgacacggcctggatcatcaggaccagtggggacctatacttgcagacaggtctgagcgtggatcgcccttgtgccagagccgtaaaggtggactgtccctacccgctgtcccagatcacagcccggaacaatgtggtgtgggcgctgacagagcagagggccctcctgtaccgggagggcgtgagcagcttctgtccggaaggcgagcagtggaagtgtgacattgtcagcgaaaggcaagctttagaacccgtctgcataacgctcggggatcagcagactctctgggccctggacatccatgggaacctgtggttcagaactggcattatttccaagaagccccaaggagatgacgaccattggtggcaagtgagcatcacggactatgtggtgtttgaccagtgcagcttatttcagacgataatccatgccactcactcggtggccacagcagcccaagcccccgtagaaaaggtggcagataagctgcgcatggcgttttggtcccagcagcttcagtgccagccaagccttctcggggtcaataacagcggtgtctggatctcctcgggcaagaatgaattccacgtcgctaagggaagtctcataggcacctactggaatcatgtggttccccgtgggacagcttctgctacaaaatgggcctttgtgttggcttctgcagctcccacgaaggaaggaagcttcctgtggctgtgccagagcagcaaggacctgtgcagcgtcagcgcccagagcgcacagtcgcggccctccacggtgcagctgcctcccgaagccgagatgcgcgcctatgccgcctgccaggatgcgctgtgggcgctggacagcctcggccaggtgttcatcaggacgctctccaagagctgccccacgggcatgcactggaccaggctggacctctcccagctaggagctgtaaaattgacaagcttggcatgtggaaatcagcacatctgggcctgtgattccaggggtggagtttacttccgtgtagggactcagcctctcaatcccagtctcatgcttccagcctggataatgattgagccacctgtccagcccgccggggtcagcttggtcagcgtccattccagccccaacgaccagatgctgtgggtgcttgacagcaggtggaacgtgcacgtgcggaccgggatcaccgaggagatgcctgtggggaccgcctgggagcatgtgccagggttgcaggcctgccagctggcgctgagcaccaggaccgtgtgggcccgctgtccaaacggagacctcgcccggcggtacggcgtcacagacaagaaccccgccggggactactggaagaaaattcccggcagcgtgtcgtgtttcacagtgactgcgtcagatgagctgtgggctgtgggcccgcccggctacctcctccaacggctgacaaagacgttcagccactcgcacggcacccagaagagcagccaggccgccatgccccaccctgaggacctggaggacgagtgggaggtcatctgaaggagccctggccgagtcacgcggaggggcccggcgtctgtggcgggcacaggggcttcngagtgactccctggtggacgcgctgcctcaacacttgtccagacacctctggccaggttggacccgcacacttactttcatctatgttggtttctgtctcgttccagaacccacagcctccacccgtggctggcgtgattgctgcagcagtggcgcctcctagctcaggacagtggcgactgcccggctgcatgcactccgattacccacgtgctgccgtcctggtctcatccacagatagctccagcttttgttggtgggagtggtctccggaggcctcccagaaccaagggtagccgggcagctggtttggcccagggcctccttccacattagtagccccagggccagatggagccaaaggtcagctctctgcagcgcgggatgtgctcggtgatggctttgtcccatcataggggggtgtccccccagagacaaagctgcagagcacattccatgccagacgctctggccaggaagctgaggccgggcttgagaggagagcgctggccatgccaggagagaacccacgcacatgcacaccacaacacacaacacacctcacctcacaccacagcacacctcaccacaccacaccgcactgcaccatacctcaccacatctcaccacaccacagcacacctcaccacacaacacaccacaccccacaccgcactgcaccgcaccgcaccgcaccgtacctcgccacatctcaccacaccacaccacaccacacctcactgcccacacacggcgcaggctgcccgcctcctggagagcacacttcagctgaaacagtaaagcctgatgggtgcaaatggaacctggatgtgtgcacgtgtgtcccaggtagggacggcacaggagggtgcatggggcgtgggggagctgagcaagggtcgctcacttagaaatgtctttggaatggtgtttaactaatgctgctggcggacatcctaaaaccagatgcatcctcagaggacgagtctactaattattgcctttgttgttgtattacaaatctgcataaaatacctcatttcaaatcaaatcttacaaatttagaagagagatatgttttccgaaaacagtggaagccctttgttccttcccgggtttgtcctgagcctgcactgtcctcgcctgcagcctcagaggggcaggcatccccgcacagacttgactggcagggcggtcacgggacctgcgggctggctccgagtggcagcccatgccttctgcggggtatgggttgacacttgacaggttgaaaccagtgcctctatggacggctgctgtggccccttcagacaatgggcagtgcccaccccgcccactggcatctgcgtgtgagggctaggccgccctgccacacatcccgccccctcccggaggcagcttcaggacaggacaccaggctggctgctttttttagcctgcccctggcccaggcccagtccttggtgtcagggagcccccaggccgcaggtggagggtgataaaatatgttctctgacaggacccagccagccacataggtggaggttttccatgtccaaatgaggtcaagatgccgaaatcccagatctgacttcacacttcccttttctagaaccttttgtaaaagttggtggcagcagaggcagccccaggccgggctgcatctctctgtgtctgttgtgccttgcccggcgcctcacggatggcaaagctctcctcacccatgggactgtagtgcaattaaacccgcgtctaggtgatgcttttaaagttgtagcttcgtgctttgtacagttttctttctggttttaatttttagttgtgctttgagtcagtgcaataaactagactttttcca

SEQ ID NO: 448546 - DNA, 8920 bp, Homo sapiens
  misc_feature (4522)..(4522): n is a, c, g, or t
cccccggcggagccagctgctgctcttcggtgctggccccggtgccggccccgttgcccagggaacaggctcccggcagcccccgcggcccggagtccatcccgcctcctccggcccggcggggccgacgagtccggaggggctgccgcgggagcccccaggtttccctagatgacaaataaacattccttttcctgcgtgaagatagtctgtggaaaccttggccatggcatcgatatcagagcctgttacattcagagagttctgcccgttgtactatctcctcaatgccattccgacaaagatccagaagggtttccgctctatcgtggtctatctcacggccctcgacaccaacggggactacatcgcggtgggcagcagcatcggcatgctctatctgtactgccggcacctcaaccagatgaggaagtacaactttgaggggaagacggaatctatcactgtggtgaagctgctgagctgctttgatgacctggtggcagcaggcacagcctctggcagggttgcagtttttcaacttgtatcttcattgccagggagaaataaacagcttcggagatttgatgtcactggtattcacaaaaatagcattacagctctggcttggagccccaatggaatgaaattgttctctggagatgacaaaggcaaaattgtttattcttctctggatctagaccaggggctctgtaactcccagctggtgttggaggagccatcttccattgtgcagctggattatagccagaaagtgctgctggtctctactctgcaaagaagtctgctcttttacactgaagaaaagtctgtaaggcaaattggaacacaaccaaggaaaagtactgggaaatttggtgcttgttttataccaggactctgtaagcaaagtgatctaaccttgtatgcgtcacggcccgggctccggctatggaaggctgatgtccacgggactgttcaagccacgtttatcttaaaagatgcttttgccgggggagtcaagccttttgaactgcacccgcgtctggaatcccccaacagtggaagttgcagcttacctgagaggcacctggggcttgtttcatgtttctttcaagaaggctgggtgctgagttggaatgaatatagtatctatctcctagacacagtcaaccaggccacaattgctggtttggaaggatccggtgatattgtgtctgtttcgtgcacagaaaatgaaatatttttcttgaaaggagataggaacattataagaatttcaagcaggcctgaaggattaacatcaacagtgagagatggtctggagatgtctggatgctcagagcgtgtccacgtgcagcaagcggagaagctgccaggggccacagtttctgagacgaggctcagaggctcttccatggccagctccgtggccagcgagccaaggagcaggagcagctcgctcaactccaccgacagcggctccgggctcctgccccctgggctccaggccacccctgagctgggcaagggcagccagcccctgtcacagagattcaacgccatcagctcagaggactttgaccaggagcttgtcgtgaagcctatcaaagtgaaaaggaagaagaagaagaagaagacagaaggtggaagcaggagcacctgtcacagctccctggaatcgacaccctgctccgaatttcctggggacagtccccagtccttgaacacagacttgctgtcgatgacctcaagtgtcctgggcagtagcgtggatcagttaagtgcagagtctccagaccaggaaagcagcttcaatggtgaagtgaacggtgtcccacaggaaaatactgaccccgaaacgtttaatgtcctggaggtgtcaggatcaatgcctgattctctggctgaggaagatgacattagaactgaaatgccacactgtcaccatgcacatgggcgggagctgctcaatggagcgagggaagatgtgggaggcagtgatgtcacgggactcggagatgagccgtgtcctgcagatgatggaccaaatagcacacagttacccttccaagaacaggacagctctcctggggcgcatgatggggaagacatccaacccattggcccccaaagcactttttgtgaagtccccctcctgaactcactcactgtgccttccagcctcagctgggccccaagtgctgaacagtggctgcctgggaccagagctgatgaaggcagccccgtggagcccagccaagagcaggacatcctaaccagcatggaggcctctggccacctcagcacaaatctctggcatgctgtcactgatgatgacacaggtcagaaagaaatacccatttctgaacgtgtcttggggagtgtgggaggacagctgactccggtctctgccttggcagccagcactcacaagccctggcttgagcagcctccacgggatcagacattgacgtccagcgatgaggaggacatctatgcccacgggcttccttcttcatcctcagagacgagtgtgacagagctcggacctagttgctcccagcaggacctgagccggctgggtgcagaggacgccgggctgctcaagccagatcagtttgcagaaagctggatgggctactcgggtcccggctatggcatcctcagcttggtggtctccgagaagtatatctggtgcctggactacaaaggcggcctgttctgcagcgcgttgccgggcgccgggctgcgctggcagaagtttgaagatgctgtccagcaggtggcagtctcgccctcaggagcccttctctggaagattgaacagaaatctaaccgggcttttgcttgtgggaaagtcaccatcaaggggaagcggcactggtacgaagccctgccccaggcagtgtttgtggccctgagcgatgacacggcctggatcatcaggaccagtggggacctatacttgcagacaggtctgagcgtggatcgcccttgtgccagagccgtaaaggtggactgtccctacccgctgtcccagatcacagcccggaacaatgtggtgtgggcgctgacagagcagagggccctcctgtaccgggagggcgtgagcagcttctgtccggaaggcgagcagtggaagtgtgacattgtcagcgaaaggcaagctttagaacccgtctgcataacgctcggggatcagcagactctctgggccctggacatccatgggaacctgtggttcagaactggcattatttccaagaagccccaaggagatgacgaccattggtggcaagtgagcatcacggactatgtggtgtttgaccagtgcagcttatttcagacgataatccatgccactcactcggtggccacagcagcccaagcccccgtagaaaaggtggcagataagctgcgcatggcgttttggtcccagcagcttcagtgccagccaagccttctcggggtcaataacagcggtgtctggatctcctcgggcaagaatgaattccacgtcgctaagggaagtctcataggcacctactggaatcatgtggttccccgtgggacagcttctgctacaaaatgggcctttgtgttggcttctgcagctcccacgaaggaaggaagcttcctgtggctgtgccagagcagcaaggacctgtgcagcgtcagcgcccagagcgcacagtcgcggccctccacggtgcagctgcctcccgaagccgagatgcgcgcctatgccgcctgccaggatgcgctgtgggcgctggacagcctcggccaggtgttcatcaggacgctctccaagagctgccccacgggcatgcactggaccaggctggacctctcccagctaggagctgtaaaattgacaagcttggcatgtggaaatcagcacatctgggcctgtgattccaggggtggagtttacttccgtgtagggactcagcctctcaatcccagtctcatgcttccagcctggataatgattgagccacctgtccagcccgccggggtcagcttggtcagcgtccattccagccccaacgaccagatgctgtgggtgcttgacagcaggtggaacgtgcacgtgcggaccgggatcaccgaggagatgcctgtggggaccgcctgggagcatgtgccagggttgcaggcctgccagctggcgctgagcaccaggaccgtgtgggcccgctgtccaaacggagacctcgcccggcggtacggcgtcacagacaagaaccccgccggggactactggaagaaaattcccggcagcgtgtcgtgtttcacagtgactgcgtcagatgagctgtgggctgtgggcccgcccggctacctcctccaacggctgacaaagacgttcagccactcgcacggcacccagaagagcagccaggccgccatgccccaccctgaggacctggaggacgagtgggaggtcatctgaaggagccctggccgagtcacgcggaggggcccggcgtctgtggcgggcacaggggcttcngagtgactccctggtggacgcgctgcctcaacacttgtccagacacctctggccaggttggacccgcacacttactttcatctatgttggtttctgtctcgttccagaacccacagcctccacccgtggctggcgtgattgctgcagcagtggcgcctcctagctcaggacagtggcgactgcccggctgcatgcactccgattacccacgtgctgccgtcctggtctcatccacagatagctccagcttttgttggtgggagtggtctccggaggcctcccagaaccaagggtagccgggcagctggtttggcccagggcctccttccacattagtagccccagggccagatggagccaaaggtcagctctctgcagcgcgggatgtgctcggtgatggctttgtcccatcataggggggtgtccccccagagacaaagctgcagagcacattccatgccagacgctctggccaggaagctgaggccgggcttgagaggagagcgctggccatgccaggagagaacccacgcacatgcacaccacaacacacaacacacctcacctcacaccacagcacacctcaccacaccacaccgcactgcaccatacctcaccacatctcaccacaccacagcacacctcaccacacaacacaccacaccccacaccgcactgcaccgcaccgcaccgcaccgtacctcgccacatctcaccacaccacaccacaccacacctcactgcccacacacggcgcaggctgcccgcctcctggagagcacacttcagctgaaacagtaaagcctgatgggtgcaaatggaacctggatgtgtgcacgtgtgtcccaggtagggacggcacaggagggtgcatggggcgtgggggagctgagcaagggtcgctcacttagaaatgtctttggaatggtgtttaactaatgctgctggcggacatcctaaaaccagatgcatcctcagaggacgagtctactaattattgcctttgttgttgtattacaaatctgcataaaatacctcatttcaaatcaaatcttacaaatttagaagagagatatgttttccgaaaacagtggaagccctttgttccttcccgggtttgtcctgagcctgcactgtcctcgcctgcagcctcagaggggcaggcatccccgcacagacttgactggcagggcggtcacgggacctgcgggctggctccgagtggcagcccatgccttctgcggggtatgggttgacacttgacaggttgaaaccagtgcctctatggacggctgctgtggccccttcagacaatgggcagtgcccaccccgcccactggcatctgcgtgtgagggctaggccgccctgccacacatcccgccccctcccggaggcagcttcaggacaggacaccaggctggctgctttttttagcctgcccctggcccaggcccagtccttggtgtcagggagcccccaggccgcaggtggagggtgataaaatatgttctctgacaggacccagccagccacataggtggaggttttccatgtccaaatgaggtcaagatgccgaaatcccagatctgacttcacacttcccttttctagaaccttttgtaaaagttggtggcagcagaggcagccccaggccgggctgcatctctctgtgtctgttgtgccttgcccggcgcctcacggatggcaaagctctcctcacccatgggactgtagtgcaattaaacccgcgtctaggtgatgcttttaaagttgtagcttcgtgctttgtacagttttctttctggttttaatttttagttgtgctttgagtcagtgcaataaactagactttttccaaacctggccgagtgtggtgcctgagctgtgagaagtgtcctcagccgacactcacgagggcagtgcaagggagaacctgccagcccagccccaccacagggagagtgcgtcagcagacctgtcctggcctggctggtgttgaaatacacaccggtttgcccaagtggctgttatgggggaatggccgctccagagctggctgtaccccatggtagcctctgaggaggacgctgtggggtgaggtccagggctgcctcctcatggagctgtgtgtgagcaggcgttggaggggttcgagcccctggttctgtatcttcagccagcaaacgaaaccatatcgcaaaccagagctgctggaaaccagcacacgcaaaagatgacgcccagcacagcagcaggacacaccatgtgccaggaaatgacctcagcaagaaacctcaggccgtgtgaagagcagcaaagctttccagaaggcataaaaggaaacttgaataaaggaagatatgttccacattcctggatggaggactacacacattatggaaagacctcattctttccaaaggaatttataggtgtagcttgatttcagttcaaatccccactgggattgttttgttggggcaggcagggaggaataatgttagtacccacaaatgcccatgactgtgcccaatgtgcttctcaccagagccctgcaaggggaagtctcattagccccttgagactcagagaggttaggtaacttgctcaaggtcacacagcactgggactggaagccagctctgtagaactgcagacctgtgctgtttgatgcctcctcactgtcccgtcactcctgggaagaagaaacgggtgagaactgctaagtgatgacaggtggagccccagcaggggccactctattgaatggcatggcccagaccctcggagggccaggcaacaggctagcaaggcccacagggagggagcagaatggagagggcatctcagatgcgcttaaggagcggcgggggcggggcatggggggtgtcacaactaatgtggccactgcttcattctctgggcaaaataatattaaatggattaaagaatctaaaaccagtgggaaaactgtctgatttctggatggcaaaggctttctaaactcaaaagtgataggacaagctacagaggaaaataagtacatagatttgatttctccaaaatacagaaatgctgctgggcacagtgatgtgcagttatagtcccagctacttgggaggccaaggcaggaggattacttgagcccaggagtttgaggctgcaatgaactatgatcacaccactgcactccagcctcggcgacagagcaagaccttgtttctcaaaaataaataaatagaaggaaataaatgtaaaaatgctgcaaattaaaaacctcaaagaagggaaataattgcaacaaatgggaattgatgttgaatatttaccttaaaaacctatacaacaataagaggagtgcgcccttcagcagcatgtatacaaaaattgcaacgatacagagattagcatggcccctgcacaaggatgactcgcaaattcataaagctttccataaatatatttattaaaaaccaataggaggagcacttcgagtcgagtgtaagggcccttcacaaaagcagaaggaacactggcccaaacccccagcaccccggaagcagaggtgagatgggagcagcttgggagccccccattggcgccgccctactggggaagccggtccgtacgtaggccttgcatctcgccacctccacttctgtcctcaagaacaagtcctaggtcaagggaaacagcacagcctgtttataattaggaaacacttaaaacagcctggcatttgggaacagccatgttaacgtgagcaaattcctctcatgaaatagcctgcagctattaagaagcacgtgtgtgcaggaagcggaggcgcaggacctcaccgcgccagcgtgaagttcccgggcatggtcatgaaagcgtggttctgtaagaaatcagagggagaaagggagagaagggggagggagacaacccaaacgttggagggtatttgttgtaaacttcaaacttttggcaggtttgaaatttttcataactccggggaggagcaagaggggtgaaaagaaacaagttctctacttgtgatcagcagctggtcatagtggttgcctggagtatatgcctttttgtatcctttgaatttccagccatgtaaatgtattatttattccaaaaataaagcagatttacattttaaaaattcagttgtctctaactactctttgttatcaaggctggttgagtcaaatatcacaaagtagacaccaatgacttcttaaaaatcatatttacaaagtacaatgggggaaatgcttatactacattaaggttaaaaaaatactaaattgtgtaactgatctggtttcatatatatataaatatacacagaaaaaaatgtaatatatatctgcacagaaaaaagctgaaagaaacatatg

SEQ ID NO: 448547 - DNA, 4379 bp, Homo sapiens
cccccggcggagccagctgctgctcttcggtgctggccccggtgccggccccgttgcccagggaacaggctcccggcagcccccgcggcccggagtccatcccgcctcctccggcccggcggggccgacgagtccggaggggctgccgcgggagcccccaggtttccctagatgacaaataaacattccttttcctgcgtgaagatagtctgtggaaaccttggccatggcatcgatatcagagcctgttacattcagagagttctgcccgttgtactatctcctcaatgccattccgacaaagatccagaagggtttccgctctatcgtggtctatctcacggccctcgacaccaacggggactacatcgcggtgggcagcagcatcggcatgctctatctgtactgccggcacctcaaccagatgaggaagtacaactttgaggggaagacggaatctatcactgtggtgaagctgctgagctgctttgatgacctggtggcagcaggcacagcctctggcagggttgcagtttttcaacttgtatcttcattgccagggagaaataaacagcttcggagatttgatgtcactggtattcacaaaaatagcattacagctctggcttggagccccaatggaatgaaattgttctctggagatgacaaaggcaaaattgtttattcttctctggatctagaccaggggctctgtaactcccagctggtgttggaggagccatcttccattgtgcagctggattatagccagaaagtgctgctggtctctactctgcaaagaagtctgctcttttacactgaagaaaagtctgtaaggcaaattggaacacaaccaaggaaaagtactgggaaatttggtgcttgttttataccaggactctgtaagcaaagtgatctaaccttgtatgcgtcacggcccgggctccggctatggaaggctgatgtccacgggactgttcaagccacgtttatcttaaaagatgcttttgccgggggagtcaagccttttgaactgcacccgcgtctggaatcccccaacagtggaagttgcagcttacctgagaggcacctggggcttgtttcatgtttctttcaagaaggctgggtgctgagttggaatgaatatagtatctatctcctagacacagtcaaccaggccacaattgctggtttggaaggatccggtgatattgtgtctgtttcgtgcacagaaaatgaaatatttttcttgaaaggagataggaacattataagaatttcaagcaggcctgaaggattaacatcaacagtgagagatggtctggagatgtctggatgctcagagcgtgtccacgtgcagcaagcggagaagctgccaggggccacagtttctgagacgaggctcagaggctcttccatggccagctccgtggccagcgagccaaggagcaggagcagctcgctcaactccaccgacagcggctccgggctcctgccccctgggctccaggccacccctgagctgggcaagggcagccagcccctgtcacagagattcaacgccatcagctcagaggactttgaccaggagcttgtcgtgaagcctatcaaagtgaaaaggaagaagaagaagaagaagacagaaggtggaagcaggagcacctgtcacagctccctggaatcgacaccctgctccgaatttcctggggacagtccccagtccttgaacacagacttgctgtcgatgacctcaagtgtcctgggcagtagcgtggatcagttaagtgcagagtctccagaccaggaaagcagcttcaatggtgaagtgaacggtgtcccacaggaaaatactgaccccgaaacgtttaatgtcctggaggtgtcaggatcaatgcctgattctctggctgaggaagatgacattagaactgaaatgccacactgtcaccatgcacatgggcgggagctgctcaatggagcgagggaagatgtgggaggcagtgatgtcacgggactcggagatgagccgtgtcctgcagatgatggaccaaatagcacacagttacccttccaagaacaggacagctctcctggggcgcatgatggggaagacatccaacccattggcccccaaagcactttttgtgaagtccccctcctgaactcactcactgtgccttccagcctcagctgggccccaagtgctgaacagtggctgcctgggaccagagctgatgaaggcagccccgtggagcccagccaagagcaggacatcctaaccagcatggaggcctctggccacctcagcacaaatctctggcatgctgtcactgatgatgacacaggtcagaaagaaatacccatttctgaacgtgtcttggggagtgtgggaggacagctgactccggtctctgccttggcagccagcactcacaagccctggcttgagcagcctccacgggatcagacattgacgtccagcgatgaggaggacatctatgcccacgggcttccttcttcatcctcagagacgagtgtgacagagctcggacctagttgctcccagcaggacctgagccggctgggtgcagaggacgccgggctgctcaagccagatcagtttgcagaaagctggatgggctactcgggtcccggctatggcatcctcagcttggtggtctccgagaagtatatctggtgcctggactacaaaggcggcctgttctgcagcgcgttgccgggcgccgggctgcgctggcagaagtttgaagatgctgtccagcaggtggcagtctcgccctcaggagcccttctctggaagattgaacagaaatctaaccgggcttttgcttgtgggaaagtcaccatcaaggggaagcggcactggtacgaagccctgccccaggcagtgtttgtggccctgagcgatgacacggcctggatcatcaggaccagtggggacctatacttgcagacaggtctgagcgtggatcgcccttgtgccagagccgtaaaggtggactgtccctacccgctgtcccagatcacagcccggaacaatgtggtgtgggcgctgacagagcagagggccctcctgtaccgggagggcgtgagcagcttctgtccggaaggcgagcagtggaagtgtgacattgtcagcgaaaggcaagctttagaacccgtctgcataacgctcggggatcagcagactctctgggccctggacatccatgggaacctgtggttcagaactggcattatttccaagaagccccaaggagatgacgaccattggtggcaagtgagcatcacggactatgtggtgtttgaccagtgcagcttatttcagacgataatccatgccactcactcggtggccacagcagcccaagcccccgtagaaaaggtggcagataagctgcgcatggcgttttggtcccagcagcttcagtgccagccaagccttctcggggtcaataacagcggtgtctggatctcctcgggcaagaatgaattccacgtcgctaagggaagtctcataggcacctactggaatcatgtggttccccgtgggacagcttctgctacaaaatgggcctttgtgttggcttctgcagctcccacgaaggaaggaagcttcctgtggctgtgccagagcagcaaggacctgtgcagcgtcagcgcccagagcgcacagtcgcggccctccacggtgcagctgcctcccgaagccgagatgcgcgcctatgccgcctgccaggatgcgctgtgggcgctggacagcctcggccaggtgttcatcaggacgctctccaagagctgccccacgggcatgcactggaccaggctggacctctcccagctaggagctgtaaaattgacaagcttggcatgtggaaatcagcacatctgggcctgtgattccaggggtggagtttacttccgtgtagggactcagcctctcaatcccagtctcatgcttccagcctggataatgattgagccacctgtccaggtaagcagaagttagctggtggaactcactcttcagtaagacagaaactgtgaggatgctggtactgggaaaaaggatctgcacagcctctagaggcctcccagcaaatgcggggagccatgcccccagggtctacacactctcgttcatcaacatcacaactggaattcgggatttgtgaagtttagagctgaacagactgttacagattatgagtcaacacgtatattttctctttcaaaataataatatttcgtttttgactttttactaagtgaatattattttttaaatctgcctatatattggaacctctattttataataataatgataataaatcagtacccagaagtataaaaaa

SEQ ID NO: 448548 - DNA, 325 bp, Homo sapiens
tggaaggctgatgtccacgggactgttcaagccacgtttatcttaaaagatgcttttgccgggggagtcaagccttttgaactgcacccgcgtctggaatcccccaacagtggaagttgcagcttacctgagaggcacctggggcttgtttcatgtttctttcaagaaggctgggtgctgagttggaatgaatatagtatctatctcctagacacagtcaaccaggtaagtgaagggacgccaccatatcttctgtgtctataggcaagagaatgtatctctataaactgttctactcagggacctcagaatgctaccaggagca

SEQ ID NO: 448549 - DNA, 8788 bp, Homo sapiens
  misc_feature (4522)..(4522): n is a, c, g, or t
cccccggcggagccagctgctgctcttcggtgctggccccggtgccggccccgttgcccagggaacaggctcccggcagcccccgcggcccggagtccatcccgcctcctccggcccggcggggccgacgagtccggaggggctgccgcgggagcccccaggtttccctagatgacaaataaacattccttttcctgcgtgaagatagtctgtggaaaccttggccatggcatcgatatcagagcctgttacattcagagagttctgcccgttgtactatctcctcaatgccattccgacaaagatccagaagggtttccgctctatcgtggtctatctcacggccctcgacaccaacggggactacatcgcggtgggcagcagcatcggcatgctctatctgtactgccggcacctcaaccagatgaggaagtacaactttgaggggaagacggaatctatcactgtggtgaagctgctgagctgctttgatgacctggtggcagcaggcacagcctctggcagggttgcagtttttcaacttgtatcttcattgccagggagaaataaacagcttcggagatttgatgtcactggtattcacaaaaatagcattacagctctggcttggagccccaatggaatgaaattgttctctggagatgacaaaggcaaaattgtttattcttctctggatctagaccaggggctctgtaactcccagctggtgttggaggagccatcttccattgtgcagctggattatagccagaaagtgctgctggtctctactctgcaaagaagtctgctcttttacactgaagaaaagtctgtaaggcaaattggaacacaaccaaggaaaagtactgggaaatttggtgcttgttttataccaggactctgtaagcaaagtgatctaaccttgtatgcgtcacggcccgggctccggctatggaaggctgatgtccacgggactgttcaagccacgtttatcttaaaagatgcttttgccgggggagtcaagccttttgaactgcacccgcgtctggaatcccccaacagtggaagttgcagcttacctgagaggcacctggggcttgtttcatgtttctttcaagaaggctgggtgctgagttggaatgaatatagtatctatctcctagacacagtcaaccaggccacaattgctggtttggaaggatccggtgatattgtgtctgtttcgtgcacagaaaatgaaatatttttcttgaaaggagataggaacattataagaatttcaagcaggcctgaaggattaacatcaacagtgagagatggtctggagatgtctggatgctcagagcgtgtccacgtgcagcaagcggagaagctgccaggggccacagtttctgagacgaggctcagaggctcttccatggccagctccgtggccagcgagccaaggagcaggagcagctcgctcaactccaccgacagcggctccgggctcctgccccctgggctccaggccacccctgagctgggcaagggcagccagcccctgtcacagagattcaacgccatcagctcagaggactttgaccaggagcttgtcgtgaagcctatcaaagtgaaaaggaagaagaagaagaagaagacagaaggtggaagcaggagcacctgtcacagctccctggaatcgacaccctgctccgaatttcctggggacagtccccagtccttgaacacagacttgctgtcgatgacctcaagtgtcctgggcagtagcgtggatcagttaagtgcagagtctccagaccaggaaagcagcttcaatggtgaagtgaacggtgtcccacaggaaaatactgaccccgaaacgtttaatgtcctggaggtgtcaggatcaatgcctgattctctggctgaggaagatgacattagaactgaaatgccacactgtcaccatgcacatgggcgggagctgctcaatggagcgagggaagatgtgggaggcagtgatgtcacgggactcggagatgagccgtgtcctgcagatgatggaccaaatagcacacagttacccttccaagaacaggacagctctcctggggcgcatgatggggaagacatccaacccattggcccccaaagcactttttgtgaagtccccctcctgaactcactcactgtgccttccagcctcagctgggccccaagtgctgaacagtggctgcctgggaccagagctgatgaaggcagccccgtggagcccagccaagagcaggacatcctaaccagcatggaggcctctggccacctcagcacaaatctctggcatgctgtcactgatgatgacacaggtcagaaagaaatacccatttctgaacgtgtcttggggagtgtgggaggacagctgactccggtctctgccttggcagccagcactcacaagccctggcttgagcagcctccacgggatcagacattgacgtccagcgatgaggaggacatctatgcccacgggcttccttcttcatcctcagagacgagtgtgacagagctcggacctagttgctcccagcaggacctgagccggctgggtgcagaggacgccgggctgctcaagccagatcagtttgcagaaagctggatgggctactcgggtcccggctatggcatcctcagcttggtggtctccgagaagtatatctggtgcctggactacaaaggcggcctgttctgcagcgcgttgccgggcgccgggctgcgctggcagaagtttgaagatgctgtccagcaggtggcagtctcgccctcaggagcccttctctggaagattgaacagaaatctaaccgggcttttgcttgtgggaaagtcaccatcaaggggaagcggcactggtacgaagccctgccccaggcagtgtttgtggccctgagcgatgacacggcctggatcatcaggaccagtggggacctatacttgcagacaggtctgagcgtggatcgcccttgtgccagagccgtaaaggtggactgtccctacccgctgtcccagatcacagcccggaacaatgtggtgtgggcgctgacagagcagagggccctcctgtaccgggagggcgtgagcagcttctgtccggaaggcgagcagtggaagtgtgacattgtcagcgaaaggcaagctttagaacccgtctgcataacgctcggggatcagcagactctctgggccctggacatccatgggaacctgtggttcagaactggcattatttccaagaagccccaaggagatgacgaccattggtggcaagtgagcatcacggactatgtggtgtttgaccagtgcagcttatttcagacgataatccatgccactcactcggtggccacagcagcccaagcccccgtagaaaaggtggcagataagctgcgcatggcgttttggtcccagcagcttcagtgccagccaagccttctcggggtcaataacagcggtgtctggatctcctcgggcaagaatgaattccacgtcgctaagggaagtctcataggcacctactggaatcatgtggttccccgtgggacagcttctgctacaaaatgggcctttgtgttggcttctgcagctcccacgaaggaaggaagcttcctgtggctgtgccagagcagcaaggacctgtgcagcgtcagcgcccagagcgcacagtcgcggccctccacggtgcagctgcctcccgaagccgagatgcgcgcctatgccgcctgccaggatgcgctgtgggcgctggacagcctcggccaggtgttcatcaggacgctctccaagagctgccccacgggcatgcactggaccaggctggacctctcccagctaggagctgtaaaattgacaagcttggcatgtggaaatcagcacatctgggcctgtgattccaggggtggagtttacttccgtgtagggactcagcctctcaatcccagtctcatgcttccagcctggataatgattgagccacctgtccagcccgccggggtcagcttggtcagcgtccattccagccccaacgaccagatgctgtgggtgcttgacagcaggtggaacgtgcacgtgcggaccgggatcaccgaggagatgcctgtggggaccgcctgggagcatgtgccagggttgcaggcctgccagctggcgctgagcaccaggaccgtgtgggcccgctgtccaaacggagacctcgcccggcggtacggcgtcacagacaagaaccccgccggggactactggaagaaaattcccggcagcgtgtcgtgtttcacagtgactgcgtcagatgagctgtgggctgtgggcccgcccggctacctcctccaacggctgacaaagacgttcagccactcgcacggcacccagaagagcagccaggccgccatgccccaccctgaggacctggaggacgagtgggaggtcatctgaaggagccctggccgagtcacgcggaggggcccggcgtctgtggcgggcacaggggcttcngagtgactccctggtggacgcgctgcctcaacacttgtccagacacctctggccaggttggacccgcacacttactttcatctatgttggtttctgtctcgttccagaacccacagcctccacccgtggctggcgtgattgctgcagcagtggcgcctcctagctcaggacagtggcgactgcccggctgcatgcactccgattacccacgtgctgccgtcctggtctcatccacagatagctccagcttttgttggtgggagtggtctccggaggcctcccagaaccaagggtagccgggcagctggtttggcccagggcctccttccacattagtagccccagggccagatggagccaaaggtcagctctctgcagcgcgggatgtgctcggtgatggctttgtcccatcataggggggtgtccccccagagacaaagctgcagagcacattccatgccagacgctctggccaggaagctgaggccgggcttgagaggagagcgctggccatgccaggagagaacccacgcacatgcacaccacaacacacaacacacctcacctcacaccacagcacacctcaccacaccacaccgcactgcaccatacctcaccacatctcaccacaccacagcacacctcaccacacaacacaccacaccccacaccgcactgcaccgcaccgcaccgcaccgtacctcgccacatctcaccacaccacaccacaccacacctcactgcccacacacggcgcaggctgcccgcctcctggagagcacacttcagctgaaacagtaaagcctgatgggtgcaaatggaacctggatgtgtgcacgtgtgtcccaggtagggacggcacaggagggtgcatggggcgtgggggagctgagcaagggtcgctcacttagaaatgtctttggaatggtgtttaactaatgctgctggcggacatcctaaaaccagatgcatcctcagaggacgagtctactaattattgcctttgttgttgtattacaaatctgcataaaatacctcatttcaaatcaaatcttacaaatttagaagagagatatgttttccgaaaacagtggaagccctttgttccttcccgggtttgtcctgagcctgcactgtcctcgcctgcagcctcagaggggcaggcatccccgcacagacttgactggcagggcggtcacgggacctgcgggctggctccgagtggcagcccatgccttctgcggggtatgggttgacacttgacaggttgaaaccagtgcctctatggacggctgctgtggccccttcagacaatgggcagtgcccaccccgcccactggcatctgcgtgtgagggctaggccgccctgccacacatcccgccccctcccggagccagccacataggtggaggttttccatgtccaaatgaggtcaagatgccgaaatcccagatctgacttcacacttcccttttctagaaccttttgtaaaagttggtggcagcagaggcagccccaggccgggctgcatctctctgtgtctgttgtgccttgcccggcgcctcacggatggcaaagctctcctcacccatgggactgtagtgcaattaaacccgcgtctaggtgatgcttttaaagttgtagcttcgtgctttgtacagttttctttctggttttaatttttagttgtgctttgagtcagtgcaataaactagactttttccaaacctggccgagtgtggtgcctgagctgtgagaagtgtcctcagccgacactcacgagggcagtgcaagggagaacctgccagcccagccccaccacagggagagtgcgtcagcagacctgtcctggcctggctggtgttgaaatacacaccggtttgcccaagtggctgttatgggggaatggccgctccagagctggctgtaccccatggtagcctctgaggaggacgctgtggggtgaggtccagggctgcctcctcatggagctgtgtgtgagcaggcgttggaggggttcgagcccctggttctgtatcttcagccagcaaacgaaaccatatcgcaaaccagagctgctggaaaccagcacacgcaaaagatgacgcccagcacagcagcaggacacaccatgtgccaggaaatgacctcagcaagaaacctcaggccgtgtgaagagcagcaaagctttccagaaggcataaaaggaaacttgaataaaggaagatatgttccacattcctggatggaggactacacacattatggaaagacctcattctttccaaaggaatttataggtgtagcttgatttcagttcaaatccccactgggattgttttgttggggcaggcagggaggaataatgttagtacccacaaatgcccatgactgtgcccaatgtgcttctcaccagagccctgcaaggggaagtctcattagccccttgagactcagagaggttaggtaacttgctcaaggtcacacagcactgggactggaagccagctctgtagaactgcagacctgtgctgtttgatgcctcctcactgtcccgtcactcctgggaagaagaaacgggtgagaactgctaagtgatgacaggtggagccccagcaggggccactctattgaatggcatggcccagaccctcggagggccaggcaacaggctagcaaggcccacagggagggagcagaatggagagggcatctcagatgcgcttaaggagcggcgggggcggggcatggggggtgtcacaactaatgtggccactgcttcattctctgggcaaaataatattaaatggattaaagaatctaaaaccagtgggaaaactgtctgatttctggatggcaaaggctttctaaactcaaaagtgataggacaagctacagaggaaaataagtacatagatttgatttctccaaaatacagaaatgctgctgggcacagtgatgtgcagttatagtcccagctacttgggaggccaaggcaggaggattacttgagcccaggagtttgaggctgcaatgaactatgatcacaccactgcactccagcctcggcgacagagcaagaccttgtttctcaaaaataaataaatagaaggaaataaatgtaaaaatgctgcaaattaaaaacctcaaagaagggaaataattgcaacaaatgggaattgatgttgaatatttaccttaaaaacctatacaacaataagaggagtgcgcccttcagcagcatgtatacaaaaattgcaacgatacagagattagcatggcccctgcacaaggatgactcgcaaattcataaagctttccataaatatatttattaaaaaccaataggaggagcacttcgagtcgagtgtaagggcccttcacaaaagcagaaggaacactggcccaaacccccagcaccccggaagcagaggtgagatgggagcagcttgggagccccccattggcgccgccctactggggaagccggtccgtacgtaggccttgcatctcgccacctccacttctgtcctcaagaacaagtcctaggtcaagggaaacagcacagcctgtttataattaggaaacacttaaaacagcctggcatttgggaacagccatgttaacgtgagcaaattcctctcatgaaatagcctgcagctattaagaagcacgtgtgtgcaggaagcggaggcgcaggacctcaccgcgccagcgtgaagttcccgggcatggtcatgaaagcgtggttctgtaagaaatcagagggagaaagggagagaagggggagggagacaacccaaacgttggagggtatttgttgtaaacttcaaacttttggcaggtttgaaatttttcataactccggggaggagcaagaggggtgaaaagaaacaagttctctacttgtgatcagcagctggtcatagtggttgcctggagtatatgcctttttgtatcctttgaatttccagccatgtaaatgtattatttattccaaaaataaagcagatttacattttaaaaattcagttgtctctaactactctttgttatcaaggctggttgagtcaaatatcacaaagtagacaccaatgacttcttaaaaatcatatttacaaagtacaatgggggaaatgcttatactacattaaggttaaaaaaatactaaattgtgtaactgatctggtttcatatatatataaatatacacagaaaaaaatgtaatatatatctgcacagaaaaaagctgaaagaaacatatg

SEQ ID NO: 448550 - DNA, 169 bp, Homo sapiens
cggcactggtacgaagccctgccccaggcagtgtttgtggccctgagcgatgacacggcctggatcatcaggaccagtggggacctatacttgcagacaggtaaccgcgggccacgcttagaggcctgccagctctgccgtcactgcctctgctgcaccctgctttgct

SEQ ID NO: 448551 - DNA, 1111 bp, Homo sapiens
gggtgggaacggcgccgagagtgtacacgtcggttgcctaacaaccggcagcggactcctttggctatggcctccaactttaagaaggcaaacatggcatcaagttctcagcgaaaaagaatgagccctaagcctgagcttactgaagagcaaaagcaggagatccgggaagcttttgatcttttcgatgcggatggaactggcaccatagatgttaaagaactgaaggtggcaatgagggccctgggctttgaacccaagaaagaagaaattaagaaaatgataagtgaaattgataaggaagggacaggaaaaatgaactttggtgactttttaactgtgatgacccagaaaatgtctgagaaagatactaaagaagaaatcctgaaagctttcaagctctttgatgatgatgaaactgggaagatttcgttcaaaaatctgaaacgcgtggccaaggagttgggtgagaacctgactgatgaggagctgcaggaaatgattgatgaagctgatcgagatggagatggagaggtcagtgagcaagagttcctgcgcatcatgaaaaagaccagcctctattaagatcagtgtcttctttttctactgcaagcacatgtaactagatttagtgcctgccatggtgtgaaatctggcttttgagaacacaaacttttcccccacggacctccctttatcactttaatagtgaccttgagcctattttagccgtttggaagtgttctttgatattacagttctttgtaaaatgacctgcgaattaccctaattctcaaaagcaaaacaagagcacacaagcgtgaagaaaaggatcttaaagctttgagcacctgccattttgccttgcatcgtttccctcgtcatgcatttccacatatccacaaacacagaacgactttagacaagcacatgttacacctgtgttgccacaagcagtcattcttgacggctccagtttttatttgacacttgagtttagttttctcttttataaacccagtgaactcctgcactggcatttggatgtgtgttaatgctatttgttttgtcttaaaagtaaaacctttctcagtttgaacttgtattctct

SEQ ID NO: 448552 - DNA, 1071 bp, Homo sapiens
aattatggccggggactcctttggctatggcctccaactttaagaaggcaaacatggcatcaagttctcagcgaaaaagaatgagccctaagcctgagcttactgaagagcaaaagcaggagatccgggaagcttttgatcttttcgatgcggatggaactggcaccatagatgttaaagaactgaaggtggcaatgagggccctgggctttgaacccaagaaagaagaaattaagaaaatgataagtgaaattgataaggaagggacaggaaaaatgaactttggtgactttttaactgtgatgacccagaaaatgtctgagaaagatactaaagaagaaatcctgaaagctttcaagctctttgatgatgatgaaactgggaagatttcgttcaaaaatctgaaacgcgtggccaaggagttgggtgagaacctgactgatgaggagctgcaggaaatgattgatgaagctgatcgagatggagatggagaggtcagtgagcaagagttcctgcgcatcatgaaaaagaccagcctctattaagatcagtgtcttctttttctactgcaagcacatgtaactagatttagtgcctgccatggtgtgaaatctggcttttgagaacacaaacttttcccccacggacctccctttatcactttaatagtgaccttgagcctattttagccgtttggaagtgttctttgatattacagttctttgtaaaatgacctgcgaattaccctaattctcaaaagcaaaacaagagcacacaagcgtgaagaaaaggatcttaaagctttgagcacctgccattttgccttgcatcgtttccctcgtcatgcatttccacatatccacaaacacagaacgactttagacaagcacatgttacacctgtgttgccacaagcagtcattcttgacggctccagtttttatttgacacttgagtttagttttctcttttataaacccagtgaactcctgcactggcatttggatgtgtgttaatgctatttgttttgtcttaaaagtaaaacctttctcagtttgaacttgtattctct

SEQ ID NO: 448553 - DNA, 1043 bp, Homo sapiens
gggtgggaacggcgccgagagtgtacacgtcggttgcctaacaaccggcagcggactcctttggctatggcctccaactttaagaaggcaaacatggcatcaagttctcagcgaaaaagaatgagccctaagcctgagcttactgaagagcaaaagcaggagatccgggaagcttttgatcttttcgatgcggatggaactggcaccatagatgttaaagaactgaaggtggcaatgagggccctgggctttgaacccaagaaagaagaaattaagaaaatgataagtgaaattgataaggaagggacaggaaaaatgaactttggtgactttttaactgtgatgacccagaaaatgtctgagaaagatactaaagaagaaatcctgaaagctttcaagctctttgatgatgatgaaactgggaagatttcgttcaaaaatctgaaacgcgtggccaaggagttgggtgagaacctgactgatgaggagctgcaggaaatgattgatgaagctgatcgagatggagatggagaggtcagtgagcaagagttcctgcgcatcatgaaaaagaccagcctctattaagatcagtgtcttctttttctactgcaagcacatgtaactagatttagtgcctgccatggtgtgaaatctggcttttgagaacacaaacttttcccccacggacctccctttatcactttaatagtgaccttgagcctattttagccgtttggaagtgttctttgatattacagttctttgtaaaatgacctgcgaattaccctaattctcaaaagcaaaacaagagcacacaagcgtgaagaaaaggatcttaaagctttgagcacctgccattttgccttgcatcgtttccctcgtcatgcatttccacatatccacaaacacagaacgactttagacaagcacatgttacacctgtgttgccacaagcagtcattcttgacggctccagtttttatttgacactttgcatccagagacacttgcatccagagacacatgcccgaggggatcctctg

SEQ ID NO: 448554 - DNA, 954 bp, Homo sapiens
gggtgggaacggcgccgagagtgtacacgtcggttgcctaacaaccggcagcggactcctttggctatggcctccaactttaagaaggcaaacatggcatcaagttctcagcgaaaaagaaaatgataagtgaaattgataaggaagggacaggaaaaatgaactttggtgactttttaactgtgatgacccagaaaatgtctgagaaagatactaaagaagaaatcctgaaagctttcaagctctttgatgatgatgaaactgggaagatttcgttcaaaaatctgaaacgcgtggccaaggagttgggtgagaacctgactgatgaggagctgcaggaaatgattgatgaagctgatcgagatggagatggagaggtcagtgagcaagagttcctgcgcatcatgaaaaagaccagcctctattaagatcagtgtcttctttttctactgcaagcacatgtaactagatttagtgcctgccatggtgtgaaatctggcttttgagaacacaaacttttcccccacggacctccctttatcactttaatagtgaccttgagcctattttagccgtttggaagtgttctttgatattacagttctttgtaaaatgacctgcgaattaccctaattctcaaaagcaaaacaagagcacacaagcgtgaagaaaaggatcttaaagctttgagcacctgccattttgccttgcatcgtttccctcgtcatgcatttccacatatccacaaacacagaacgactttagacaagcacatgttacacctgtgttgccacaagcagtcattcttgacggctccagtttttatttgacacttgagtttagttttctcttttataaacccagtgaactcctgcactggcatttggatgtgtgttaatgctatttgttttgtcttaaaagtaaaacctttctcagtttgaacttgtattctct

SEQ ID NO: 448555 - DNA, 1057 bp, Homo sapiens
gggtgggaacggcgccgagagtgtacacgtcggttgcctaacaaccggcagcggactcctttggctatggcctccaactttaagaaggcaaacatggcatcaagttctcagcgaaaaagaatgagccctaagcctgagcttactgaagagcaaaagcaggagatccgggaagcttttgatcttttcgatgcggatggaactggcaccatagatgttaaagaactgaaggtggcaatgagggccctgggctttgaacccaagaaagaagaaattaagaaaatgataagtgaaattgataaggaagggacaggaaaaatgaactttggtgactttttaactgtgatgacccagaaaatgtctgagaaagatactaaagaagaaatcctgaaagctttcaagctctttgatgatgatgaaactgggaagatttcgttcaaaaatctgaaacgcgtggccaaggagttgggtgagaacctgactgatgaggagctgcaggaaatgattgatgaagctgatcgagatggagatggagaggtcagtgagcaagagttcctgcgcatcatggtaactagatttagtgcctgccatggtgtgaaatctggcttttgagaacacaaacttttcccccacggacctccctttatcactttaatagtgaccttgagcctattttagccgtttggaagtgttctttgatattacagttctttgtaaaatgacctgcgaattaccctaattctcaaaagcaaaacaagagcacacaagcgtgaagaaaaggatcttaaagctttgagcacctgccattttgccttgcatcgtttccctcgtcatgcatttccacatatccacaaacacagaacgactttagacaagcacatgttacacctgtgttgccacaagcagtcattcttgacggctccagtttttatttgacacttgagtttagttttctcttttataaacccagtgaactcctgcactggcatttggatgtgtgttaatgctatttgttttgtcttaaaagtaaaacctttctcagtttgaacttgtattctct

SEQ ID NO: 448556 - DNA, 1036 bp, Homo sapiens
gggtgggaacggcgccgagagtgtacacgtcggttgcctaacaaccggcagcggactcctttggctatggcctccaactttaagaaggcaaacatggcatcaagttctcagcgaaaaagaatgagccctaagcctgagcttactgaagagcaaaagcaggagatccgggaagcttttgatcttttcgatgcggatggaactggcaccatagatgttaaagaactgaaggtggcaatgagggccctgggctttgaacccaagaaagaagaaattaagaaaatgataagtgaaattgataaggaagggacaggaaaaatgaactttggtgactttttaactgtgatgacccagaaaatgtctgagaaagatactaaagaagaaatcctgaaagctttcaagctctttgatgatgatgaaactgggaagatttcgttcaaaaatctgaaacgcgtggccaaggagttgggtgagaacctgactgatgaggagctgcaggaaatgattgatgaagctgatcgagatggagatggagaggtcagtgagcaagagttcctgcgcatcatgaaaaagaccagcctctattaagatcagtgtcttctttttctactgcaagcacatgtaactagatttagtgcctgccatggtgtgaaatctggcttttgagaacacaaacttttcccccacggacctccctttatcactttaatagtgaccttgagcctattttagccgtttggaagtgttctttgatattacagttctttgtaaaatgacctgcgaattaccctaattctcaaaagcaaaacaagagcacacaagcgtgaagaaaaggatcttaaagctttgagcacctgccattttgccttgcatcgtttccctcgtcatgcatttccacatatccacaaacacagaacgactttagacaagcacatgttacacctgtgttgccacaagcagtcattcttgacggctccagtttttatttgacacttgagtttagttttctcttttataaacccagtgaactcctgcactg

SEQ ID NO: 448557 - DNA, 2000 bp, Homo sapiens
gggtgggaacggcgccgagagtgtacacgtcggttgcctaacaaccggcagcggactcctttggctatggcctccaactttaagaaggcaaacatggcatcaagttctcagcgaaaaagaatgagccctaagcctgagcttactgaagagcaaaagcaggagatccgggaagcttttgatcttttcgatgcggatggaactggcaccatagatgttaaagaactgaaggtggcaatgagggccctgggctttgaacccaagaaagaagaaattaagaaaatgataagtgaaattgataaggaagggacaggaaaaatgaactttggtgactttttaactgtgatgacccagaaaatgtctgagaaagatactaaagaagaaatcctgaaagctttcaagctctttgatgatgatgaaactgggaagatttcgttcaaaaatctgaaacgcgtggccaaggagttgggtgagaacctgactgatgaggagctgcaggaaatgattgatgaagctgatcgagatggagatggagaggtcagtgagcaagagttcctgcgcatcatgaaaaagaccagcctctattaagatcagtgtcttctttttctactgcaagcacatgtaactagatttagtgcctgccatggtgtgaaatctggcttttgagaacacaaacttttcccccacggacctccctttatcactttaatagtgaccttgagcctattttagccgtttggaagtgttctttgatattacagttctttgtaaaatgacctgcgaattaccctaattctcaaaagcaaaacaagagcacacaagcgtgaagaaaaggatcttaaagctttgagcacctgccattttgccttgcatcgtttccctcgtcatgcatttccacatatccacaaacacagaacgactttagacaagcacatgttacacctgtgttgccacaagcagtcattcttgacggctccagtttttatttgacacttgagtttagttttctcttttataaacccagtgaactcctgcactggcatttggatgtgtgttaatgctatttgttttgtcttaaaagtaaaacctttctcagtttgaacttgtattctctaaggatgagttctttagctttgcttatgagttcctcttctcaattattgtgttgaaggcagcctattagatacaaaactccttaccagcctatggacagaaaatgaataatcctttgctactttcctggcatgaattgctttttgccttggaaggctgctggtttgtaaaactagcagaatttttatatcacctaagcctaaatgatgctctaaaaatagttttggcaaagctaagactggaaaagagtcttgttagtaatttgtgcttgaataaaatggggagagccaggctaacgcaacactaggatggattcagccaacctctcgtgaatttatttgcttatggtatctcatcgactcttggaggtgggttgggctgagtgaccccatccaaccatcttcctggccttgcccgggattccctgtgtgagaaatcctggtagatgacattaaagtctctgctccagggtgagagtggggaggcagaaggggtgagggagaatagaaaatgaacaatgatggaatgctcgtttgttcacatggagagggagaaaacagattttcaaacttctgggggtaggctagtcctctggggatagggttgcctgattcagctaataaaaagaaagttgaggtaaatttgcatttcagatcaatgatgccttttttttagtatgactatatcccatttgtattttttgtttattcattgttgatcttaaatgcaaatttacctaagcatcctgtattgccactggtaaccctacccggggagcacgttacagaggccagaagcctggccctcggtctcatgcctctggaccctgacatcctgtaggacttgggggcccaggaatatgaagtttaccatatcccccagatgagtct

SEQ ID NO: 448558 - DNA, 969 bp, Homo sapiens
ctgctcgcagcccatgcctcggggtgctgccatcttctctccctgcagggagagagaactggcacatagatgttaaagaactgaaggtggcaatgagggccctgggctttgaacccaagaaagaagaaattaagaaaatgataagtgaaattgataaggaagggacaggaaaaatgaactttggtgactttttaactgtgatgacccagaaaatgtctgagaaagatactaaagaagaaatcctgaaagctttcaagctctttgatgatgatgaaactgggaagatttcgttcaaaaatctgaaacgcgtggccaaggagttgggtgagaacctgactgatgaggagctgcaggaaatgattgatgaagctgatcgagatggagatggagaggtcagtgagcaagagttcctgcgcatcatgaaaaagaccagcctctattaagatcagtgtcttctttttctactgcaagcacatgtaactagatttagtgcctgccatggtgtgaaatctggcttttgagaacacaaacttttcccccacggacctccctttatcactttaatagtgaccttgagcctattttagccgtttggaagtgttctttgatattacagttctttgtaaaatgacctgcgaattaccctaattctcaaaagcaaaacaagagcacacaagcgtgaagaaaaggatcttaaagctttgagcacctgccattttgccttgcatcgtttccctcgtcatgcatttccacatatccacaaacacagaacgactttagacaagcacatgttacacctgtgttgccacaagcagtcattcttgacggctccagtttttatttgacacttgagtttagttttctcttttataaacccagtgaactcctgcactggcatttggatgtgtgttaatgctatttgttttgtcttaaaagtaaaacctttctcagtttgaacttgtattctct

SEQ ID NO: 448559 - DNA, 681 bp, Homo sapiens
cgaatgcacagccgaacccaagaatgtagagccagagcctcgtccgaacgccagagaagaagctatgctccgaccattccaacaaaagacagacttgaaggtcttcttgcttttaaagagaaaaggccccctcgctataaaggagaataaaaggaacagaaattcttaagatgccaatgtaataaatgtacttcctggaagtgtctttcggatccactatatgcctcagcacatggaaccttaatgaccaaagtgaagagcagattattcatacggtgtaataagcatctggaatggacccatccgtgtacttcattcaaatgtgtaaatgtcatattcattcagatttataaagctagtagtgtatagtcagaaacagaatcaaagttagatatacatttttaaatatttactgcatatgaggctttctgttaattttttaatgtgaataatttatatattgcacattctagggaataatattgattgtatgtctactgtgctgcattaagaaaataaaatttctatataccaaaaatgtgaagttataccaaataaagtttctaagtgattaatgcatacgaacagctacatatacatatatctaaacctgaaaaatgaattgatattctgagtgaaaactacctaatataaataaaattagtgaaaagaaaacatggg

SEQ ID NO: 448560 - DNA, 757 bp, Homo sapiens
ggcgggtccggacgccgtgcgcgtgcgcgcggcaggtcggcgccgggcgggggcggagcggccgtcgcaggtccacgccgtaaacagacaacatggcggccgcggtggcggcggcacctggggccttgggatccctgcatgctggcggcgcccgcctggtggccgcttgcagtgcgtggctctgcccggggttgaggctgcccggctcgttggcaggccggcgagcgggcccggcgatctgggcccagggctgggtacctgcggccgggggtcccgccccgaaaaggggctacagctctgagatgaagacggaggacgagctgcgggtgcggcacctggaggaggagaaccgagacagagacaagaacatggtcaaaggcatggagatgtgaacatgtgtggtgtatttgggacgtaacataaggaattgtggtgcttggaataaacagagcttatggcaaaaattcactcagtaaaaatcttataaaaatgctatcaaaagctgtggatgctttgaaatctgataagaaagtacggaccataataatcaggagtgaagtcccagggatattctgtgctgcttggcgagccggccaggggcatcacagccctttcattcctgtcgcctgcagctcagcgagttccaggtccttgtcccgcgaccaagaggaatgaggtgcgtggacaccagagagtgagtaaggcagagaagaattttattgagtgacataaggaaagctctcagctgtgagagggg

SEQ ID NO: 448561 - DNA, 1643 bp, Homo sapiens
ggcgggtccggacgccgtgcgcgtgcgcgcggcaggtcggcgccgggcgggggcggagcggccgtcgcaggtccacgccgtaaacagacaacatggcggccgcggtggcggcggcacctggggccttgggatccctgcatgctggcggcgcccgcctggtggccgcttgcagtgcgtggctctgcccggggttgaggctgcccggctcgttggcaggccggcgagcgggcccggcgatctgggcccagggctgggtacctgcggccgggggtcccgccccgaaaaggggctacagctctgagatgaagacggaggacgagctgcgggtgcggcacctggaggaggagaaccgaggaattgtggtgcttggaataaacagagcttatggcaaaaattcactcagtaaaaatcttataaaaatgctatcaaaagctgtggatgctttgaaatctgataagaaagtacggaccataataatcaggagtgaagtcccagggatattctgtgctggtgctgaccttaaggaaagagccaaaatgagttccagtgaagttggtccttttgtctccaaaataagagcagtgattaacgatattgctaatcttccagtaccaacaattgcagcaatagatggactcgctttaggtggtggtcttgaactggctttagcctgtgatatacgagtagcagcttcctctgcaaaaatgggcctggttgaaacaaaattggcgattattcctggtggaggggggacacagcgattgccacgcgccattggaatgtccctggccaaggagctcatattctctgcgcgagtcctcgatggcaaagaagccaaagcagtgggcttaatcagccacgttctggaacagaaccaggagggagacgcggcctacaggaaggccttggacctggcgagagagtttttacctcagggacctgttgcaatgagagtggcaaaattagcaattaatcaagggatggaggtcgatttagtaacagggttagccatagaagaagcttgttatgctcagaccattccaacaaaagacagacttgaaggtcttcttgcttttaaagagaaaaggccccctcgctataaaggagaataaaaggaacagaaattcttaagatgccaatgtaataaatgtacttcctggaagtgtctttcggatccactatatgcctcagcacatggaaccttaatgaccaaagtgaagagcagattattcatacggtgtaataagcatctggaatggacccatccgtgtacttcattcaaatgtgtaaatgtcatattcattcagatttataaagctagtagtgtatagtcagaaacagaatcaaagttagatatacatttttaaatatttactgcatatgaggctttctgttaattttttaatgtgaataatttatatattgcacattctagggaataatattgattgtatgtctactgtgctgcattaagaaaataaaatttctatataccaaaaatgtgaagttataccaaataaagtttctaagtgattaatgcatacgaacagctacatatacatatatctaaacctgaaaaatgaattgatattctgagtgaaaactacctaatataaataaaattagtgaaaagaaaacatggg

SEQ ID NO: 448562 - DNA, 1805 bp, Homo sapiens
ggcgggtccggacgccgtgcgcgtgcgcgcggcaggtcggcgccgggcgggggcggagcggccgtcgcaggtccacgccgtaaacagacaacatggcggccgcggtggcggcggcacctggggccttgggatccctgcatgctggcggcgcccgcctggtggccgcttgcagtgcgtggctctgcccggggttgaggctgcccggctcgttggcaggccggcgagcgggcccggcgatctgggcccagggctgggtacctgcggccgggggtcccgccccgaaaaggggctacagctctgagatgaagacggaggacgagctgcgggtgcggcacctggaggaggagaaccgagacagagacaagaacatggtcaaaggcatggagatgtgaacatgtgtggtgtatttgggacgtaacataaggcaagtgtggcataagcagaatagtaagaaattcagctggaagcatagactagcactggagtgattagagcctgaatgccatcatcttttgggaattgtggtgcttggaataaacagagcttatggcaaaaattcactcagtaaaaatcttataaaaatgctatcaaaagctgtggatgctttgaaatctgataagaaagtacggaccataataatcaggagtgaagtcccagggatattctgtgctggtgctgaccttaaggaaagagccaaaatgagttccagtgaagttggtccttttgtctccaaaataagagcagtgattaacgatattgctaatcttccagtaccaacaattgcagcaatagatggactcgctttaggtggtggtcttgaactggctttagcctgtgatatacgagtagcagcttcctctgcaaaaatgggcctggttgaaacaaaattggcgattattcctggtggaggggggacacagcgattgccacgcgccattggaatgtccctggccaaggagctcatattctctgcgcgagtcctcgatggcaaagaagccaaagcagtgggcttaatcagccacgttctggaacagaaccaggagggagacgcggcctacaggaaggccttggacctggcgagagagtttttacctcagggacctgttgcaatgagagtggcaaaattagcaattaatcaagggatggaggtcgatttagtaacagggttagccatagaagaagcttgttatgctcagaccattccaacaaaagacagacttgaaggtcttcttgcttttaaagagaaaaggccccctcgctataaaggagaataaaaggaacagaaattcttaagatgccaatgtaataaatgtacttcctggaagtgtctttcggatccactatatgcctcagcacatggaaccttaatgaccaaagtgaagagcagattattcatacggtgtaataagcatctggaatggacccatccgtgtacttcattcaaatgtgtaaatgtcatattcattcagatttataaagctagtagtgtatagtcagaaacagaatcaaagttagatatacatttttaaatatttactgcatatgaggctttctgttaattttttaatgtgaataatttatatattgcacattctagggaataatattgattgtatgtctactgtgctgcattaagaaaataaaatttctatataccaaaaatgtgaagttataccaaataaagtttctaagtgattaatgcatacgaacagctacatatacatatatctaaacctgaaaaatgaattgatattctgagtgaaaactacctaatataaataaaattagtgaaaagaaaacatggg

SEQ ID NO: 448563 - DNA, 1647 bp, Homo sapiens
ggcgggtccggacgccgtgcgcgtgcgcgcggcaggtcggcgccgggcgggggcggagcggccgtcgcaggtccacgccgtaaacagacaacatggcggccgcggtggcggcggcacctggggccttgggatccctgcatgctggcggcgcccgcctggtggccgcttgcagtgcgtggctctgcccggggttgaggctgcccggctcgttggcaggccggcgagcgggcccggcgatctgggcccagggctgggtacctgcggccgggggtcccgccccgaaaaggggctacagctctgagatgaagacggaggacgagctgcgggtgcggcacctggaggaggagaaccgaggaattgtggtgcttggaataaacagagcttatggcaaaaattcactcagtaaaaatcttataaaaatgctatcaaaagctgtggatgctttgaaatctgataagaaagtacggaccataataatcaggagtgaagtcccagggatattctgtgctggtgctgaccttaaggaaagagccaaaatgagttccagtgaagttggtccttttgtctccaaaataagagcagtgattaacgatattgctaatcttccagtaccaacaattgcagcaatagatggactcgctttaggtggtggtcttgaactggctttagcctgtgatatacgagtagcagcttcctctgcaaaaatgggcctggttgaaacaaaattggcgattattcctggtggaggggggacacagcgattgccacgcgccattggaatgtccctggccaaggagctcatattctctgcgcgagtcctcgatggcaaagaagccaaagcagtgggcttaatcagccacgttctggaacagaaccaggagggagacgcggcctacaggaaggccttggacctggcgagagagtttttacctcagggacctgttgcaatgagagtggcaaaattagcaattaatcaagggatggagcgattttagtaaacagggttaagccaatagaagaaagcttgttgatgctcagaccattccaacaaaagacagacttgaaggtcttcttgcttttaaagagaaaaggccccctcgctataaaggagaataaaaggaacagaaattcttaagatgccaatgtaataaatgtacttcctggaagtgtctttcggatccactatatgcctcagcacatggaaccttaatgaccaaagtgaagagcagattattcatacggtgtaataagcatctggaatggacccatccgtgtacttcattcaaatgtgtaaatgtcatattcattcagatttataaagctagtagtgtatagtcagaaacagaatcaaagttagatatacatttttaaatatttactgcatatgaggctttctgttaattttttaatgtgaataatttatatattgcacattctagggaataatattgattgtatgtctactgtgctgcattaagaaaataaaatttctatataccaaaaatgtgaagttataccaaataaagtttctaagtgattaatgcatacgaacagctacatatacatatatctaaacctgaaaaatgaattgatattctgagtgaaaactacctaatataaataaaattagtgaaaagaaaacatggg

SEQ ID NO: 448564 - DNA, 1504 bp, Homo sapiens
  misc_feature (1468)..(1468): n is a, c, g, or t
  misc_feature (1482)..(1482): n is a, c, g, or t
  misc_feature (1498)..(1499): n is a, c, g, or t
ggcgggtccggacgccgtgcgcgtgcgcgcggcaggtcggcgccgggcgggggcggagcggccgtcgcaggtccacgccgtaaacagacaacatggcggccgcggtggcggcggcacctggggccttgggatccctgcatgctggcggcgcccgcctggtggccgcttgcagtgcgtggctctgcccggggttgaggctgcccggctcgttggcaggccggcgagcgggcccggcgatctgggcccagggctgggtacctgcggccgggggtcccgccccgaaaaggggctacagctctgagatgaagacggaggacgagctgcgggtgcggcacctggaggaggagaaccgaggaattgtggtgcttggaataaacagagcttatggcaaaaattcactcagtaaaaatcttataaaaatgctatcaaaagctgtggatgctttgaaatctgataagaaagtacggaccataataatcaggagtgaagtcccagggatattctgtgctggtgctgaccttaaggaaagagccaaaatgagttccagtgaagttggtccttttgtctccaaaataagagcagtgattaacgatattgctaatcttccagtaccaacaattgcagcaatagatggactcgctttaggtggtggtcttgaactggctttagcctgtgatatacgagtagcagcttcctctgcaaaaatgggcctggttgaaacaaaattggcgattattcctggtggaggggggacacagcgattgccacgcgccattggaatgtccctggccaaggagctcatattctctgcgcgagtcctcgatggcaaagaagccaaagcagtgggcttaatcagccacgttctggaacagaaccaggagggagacgcggcctacaggaaggccttggacctggcgagagagtttttacctcagggacctgttgcaatgagagtggcaaaattagcaattaatcaagggatggaggtcgatttagtaacagggttagccatagaagaagcttgttatgctcagaccattccaacaaaagacagacttgaaggtcttcttgcttttaaagagaaaaggccccctcgctataaaggagaataaaaggaacagaaattcttaagatgccaatgtaataaatgtacttcctggaagtgtctttcggatccactatatgcctcagcacatggaaccttaatgaccaaagtgaagagcagattattcatacggtgtaataagcatctggaatggacccatccgtgtacttcattcaaatgtgtaaatgtcatattcattcagatttataaagctagtagtgtatagtcagaaacagaatcaaagttagatatacatttttaaatatttactgcatatgaggctttctgttaattttttaatgtgaataatttatatattgcacattctagggaataagggggaacgaatgtttttttactagntctagataataggntttttatataccaagnnaaaaa

SEQ ID NO: 448565 - DNA, 748 bp, Homo sapiens
  misc_feature (35)..(36): n is a, c, g, or t
  misc_feature (47)..(48): n is a, c, g, or t
  misc_feature (86)..(86): n is a, c, g, or t
ccccgcggcccgccatgaaagagtgtggtcactgnngcctaccattnncctaacccatgggaggcaaaatagcacttaatcaaggnatggagtcgatttagtaacagggttagccatagaagaagcttgttatgctcagaccattccaacaaaagacagacttgaaggtcttcttgcttttaaagagaaaaggccccctcgctataaaggagaataaaaggaacagaaattcttaagatgccaatgtaataaatgtacttcctggaagtgtctttcggatccactatatgcctcagcacatggaaccttaatgaccaaagtgaagagcagattattcatacggtgtaataagcatctggaatggacccatccgtgtacttcattcaaatgtgtaaatgtcatattcattcagatttataaagctagtagtgtatagtcagaaacagaatcaaagttagatatacatttttaaatatttactgcatatgaggctttctgttaattttttaatgtgaataatttatatattgcacattctagggaataatattgattgtatgtctactgtgctgcattaagaaaataaaatttctatataccaaaaatgtgaagttataccaaataaagtttctaagtgattaatgcatacgaacagctacatatacatatatctaaacctgaaaaatgaattgatattctgagtgaaaactacctaatataaataaaattagtgaaaagaaaacatggg

SEQ ID NO: 448566 - DNA, 713 bp, Homo sapiens
  misc_feature (1)..(1): n is a, c, g, or t
ngttccgggcccctgtcgcatgtaaatggcaaaatggcaattaatcaagggaggaggtcgatttagtaacagggttagccatagaagaagcttgttatgctcagaccattccaacaaaagacagacttgaaggtcttcttgcttttaaagagaaaaggccccctcgctataaaggagaataaaaggaacagaaattcttaagatgccaatgtaataaatgtacttcctggaagtgtctttcggatccactatatgcctcagcacatggaaccttaatgaccaaagtgaagagcagattattcatacggtgtaataagcatctggaatggacccatccgtgtacttcattcaaatgtgtaaatgtcatattcattcagatttataaagctagtagtgtatagtcagaaacagaatcaaagttagatatacatttttaaatatttactgcatatgaggctttctgttaattttttaatgtgaataatttatatattgcacattctagggaataatattgattgtatgtctactgtgctgcattaagaaaataaaatttctatataccaaaaatgtgaagttataccaaataaagtttctaagtgattaatgcatacgaacagctacatatacatatatctaaacctgaaaaatgaattgatattctgagtgaaaactacctaatataaataaaattagtgaaaagaaaacatggg

SEQ ID NO: 448567 - DNA, 1529 bp, Homo sapiens
ggcgggtccggacgccgtgcgcgtgcgcgcggcaggtcggcgccgggcgggggcggagcggccgtcgcaggtccacgccgtaaacagacaacatggcggccgcggtggcggcggcacctggggccttgggatccctgcatgctggcggcgcccgcctggtggccgcttgcagtgcgtggctctgcccggggttgaggctgcccggctcgttggcaggccggcgagcgggcccggcgatctgggcccagggctgggtacctgcggccgggggtcccgccccgaaaaggggctacagctctgagatgaagacggaggacgagctgcgggtgcggcacctggaggaggagaaccgaggaattgtggtgcttggaataaacagagcttatggcaaaaattcactcagtaaaaatcttataaaaatgctatcaaaagctgtggatgctttgaaatctgataagaaagtacggaccataataatcaggagtgaagtcccagggatattctgtgctggtgctgaccttaaggaaagagccaaaatgagttccagtgaagttggtccttttgtctccaaaataagagcagtgattaacgatattgctaatcttccagtaccaacaattgcagcaatagatggactcgctttaggtggtggtcttgaactggctttagcctgtgatatacgagtagcagcttcctctgcaaaaatgggcctggttgaaacaaaattggcgattattcctggtggaggggggacacagcgattgccacgcgccattggaatgtccctggccaaggagctcatattctctgcgcgagtcctcgatggcaaagaagccaaagcagtgggcttaatcagccacgttctggaacagaaccaggagggagacgcggcctacaggaaggccttggacctggcgagagagtttttacctcaggtcaaacaaataagaagatgttgatgtataagaagatgttgagttacttcagaaaatatgtgactgcaaaattacatgcacgagtcaccaaatgaagtttgagtggaatcacctttatttttatgtttgttactttgttgccaaatgattagtcctccagataactgaaagcttttgtaaaatcagtatttctaggtgatatctgtattatatattacttccatttatctgagaaaaaaaggcttgtaaagaagaaaaggcactggaaatgttttaaggaggaaacaaattaaatcaagcactatttctaatagcattttgaattttcctgtttttctcatggctttctaaactttacttcccaaagtgtggtctgtggaccagcagcctgggcatctcctggcagcttgttagacgtgcagaatctcaggcccatctcagacccactgagtccacatctgcattttaacaaggaggatggggatttgtgtgcatctaggagtttgacaagcaccttttcttggtcagttgacaatgaaaatggaaaaattagaggagcacaccatttaataaaatggattgattatcatgaaa

SEQ ID NO: 448568 - DNA, 175 bp, Homo sapiens
agatgtgaacatgtgtggtgtatttgggacgtaacataaggcaagtgtggcataagcagaatagtaagaaattcagctggaagcatagactagcactggagtgattagagcctgaatgccatcatcttttgggtaagcttagtcatgccgggacttcacttccgttaagtgtacc

SEQ ID NO: 448569 - DNA, 976 bp, Homo sapiens
ggcgggtccggacgccgtgcgcgtgcgcgcggcaggtcggcgccgggcgggggcggagcggccgtcgcaggtccacgccgtaaacagacaacatggcggccgcggtggcggcggcacctggggccttgggatccctgcatgctggcggcgcccgcctggtggccgcttgcagtgcgtggctctgcccggggttgaggctgcccggctcgttggcaggccggcgagcgggcccggcgatctgggcccagggctgggtacctgcggccgggggtcccgccccgaaaaggggctacagctctgagatgaagacggaggacgagctgcgggtgcggcacctggaggaggagaaccgaggaattgtggtgcttggaataaacagagcttatggcaaaaattcactcagtaaaaatcttataaaaatgctatcaaaagctgtggatgctttgaaatctgataagaaagtacggaccataataatcaggagtgaagtcccagggatattctgtgctggtgctgaccttaaggaaagagccaaaatgagttccagtgaagttggtccttttgtctccaaaataagagcagtgattaacgatattgctaatcttccagtaccaacaattgcagcaatagatggactcgctttaggtggtggtcttgaactggctttagcctgtgatatacgagtagcagcttcctctgcaaaaatgggcctggttgaaacaaaattggcgattattcctggtggagtgacttcctccactgaagtcttgaatccctccaagtcatccatgaagattggaatcatcatcttccaaactcctgttaatattgatattctggcctcttcccatgaatcatgaatgttcttaaagggatctagaatggcagatcctttccagaaggttttcaatttaatttgcccagatccataagaggaatcactgtctatggcagctatagccttatgaaatgtggt

SEQ ID NO: 448570 - DNA, 1685 bp, Homo sapiens
  misc_feature (1641)..(1641): n is a, c, g, or t
ggcgggtccggacgccgtgcgcgtgcgcgcggcaggtcggcgccgggcgggggcggagcggccgtcgcaggtccacgccgtaaacagacaacatggcggccgcggtggcggcggcacctggggccttgggatccctgcatgctggcggcgcccgcctggtggccgcttgcagtgcgtggctctgcccggggttgaggctgcccggctcgttggcaggccggcgagcgggcccggcgatctgggcccagggctgggtacctgcggccgggggtcccgccccgaaaaggggctacagctctgagatgaagacggaggacgagctgcgggtgcggcacctggaggaggagaaccgaggaattgtggtgcttggaataaacagagcttatggcaaaaattcactcagtaaaaatcttataaaaatgctatcaaaagctgtggatgctttgaaatctgataagaaagtacggaccataataatcaggagtgaagtcccagggatattctgtgctggtgctgaccttaaggaaagagccaaaatgagttccagtgaagttggtccttttgtctccaaaataagagcagtgattaacgatattgctaatcttccagtaccaacaattgcagcaatagatggactcgctttaggtggtggtcttgaactggctttagcctgtgatatacgagtagcagcttcctctgcaaaaatgggcctggttgaaacaaaattggcgattattcctggtggaggggggacacagcgattgccacgcgccattggaatgtccctggccaaggagctcatattctctgcgcgagtcctcgatggcaaagaagccaaagcagtgggcttaatcagccacgttctggaacagaaccaggagggagacgcggcctacaggaaggccttggacctggcgagagagtttttacctcagggacctgttgcaatgagagtggcaaaattagcaattaatcaagggatggaggtcgatttagtaacagggttagccatagaagaagcttgttatgctcagaccattccaacaaaagacagacttgaaggtcttcttgcttttaaagagaaaaggccccctcgctataaaggagaataaaaggaacagaaattcttaagatgccaatgtaataaatgtacttcctggaagtgtctttcggatccactatatgcctcagcacatggaaccttaatgaccaaagtgaagagcagattattcatacggtgtaataagcatctggaatggacccatccgtgtacttcattcaaatgtgtaaatgtcatattcattcagatttataaagctagtagtgtatagtcagaaacagaatcaaagttagatatacatttttaaatatttactgcatatgaggctttctgttaattttttaatgtgaataatttatatattgcacattctagggaataatattgattgtatgtctactgtgctgcattaagaaaataaaatttctatataccaaaaatgtgaagttataccaaataaagtttctaagtgattaatgcatacgaacagctacatatacatatatctaaacctgaaaaatgaattgatattctgagtgaaaactacctaatataaataaatcgatgacgcgagcaagccntcccctctttctcggcgatatatcttcgagatctaattcttacg

SEQ ID NO: 448571 - DNA, 1556 bp, Homo sapiens
ggcgggtccggacgccgtgcgcgtgcgcgcggcaggtcggcgccgggcgggggcggagcggccgtcgcaggtccacgccgtaaacagacaacatggcggccgcggtggcggcggcacctggggccttgggatccctgcatgctggcggcgcccgcctggtggccgcttgcagtgcgtggctctgcccggggttgaggctgcccggctcgttggcaggccggcgagcgggcccggcgatctgggcccagggctgggtacctgcggccgggggtcccgccccgaaaaggggctacagctctgagatgaagacggaggacgagctgcgggtgcggcacctggaggaggagaaccgaggaattgtggtgcttggaataaacagagcttatggcaaaaattcactcagtaaaaatcttataaaaatgctatcaaaagctgtggatgctttgaaatctgataagaaagtacggaccataataatcaggagtgaagtcccagggatattctgtgctgctaatcttccagtaccaacaattgcagcaatagatggactcgctttaggtggtggtcttgaactggctttagcctgtgatatacgagtagcagcttcctctgcaaaaatgggcctggttgaaacaaaattggcgattattcctggtggaggggggacacagcgattgccacgcgccattggaatgtccctggccaaggagctcatattctctgcgcgagtcctcgatggcaaagaagccaaagcagtgggcttaatcagccacgttctggaacagaaccaggagggagacgcggcctacaggaaggccttggacctggcgagagagtttttacctcagggacctgttgcaatgagagtggcaaaattagcaattaatcaagggatggaggtcgatttagtaacagggttagccatagaagaagcttgttatgctcagaccattccaacaaaagacagacttgaaggtcttcttgcttttaaagagaaaaggccccctcgctataaaggagaataaaaggaacagaaattcttaagatgccaatgtaataaatgtacttcctggaagtgtctttcggatccactatatgcctcagcacatggaaccttaatgaccaaagtgaagagcagattattcatacggtgtaataagcatctggaatggacccatccgtgtacttcattcaaatgtgtaaatgtcatattcattcagatttataaagctagtagtgtatagtcagaaacagaatcaaagttagatatacatttttaaatatttactgcatatgaggctttctgttaattttttaatgtgaataatttatatattgcacattctagggaataatattgattgtatgtctactgtgctgcattaagaaaataaaatttctatataccaaaaatgtgaagttataccaaataaagtttctaagtgattaatgcatacgaacagctacatatacatatatctaaacctgaaaaatgaattgatattctgagtgaaaactacctaatataaataaaattagtgaaaagaaaacatggg

SEQ ID NO: 448572 - DNA, 1595 bp, Homo sapiens
ggcgggtccggacgccgtgcgcgtgcgcgcggcaggtcggcgccgggcgggggcggagcggccgtcgcaggtccacgccgtaaacagacaacatggcggccgcggtggcggcggcacctggggccttgggatccctgcatgctggcggcgcccgcctggtggccgcttgcagtgcgtggctctgcccggggttgaggctgcccggctcgttggcaggccggcgagcgggcccggcgatctgggcccagggctgggtacctgcggccgggggtcccgccccgaaaaggggctacagctctgagatgaagacggaggacgagctgcgggtgcggcacctggaggaggagaaccgaggaattgtggtgcttggaataaacagagcttatggcaaaaattcactcagtaaaaatcttataaaaatgctatcaaaagctgtggatgctttgaaatctgataagaaagtacggaccataataatcaggagtgaagtcccagggatattctgtgctggtgctgaccttaaggaaagagccaaaatgagttccagtgaagttggtccttttgtctccaaaataagagcagtgattaacgatattgctaatcttccagtaccaacaattgcagcaatagatggactcgctttaggtggtggtcttgaactggctttagcctgtgatatacgagtagcagcttcctctgcaaaaatgggcctggttgaaacaaaattggcgattattcctggtggaggggggacacagcgattgccacgcgccattggaatgtccctggccaaggagctcatattctctgcgcgagtcctcgatggcaaagaagccaaagcagtgggcttaatcagccacgttctggaacagaaccaggagggagacgcggcctacaggaaggccttggacctggcgagagagtttttacctcagggacctgttgcaatgagagtggcaaaattagcaattaatcaagggatggagaccattccaacaaaagacagacttgaaggtcttcttgcttttaaagagaaaaggccccctcgctataaaggagaataaaaggaacagaaattcttaagatgccaatgtaataaatgtacttcctggaagtgtctttcggatccactatatgcctcagcacatggaaccttaatgaccaaagtgaagagcagattattcatacggtgtaataagcatctggaatggacccatccgtgtacttcattcaaatgtgtaaatgtcatattcattcagatttataaagctagtagtgtatagtcagaaacagaatcaaagttagatatacatttttaaatatttactgcatatgaggctttctgttaattttttaatgtgaataatttatatattgcacattctagggaataatattgattgtatgtctactgtgctgcattaagaaaataaaatttctatataccaaaaatgtgaagttataccaaataaagtttctaagtgattaatgcatacgaacagctacatatacatatatctaaacctgaaaaatgaattgatattctgagtgaaaactacctaatataaataaaattagtgaaaagaaaacatggg

SEQ ID NO: 448573 - DNA, 7922 bp, Homo sapiens
gggttgagtcaagatggcggccaaggtggcgaagcagcagccgcggcggcggcggcggctggagtgagcgtccgactcgccgcgccgaacgaggtcccggtgtagggccgcgcgccgtggccgcgtcccactcctcaggccggggcgcacgtcggctcccacgcttagccagctcccggtggtttcctagaaacatgattgtttattggcattgatctcacagtctggtgaggacttctttactgataatgtcaagttcaggttatcctcccaaccaaggagcattcagcacagaacaaagtcgttatcctcctcactctgtccagtatacatttcccaacacccgccaccagcaggagttcgcagtccctgattatcgttcctctcatcttgaagtgagtcaggcatcacagcttttgcagcaacagcagcagcaacagcttcgaaggcgaccttccttgctttcagaatttcacccaggttctgacaggcctcaagaaaggagaactagttatgaaccgtttcatccaggcccatccccagtggatcatgattcactggaatcgaagcgaccacgtctggaacaggtttctgattctcattttcagcgtgtcagtgctgcggttttgcctttagtgcacccgctgccagaagggctgagggcttctgcagatgctaagaaggatccagcattcggaggcaaacatgaagctccatcctctccaatttcggggcaaccatgtggagatgatcaaaatgcttcaccttcaaaactctcaaaggaagagttaatacagagtatggatcgtgtagatcgagaaattgcaaaagtagaacagcagatccttaaactgaaaaagaaacaacaacagcttgaagaagaggcagctaaacctcctgagcctgagaagcccgtgtcccctcctcctgtggagcagaaacaccgcagtattgtccaaattatttatgatgagaatcggaaaaaagcagaagaagctcataaaatttttgaaggtcttggcccaaaagttgaactgccactgtataaccagccatcagataccaaggtgtaccatgagaacatcaagacaaaccaggtgatgaggaaaaaactcattttattttttaaaagaagaaatcatgcaagaaaacaaagggaacaaaaaatctgccagcgttatgatcagctcatggaggcatgggagaaaaaagtggacagaatagaaaataatcctcggaggaaagctaaagaaagcaaaacaagggaatactatgaaaagcagtttccagaaattcgaaaacaaagagaacagcaagaaagatttcagcgagttgggcagaggggagctggtctttcagccaccattgctaggagtgagcatgagatttctgaaattattgatgggctctctgagcaggagaataatgagaaacaaatgcggcagctctctgtgattccacctatgatgtttgatgcagaacaaagacgagtcaagttcattaacatgaatgggcttatggaggaccctatgaaagtgtataaagataggcagtttatgaatgtttggactgaccatgaaaaggagatctttaaggacaagtttatccagcatccaaaaaactttggactaattgcatcatacttggagaggaagagtgttcctgattgtgttttgtattactatttaaccaagaaaaatgagaattataaagccctcgtcagaaggaattatgggaaacgcagaggcagaaaccagcaaattgctcgaccctcgcaagaagaaaaagtagaagaaaaagaagaggataaagcagaaaaaacagaaaaaaaagaagaagaaaagaaagatgaagaggaaaaagatgaaaaagaagactccaaagaaaataccaaggaaaaggacaagatagatggtacagcagaagaaactgaggaaagagagcaagccacaccccgggggcgaaagactgccaacagtcagggccgccgtaagggccggatcaccaggtccatgacaaacgaagctgcagctgccagtgctgcagccgcagcggctactgaagagcccccaccacctctgccaccgccaccagaacccatttctacagagcctgtggagacctctcgatggacagaagaagaaatggaagttgctaaaaaaggtctagtagaacatggtcgtaactgggcagcaattgctaaaatggtgggaacgaaaagtgaagctcaatgtaaaaacttctattttaactataaaaggcgacacaatcttgacaacctcttacagcagcataaacagaaaacttcacgaaaacctcgtgaagagcgagatgtgtctcaatgtgaaagtgtcgcttccactgtttctgctcaggaggatgaagatattgaagcctccaatgaagaagaaaatccagaagacagcgaagttgaagctgtcaagcccagcgaggacagtcctgaaaatgctacttctcgaggaaacacagaacctgcggttgagcttgagcccaccacggaaactgcacccagtacatctccctccttagcagttccaagtacaaaaccagctgaagatgaaagtgtggagacccaggtgaatgacagcatcagtgctgagacagcagagcagatggatgtagatcagcaggagcacagtgctgaagagggttctgtttgtgatcccccacccgctaccaaagctgactctgtggacgttgaagtgagggtgccagaaaaccatgcatctaaagttgaaggtgataataccaaagaaagagacttggatagagccagtgagaaggtggaacctagagatgaagatttggtggtagctcagcaaataaatgcccaaaggcccgagccccagtcagacaatgattccagtgccacgtgcagcgctgatgaggatgtggatggagagccagagaggcagagaatgtttcctatggactcaaagccttcactgttaaaccccactggatctatactcgtctcatctccgttaaaaccaaatccactggatctgccacagcttcagcatcgagctgctgttatcccaccaatggtatcctgcaccccatgtaacataccaattggaaccccagtgagcggctatgctctctaccagcgacacattaaagcaatgcatgagtcagcactcctggaggagcagcggcagagacaagaacagatagatttggaatgtagaagttctacaagtccatgtggcacatccaagagtccaaacagagagtgggaagtccttcagcctgctccacatcaagtgataactaatctccctgaaggcgttcggcttccgacaactcgaccaaccaggccaccgccccctctcatcccgtcatccaaaaccacagtggcttcagaaaaaccatcttttataatgggaggctccatctcacagggaacaccaggcacttatttgacttctcataatcaggcttcctacactcaagaaacacccaagccgtcagtgggatctatctctcttggactgccacggcaacaggaatctgccaaatcagctactttgccctacatcaagcaggaagaattttctccccgaagccaaaactcacaacctgagggtctgttggtcagggcccaacatgaaggtgtagtcagaggtaccgcaggagccatacaagaaggaagtataactcggggaactccaaccagcaaaatttcagtggagagcattccatccctacggggctctatcactcagggcaccccggctctgccccagactggcataccaacagaggctttggtgaaggggtccatttcgagaatgcccattgaagacagcagtcctgagaaaggcagagaggaagctgcatccaaaggccatgttatttatgaaggcaaaagtggacatatcttgtcatatgataatattaagaatgcccgagaagggactaggagtccaagaacagctcatgaaatcagtttaaagagaagctatgaatcagtggaaggaaatataaagcaagggatgtcaatgagggagtctcctgtatcagcaccgttagaggggctgatatgccgagcattacccagggggagtcctcattctgacctcaaagaaaggactgtattgtctggctccataatgcaggggacaccaagagcaacaactgaaagctttgaagatggccttaaatatcccaaacaaattaaaagggaaagtcctcccatacgagcatttgaaggtgccattaccaaaggaaaaccatatgatggcatcaccaccatcaaagaaatggggcgttccattcatgagattccaaggcaagatattttaactcaggaaagtcggaaaactccagaagtggtccagagcacacggccgataattgagggttccatttcccagggcacaccaataaagtttgacaacaactcaggtcaatctgccatcaaacacaatgtcaaatccttaatcacggggcctagcaaactatcccgtggaatgcctccgctggaaattgtgccagagaacataaaagtggtagaacggggaaaatatgaggatgtgaaagcaggcgagaccgtgcgttcccggcacacgtcagtggtaagctctggcccctccgttcttaggtccacactgcatgaagctcccaaagcacaactgagccctgggatttatgatgacaccagtgcacggaggacccctgtgagttatcaaaacaccatgtccagaggctcacccatgatgaacagaacttctgatgttacaatttcttctaacaagtctaccaatcatgaaaggaaatcgacactgacccctacccagagggaaagtatcccagcgaagtctccagtgcctggggtggaccctgtcgtgagccacagtccgtttgatccccatcacagaggcagcactgcaggcgaggtttatcggagccacctgcccacgcacttggatccagccatgccttttcacagggctttggatcctgcagcggctgcttacctgtttcagagacagctttcaccaactccaggttacccaagtcagtatcagctttacgcaatggagaacacaagacagacaatcttaaatgattacattacctcacaacagatgcaagtgaacttgcgtccagatgtggccagaggactctccccaagagagcagccactgggtctcccatacccagcaacgagaggaatcattgacctgaccaatatgcctccaacaattttagtgcctcatccagggggaacaagcactcctcccatggacagaatcacttatattcctggtacacagattactttccctcccaggccgtacaactctgcttccatgtctccaggacacccaacacaccttgcagctgctgcaagtgctgagagggaacgggaacgggagcgggagaaggagcgggagcgggaacggattgctgcagcttcctccgacctctacctgcggccaggctcagaacagcctggccgacctggcagtcatggatatgttcgctccccttccccttcagtaagaactcaggagaccatgttgcaacagagacccagtgttttccaaggaaccaatggaaccagtgtaatcacacctttggatccaactgctcagctacgaatcatgccactgcctgctgggggcccttcaataagccaaggcctgccagcctcccgttacaacactgctgcggatgccctggctgctcttgtggatgctgcagcttctgcaccccagatggatgtgtccaaaacaaaagagagtaagcatgaagctgccaggttagaagaaaatttgagaagcaggtcagcagcagttagtgaacagcagcagctagagcagaaaaccctggaggtggagaagagatctgttcagtgtttatacacttcttcagcctttccaagtggcaagccccagcctcattcttcagtagtttattctgaggctgggaaagataaagggcctcctccaaaatccagatatgaggaagagctaaggaccagagggaagactaccattactgcagctaacttcatagacgtgatcatcacccggcaaattgcctcggacaaggatgcgagggaacgtggctctcaaagttcagactcttctagtagcttatcttctcacaggtatgaaacacctagcgatgctattgaggtgataagtcctgccagctcacctgcgccaccccaggagaaactgcagacctatcagccagaggttgttaaggcaaatcaagcggaaaatgatcctaccagacaatatgaaggaccattacatcactatcgaccacagcaggaatcaccatctccccaacaacagctgcccccttcttcacaggcagagggaatggggcaagtgcccaggacccatcggctgatcacacttgctgatcacatctgtcaaattatcacacaagattttgctagaaatcaagtttcctcgcagactccccagcagcctcctacttctacattccagaactcaccttctgctttggtatctacacctgtgaggactaaaacatcaaaccgttacagcccagaatcccaggctcagtctgtccatcatcaaagaccaggttcaagggtctctccagaaaatcttgtggacaaatccaggggaagtaggcctggaaaatccccagagaggagtcacgtctcttcggagccctacgagcccatctccccaccccaggttccggttgtgcatgagaaacaggacagcttgctgctcttgtctcagaggggcgcagagcctgcagagcagaggaatgatgcccgctcaccagggagtataagctacttgccttcattcttcaccaagcttgaaaatacatcacccatggttaaatcaaagaagcaggagatttttcgtaagttgaactcctctggtggaggtgactctgatatggcagctgctcagccaggaactgagatctttaatctgccagcagttactacgtcaggctcagttagctctagaggccattcttttgctgatcctgccagtaatcttgggctggaagacattatcaggaaggctctcatgggaagctttgatgacaaagttgaggatcatggagttgtcatgtcccagcctatgggagtagtgcctggtactgccaacacctcagttgtgaccagtggtgagacacgaagagaggaaggggacccatcacctcattcaggaggagtttgcaaaccaaagctgatcagcaagtcaaacagcaggaaatctaagtctcctatacctgggcaaggctacttaggaacggaacggccctcttcagtctcctctgtacattcagaaggggattaccataggcagacgccagggtgggcctgggaagacaggccctcttcaacaggctcaactcagtttccttataaccctctgactatgcggatgctcagcagtactccaccaacaccgattgcatgtgctccctctgcggtgaaccaagcagctcctcaccaacagaacaggatctgggagcgagagcctgccccactgctctcagcacagtacgagaccctgtcggatagtgatgactgaactgcacaaagtgaggggaacagggtgcaggagagggatctctagtttttgtggtttaatttttagtagcaggtcaaaaacctgccctcctgtgacttattccctgagacttttcaggagagccagcccacagatgatgaagaaatgatggaagttcatttggagagtcaaatgggaaaaaaacaaacaaaaaactgcctttgatacaggcaattcagtggactataataatagtggagggttgagatgtagagtttttaaaaagtgaacagttgctgttcttacatctgtaaagaaaaccataatgtctttaaatcactcttctgtaaatagatgacctttttgcagtgt

SEQ ID NO: 448574 - DNA, 2856 bp, Homo sapiens
  misc_feature (190)..(190): n is a, c, g, or t
  misc_feature (200)..(200): n is a, c, g, or t
  misc_feature (204)..(205): n is a, c, g, or t
  misc_feature (210)..(210): n is a, c, g, or t
  misc_feature (217)..(218): n is a, c, g, or t
  misc_feature (232)..(232): n is a, c, g, or t
  misc_feature (236)..(236): n is a, c, g, or t
  misc_feature (240)..(242): n is a, c, g, or t
  misc_feature (246)..(246): n is a, c, g, or t
  misc_feature (257)..(257): n is a, c, g, or t
  misc_feature (263)..(263): n is a, c, g, or t
  misc_feature (272)..(273): n is a, c, g, or t
  misc_feature (282)..(282): n is a, c, g, or t
  misc_feature (287)..(288): n is a, c, g, or t
  misc_feature (294)..(294): n is a, c, g, or t
  misc_feature (300)..(301): n is a, c, g, or t
  misc_feature (305)..(305): n is a, c, g, or t
  misc_feature (317)..(318): n is a, c, g, or t
  misc_feature (320)..(321): n is a, c, g, or t
  misc_feature (332)..(332): n is a, c, g, or t
  misc_feature (336)..(337): n is a, c, g, or t
  misc_feature (348)..(348): n is a, c, g, or t
  misc_feature (351)..(351): n is a, c, g, or t
  misc_feature (360)..(360): n is a, c, g, or t
  misc_feature (362)..(362): n is a, c, g, or t
  misc_feature (365)..(368): n is a, c, g, or t
  misc_feature (370)..(370): n is a, c, g, or t
  misc_feature (373)..(373): n is a, c, g, or t
  misc_feature (377)..(377): n is a, c, g, or t
  misc_feature (382)..(382): n is a, c, g, or t
  misc_feature (387)..(388): n is a, c, g, or t
  misc_feature (390)..(390): n is a, c, g, or t
  misc_feature (393)..(393): n is a, c, g, or t
  misc_feature (405)..(405): n is a, c, g, or t
  misc_feature (414)..(416): n is a, c, g, or t
  misc_feature (425)..(425): n is a, c, g, or t
  misc_feature (437)..(437): n is a, c, g, or t
  misc_feature (441)..(441): n is a, c, g, or t
  misc_feature (443)..(444): n is a, c, g, or t
  misc_feature (459)..(459): n is a, c, g, or t
  misc_feature (461)..(461): n is a, c, g, or t
  misc_feature (470)..(470): n is a, c, g, or t
  misc_feature (476)..(477): n is a, c, g, or t
  misc_feature (485)..(485): n is a, c, g, or t
  misc_feature (487)..(487): n is a, c, g, or t
  misc_feature (492)..(492): n is a, c, g, or t
  misc_feature (496)..(496): n is a, c, g, or t
  misc_feature (502)..(502): n is a, c, g, or t
  misc_feature (508)..(508): n is a, c, g, or t
  misc_feature (515)..(515): n is a, c, g, or t
  misc_feature (520)..(520): n is a, c, g, or t
  misc_feature (523)..(523): n is a, c, g, or t
  misc_feature (672)..(672): n is a, c, g, or t
  misc_feature (689)..(689): n is a, c, g, or t
  misc_feature (1425)..(1425): n is a, c, g, or t
tctggccagtcacgtgaagcagtgggagtggaaaaggaacaaagaaatctgtaactggtggtgatcagttactgtaaacaccacttcacctagaccagcctgagtatttttctttcgggtttttttttttttttttttttgctagttgcaaaatgaacatatttattataaaaaagttgaaacatatttnttttttgagncagnntctcnctctgtnncccaggctgaagtncagnggcnnnatcntgctattgcancctcanctcctgggnncaagcaatnctcanncctcancctccnnagtngctgggaccacnnanntgtgccaccangccnngctaatttttntanttttagtananacnnnntntcnccangttgnccagnntngtntgaactcctggnctcaagcannnctcccaccntggcctcccaangtgntnngattacaggtgtgancnaccatgccnggctgnnatttgttntnttttntttntttttntttttnttttttngaganggngtttcgccatgttggccaggctggtcttgaacccctggcttcaggtgatccgcccgtcttggcctcccacagtgctgggattacaggcgcaagccaccacagccagccatggaaagcattctgctgcttgtggaagaattttccctgcntaaagttgtcgagatgnttgaataagtggtagagagagaggtcaggtgaatgtggcagatgaggcaaaacttcatagcccaattcattcaatttttgaagcattggttgtgtgacacaggtgttgtcgtggagaattgggctatttctgttgaccagtgctggctgcaggcattgcagttttcagtgcatctcattcatttgctgagcatacttgtcatatgtaatggttttgccgggattcggaaagctgtagtggctcagactggcagcagaccacctttttttggtgcaagtttggctttgggaagtgttttggagctgcttctcagtccagccactgaggtggttgtcgctagtttttgtataaaatctacttttcatcggatgtcatgatccagttgagaaatggtttgttgttgcctagaataagagaagacacttcagaaagacagtttttaaaattttcgctcagctcatggggcacccatttactgagctttttcacctttccagtttgcttcaaatgccaaacaaccgtagaatggttgacgttgagttctttggcaacttctcgtgtagttgtaagaggatcagcatcaatgattgctctcaattggttgttgtcaacttccgatggccggccactatgctcctcatcttcaaggctcttgtttcctttgtaaaacttcttgaaccaccactgcactgtatgcttgttaacagttcctgggccaaatgcgttgttgatgttntgaattgtctctgctgctttacaacccattttgaacttgaataagaaaatcacttgaatttgctttttgtataacataattttcatcgtctaaaataaatataaaacaccaagtaataagtcattaacaaaaaaagtgacaaatgcacattaaaatgatatattgcgtaactacattcagaagaaaacaagaacttaaccacatttatttaagaatgtattccagtatcaaacggcaaatttcaacaacgcaaaaactgcaattacatttgcaacaacctaataaaagctgttacatttacttgattttagtccttaagagaaacttctgagagttaaatcctgtaatagagtcctcacatgaaggtgagagcaaagttgattcacctaatgtacgtgtcataattttaagtgttatgtggctgagttgaaggatgaaggtacaggatgtcttcatgttgataaaaattcaatgtctaatttcctttcatgtatgtgtgctttcttctttgaagctatagattagcctgactctgtcataggttaaattttctgagcatcttgtgttttccctaaactcgagtgactcctctgctatttatgcttgatttgatggcagggcaccccggctctgccccagactggcataccaacagaggctttggtgaaggggtccatttcgagaatgcccattgaagacagcagtcctgagaaaggcagagaggaagctgcatccaaaggccatgttatttatgaaggcaaaagtggacatatcttgtcatatgatagtaagtattgtatgtatgcaccaaagccagtattacaatatgtgctaaaaacataggcttgggttttcccgcatttctgctctctgggagtcagtttatctttgctgagcctatgttttctctcagtaaatggggttagtaatacttgtctcatgagaattttgtgaataacagcttagtcgataaaaagtaattaacaacgcagagctcatattaaatgtcccataggtggtagctaagattgtcgactgtggtcagtcagtttagcttaggtaaagagcctttgttgaactttaatggaatacttttattttgaagagattcatgttttatgaattaagaattagagggtagataggctgggcgcggtggttcacgcctatctactatctaatcccagtactttgggaggccaaggcaggtggatcgcctggggtcgggagttcaagaccggcctgaccaacatggagaaaccccatctctactagaaatacaaagttagccaggcatggtggtgcatgcctgtaatcccagctactcgggaggctgaagcaggagaatcgcttgaatccgggaggcggaggttgctgtgagccgagatcgcgccatttccagcctgggcaacaagagggaaactccgtctc

SEQ ID NO: 448575 - DNA, 651 bp, Homo sapiens
actgcaatgccttaagcattattcttgaagataactttgattaaaaaatgataaaatcaattcaaccaataacatgacagaaataagcattacattacttgttaagagatggcaattattacattggttgtttgcatatttcgatttattttcttcctataggtatcctgcaccccatgtaacataccaattggaaccccagtgagcggctatgctctctaccagcgacacattaaagcaatgcatgagtcagcactcctggaggagcagcggcagagacaagaacagatagatttggaatgtagaagttctacaagtccatgtggcacatccaagagtccaaacagagagtgggaaggtaggtagatagagctatcaccaagagaacttttatgaagggaaataaagctaaacccaaaagcagtgtccattgtgctttgtaagttgtcagcctcccaactgattattatatttgtcctaacagacacagttccttaaattgaccttaaactatgaagaaatgttagtattattaactactaaaggatgccagtaacatttttaatagcattctagttaatgtgaattttctgatattcatctttgtgctggaagacattataaataaagttatgctttatgttccgttca

SEQ ID NO: 448576 - DNA, 973 bp, Homo sapiens
gatgagcaaagaaagtggtttcttgagattgaatctgcccctgaagatgctgtgaacatggctgaaatgacaacaaaggatttagaatactacattacataaacccagttaataaagaagggtttgagggatcaactccaattttgaaagttctactgtggctaaaatgctatcattgcatgctacaaataagtctttcatgaaaggaaaagaaattgccacagccatcccagcctttggcaaccgccatgcagattagtcagcagccatcaacatggaggcaagaccatccaccagcaaaataattgtgacttactaaaccctcagtatctctgaggtatgcctgtagtattttatttcattgagtaccaggatctggattcttcatgttaccattctgcttttttttcatttagcaatatataatcattagcattttggtaatttttgagaacttaatatattaatactttaacttgaatttcactttcaggaggagtttgcaaaccaaagctgatcagcaagtcaaacagcaggaaatctaagtctcctatacctgggcaaggctacttaggaacggaacggccctcttcagtctcctctgtacattcagaaggggattaccataggcagacgccagggtgggcctgggaagacaggccctcttcaacaggtaaggattctgctttaacttagaaaatgagacagagcaataatatcaatgtcttggttattagttcttcaaaattcagcaactcttctaatttggaaacctatattcccatttctgtatcattaatatgttccactttcccgaatagaagtatttttttgaggggtcttgttctgtcacccaggatctggattcttcatgttaccattctgcttttttttcatttagcaatatataatcattagcattttggtaatttttgagaacttaatatattaatactttaacttgaatttcact

SEQ ID NO: 448577 - DNA, 546 bp, Homo sapiens
tgatgatagtaaacatttttatttatattatgtacaaattacccttgattcacagagatagacaaaatccaaagtcatgtatggttctgtacctttagaataacacttaacataaattgtattgtcttttggataggaatcattgacctgaccaatatgcctccaacaattttagtgcctcatccagggggaacaagcactcctcccatggacagaatcacttatattcctggtacacagattactttccctcccaggccgtacaactctgcttccatgtctccaggtgagattgtacagttacacacctctctaatagaaccatcatgtttacatttttacaacatagccttttaaggtatcttgggcaatttttcctcatttggtttcttgtttttcttttaacatttaatagtagttcttatgtgccagctgtcactagataccttaggaatgccttaaaagcttatgttatgcttcagttcttatccaggactcttaataaaacaaacttctttttctcttttcttgttttttttttgtttt

SEQ ID NO: 448578 - DNA, 569 bp, Homo sapiens
caactaaagttcatttgcctttattcccaggaaagtgtaaatgagctttcttccccctgcatattattcttagaatgtccccactgtccttggcatttggtacctatgacctttttaatgtatattcaaaagatgattatattcctatttgttggtttgtaaagacagttaagaagaatgtgtagtttggtagtggtttggggacacttcagtggtgcttccgaataatacctctcatatttatctgtctcaatggtttctactgggtcagcatcagtagaagtttaagaaggtgatattggccagacatagtggcttatacctgtaatgctagcactttgggaggctgaggtaggaggattgcttgagcccaggaatttgagaccagcctgggcaacatagtgagatctcatctctacaaaaaaaaagtttatatattttttgtttgtttgtttgcttgcttctgcatttatattttattctaggcctcagacttctgtcagtgaataattttatatatatatatatgtatatatgtatgtatagatacacacacatatatatatgca

SEQ ID NO: 448579 - DNA, 907 bp, Homo sapiens
tttaaagaagagtattgaattttatttttaatgttacataaggtggtaaaatactggtgctatgatccaaaaggtgacagtactctccaaatctcagtttctactagttgtttacattttcatatgttgtttacattttcatattttgcaatattgaatgttaaatgttgagtggaaagagaagatccaaatacatgaatatagtctttatttgaatggttgagaaatggacaaatattatcatacttgcaagtttcttaagaacttgtggcattggctctttttttccagttacaatttcttctaacaagtctaccaatcatgaaaggaaatcgacactgacccctacccagagggaaagtatcccagcgaagtctccagtgcctggggtggaccctgtcgtgagccacagtccgtttgatccccatcacagaggcagcactgcaggcgaggtttatcggagccacctgcccacgcacttggatccagccatgccttttcacagggctttggatcctggtaaacacaaaatatagtgataatttatggcaaataaatatgccaccagtatgacttttcagctttctgttgttgtacaatatagtacaattgcaaatatcattaatgtacagctcagtgaattttcacaaactaaattctcccatgttaccagcacccagatcaagaaataaaatcttatcagcacccggtaaagaactaaaaagaatagtatatgaaaagctctcttatctgatggcacttggtgaaactagttgaaaaagtggattaatgtgaataattattttaaaatgacagaggcatacctaaacatgttaacttacagcataaatagacgttcatttaccagaactctgatctaatgccaaggctttttcataaacaagtg

SEQ ID NO: 448580 - DNA, 8511 bp, Homo sapiens
gggttgagtcaagatggcggccaaggtggcgaagcagcagccgcggcggcggcggcggctggagtgagcgtccgactcgccgcgccgaacgaggtcccggtgtagggccgcgcgccgtggccgcgtcccactcctcaggccggggcgcacgtcggctcccacgcttagccagctcccggtggtttcctagaaacatgattgtttattggcattgatctcacagtctggtgaggacttctttactgataatgtcaagttcaggttatcctcccaaccaaggagcattcagcacagaacaaagtcgttatcctcctcactctgtccagtatacatttcccaacacccgccaccagcaggagttcgcagtccctgattatcgttcctctcatcttgaagtgagtcaggcatcacagcttttgcagcaacagcagcagcaacagcttcgaaggcgaccttccttgctttcagaatttcacccaggttctgacaggcctcaagaaaggagaactagttatgaaccgtttcatccaggcccatccccagtggatcatgattcactggaatcgaagcgaccacgtctggaacaggtttctgattctcattttcagcgtgtcagtgctgcggttttgcctttagtgcacccgctgccagaagggctgagggcttctgcagatgctaagaaggatccagcattcggaggcaaacatgaagctccatcctctccaatttcggggcaaccatgtggagatgatcaaaatgcttcaccttcaaaactctcaaaggaagagttaatacagagtatggatcgtgtagatcgagaaattgcaaaagtagaacagcagatccttaaactgaaaaagaaacaacaacagcttgaagaagaggcagctaaacctcctgagcctgagaagcccgtgtcccctcctcctgtggagcagaaacaccgcagtattgtccaaattatttatgatgagaatcggaaaaaagcagaagaagctcataaaatttttgaaggtcttggcccaaaagttgaactgccactgtataaccagccatcagataccaaggtgtaccatgagaacatcaagacaaaccaggtgatgaggaaaaaactcattttattttttaaaagaagaaatcatgcaagaaaacaaagggaacaaaaaatctgccagcgttatgatcagctcatggaggcatgggagaaaaaagtggacagaatagaaaataatcctcggaggaaagctaaagaaagcaaaacaagggaatactatgaaaagcagtttccagaaattcgaaaacaaagagaacagcaagaaagatttcagcgagttgggcagaggggagctggtctttcagccaccattgctaggagtgagcatgagatttctgaaattattgatgggctctctgagcaggagaataatgagaaacaaatgcggcagctctctgtgattccacctatgatgtttgatgcagaacaaagacgagtcaagttcattaacatgaatgggcttatggaggaccctatgaaagtgtataaagataggcagtttatgaatgtttggactgaccatgaaaaggagatctttaaggacaagtttatccagcatccaaaaaactttggactaattgcatcatacttggagaggaagagtgttcctgattgtgttttgtattactatttaaccaagaaaaatgagaattataaagccctcgtcagaaggaattatgggaaacgcagaggcagaaaccagcaaattgctcgaccctcgcaagaagaaaaagtagaagaaaaagaagaggataaagcagaaaaaacagaaaaaaaagaagaagaaaagaaagatgaagaggaaaaagatgaaaaagaagactccaaagaaaataccaaggaaaaggacaagatagatggtacagcagaagaaactgaggaaagagagcaagccacaccccgggggcgaaagactgccaacagtcagggccgccgtaagggccggatcaccaggtccatgacaaacgaagctgcagctgccagtgctgcagccgcagcggctactgaagagcccccaccacctctgccaccgccaccagaacccatttctacagagcctgtggagacctctcgatggacagaagaagaaatggaagttgctaaaaaaggtctagtagaacatggtcgtaactgggcagcaattgctaaaatggtgggaacgaaaagtgaagctcaatgtaaaaacttctattttaactataaaaggcgacacaatcttgacaacctcttacagcagcataaacagaaaacttcacgaaaacctcgtgaagagcgagatgtgtctcaatgtgaaagtgtcgcttccactgtttctgctcaggaggatgaagatattgaagcctccaatgaagaagaaaatccagaagacagcgaaggtgcagaaaatagttctgatacagaaagtgctccttctccttcaccagttgaagctgtcaagcccagcgaggacagtcctgaaaatgctacttctcgaggaaacacagaacctgcggttgagcttgagcccaccacggaaactgcacccagtacatctccctccttagcagttccaagtacaaaaccagctgaagatgaaagtgtggagacccaggtgaatgacagcatcagtgctgagacagcagagcagatggatgtagatcagcaggagcacagtgctgaagagggttctgtttgtgatcccccacccgctaccaaagctgactctgtggacgttgaagtgagggtgccagaaaaccatgcatctaaagttgaaggtgataataccaaagaaagagacttggatagagccagtgagaaggtggaacctagagatgaagatttggtggtagctcagcaaataaatgcccaaaggcccgagccccagtcagacaatgattccagtgccacgtgcagcgctgatgaggatgtggatggagagccagagaggcagagaatgtttcctatggactcaaagccttcactgttaaaccccactggatctatactcgtctcatctccgttaaaaccaaatccactggatctgccacagcttcagcatcgagctgctgttatcccaccaatggtatcctgcaccccatgtaacataccaattggaaccccagtgagcggctatgctctctaccagcgacacattaaagcaatgcatgagtcagcactcctggaggagcagcggcagagacaagaacagatagatttggaatgtagaagttctacaagtccatgtggcacatccaagagtccaaacagagagtgggaagtccttcagcctgctccacatcaagtgataactaatctccctgaaggcgttcggcttccgacaactcgaccaaccaggccaccgccccctctcatcccgtcatccaaaaccacagtggcttcagaaaaaccatcttttataatgggaggctccatctcacagggaacaccaggcacttatttgacttctcataatcaggcttcctacactcaagaaacacccaagccgtcagtgggatctatctctcttggactgccacggcaacaggaatctgccaaatcagctactttgccctacatcaagcaggaagaattttctccccgaagccaaaactcacaacctgagggtctgttggtcagggcccaacatgaaggtgtagtcagaggtaccgcaggagccatacaagaaggaagtataactcggggaactccaaccagcaaaatttcagtggagagcattccatccctacggggctctatcactcagggcaccccggctctgccccagactggcataccaacagaggctttggtgaaggggtccatttcgagaatgcccattgaagacagcagtcctgagaaaggcagagaggaagctgcatccaaaggccatgttatttatgaaggcaaaagtggacatatcttgtcatatgataatattaagaatgcccgagaagggactaggagtccaagaacagctcatgaaatcagtttaaagagaagctatgaatcagtggaaggaaatataaagcaagggatgtcaatgagggagtctcctgtatcagcaccgttagaggggctgatatgccgagcattacccagggggagtcctcattctgacctcaaagaaaggactgtattgtctggctccataatgcaggggacaccaagagcaacaactgaaagctttgaagatggccttaaatatcccaaacaaattaaaagggaaagtcctcccatacgagcatttgaaggtgccattaccaaaggaaaaccatatgatggcatcaccaccatcaaagaaatggggcgttccattcatgagattccaaggcaagatattttaactcaggaaagtcggaaaactccagaagtggtccagagcacacggccgataattgagggttccatttcccagggcacaccaataaagtttgacaacaactcaggtcaatctgccatcaaacacaatgtcaaatccttaatcacggggcctagcaaactatcccgtggaatgcctccgctggaaattgtgccagagaacataaaagtggtagaacggggaaaatatgaggatgtgaaagcaggcgagaccgtgcgttcccggcacacgtcagtggtaagctctggcccctccgttcttaggtccacactgcatgaagctcccaaagcacaactgagccctgggatttatgatgacaccagtgcacggaggacccctgtgagttatcaaaacaccatgtccagaggctcacccatgatgaacagaacttctgatgttacaatttcttctaacaagtctaccaatcatgaaaggaaatcgacactgacccctacccagagggaaagtatcccagcgaagtctccagtgcctggggtggaccctgtcgtgagccacagtccgtttgatccccatcacagaggcagcactgcaggcgaggtttatcggagccacctgcccacgcacttggatccagccatgccttttcacagggctttggatcctgcagcggctgcttacctgtttcagagacagctttcaccaactccaggttacccaagtcagtatcagctttacgcaatggagaacacaagacagacaatcttaaatgattacattacctcacaacagatgcaagtgaacttgcgtccagatgtggccagaggactctccccaagagagcagccactgggtctcccatacccagcaacgagaggaatcattgacctgaccaatatgcctccaacaattttagtgcctcatccagggggaacaagcactcctcccatggacagaatcacttatattcctggtacacagattactttccctcccaggccgtacaactctgcttccatgtctccaggacacccaacacaccttgcagctgctgcaagtgctgagagggaacgggaacgggagcgggagaaggagcgggagcgggaacggattgctgcagcttcctccgacctctacctgcggccaggctcagaacagcctggccgacctggcagtcatggatatgttcgctccccttccccttcagtaagaactcaggagaccatgttgcaacagagacccagtgttttccaaggaaccaatggaaccagtgtaatcacacctttggatccaactgctcagctacgaatcatgccactgcctgctgggggcccttcaataagccaaggcctgccagcctcccgttacaacactgctgcggatgccctggctgctcttgtggatgctgcagcttctgcaccccagatggatgtgtccaaaacaaaagagagtaagcatgaagctgccaggttagaagaaaatttgagaagcaggtcagcagcagttagtgaacagcagcagctagagcagaaaaccctggaggtggagaagagatctgttcagtgtttatacacttcttcagcctttccaagtggcaagccccagcctcattcttcagtagtttattctgaggctgggaaagataaagggcctcctccaaaatccagatatgaggaagagctaaggaccagagggaagactaccattactgcagctaacttcatagacgtgatcatcacccggcaaattgcctcggacaaggatgcgagggaacgtggctctcaaagttcagactcttctagtagcttatcttctcacaggtatgaaacacctagcgatgctattgaggtgataagtcctgccagctcacctgcgccaccccaggagaaactgcagacctatcagccagaggttgttaaggcaaatcaagcggaaaatgatcctaccagacaatatgaaggaccattacatcactatcgaccacagcaggaatcaccatctccccaacaacagctgcccccttcttcacaggcagagggaatggggcaagtgcccaggacccatcggctgatcacacttgctgatcacatctgtcaaattatcacacaagattttgctagaaatcaagtttcctcgcagactccccagcagcctcctacttctacattccagaactcaccttctgctttggtatctacacctgtgaggactaaaacatcaaaccgttacagcccagaatcccaggctcagtctgtccatcatcaaagaccaggttcaagggtctctccagaaaatcttgtggacaaatccaggggaagtaggcctggaaaatccccagagaggagtcacgtctcttcggagccctacgagcccatctccccaccccaggttccggttgtgcatgagaaacaggacagcttgctgctcttgtctcagaggggcgcagagcctgcagagcagaggaatgatgcccgctcaccagggagtataagctacttgccttcattcttcaccaagcttgaaaatacatcacccatggttaaatcaaagaagcaggagatttttcgtaagttgaactcctctggtggaggtgactctgatatggcagctgctcagccaggaactgagatctttaatctgccagcagttactacgtcaggctcagttagctctagaggccattcttttgctgatcctgccagtaatcttgggctggaagacattatcaggaaggctctcatgggaagctttgatgacaaagttgaggatcatggagttgtcatgtcccagcctatgggagtagtgcctggtactgccaacacctcagttgtgaccagtggtgagacacgaagagaggaaggggacccatcacctcattcaggaggagtttgcaaaccaaagctgatcagcaagtcaaacagcaggaaatctaagtctcctatacctgggcaaggctacttaggaacggaacggccctcttcagtctcctctgtacattcagaaggggattaccataggcagacgccagggtgggcctgggaagacaggccctcttcaacaggctcaactcagtttccttataaccctctgactatgcggatgctcagcagtactccaccaacaccgattgcatgtgctccctctgcggtgaaccaagcagctcctcaccaacagaacaggatctgggagcgagagcctgccccactgctctcagcacagtacgagaccctgtcggatagtgatgactgaactgcacaaagtgaggggaacagggtgcaggagagggatctctagtttttgtggtttaatttttagtagcaggtcaaaaacctgccctcctgtgacttattccctgagacttttcaggagagccagcccacagatgatgaagaaatgatggaagttcatttggagagtcaaatgggaaaaaaacaaacaaaaaactgcctttgatacaggcaattcagtggactataataatagtggagggttgagatgtagagtttttaaaaagtgaacagttgctgttcttacatctgtaaagaaaaccataatgtctttaaatcactcttctgtaaatagatgacctttttgcagtgtatatccccttgctgtagtatctggtgtacttatgttcaaatcagcgcatcaactttgggggtgatttttaaaaatctttttgtctatctatctttttaaccctagccttctaaacaacctcatacagcccagttacataatgttggctgtcacgggcattgtacttttatctgatattgtttcctctaaattcagctttccagtgatgtttaaaatcttgtgaaaatgtttagatttttaacacagaccctgtcataaaatctgtacattagggtcaaaaggtaaaagtaacaaattctgccatattgtaaatttccagtgcaggctttaatttttttttttcattagtagcactgaaaaaatattactgcatgggtatgttctagttcagtttataaagttttaaaggcttatttgaggcatacctcactgttacgcacactggtaatttaaccatgcccctaagtattccttttctcctgcatttgatgcagcccaacaaagcttttgttttgaaataaatttgactaccctgtccata

SEQ ID NO: 448581 - DNA, 8376 bp, Homo sapiens
atgaagagaccgggcgcagcgcgacccgggaagctccgccgaggtggtttcctagaaacatgattgtttattggcattgatctcacagtctggtgaggacttctttactgataatgtcaagttcaggttatcctcccaaccaaggagcattcagcacagaacaaagtcgttatcctcctcactctgtccagtatacatttcccaacacccgccaccagcaggagttcgcagtccctgattatcgttcctctcatcttgaagtgagtcaggcatcacagcttttgcagcaacagcagcagcaacagcttcgaaggcgaccttccttgctttcagaatttcacccaggttctgacaggcctcaagaaaggagaactagttatgaaccgtttcatccaggcccatccccagtggatcatgattcactggaatcgaagcgaccacgtctggaacaggtttctgattctcattttcagcgtgtcagtgctgcggttttgcctttagtgcacccgctgccagaagggctgagggcttctgcagatgctaagaaggatccagcattcggaggcaaacatgaagctccatcctctccaatttcggggcaaccatgtggagatgatcaaaatgcttcaccttcaaaactctcaaaggaagagttaatacagagtatggatcgtgtagatcgagaaattgcaaaagtagaacagcagatccttaaactgaaaaagaaacaacaacagcttgaagaagaggcagctaaacctcctgagcctgagaagcccgtgtcccctcctcctgtggagcagaaacaccgcagtattgtccaaattatttatgatgagaatcggaaaaaagcagaagaagctcataaaatttttgaaggtcttggcccaaaagttgaactgccactgtataaccagccatcagataccaaggtgtaccatgagaacatcaagacaaaccaggtgatgaggaaaaaactcattttattttttaaaagaagaaatcatgcaagaaaacaaagggaacaaaaaatctgccagcgttatgatcagctcatggaggcatgggagaaaaaagtggacagaatagaaaataatcctcggaggaaagctaaagaaagcaaaacaagggaatactatgaaaagcagtttccagaaattcgaaaacaaagagaacagcaagaaagatttcagcgagttgggcagaggggagctggtctttcagccaccattgctaggagtgagcatgagatttctgaaattattgatgggctctctgagcaggagaataatgagaaacaaatgcggcagctctctgtgattccacctatgatgtttgatgcagaacaaagacgagtcaagttcattaacatgaatgggcttatggaggaccctatgaaagtgtataaagataggcagtttatgaatgtttggactgaccatgaaaaggagatctttaaggacaagtttatccagcatccaaaaaactttggactaattgcatcatacttggagaggaagagtgttcctgattgtgttttgtattactatttaaccaagaaaaatgagaattataaagccctcgtcagaaggaattatgggaaacgcagaggcagaaaccagcaaattgctcgaccctcgcaagaagaaaaagtagaagaaaaagaagaggataaagcagaaaaaacagaaaaaaaagaagaagaaaagaaagatgaagaggaaaaagatgaaaaagaagactccaaagaaaataccaaggaaaaggacaagatagatggtacagcagaagaaactgaggaaagagagcaagccacaccccgggggcgaaagactgccaacagtcagggccgccgtaagggccggatcaccaggtccatgacaaacgaagctgcagctgccagtgctgcagccgcagcggctactgaagagcccccaccacctctgccaccgccaccagaacccatttctacagagcctgtggagacctctcgatggacagaagaagaaatggaagttgctaaaaaaggtctagtagaacatggtcgtaactgggcagcaattgctaaaatggtgggaacgaaaagtgaagctcaatgtaaaaacttctattttaactataaaaggcgacacaatcttgacaacctcttacagcagcataaacagaaaacttcacgaaaacctcgtgaagagcgagatgtgtctcaatgtgaaagtgtcgcttccactgtttctgctcaggaggatgaagatattgaagcctccaatgaagaagaaaatccagaagacagcgaaggtgcagaaaatagttctgatacagaaagtgctccttctccttcaccagttgaagctgtcaagcccagcgaggacagtcctgaaaatgctacttctcgaggaaacacagaacctgcggttgagcttgagcccaccacggaaactgcacccagtacatctccctccttagcagttccaagtacaaaaccagctgaagatgaaagtgtggagacccaggtgaatgacagcatcagtgctgagacagcagagcagatggatgtagatcagcaggagcacagtgctgaagagggttctgtttgtgatcccccacccgctaccaaagctgactctgtggacgttgaagtgagggtgccagaaaaccatgcatctaaagttgaaggtgataataccaaagaaagagacttggatagagccagtgagaaggtggaacctagagatgaagatttggtggtagctcagcaaataaatgcccaaaggcccgagccccagtcagacaatgattccagtgccacgtgcagcgctgatgaggatgtggatggagagccagagaggcagagaatgtttcctatggactcaaagccttcactgttaaaccccactggatctatactcgtctcatctccgttaaaaccaaatccactggatctgccacagcttcagcatcgagctgctgttatcccaccaatggtatcctgcaccccatgtaacataccaattggaaccccagtgagcggctatgctctctaccagcgacacattaaagcaatgcatgagtcagcactcctggaggagcagcggcagagacaagaacagatagatttggaatgtagaagttctacaagtccatgtggcacatccaagagtccaaacagagagtgggaagtccttcagcctgctccacatcaagtgataactaatctccctgaaggcgttcggcttccgacaactcgaccaaccaggccaccgccccctctcatcccgtcatccaaaaccacagtggcttcagaaaaaccatcttttataatgggaggctccatctcacagggaacaccaggcacttatttgacttctcataatcaggcttcctacactcaagaaacacccaagccgtcagtgggatctatctctcttggactgccacggcaacaggaatctgccaaatcagctactttgccctacatcaagcaggaagaattttctccccgaagccaaaactcacaacctgagggtctgttggtcagggcccaacatgaaggtgtagtcagaggtaccgcaggagccatacaagaaggaagtataactcggggaactccaaccagcaaaatttcagtggagagcattccatccctacggggctctatcactcagggcaccccggctctgccccagactggcataccaacagaggctttggtgaaggggtccatttcgagaatgcccattgaagacagcagtcctgagaaaggcagagaggaagctgcatccaaaggccatgttatttatgaaggcaaaagtggacatatcttgtcatatgataatattaagaatgcccgagaagggactaggagtccaagaacagctcatgaaatcagtttaaagagaagctatgaatcagtggaaggaaatataaagcaagggatgtcaatgagggagtctcctgtatcagcaccgttagaggggctgatatgccgagcattacccagggggagtcctcattctgacctcaaagaaaggactgtattgtctggctccataatgcaggggacaccaagagcaacaactgaaagctttgaagatggccttaaatatcccaaacaaattaaaagggaaagtcctcccatacgagcatttgaaggtgccattaccaaaggaaaaccatatgatggcatcaccaccatcaaagaaatggggcgttccattcatgagattccaaggcaagatattttaactcaggaaagtcggaaaactccagaagtggtccagagcacacggccgataattgagggttccatttcccagggcacaccaataaagtttgacaacaactcaggtcaatctgccatcaaacacaatgtcaaatccttaatcacggggcctagcaaactatcccgtggaatgcctccgctggaaattgtgccagagaacataaaagtggtagaacggggaaaatatgaggatgtgaaagcaggcgagaccgtgcgttcccggcacacgtcagtggtaagctctggcccctccgttcttaggtccacactgcatgaagctcccaaagcacaactgagccctgggatttatgatgacaccagtgcacggaggacccctgtgagttatcaaaacaccatgtccagaggctcacccatgatgaacagaacttctgatgttacaatttcttctaacaagtctaccaatcatgaaaggaaatcgacactgacccctacccagagggaaagtatcccagcgaagtctccagtgcctggggtggaccctgtcgtgagccacagtccgtttgatccccatcacagaggcagcactgcaggcgaggtttatcggagccacctgcccacgcacttggatccagccatgccttttcacagggctttggatcctgcagcggctgcttacctgtttcagagacagctttcaccaactccaggttacccaagtcagtatcagctttacgcaatggagaacacaagacagacaatcttaaatgattacattacctcacaacagatgcaagtgaacttgcgtccagatgtggccagaggactctccccaagagagcagccactgggtctcccatacccagcaacgagaggaatcattgacctgaccaatatgcctccaacaattttagtgcctcatccagggggaacaagcactcctcccatggacagaatcacttatattcctggtacacagattactttccctcccaggccgtacaactctgcttccatgtctccaggacacccaacacaccttgcagctgctgcaagtgctgagagggaacgggaacgggagcgggagaaggagcgggagcgggaacggattgctgcagcttcctccgacctctacctgcggccaggctcagaacagcctggccgacctggcagtcatggatatgttcgctccccttccccttcagtaagaactcaggagaccatgttgcaacagagacccagtgttttccaaggaaccaatggaaccagtgtaatcacacctttggatccaactgctcagctacgaatcatgccactgcctgctgggggcccttcaataagccaaggcctgccagcctcccgttacaacactgctgcggatgccctggctgctcttgtggatgctgcagcttctgcaccccagatggatgtgtccaaaacaaaagagagtaagcatgaagctgccaggttagaagaaaatttgagaagcaggtcagcagcagttagtgaacagcagcagctagagcagaaaaccctggaggtggagaagagatctgttcagtgtttatacacttcttcagcctttccaagtggcaagccccagcctcattcttcagtagtttattctgaggctgggaaagataaagggcctcctccaaaatccagatatgaggaagagctaaggaccagagggaagactaccattactgcagctaacttcatagacgtgatcatcacccggcaaattgcctcggacaaggatgcgagggaacgtggctctcaaagttcagactcttctagtagcttatcttctcacaggtatgaaacacctagcgatgctattgaggtgataagtcctgccagctcacctgcgccaccccaggagaaactgcagacctatcagccagaggttgttaaggcaaatcaagcggaaaatgatcctaccagacaatatgaaggaccattacatcactatcgaccacagcaggaatcaccatctccccaacaacagctgcccccttcttcacaggcagagggaatggggcaagtgcccaggacccatcggctgatcacacttgctgatcacatctgtcaaattatcacacaagattttgctagaaatcaagtttcctcgcagactccccagcagcctcctacttctacattccagaactcaccttctgctttggtatctacacctgtgaggactaaaacatcaaaccgttacagcccagaatcccaggctcagtctgtccatcatcaaagaccaggttcaagggtctctccagaaaatcttgtggacaaatccaggggaagtaggcctggaaaatccccagagaggagtcacgtctcttcggagccctacgagcccatctccccaccccaggttccggttgtgcatgagaaacaggacagcttgctgctcttgtctcagaggggcgcagagcctgcagagcagaggaatgatgcccgctcaccagggagtataagctacttgccttcattcttcaccaagcttgaaaatacatcacccatggttaaatcaaagaagcaggagatttttcgtaagttgaactcctctggtggaggtgactctgatatggcagctgctcagccaggaactgagatctttaatctgccagcagttactacgtcaggctcagttagctctagaggccattcttttgctgatcctgccagtaatcttgggctggaagacattatcaggaaggctctcatgggaagctttgatgacaaagttgaggatcatggagttgtcatgtcccagcctatgggagtagtgcctggtactgccaacacctcagttgtgaccagtggtgagacacgaagagaggaaggggacccatcacctcattcaggaggagtttgcaaaccaaagctgatcagcaagtcaaacagcaggaaatctaagtctcctatacctgggcaaggctacttaggaacggaacggccctcttcagtctcctctgtacattcagaaggggattaccataggcagacgccagggtgggcctgggaagacaggccctcttcaacaggctcaactcagtttccttataaccctctgactatgcggatgctcagcagtactccaccaacaccgattgcatgtgctccctctgcggtgaaccaagcagctcctcaccaacagaacaggatctgggagcgagagcctgccccactgctctcagcacagtacgagaccctgtcggatagtgatgactgaactgcacaaagtgaggggaacagggtgcaggagagggatctctagtttttgtggtttaatttttagtagcaggtcaaaaacctgccctcctgtgacttattccctgagacttttcaggagagccagcccacagatgatgaagaaatgatggaagttcatttggagagtcaaatgggaaaaaaacaaacaaaaaactgcctttgatacaggcaattcagtggactataataatagtggagggttgagatgtagagtttttaaaaagtgaacagttgctgttcttacatctgtaaagaaaaccataatgtctttaaatcactcttctgtaaatagatgacctttttgcagtgtatatccccttgctgtagtatctggtgtacttatgttcaaatcagcgcatcaactttgggggtgatttttaaaaatctttttgtctatctatctttttaaccctagccttctaaacaacctcatacagcccagttacataatgttggctgtcacgggcattgtacttttatctgatattgtttcctctaaattcagctttccagtgatgtttaaaatcttgtgaaaatgtttagatttttaacacagaccctgtcataaaatctgtacattagggtcaaaaggtaaaagtaacaaattctgccatattgtaaatttccagtgcaggctttaatttttttttttcattagtagcactgaaaaaatattactgcatgggtatgttctagttcagtttataaagttttaaaggcttatttgaggcatacctcactgttacgcacactggtaatttaaccatgcccctaagtattccttttctcctgcatttgatgcagcccaacaaagcttttgttttgaaataaatttgactaccctgtccata

SEQ ID NO: 448582 - DNA, 8066 bp, Homo sapiens
  misc_feature (73)..(73): n is a, c, g, or t
tttttatttttattttttagatggagtctcactctgtcgcccaggcaggagtgcagcagcgtgagctcagctnactgcaacctctgtctcccacactcaagcgattcccctgcctaggcctcccaaagtgctgggattacaggcatgagccactgcacccggcccagaattaaaatcttaaaggatgcttcctcttagttttttttttaaactctatctaatgaaaatttgtgttgtttggttatgaaataaatctgattaattctctttgagctcttggtccatgagaccttcatggattaattggttaccctacagaatctgcaagcaaagcttagtagcctgtgttatctccagtggttaatcactgctgggtgtggtgtgcagcacatgcttgactctttctttctggatctcttagcaacagcttgaagaagaggcagctaaacctcctgagcctgagaagcccgtgtcccctcctcctgtggagcagaaacaccgcagtattgtccaaattatttatgatgagaatcggaaaaaagcagaagaagctcataaaatttttgaaggtcttggcccaaaagttgaactgccactgtataaccagccatcagataccaaggtgtaccatgagaacatcaagacaaaccaggtgatgaggaaaaaactcattttattttttaaaagaagaaatcatgcaagaaaacaaagggaacaaaaaatctgccagcgttatgatcagctcatggaggcatgggagaaaaaagtggacagaatagaaaataatcctcggaggaaagctaaagaaagcaaaacaagggaatactatgaaaagcagtttccagaaattcgaaaacaaagagaacagcaagaaagatttcagcgagttgggcagaggggagctggtctttcagccaccattgctaggagtgagcatgagatttctgaaattattgatgggctctctgagcaggagaataatgagaaacaaatgcggcagctctctgtgattccacctatgatgtttgatgcagaacaaagacgagtcaagttcattaacatgaatgggcttatggaggaccctatgaaagtgtataaagataggcagtttatgaatgtttggactgaccatgaaaaggagatctttaaggacaagtttatccagcatccaaaaaactttggactaattgcatcatacttggagaggaagagtgttcctgattgtgttttgtattactatttaaccaagaaaaatgagaattataaagccctcgtcagaaggaattatgggaaacgcagaggcagaaaccagcaaattgctcgaccctcgcaagaagaaaaagtagaagaaaaagaagaggataaagcagaaaaaacagaaaaaaaagaagaagaaaagaaagatgaagaggaaaaagatgaaaaagaagactccaaagaaaataccaaggaaaaggacaagatagatggtacagcagaagaaactgaggaaagagagcaagccacaccccgggggcgaaagactgccaacagtcagggccgccgtaagggccggatcaccaggtccatgacaaacgaagctgcagctgccagtgctgcagccgcagcggctactgaagagcccccaccacctctgccaccgccaccagaacccatttctacagagcctgtggagacctctcgatggacagaagaagaaatggaagttgctaaaaaaggtctagtagaacatggtcgtaactgggcagcaattgctaaaatggtgggaacgaaaagtgaagctcaatgtaaaaacttctattttaactataaaaggcgacacaatcttgacaacctcttacagcagcataaacagaaaacttcacgaaaacctcgtgaagagcgagatgtgtctcaatgtgaaagtgtcgcttccactgtttctgctcaggaggatgaagatattgaagcctccaatgaagaagaaaatccagaagacagcgaaggtgcagaaaatagttctgatacagaaagtgctccttctccttcaccagttgaagctgtcaagcccagcgaggacagtcctgaaaatgctacttctcgaggaaacacagaacctgcggttgagcttgagcccaccacggaaactgcacccagtacatctccctccttagcagttccaagtacaaaaccagctgaagatgaaagtgtggagacccaggtgaatgacagcatcagtgctgagacagcagagcagatggatgtagatcagcaggagcacagtgctgaagagggttctgtttgtgatcccccacccgctaccaaagctgactctgtggacgttgaagtgagggtgccagaaaaccatgcatctaaagttgaaggtgataataccaaagaaagagacttggatagagccagtgagaaggtggaacctagagatgaagatttggtggtagctcagcaaataaatgcccaaaggcccgagccccagtcagacaatgattccagtgccacgtgcagcgctgatgaggatgtggatggagagccagagaggcagagaatgtttcctatggactcaaagccttcactgttaaaccccactggatctatactcgtctcatctccgttaaaaccaaatccactggatctgccacagcttcagcatcgagctgctgttatcccaccaatggtatcctgcaccccatgtaacataccaattggaaccccagtgagcggctatgctctctaccagcgacacattaaagcaatgcatgagtcagcactcctggaggagcagcggcagagacaagaacagatagatttggaatgtagaagttctacaagtccatgtggcacatccaagagtccaaacagagagtgggaagtccttcagcctgctccacatcaagtgataactaatctccctgaaggcgttcggcttccgacaactcgaccaaccaggccaccgccccctctcatcccgtcatccaaaaccacagtggcttcagaaaaaccatcttttataatgggaggctccatctcacagggaacaccaggcacttatttgacttctcataatcaggcttcctacactcaagaaacacccaagccgtcagtgggatctatctctcttggactgccacggcaacaggaatctgccaaatcagctactttgccctacatcaagcaggaagaattttctccccgaagccaaaactcacaacctgagggtctgttggtcagggcccaacatgaaggtgtagtcagaggtaccgcaggagccatacaagaaggaagtataactcggggaactccaaccagcaaaatttcagtggagagcattccatccctacggggctctatcactcagggcaccccggctctgccccagactggcataccaacagaggctttggtgaaggggtccatttcgagaatgcccattgaagacagcagtcctgagaaaggcagagaggaagctgcatccaaaggccatgttatttatgaaggcaaaagtggacatatcttgtcatatgataatattaagaatgcccgagaagggactaggagtccaagaacagctcatgaaatcagtttaaagagaagctatgaatcagtggaaggaaatataaagcaagggatgtcaatgagggagtctcctgtatcagcaccgttagaggggctgatatgccgagcattacccagggggagtcctcattctgacctcaaagaaaggactgtattgtctggctccataatgcaggggacaccaagagcaacaactgaaagctttgaagatggccttaaatatcccaaacaaattaaaagggaaagtcctcccatacgagcatttgaaggtgccattaccaaaggaaaaccatatgatggcatcaccaccatcaaagaaatggggcgttccattcatgagattccaaggcaagatattttaactcaggaaagtcggaaaactccagaagtggtccagagcacacggccgataattgagggttccatttcccagggcacaccaataaagtttgacaacaactcaggtcaatctgccatcaaacacaatgtcaaatccttaatcacggggcctagcaaactatcccgtggaatgcctccgctggaaattgtgccagagaacataaaagtggtagaacggggaaaatatgaggatgtgaaagcaggcgagaccgtgcgttcccggcacacgtcagtggtaagctctggcccctccgttcttaggtccacactgcatgaagctcccaaagcacaactgagccctgggatttatgatgacaccagtgcacggaggacccctgtgagttatcaaaacaccatgtccagaggctcacccatgatgaacagaacttctgatgttacaatttcttctaacaagtctaccaatcatgaaaggaaatcgacactgacccctacccagagggaaagtatcccagcgaagtctccagtgcctggggtggaccctgtcgtgagccacagtccgtttgatccccatcacagaggcagcactgcaggcgaggtttatcggagccacctgcccacgcacttggatccagccatgccttttcacagggctttggatcctgcagcggctgcttacctgtttcagagacagctttcaccaactccaggttacccaagtcagtatcagctttacgcaatggagaacacaagacagacaatcttaaatgattacattacctcacaacagatgcaagtgaacttgcgtccagatgtggccagaggactctccccaagagagcagccactgggtctcccatacccagcaacgagaggaatcattgacctgaccaatatgcctccaacaattttagtgcctcatccagggggaacaagcactcctcccatggacagaatcacttatattcctggtacacagattactttccctcccaggccgtacaactctgcttccatgtctccaggacacccaacacaccttgcagctgctgcaagtgctgagagggaacgggaacgggagcgggagaaggagcgggagcgggaacggattgctgcagcttcctccgacctctacctgcggccaggctcagaacagcctggccgacctggcagtcatggatatgttcgctccccttccccttcagtaagaactcaggagaccatgttgcaacagagacccagtgttttccaaggaaccaatggaaccagtgtaatcacacctttggatccaactgctcagctacgaatcatgccactgcctgctgggggcccttcaataagccaaggcctgccagcctcccgttacaacactgctgcggatgccctggctgctcttgtggatgctgcagcttctgcaccccagatggatgtgtccaaaacaaaagagagtaagcatgaagctgccaggttagaagaaaatttgagaagcaggtcagcagcagttagtgaacagcagcagctagagcagaaaaccctggaggtggagaagagatctgttcagtgtttatacacttcttcagcctttccaagtggcaagccccagcctcattcttcagtagtttattctgaggctgggaaagataaagggcctcctccaaaatccagatatgaggaagagctaaggaccagagggaagactaccattactgcagctaacttcatagacgtgatcatcacccggcaaattgcctcggacaaggatgcgagggaacgtggctctcaaagttcagactcttctagtagcttatcttctcacaggtatgaaacacctagcgatgctattgaggtgataagtcctgccagctcacctgcgccaccccaggagaaactgcagacctatcagccagaggttgttaaggcaaatcaagcggaaaatgatcctaccagacaatatgaaggaccattacatcactatcgaccacagcaggaatcaccatctccccaacaacagctgcccccttcttcacaggcagagggaatggggcaagtgcccaggacccatcggctgatcacacttgctgatcacatctgtcaaattatcacacaagattttgctagaaatcaagtttcctcgcagactccccagcagcctcctacttctacattccagaactcaccttctgctttggtatctacacctgtgaggactaaaacatcaaaccgttacagcccagaatcccaggctcagtctgtccatcatcaaagaccaggttcaagggtctctccagaaaatcttgtggacaaatccaggggaagtaggcctggaaaatccccagagaggagtcacgtctcttcggagccctacgagcccatctccccaccccaggttccggttgtgcatgagaaacaggacagcttgctgctcttgtctcagaggggcgcagagcctgcagagcagaggaatgatgcccgctcaccagggagtataagctacttgccttcattcttcaccaagcttgaaaatacatcacccatggttaaatcaaagaagcaggagatttttcgtaagttgaactcctctggtggaggtgactctgatatggcagctgctcagccaggaactgagatctttaatctgccagcagttactacgtcaggctcagttagctctagaggccattcttttgctgatcctgccagtaatcttgggctggaagacattatcaggaaggctctcatgggaagctttgatgacaaagttgaggatcatggagttgtcatgtcccagcctatgggagtagtgcctggtactgccaacacctcagttgtgaccagtggtgagacacgaagagaggaaggggacccatcacctcattcaggaggagtttgcaaaccaaagctgatcagcaagtcaaacagcaggaaatctaagtctcctatacctgggcaaggctacttaggaacggaacggccctcttcagtctcctctgtacattcagaaggggattaccataggcagacgccagggtgggcctgggaagacaggccctcttcaacaggctcaactcagtttccttataaccctctgactatgcggatgctcagcagtactccaccaacaccgattgcatgtgctccctctgcggtgaaccaagcagctcctcaccaacagaacaggatctgggagcgagagcctgccccactgctctcagcacagtacgagaccctgtcggatagtgatgactgaactgcacaaagtgaggggaacagggtgcaggagagggatctctagtttttgtggtttaatttttagtagcaggtcaaaaacctgccctcctgtgacttattccctgagacttttcaggagagccagcccacagatgatgaagaaatgatggaagttcatttggagagtcaaatgggaaaaaaacaaacaaaaaactgcctttgatacaggcaattcagtggactataataatagtggagggttgagatgtagagtttttaaaaagtgaacagttgctgttcttacatctgtaaagaaaaccataatgtctttaaatcactcttctgtaaatagatgacctttttgcagtgtatatccccttgctgtagtatctggtgtacttatgttcaaatcagcgcatcaactttgggggtgatttttaaaaatctttttgtctatctatctttttaaccctagccttctaaacaacctcatacagcccagttacataatgttggctgtcacgggcattgtacttttatctgatattgtttcctctaaattcagctttccagtgatgtttaaaatcttgtgaaaatgtttagatttttaacacagaccctgtcataaaatctgtacattagggtcaaaaggtaaaagtaacaaattctgccatattgtaaatttccagtgcaggctttaatttttttttttcattagtagcactgaaaaaatattactgcatgggtatgttctagttcagtttataaagttttaaaggcttatttgaggcatacctcactgttacgcacactggtaatttaaccatgcccctaagtattccttttctcctgcatttgatgcagcccaacaaagcttttgttttgaaataaatttgactaccctgtccata

SEQ ID NO: 448583 - DNA, 9756 bp, Homo sapiens
gggttgagtcaagatggcggccaaggtggcgaagcagcagccgcggcggcggcggcggctggagtgagcgtccgactcgccgcgccgaacgaggtcccggtgtagggccgcgcgccgtggccgcgtcccactcctcaggccggggcgcacgtcggctcccacgcttagccagctcccggtggtttcctagaaacatgattgtttattggcattgatctcacagtctggtgaggacttctttactgataatgtcaagttcaggttatcctcccaaccaaggagcattcagcacagaacaaagtcgttatcctcctcactctgtccagtatacatttcccaacacccgccaccagcaggagttcgcagtccctgattatcgttcctctcatcttgaagtgagtcaggcatcacagcttttgcagcaacagcagcagcaacagcttcgaaggcgaccttccttgctttcagaatttcacccaggttctgacaggcctcaagaaaggagaactagttatgaaccgtttcatccaggcccatccccagtggatcatgattcactggaatcgaagcgaccacgtctggaacaggtttctgattctcattttcagcgtgtcagtgctgcggttttgcctttagtgcacccgctgccagaagggctgagggcttctgcagatgctaagaaggatccagcattcggaggcaaacatgaagctccatcctctccaatttcggggcaaccatgtggagatgatcaaaatgcttcaccttcaaaactctcaaaggaagagttaatacagagtatggatcgtgtagatcgagaaattgcaaaagtagaacagcagatccttaaactgaaaaagaaacaacaacagcttgaagaagaggcagctaaacctcctgagcctgagaagcccgtgtcccctcctcctgtggagcagaaacaccgcagtattgtccaaattatttatgatgagaatcggaaaaaagcagaagaagctcataaaatttttgaaggtcttggcccaaaagttgaactgccactgtataaccagccatcagataccaaggtgtaccatgagaacatcaagacaaaccaggtgatgaggaaaaaactcattttattttttaaaagaagaaatcatgcaagaaaacaaagggaacaaaaaatctgccagcgttatgatcagctcatggaggcatgggagaaaaaagtggacagaatagaaaataatcctcggaggaaagctaaagaaagcaaaacaagggaatactatgaaaagcagtttccagaaattcgaaaacaaagagaacagcaagaaagatttcagcgagttgggcagaggggagctggtctttcagccaccattgctaggagtgagcatgagatttctgaaattattgatgggctctctgagcaggagaataatgagaaacaaatgcggcagctctctgtgattccacctatgatgtttgatgcagaacaaagacgagtcaagttcattaacatgaatgggcttatggaggaccctatgaaagtgtataaagataggcagtttatgaatgtttggactgaccatgaaaaggagatctttaaggacaagtttatccagcatccaaaaaactttggactaattgcatcatacttggagaggaagagtgttcctgattgtgttttgtattactatttaaccaagaaaaatgagaattataaagccctcgtcagaaggaattatgggaaacgcagaggcagaaaccagcaaattgctcgaccctcgcaagaagaaaaagtagaagaaaaagaagaggataaagcagaaaaaacagaaaaaaaagaagaagaaaagaaagatgaagaggaaaaagatgaaaaagaagactccaaagaaaataccaaggaaaaggacaagatagatggtacagcagaagaaactgaggaaagagagcaagccacaccccgggggcgaaagactgccaacagtcagggccgccgtaagggccggatcaccaggtccatgacaaacgaagctgcagctgccagtgctgcagccgcagcggctactgaagagcccccaccacctctgccaccgccaccagaacccatttctacagagcctgtggagacctctcgatggacagaagaagaaatggaagttgctaaaaaaggtctagtagaacatggtcgtaactgggcagcaattgctaaaatggtgggaacgaaaagtgaagctcaatgtaaaaacttctattttaactataaaaggcgacacaatcttgacaacctcttacagcagcataaacagaaaacttcacgaaaacctcgtgaagagcgagatgtgtctcaatgtgaaagtgtcgcttccactgtttctgctcaggaggatgaagatattgaagcctccaatgaagaagaaaatccagaagacagcgaaggtgcagaaaatagttctgatacagaaagtgctccttctccttcaccagttgaagctgtcaagcccagcgaggacagtcctgaaaatgctacttctcgaggaaacacagaacctgcggttgagcttgagcccaccacggaaactgcacccagtacatctccctccttagcagttccaagtacaaaaccagctgaagatgaaagtgtggagacccaggtgaatgacagcatcagtgctgagacagcagagcagatggatgtagatcagcaggagcacagtgctgaagagggttctgtttgtgatcccccacccgctaccaaagctgactctgtggacgttgaagtgagggtgccagaaaaccatgcatctaaagttgaaggtgataataccaaagaaagagacttggatagagccagtgagaaggtggaacctagagatgaagatttggtggtagctcagcaaataaatgcccaaaggcccgagccccagtcagacaatgattccagtgccacgtgcagcgctgatgaggatgtggatggagagccagagaggcagagaatgtttcctatggactcaaagccttcactgttaaaccccactggatctatactcgtctcatctccgttaaaaccaaatccactggatctgccacagcttcagcatcgagctgctgttatcccaccaatggtatcctgcaccccatgtaacataccaattggaaccccagtgagcggctatgctctctaccagcgacacattaaagcaatgcatgagtcagcactcctggaggagcagcggcagagacaagaacagatagatttggaatgtagaagttctacaagtccatgtggcacatccaagagtccaaacagagagtgggaagtccttcagcctgctccacatcaagtgataactaatctccctgaaggcgttcggcttccgacaactcgaccaaccaggccaccgccccctctcatcccgtcatccaaaaccacagtggcttcagaaaaaccatcttttataatgggaggctccatctcacagggaacaccaggcacttatttgacttctcataatcaggcttcctacactcaagaaacacccaagccgtcagtgggatctatctctcttggactgccacggcaacaggaatctgccaaatcagctactttgccctacatcaagcaggaagaattttctccccgaagccaaaactcacaacctgagggtctgttggtcagggcccaacatgaaggtgtagtcagaggtaccgcaggagccatacaagaaggaagtataactcggggaactccaaccagcaaaatttcagtggagagcattccatccctacggggctctatcactcagggcaccccggctctgccccagactggcataccaacagaggctttggtgaaggggtccatttcgagaatgcccattgaagacagcagtcctgagaaaggcagagaggaagctgcatccaaaggccatgttatttatgaaggcaaaagtggacatatcttgtcatatgataatattaagaatgcccgagaagggactaggagtccaagaacagctcatgaaatcagtttaaagagaagctatgaatcagtggaaggaaatataaagcaagggatgtcaatgagggagtctcctgtatcagcaccgttagaggggctgatatgccgagcattacccagggggagtcctcattctgacctcaaagaaaggactgtattgtctggctccataatgcaggggacaccaagagcaacaactgaaagctttgaagatggccttaaatatcccaaacaaattaaaagggaaagtcctcccatacgagcatttgaaggtgccattaccaaaggaaaaccatatgatggcatcaccaccatcaaagaaatggggcgttccattcatgagattccaaggcaagatattttaactcaggaaagtcggaaaactccagaagtggtccagagcacacggccgataattgagggttccatttcccagggcacaccaataaagtttgacaacaactcaggtcaatctgccatcaaacacaatgtcaaatccttaatcacggggcctagcaaactatcccgtggaatgcctccgctggaaattgtgccagagaacataaaagtggtagaacggggaaaatatgaggatgtgaaagcaggcgagaccgtgcgttcccggcacacgtcagtggtaagctctggcccctccgttcttaggtccacactgcatgaagctcccaaagcacaactgagccctgggatttatgatgacaccagtgcacggaggacccctgtgagttatcaaaacaccatgtccagaggctcacccatgatgaacagaacttctgatgttacaatttcttctaacaagtctaccaatcatgaaaggaaatcgacactgacccctacccagagggaaagtatcccagcgaagtctccagtgcctggggtggaccctgtcgtgagccacagtccgtttgatccccatcacagaggcagcactgcaggcgaggtttatcggagccacctgcccacgcacttggatccagccatgccttttcacagggctttggatcctgcagcggctgcttacctgtttcagagacagctttcaccaactccaggttacccaagtcagtatcagctttacgcaatggagaacacaagacagacaatcttaaatgattacattacctcacaacagatgcaagtgaacttgcgtccagatgtggccagaggactctccccaagagagcagccactgggtctcccatacccagcaacgagaggaatcattgacctgaccaatatgcctccaacaattttagtgcctcatccagggggaacaagcactcctcccatggacagaatcacttatattcctggtacacagattactttccctcccaggccgtacaactctgcttccatgtctccaggacacccaacacaccttgcagctgctgcaagtgctgagagggaacgggaacgggagcgggagaaggagcgggagcgggaacggattgctgcagcttcctccgacctctacctgcggccaggctcagaacagcctggccgacctggcagtcatggatatgttcgctccccttccccttcagtaagaactcaggagaccatgttgcaacagagacccagtgttttccaaggaaccaatggaaccagtgtaatcacacctttggatccaactgctcagctacgaatcatgccactgcctgctgggggcccttcaataagccaaggcctgccagcctcccgttacaacactgctgcggatgccctggctgctcttgtggatgctgcagcttctgcaccccagatggatgtgtccaaaacaaaagagagtaagcatgaagctgccaggttagaagaaaatttgagaagcaggtcagcagcagttagtgaacagcagcagctagagcagaaaaccctggaggtggagaagagatctgttcagtgtttatacacttcttcagcctttccaagtggcaagccccagcctcattcttcagtagtttattctgaggctgggaaagataaagggcctcctccaaaatccagatatgaggaagagctaaggaccagagggaagactaccattactgcagctaacttcatagacgtgatcatcacccggcaaattgcctcggacaaggatgcgagggaacgtggctctcaaagttcagactcttctagtagcttatcttctcacaggtatgaaacacctagcgatgctattgaggtgataagtcctgccagctcacctgcgccaccccaggagaaactgcagacctatcagccagaggttgttaaggcaaatcaagcggaaaatgatcctaccagacaatatgaaggaccattacatcactatcgaccacagcaggaatcaccatctccccaacaacagctgcccccttcttcacaggcagagggaatggggcaagtgcccaggacccatcggctgatcacacttgctgatcacatctgtcaaattatcacacaagattttgctagaaatcaagtttcctcgcagactccccagcagcctcctacttctacattccagaactcaccttctgctttggtatctacacctgtgaggactaaaacatcaaaccgttacagcccagaatcccaggctcagtctgtccatcatcaaagaccaggttcaagggtctctccagaaaatcttgtggacaaatccaggggaagtaggcctggaaaatccccagagaggagtcacgtctcttcggagccctacgagcccatctccccaccccaggttccggttgtgcatgagaaacaggacagcttgctgctcttgtctcagaggggcgcagagcctgcagagcagaggaatgatgcccgctcaccagggagtataagctacttgccttcattcttcaccaagcttgaaaatacatcacccatggttaaatcaaagaagcaggagatttttcgtaagttgaactcctctggtggaggtgactctgatatggcagctgctcagccaggaactgagatctttaatctgccagcagttactacgtcaggctcagttagctctagaggccattcttttgctgatcctgccagtaatcttgggctggaagacattatcaggaaggctctcatgggaagctttgatgacaaagttgaggatcatggagttgtcatgtcccagcctatgggagtagtgcctggtactgccaacacctcagttgtgaccagtggtgagacacgaagagaggaaggggacccatcacctcattcaggaggagtttgcaaaccaaagctgatcagcaagtcaaacagcaggaaatctaagtctcctatacctgggcaaggctacttaggaacggaacggccctcttcagtctcctctgtacattcagaaggggattaccataggcagacgccagggtgggcctgggaagacaggccctcttcaacaggctcaactcagtttccttataaccctctgactatgcggatgctcagcagtactccaccaacaccgattgcatgtgctccctctgcggtgaaccaagcagctcctcaccaacagaacaggatctgggagcgagagcctgccccactgctctcagcacagtacgagaccctgtcggatagtgatgactgaactgcacaaagtgaggggaacagggtgcaggagagggatctctagtttttgtggtttaatttttagtagcaggtcaaaaacctgccctcctgtgacttattccctgagacttttcaggagagccagcccacagatgatgaagaaatgatggaagttcatttggagagtcaaatgggaaaaaaacaaacaaaaaactgcctttgatacaggcaattcagtggactataataatagtggagggttgagatgtagagtttttaaaaagtgaacagttgctgttcttacatctgtaaagaaaaccataatgtctttaaatcactcttctgtaaatagatgacctttttgcagtgtatatccccttgctgtagtatctggtgtacttatgttcaaatcagcgcatcaactttgggggtgatttttaaaaatctttttgtctatctatctttttaaccctagccttctaaacaacctcatacagcccagttacataatgttggctgtcacgggcattgtacttttatctgatattgtttcctctaaattcagctttccagtgatgtttaaaatcttgtgaaaatgtttagatttttaacacagaccctgtcataaaatctgtacattagggtcaaaaggtaaaagtaacaaattctgccatattgtaaatttccagtgcaggctttaatttttttttttcagtgctactaatgaaaaaaaaaactcgtgccgaattcggcacgagagaacaaggggtctgtggaaatcatgagaaaggacttgaatgacgcccgggacctgcatggccaggcagagtcagcagctgcagtgtggaagggacacgtgatggaccgtaggaagaaggcactgaccgactacaagaagctgcgggccttctttgtggaggaggaggagcatttcctgcaggaggctgagaaggaggaggggctccctgaggacgagctggctgaccccactgagcggttcaggtcactgctgcaggcggtctcggagctggagaagaagcatcgcaacctgggcctcagcatgctgctgcagtgatggcgccaacccgtggcagtcccagagctggaggcaggaggatggatcctcatctccatgggaagtgtcagcgtgtggctgccagggaagcgtggcaggcgcctggccttgggtccatctacatagttgcgtgtttcaacaatgtccatttatccttcaccccgaggcgtgttttgggggctgcaaacacctcccggtagaggctggacctgaggacccttcccacctgtgcccgtcccttcctgaagtcctagccacagcccatcctccatgagtcccggcagctctgggtcatgcccttccctggtcacccatctgcccctcacccgtcatccagggaccagaccctgcaccttccatgtgggcccacaaatccttggcaggtacctgaggtgcaccattgagtgtcggatttggggttagcatccagaaagaagaatgcgcatgacgctctgtgaaggctggaactcaggtcttcagggagagaaaggaagactggattgccccttgatgcctcctgaggaggcggcccccctcttgaggtgggcgtgggcccggcccagccttatccaagtcgctctgtccacctcccccttcctggcccccaccccactcctgtgcctcccaggagccctccctgtgttccacctgcctccgcagaaggaagcctctttctctgtttccctgggtgagggggctggcaggtggctaaccccatttagcatttccaggccctgccatggtgtctcatcttgctgttatctctagctctttccctcctcccatttcctttagtagttgaattttgcaaagcttgtagcagtagctcagttgcctgcagcatccttgtgtgtagataaattagtcgacagaaaatcagcactggggacaggattgcaaagtcggggaaatagatgcagacagttgttgagatttggggatagccgggcttgtgagcggtgcccatttccagatgaagcctttcagcccttttgagtccccggcccttggtgcgatgtttgtgagtttgacctgcccagcgtgtgggctggctcaatgctgaataaagtgggtttgtgtc

SEQ ID NO: 448584 - DNA, 11024 bp, Homo sapiens
gggttgagtcaagatggcggccaaggtggcgaagcagcagccgcggcggcggcggcggctggagtgagcgtccgactcgccgcgccgaacgaggtcccggtgtagggccgcgcgccgtggccgcgtcccactcctcaggccggggcgcacgtcggctcccacgcttagccagctcccggtggtttcctagaaacatgattgtttattggcattgatctcacagtctggtgaggacttctttactgataatgtcaagttcaggttatcctcccaaccaaggagcattcagcacagaacaaagtcgttatcctcctcactctgtccagtatacatttcccaacacccgccaccagcaggagttcgcagtccctgattatcgttcctctcatcttgaagtgagtcaggcatcacagcttttgcagcaacagcagcagcaacagcttcgaaggcgaccttccttgctttcagaatttcacccaggttctgacaggcctcaagaaaggagaactagttatgaaccgtttcatccaggcccatccccagtggatcatgattcactggaatcgaagcgaccacgtctggaacaggtttctgattctcattttcagcgtgtcagtgctgcggttttgcctttagtgcacccgctgccagaagggctgagggcttctgcagatgctaagaaggatccagcattcggaggcaaacatgaagctccatcctctccaatttcggggcaaccatgtggagatgatcaaaatgcttcaccttcaaaactctcaaaggaagagttaatacagagtatggatcgtgtagatcgagaaattgcaaaagtagaacagcagatccttaaactgaaaaagaaacaacaacagcttgaagaagaggcagctaaacctcctgagcctgagaagcccgtgtcccctcctcctgtggagcagaaacaccgcagtattgtccaaattatttatgatgagaatcggaaaaaagcagaagaagctcataaaatttttgaaggtcttggcccaaaagttgaactgccactgtataaccagccatcagataccaaggtgtaccatgagaacatcaagacaaaccaggtgatgaggaaaaaactcattttattttttaaaagaagaaatcatgcaagaaaacaaagggaacaaaaaatctgccagcgttatgatcagctcatggaggcatgggagaaaaaagtggacagaatagaaaataatcctcggaggaaagctaaagaaagcaaaacaagggaatactatgaaaagcagtttccagaaattcgaaaacaaagagaacagcaagaaagatttcagcgagttgggcagaggggagctggtctttcagccaccattgctaggagtgagcatgagatttctgaaattattgatgggctctctgagcaggagaataatgagaaacaaatgcggcagctctctgtgattccacctatgatgtttgatgcagaacaaagacgagtcaagttcattaacatgaatgggcttatggaggaccctatgaaagtgtataaagataggcagtttatgaatgtttggactgaccatgaaaaggagatctttaaggacaagtttatccagcatccaaaaaactttggactaattgcatcatacttggagaggaagagtgttcctgattgtgttttgtattactatttaaccaagaaaaatgagaattataaagccctcgtcagaaggaattatgggaaacgcagaggcagaaaccagcaaattgctcgaccctcgcaagaagaaaaagtagaagaaaaagaagaggataaagcagaaaaaacagaaaaaaaagaagaagaaaagaaagatgaagaggaaaaagatgaaaaagaagactccaaagaaaataccaaggaaaaggacaagatagatggtacagcagaagaaactgaggaaagagagcaagccacaccccgggggcgaaagactgccaacagtcagggccgccgtaagggccggatcaccaggtccatgacaaacgaagctgcagctgccagtgctgcagccgcagcggctactgaagagcccccaccacctctgccaccgccaccagaacccatttctacagagcctgtggagacctctcgatggacagaagaagaaatggaagttgctaaaaaaggtctagtagaacatggtcgtaactgggcagcaattgctaaaatggtgggaacgaaaagtgaagctcaatgtaaaaacttctattttaactataaaaggcgacacaatcttgacaacctcttacagcagcataaacagaaaacttcacgaaaacctcgtgaagagcgagatgtgtctcaatgtgaaagtgtcgcttccactgtttctgctcaggaggatgaagatattgaagcctccaatgaagaagaaaatccagaagacagcgaaggtgcagaaaatagttctgatacagaaagtgctccttctccttcaccagttgaagctgtcaagcccagcgaggacagtcctgaaaatgctacttctcgaggaaacacagaacctgcggttgagcttgagcccaccacggaaactgcacccagtacatctccctccttagcagttccaagtacaaaaccagctgaagatgaaagtgtggagacccaggtgaatgacagcatcagtgctgagacagcagagcagatggatgtagatcagcaggagcacagtgctgaagagggttctgtttgtgatcccccacccgctaccaaagctgactctgtggacgttgaagtgagggtgccagaaaaccatgcatctaaagttgaaggtgataataccaaagaaagagacttggatagagccagtgagaaggtggaacctagagatgaagatttggtggtagctcagcaaataaatgcccaaaggcccgagccccagtcagacaatgattccagtgccacgtgcagcgctgatgaggatgtggatggagagccagagaggcagagaatgtttcctatggactcaaagccttcactgttaaaccccactggatctatactcgtctcatctccgttaaaaccaaatccactggatctgccacagcttcagcatcgagctgctgttatcccaccaatggtatcctgcaccccatgtaacataccaattggaaccccagtgagcggctatgctctctaccagcgacacattaaagcaatgcatgagtcagcactcctggaggagcagcggcagagacaagaacagatagatttggaatgtagaagttctacaagtccatgtggcacatccaagagtccaaacagagagtgggaaggaaaatcagtcgcctatatgccttatgctgaggtcaaacgtgctctagaacaggaagcacagatgcacaatactgcagcaaggtcagcctcaccgtgtaggctttctccaagagaagtcagtaaagccgctccacagcctgatatgagtgcagcccgctatagtgtcccgccagtccttcagcctgctccacatcaagtgataactaatctccctgaaggcgttcggcttccgacaactcgaccaaccaggccaccgccccctctcatcccgtcatccaaaaccacagtggcttcagaaaaaccatcttttataatgggaggctccatctcacagggaacaccaggcacttatttgacttctcataatcaggcttcctacactcaagaaacacccaagccgtcagtgggatctatctctcttggactgccacggcaacaggaatctgccaaatcagctactttgccctacatcaagcaggaagaattttctccccgaagccaaaactcacaacctgagggtctgttggtcagggcccaacatgaaggtgtagtcagaggtaccgcaggagccatacaagaaggaagtataactcggggaactccaaccagcaaaatttcagtggagagcattccatccctacggggctctatcactcagggcaccccggctctgccccagactggcataccaacagaggctttggtgaaggggtccatttcgagaatgcccattgaagacagcagtcctgagaaaggcagagaggaagctgcatccaaaggccatgttatttatgaaggcaaaagtggacatatcttgtcatatgataatattaagaatgcccgagaagggactaggagtccaagaacagctcatgaaatcagtttaaagagaagctatgaatcagtggaaggaaatataaagcaagggatgtcaatgagggagtctcctgtatcagcaccgttagaggggctgatatgccgagcattacccagggggagtcctcattctgacctcaaagaaaggactgtattgtctggctccataatgcaggggacaccaagagcaacaactgaaagctttgaagatggccttaaatatcccaaacaaattaaaagggaaagtcctcccatacgagcatttgaaggtgccattaccaaaggaaaaccatatgatggcatcaccaccatcaaagaaatggggcgttccattcatgagattccaaggcaagatattttaactcaggaaagtcggaaaactccagaagtggtccagagcacacggccgataattgagggttccatttcccagggcacaccaataaagtttgacaacaactcaggtcaatctgccatcaaacacaatgtcaaatccttaatcacggggcctagcaaactatcccgtggaatgcctccgctggaaattgtgccagagaacataaaagtggtagaacggggaaaatatgaggatgtgaaagcaggcgagaccgtgcgttcccggcacacgtcagtggtaagctctggcccctccgttcttaggtccacactgcatgaagctcccaaagcacaactgagccctgggatttatgatgacaccagtgcacggaggacccctgtgagttatcaaaacaccatgtccagaggctcacccatgatgaacagaacttctgatgttacaatttcttctaacaagtctaccaatcatgaaaggaaatcgacactgacccctacccagagggaaagtatcccagcgaagtctccagtgcctggggtggaccctgtcgtgagccacagtccgtttgatccccatcacagaggcagcactgcaggcgaggtttatcggagccacctgcccacgcacttggatccagccatgccttttcacagggctttggatcctgcagcggctgcttacctgtttcagagacagctttcaccaactccaggttacccaagtcagtatcagctttacgcaatggagaacacaagacagacaatcttaaatgattacattacctcacaacagatgcaagtgaacttgcgtccagatgtggccagaggactctccccaagagagcagccactgggtctcccatacccagcaacgagaggaatcattgacctgaccaatatgcctccaacaattttagtgcctcatccagggggaacaagcactcctcccatggacagaatcacttatattcctggtacacagattactttccctcccaggccgtacaactctgcttccatgtctccaggacacccaacacaccttgcagctgctgcaagtgctgagagggaacgggaacgggagcgggagaaggagcgggagcgggaacggattgctgcagcttcctccgacctctacctgcggccaggctcagaacagcctggccgacctggcagtcatggatatgttcgctccccttccccttcagtaagaactcaggagaccatgttgcaacagagacccagtgttttccaaggaaccaatggaaccagtgtaatcacacctttggatccaactgctcagctacgaatcatgccactgcctgctgggggcccttcaataagccaaggcctgccagcctcccgttacaacactgctgcggatgccctggctgctcttgtggatgctgcagcttctgcaccccagatggatgtgtccaaaacaaaagagagtaagcatgaagctgccaggttagaagaaaatttgagaagcaggtcagcagcagttagtgaacagcagcagctagagcagaaaaccctggaggtggagaagagatctgttcagtgtttatacacttcttcagcctttccaagtggcaagccccagcctcattcttcagtagtttattctgaggctgggaaagataaagggcctcctccaaaatccagatatgaggaagagctaaggaccagagggaagactaccattactgcagctaacttcatagacgtgatcatcacccggcaaattgcctcggacaaggatgcgagggaacgtggctctcaaagttcagactcttctagtagcttatcttctcacaggtatgaaacacctagcgatgctattgaggtgataagtcctgccagctcacctgcgccaccccaggagaaactgcagacctatcagccagaggttgttaaggcaaatcaagcggaaaatgatcctaccagacaatatgaaggaccattacatcactatcgaccacagcaggaatcaccatctccccaacaacagctgcccccttcttcacaggcagagggaatggggcaagtgcccaggacccatcggctgatcacacttgctgatcacatctgtcaaattatcacacaagattttgctagaaatcaagtttcctcgcagactccccagcagcctcctacttctacattccagaactcaccttctgctttggtatctacacctgtgaggactaaaacatcaaaccgttacagcccagaatcccaggctcagtctgtccatcatcaaagaccaggttcaagggtctctccagaaaatcttgtggacaaatccaggggaagtaggcctggaaaatccccagagaggagtcacgtctcttcggagccctacgagcccatctccccaccccaggttccggttgtgcatgagaaacaggacagcttgctgctcttgtctcagaggggcgcagagcctgcagagcagaggaatgatgcccgctcaccagggagtataagctacttgccttcattcttcaccaagcttgaaaatacatcacccatggttaaatcaaagaagcaggagatttttcgtaagttgaactcctctggtggaggtgactctgatatggcagctgctcagccaggaactgagatctttaatctgccagcagttactacgtcaggctcagttagctctagaggccattcttttgctgatcctgccagtaatcttgggctggaagacattatcaggaaggctctcatgggaagctttgatgacaaagttgaggatcatggagttgtcatgtcccagcctatgggagtagtgcctggtactgccaacacctcagttgtgaccagtggtgagacacgaagagaggaaggggacccatcacctcattcaggaggagtttgcaaaccaaagctgatcagcaagtcaaacagcaggaaatctaagtctcctatacctgggcaaggctacttaggaacggaacggccctcttcagtctcctctgtacattcagaaggggattaccataggcagacgccagggtgggcctgggaagacaggccctcttcaacaggctcaactcagtttccttataaccctctgactatgcggatgctcagcagtactccaccaacaccgattgcatgtgctccctctgcggtgaaccaagcagctcctcaccaacagaacaggatctgggagcgagagcctgccccactgctctcagcacagtacgagaccctgtcggatagtgatgactgaactgcacaaagtgaggggaacagggtgcaggagagggatctctagtttttgtggtttaatttttagtagcaggtcaaaaacctgccctcctgtgacttattccctgagacttttcaggagagccagcccacagatgatgaagaaatgatggaagttcatttggagagtcaaatgggaaaaaaacaaacaaaaaactgcctttgatacaggcaattcagtggactataataatagtggagggttgagatgtagagtttttaaaaagtgaacagttgctgttcttacatctgtaaagaaaaccataatgtctttaaatcactcttctgtaaatagatgacctttttgcagtgtatatccccttgctgtagtatctggtgtacttatgttcaaatcagcgcatcaactttgggggtgatttttaaaaatctttttgtctatctatctttttaaccctagccttctaaacaacctcatacagcccagttacataatgttggctgtcacgggcattgtacttttatctgatattgtttcctctaaattcagctttccagtgatgtttaaaatcttgtgaaaatgtttagatttttaacacagaccctgtcataaaatctgtacattagggtcaaaaggtaaaagtaacaaattctgccatattgtaaatttccagtgcaggctttaatttttttttttcattagtagcactgaaaaaatattactgcatgggtatgttctagttcagtttataaagttttaaaggcttatttgaggcatacctcactgttacgcacactggtaatttaaccatgcccctaagtattccttttctcctgcatttgatgcagcccaacaaagcttttgttttgaaataaatttgactaccctgtccatagctacagtagattatttgtggtttaaggctcctggtgtctcaggttccaaaggaaaagcttacatatttttcccttagtttgaatatatgattggttgggttaaaagataatgatctgtgtagtatttagataagctttatgctgcatcctgaaaaactcatggtgaacacagtcctttttccccatcactatggaccagcatttactctcactttgctcccttgggacaagagtttactgttaaatgttttcatttcacagagtctcaaggtgcaaataatttaaaagactgaattctaaactaattatggtactagagggccagttttatctttcattaagaattgcttgctgaattttaaagtttttttcatacaatttatcatagcatttaagtatctttctataacatagatactaacagttttgggagaatgccactggtaactggaaaggggagaaacagatctctcaggatgataaaaattagcactttacagactttcaagtagacctaaacttttaaacaaaagtactcaaggcttttaaggaagcagctctgtgattagctactgaccaagaccctcctatcactggtgtctaatccctatgttacagatgaagacacaggtttagtactttgcccatatagttaaattagtgacagagataggccataagcccacatttgtcttcagtcaaagctttcactcctgtccctgttccactcctgtatacctgaggtccccaacataaactttagatcaggcttagtggtcagcattcctagtacttggaaagttggtattttttacaacagatatatgtaaacatataaaaatttcaaaatgaatgaaaaacagtgactaaatgttccacttcacagttttctgctgaatttttttttttcaggtactggtaatattttagagtttgttaataatttatattgccaacctaccataaaagagattatgatggtatttttctatgaccctgagggtcttaagctattctgagtcagaatacagttgacccttgaacaacacgggtttgaactgtgtgggtccacttatacatggattttcttccacctctgccacccaagatagcaagaccaaccccttctcatcctcagcctattcaacatgaagatgacaaggatgaagaccttcatgatgatccacttccacttaatgaatagtaaatatattttctcttccttataatcttaacaaacattttctcttctctagcttactttattgtaagaatacagtatataatacatatacaaaatatgtgtcaatcgactatgttatccgtaagacttctggtcagcagtaggccatgagtagttaagttttggaggagtcaaagttagatgtggatttttgactacttagggggtctatgcccctaactcctgcattatttgaaggtcaaccgtatagtttctgagaacatgtcagatcagagcctaacttcttactcttgcagttctacctgaggacccgaaggtgaggtgctgtgaaccactccctccatcctcatcataatgcatgtgcgtattactttatttaccatcacctggagaagaaatctcagaatgagagttaaaatccaataatagttcttgggttcaaaataaatgaaaggacagaattctcacatggtttacctatggaggttcaccttatcatgatttaagtggtaagcacagagcagcactgacaacttactgtggttcactgcaaaccaaaacatgatattctttgtagacttagatttcagtgttctgacactatatcccttacaccgtgatttttttagcacccagaactaaattaaggtcttcctaaatactcttcataaaagtattctgacagccagttttccactgcatgtttatgactgcaaatttcataatgcttttaattttggtacactgagtgattctattttaaaaatatttatgcccagaaaactccagtgaccattggacagttaaaaaattttaatgacacgattttaaccaattcacttttgaatttagaccaatcagtaaaggagatcagtcctccttttgcttcagtaccttattttacaacagtgtaaatgaactgtaatgaaaacacccacatgaagagactgtcctgaaaactcctagtgtttccaacaacgagaccatgagctgagtcactgtggatgatttaaaattaataaataaataaaacttggaatgaaaaacctttcagtaacccctgcagttgtgaaaaggtaaaaacattctcaatgcaaaaggtgagtggttgacattaatttttttaagaaatca

SEQ ID NO: 448585 - DNA, 9641 bp, Homo sapiens
gggttgagtcaagatggcggccaaggtggcgaagcagcagccgcggcggcggcggcggctggagtgagcgtccgactcgccgcgccgaacgaggtcccggtgtagggccgcgcgccgtggccgcgtcccactcctcaggccggggcgcacgtcggctcccacgcttagccagctcccggtggtttcctagaaacatgattgtttattggcattgatctcacagtctggtgaggacttctttactgataatgtcaagttcaggttatcctcccaaccaaggagcattcagcacagaacaaagtcgttatcctcctcactctgtccagtatacatttcccaacacccgccaccagcaggagttcgcagtccctgattatcgttcctctcatcttgaagtgagtcaggcatcacagcttttgcagcaacagcagcagcaacagcttcgaaggcgaccttccttgctttcagaatttcacccaggttctgacaggcctcaagaaaggagaactagttatgaaccgtttcatccaggcccatccccagtggatcatgattcactggaatcgaagcgaccacgtctggaacaggtttctgattctcattttcagcgtgtcagtgctgcggttttgcctttagtgcacccgctgccagaagggctgagggcttctgcagatgctaagaaggatccagcattcggaggcaaacatgaagctccatcctctccaatttcggggcaaccatgtggagatgatcaaaatgcttcaccttcaaaactctcaaaggaagagttaatacagagtatggatcgtgtagatcgagaaattgcaaaagtagaacagcagatccttaaactgaaaaagaaacaacaacagcttgaagaagaggcagctaaacctcctgagcctgagaagcccgtgtcccctcctcctgtggagcagaaacaccgcagtattgtccaaattatttatgatgagaatcggaaaaaagcagaagaagctcataaaatttttgaaggtcttggcccaaaagttgaactgccactgtataaccagccatcagataccaaggtgtaccatgagaacatcaagacaaaccaggtgatgaggaaaaaactcattttattttttaaaagaagaaatcatgcaagaaaacaaagggaacaaaaaatctgccagcgttatgatcagctcatggaggcatgggagaaaaaagtggacagaatagaaaataatcctcggaggaaagctaaagaaagcaaaacaagggaatactatgaaaagcagtttccagaaattcgaaaacaaagagaacagcaagaaagatttcagcgagttgggcagaggggagctggtctttcagccaccattgctaggagtgagcatgagatttctgaaattattgatgggctctctgagcaggagaataatgagaaacaaatgcggcagctctctgtgattccacctatgatgtttgatgcagaacaaagacgagtcaagttcattaacatgaatgggcttatggaggaccctatgaaagtgtataaagataggcagtttatgaatgtttggactgaccatgaaaaggagatctttaaggacaagtttatccagcatccaaaaaactttggactaattgcatcatacttggagaggaagagtgttcctgattgtgttttgtattactatttaaccaagaaaaatgagaattataaagccctcgtcagaaggaattatgggaaacgcagaggcagaaaccagcaaattgctcgaccctcgcaagaagaaaaagtagaagaaaaagaagaggataaagcagaaaaaacagaaaaaaaagaagaagaaaagaaagatgaagaggaaaaagatgaaaaagaagactccaaagaaaataccaaggaaaaggacaagatagatggtacagcagaagaaactgaggaaagagagcaagccacaccccgggggcgaaagactgccaacagtcagggccgccgtaagggccggatcaccaggtccatgacaaacgaagctgcagctgccagtgctgcagccgcagcggctactgaagagcccccaccacctctgccaccgccaccagaacccatttctacagagcctgtggagacctctcgatggacagaagaagaaatggaagttgctaaaaaaggtctagtagaacatggtcgtaactgggcagcaattgctaaaatggtgggaacgaaaagtgaagctcaatgtaaaaacttctattttaactataaaaggcgacacaatcttgacaacctcttacagcagcataaacagaaaacttcacgaaaacctcgtgaagagcgagatgtgtctcaatgtgaaagtgtcgcttccactgtttctgctcaggaggatgaagatattgaagcctccaatgaagaagaaaatccagaagacagcgaaggtgcagaaaatagttctgatacagaaagtgctccttctccttcaccagttgaagctgtcaagcccagcgaggacagtcctgaaaatgctacttctcgaggaaacacagaacctgcggttgagcttgagcccaccacggaaactgcacccagtacatctccctccttagcagttccaagtacaaaaccagctgaagatgaaagtgtggagacccaggtgaatgacagcatcagtgctgagacagcagagcagatggatgtagatcagcaggagcacagtgctgaagagggttctgtttgtgatcccccacccgctaccaaagctgactctgtggacgttgaagtgagggtgccagaaaaccatgcatctaaagttgaaggtgataataccaaagaaagagacttggatagagccagtgagaaggtggaacctagagatgaagatttggtggtagctcagcaaataaatgcccaaaggcccgagccccagtcagacaatgattccagtgccacgtgcagcgctgatgaggatgtggatggagagccagagaggcagagaatgtttcctatggactcaaagccttcactgttaaaccccactggatctatactcgtctcatctccgttaaaaccaaatccactggatctgccacagcttcagcatcgagctgctgttatcccaccaatggtatcctgcaccccatgtaacataccaattggaaccccagtgagcggctatgctctctaccagcgacacattaaagcaatgcatgagtcagcactcctggaggagcagcggcagagacaagaacagatagatttggaatgtagaagttctacaagtccatgtggcacatccaagagtccaaacagagagtgggaagtccttcagcctgctccacatcaagtgataactaatctccctgaaggcgttcggcttccgacaactcgaccaaccaggccaccgccccctctcatcccgtcatccaaaaccacagtggcttcagaaaaaccatcttttataatgggaggctccatctcacagggaacaccaggcacttatttgacttctcataatcaggcttcctacactcaagaaacacccaagccgtcagtgggatctatctctcttggactgccacggcaacaggaatctgccaaatcagctactttgccctacatcaagcaggaagaattttctccccgaagccaaaactcacaacctgagggtctgttggtcagggcccaacatgaaggtgtagtcagaggtaccgcaggagccatacaagaaggaagtataactcggggaactccaaccagcaaaatttcagtggagagcattccatccctacggggctctatcactcagggcaccccggctctgccccagactggcataccaacagaggctttggtgaaggggtccatttcgagaatgcccattgaagacagcagtcctgagaaaggcagagaggaagctgcatccaaaggccatgttatttatgaaggcaaaagtggacatatcttgtcatatgataatattaagaatgcccgagaagggactaggagtccaagaacagctcatgaaatcagtttaaagagaagctatgaatcagtggaaggaaatataaagcaagggatgtcaatgagggagtctcctgtatcagcaccgttagaggggctgatatgccgagcattacccagggggagtcctcattctgacctcaaagaaaggactgtattgtctggctccataatgcaggggacaccaagagcaacaactgaaagctttgaagatggccttaaatatcccaaacaaattaaaagggaaagtcctcccatacgagcatttgaaggtgccattaccaaaggaaaaccatatgatggcatcaccaccatcaaagaaatggggcgttccattcatgagattccaaggcaagatattttaactcaggaaagtcggaaaactccagaagtggtccagagcacacggccgataattgagggttccatttcccagggcacaccaataaagtttgacaacaactcaggtcaatctgccatcaaacacaatgtcaaatccttaatcacggggcctagcaaactatcccgtggaatgcctccgctggaaattgtgccagagaacataaaagtggtagaacggggaaaatatgaggatgtgaaagcaggcgagaccgtgcgttcccggcacacgtcagtggtaagctctggcccctccgttcttaggtccacactgcatgaagctcccaaagcacaactgagccctgggatttatgatgacaccagtgcacggaggacccctgtgagttatcaaaacaccatgtccagaggctcacccatgatgaacagaacttctgatgttacaatttcttctaacaagtctaccaatcatgaaaggaaatcgacactgacccctacccagagggaaagtatcccagcgaagtctccagtgcctggggtggaccctgtcgtgagccacagtccgtttgatccccatcacagaggcagcactgcaggcgaggtttatcggagccacctgcccacgcacttggatccagccatgccttttcacagggctttggatcctgcagcggctgcttacctgtttcagagacagctttcaccaactccaggttacccaagtcagtatcagctttacgcaatggagaacacaagacagacaatcttaaatgattacattacctcacaacagatgcaagtgaacttgcgtccagatgtggccagaggactctccccaagagagcagccactgggtctcccatacccagcaacgagaggaatcattgacctgaccaatatgcctccaacaattttagtgcctcatccagggggaacaagcactcctcccatggacagaatcacttatattcctggtacacagattactttccctcccaggccgtacaactctgcttccatgtctccaggacacccaacacaccttgcagctgctgcaagtgctgagagggaacgggaacgggagcgggagaaggagcgggagcgggaacggattgctgcagcttcctccgacctctacctgcggccaggctcagaacagcctggccgacctggcagtcatggatatgttcgctccccttccccttcagtaagaactcaggagaccatgttgcaacagagacccagtgttttccaaggaaccaatggaaccagtgtaatcacacctttggatccaactgctcagctacgaatcatgccactgcctgctgggggcccttcaataagccaaggcctgccagcctcccgttacaacactgctgcggatgccctggctgctcttgtggatgctgcagcttctgcaccccagatggatgtgtccaaaacaaaagagagtaagcatgaagctgccaggttagaagaaaatttgagaagcaggtcagcagcagttagtgaacagcagcagctagagcagaaaaccctggaggtggagaagagatctgttcagtgtttatacacttcttcagcctttccaagtggcaagccccagcctcattcttcagtagtttattctgaggctgggaaagataaagggcctcctccaaaatccagatatgaggaagagctaaggaccagagggaagactaccattactgcagctaacttcatagacgtgatcatcacccggcaaattgcctcggacaaggatgcgagggaacgtggctctcaaagttcagactcttctagtagcttatcttctcacaggtatgaaacacctagcgatgctattgaggtgataagtcctgccagctcacctgcgccaccccaggagaaactgcagacctatcagccagaggttgttaaggcaaatcaagcggaaaatgatcctaccagacaatatgaaggaccattacatcactatcgaccacagcaggaatcaccatctccccaacaacagctgcccccttcttcacaggcagagggaatggggcaagtgcccaggacccatcggctgatcacacttgctgatcacatctgtcaaattatcacacaagattttgctagaaatcaagtttcctcgcagactccccagcagcctcctacttctacattccagaactcaccttctgctttggtatctacacctgtgaggactaaaacatcaaaccgttacagcccagaatcccaggctcagtctgtccatcatcaaagaccaggttcaagggtctctccagaaaatcttgtggacaaatccaggggaagtaggcctggaaaatccccagagaggagtcacgtctcttcggagccctacgagcccatctccccaccccaggttccggttgtgcatgagaaacaggacagcttgctgctcttgtctcagaggggcgcagagcctgcagagcagaggaatgatgcccgctcaccagggagtataagctacttgccttcattcttcaccaagcttgaaaatacatcacccatggttaaatcaaagaagcaggagatttttcgtaagttgaactcctctggtggaggtgactctgatatggcagctgctcagccaggaactgagatctttaatctgccagcagttactacgtcaggctcagttagctctagaggccattcttttgctgatcctgccagtaatcttgggctggaagacattatcaggaaggctctcatgggaagctttgatgacaaagttgaggatcatggagttgtcatgtcccagcctatgggagtagtgcctggtactgccaacacctcagttgtgaccagtggtgagacacgaagagaggaaggggacccatcacctcattcaggaggagtttgcaaaccaaagctgatcagcaagtcaaacagcaggaaatctaagtctcctatacctgggcaaggctacttaggaacggaacggccctcttcagtctcctctgtacattcagaaggggattaccataggcagacgccagggtgggcctgggaagacaggccctcttcaacaggctcaactcagtttccttataaccctctgactatgcggatgctcagcagtactccaccaacaccgattgcatgtgctccctctgcggtgaaccaagcagctcctcaccaacagaacaggatctgggagcgagagcctgccccactgctctcagcacagtacgagaccctgtcggatagtgatgactgaactgcacaaagtgaggggaacagggtgcaggagagggatctctagtttttgtggtttaatttttagtagcaggtcaaaaacctgccctcctgtgacttattccctgagacttttcaggagagccagcccacagatgatgaagaaatgatggaagttcatttggagagtcaaatgggaaaaaaacaaacaaaaaactgcctttgatacaggcaattcagtggactataataatagtggagggttgagatgtagagtttttaaaaagtgaacagttgctgttcttacatctgtaaagaaaaccataatgtctttaaatcactcttctgtaaatagatgacctttttgcagtgtatatccccttgctgtagtatctggtgtacttatgttcaaatcagcgcatcaactttgggggtgatttttaaaaatctttttgtctatctatctttttaaccctagccttctaaacaacctcatacagcccagttacataatgttggctgtcacgggcattgtacttttatctgatattgtttcctctaaattcagctttccagtgatgtttaaaatcttgtgaaaatgtttagatttttaacacagaccctgtcataaaatctgtacattagggtcaaaaggtaaaagtaacaaattctgccatattgtaaatttccagtgcaggctttaatttttttttttcattagtagcactgaaaaaatattactgcatgggtatgttctagttcagtttataaagttttaaaggcttatttgaggcatacctcactgttacgcacactggtaatttaaccatgcccctaagtattccttttctcctgcatttgatgcagcccaacaaagcttttgttttgaaataaatttgactaccctgtccatagctacagtagattatttgtggtttaaggctcctggtgtctcaggttccaaaggaaaagcttacatatttttcccttagtttgaatatatgattggttgggttaaaagataatgatctgtgtagtatttagataagctttatgctgcatcctgaaaaactcatggtgaacacagtcctttttccccatcactatggaccagcatttactctcactttgctcccttgggacaagagtttactgttaaatgttttcatttcacagagtctcaaggtgcaaataatttaaaagactgaattctaaactaattatggtactagagggccagttttatctttcattaagaattgcttgctgaattttaaagtttttttcatacaatttatcatagcatttaagtatctttctataacatagatactaacagttttgggagaatgccactggtaactggaaaggggagaaacagatctctcaggatgataaaaattagcactttacagactttcaagtagacctaaacttttaaacaaaagtactcaaggcttttaaggaagcagctctgtgattagctactgaccaagaccctcctatcactggtgtctaatccctatgttacagatgaagacacaggtttagtactttgcccatatagttaaattagtgacagagataggccataagcccacatttgtcttcagtcaaagctttcactcctgtccctgttccactcctgtatacctgaggtccccaacataaactttagatcaggcttagtggtcagcattcctagtacttggaaagttggtattttttacaacagatatatgtaaacatataaaaatttcaaaatgaatgaaaaacagtgactaaatgttccacttcacagttttctgctgaatttttttttttcaggtactggtccagcaggttatgtctctaaaattacttttcgttcagagcagaatgttgtcctatctacttgatacaatcctttatggaccaacgcatctggtatgaaactcgagcaaggaaatataacacaacgggtattcccctctcagagactatacaatctaatatgtaaacatgatttactattactgctactaaacttgttccgtcttgctgc

SEQ ID NO: 448586 - DNA, 11058 bp, Homo sapiens
gggttgagtcaagatggcggccaaggtggcgaagcagcagccgcggcggcggcggcggctggagtgagcgtccgactcgccgcgccgaacgaggtcccggtgtagggccgcgcgccgtggccgcgtcccactcctcaggccggggcgcacgtcggctcccacgcttagccagctcccggtggtttcctagaaacatgattgtttattggcattgatctcacagtctggtgaggacttctttactgataatgtcaagttcaggttatcctcccaaccaaggagcattcagcacagaacaaagtcgttatcctcctcactctgtccagtatacatttcccaacacccgccaccagcaggagttcgcagtccctgattatcgttcctctcatcttgaagtgagtcaggcatcacagcttttgcagcaacagcagcagcaacagcttcgaaggcgaccttccttgctttcagaatttcacccaggttctgacaggcctcaagaaaggagaactagttatgaaccgtttcatccaggcccatccccagtggatcatgattcactggaatcgaagcgaccacgtctggaacaggtttctgattctcattttcagcgtgtcagtgctgcggttttgcctttagtgcacccgctgccagaagggctgagggcttctgcagatgctaagaaggatccagcattcggaggcaaacatgaagctccatcctctccaatttcggggcaaccatgtggagatgatcaaaatgcttcaccttcaaaactctcaaaggaagagttaatacagagtatggatcgtgtagatcgagaaattgcaaaagtagaacagcagatccttaaactgaaaaagaaacaacaacagcttgaagaagaggcagctaaacctcctgagcctgagaagcccgtgtcccctcctcctgtggagcagaaacaccgcagtattgtccaaattatttatgatgagaatcggaaaaaagcagaagaagctcataaaatttttgaaggtcttggcccaaaagttgaactgccactgtataaccagccatcagataccaaggtgtaccatgagaacatcaagacaaaccaggtgatgaggaaaaaactcattttattttttaaaagaagaaatcatgcaagaaaacaaagggaacaaaaaatctgccagcgttatgatcagctcatggaggcatgggagaaaaaagtggacagaatagaaaataatcctcggaggaaagctaaagaaagcaaaacaagggaatactatgaaaagcagtttccagaaattcgaaaacaaagagaacagcaagaaagatttcagcgagttgggcagaggggagctggtctttcagccaccattgctaggagtgagcatgagatttctgaaattattgatgggctctctgagcaggagaataatgagaaacaaatgcggcagctctctgtgattccacctatgatgtttgatgcagaacaaagacgagtcaagttcattaacatgaatgggcttatggaggaccctatgaaagtgtataaagataggcagtttatgaatgtttggactgaccatgaaaaggagatctttaaggacaagtttatccagcatccaaaaaactttggactaattgcatcatacttggagaggaagagtgttcctgattgtgttttgtattactatttaaccaagaaaaatgagaattataaagccctcgtcagaaggaattatgggaaacgcagaggcagaaaccagcaaattgctcgaccctcgcaagaagaaaaagtagaagaaaaagaagaggataaagcagaaaaaacagaaaaaaaagaagaagaaaagaaagatgaagaggaaaaagatgaaaaagaagactccaaagaaaataccaaggaaaaggacaagatagatggtacagcagaagaaactgaggaaagagagcaagccacaccccgggggcgaaagactgccaacagtcagggccgccgtaagggccggatcaccaggtccatgacaaacgaagctgcagctgccagtgctgcagccgcagcggctactgaagagcccccaccacctctgccaccgccaccagaacccatttctacagagcctgtggagacctctcgatggacagaagaagaaatggaagttgctaaaaaaggtctagtagaacatggtcgtaactgggcagcaattgctaaaatggtgggaacgaaaagtgaagctcaatgtaaaaacttctattttaactataaaaggcgacacaatcttgacaacctcttacagcagcataaacagaaaacttcacgaaaacctcgtgaagagcgagatgtgtctcaatgtgaaagtgtcgcttccactgtttctgctcaggaggatgaagatattgaagcctccaatgaagaagaaaatccagaagacagcgaaggtgcagaaaatagttctgatacagaaagtgctccttctccttcaccagttgaagctgtcaagcccagcgaggacagtcctgaaaatgctacttctcgaggaaacacagaacctgcggttgagcttgagcccaccacggaaactgcacccagtacatctccctccttagcagttccaagtacaaaaccagctgaagatgaaagtgtggagacccaggtgaatgacagcatcagtgctgagacagcagagcagatggatgtagatcagcaggagcacagtgctgaagagggttctgtttgtgatcccccacccgctaccaaagctgactctgtggacgttgaagtgagggtgccagaaaaccatgcatctaaagttgaaggtgataataccaaagaaagagacttggatagagccagtgagaaggtggaacctagagatgaagatttggtggtagctcagcaaataaatgcccaaaggcccgagccccagtcagacaatgattccagtgccacgtgcagcgctgatgaggatgtggatggagagccagagaggcagagaatgtttcctatggactcaaagccttcactgttaaaccccactggatctatactcgtctcatctccgttaaaaccaaatccactggatctgccacagcttcagcatcgagctgctgttatcccaccaatggtatcctgcaccccatgtaacataccaattggaaccccagtgagcggctatgctctctaccagcgacacattaaagcaatgcatgagtcagcactcctggaggagcagcggcagagacaagaacagatagatttggaatgtagaagttctacaagtccatgtggcacatccaagagtccaaacagagagtgggaagtccttcagcctgctccacatcaagtgataactaatctccctgaaggcgttcggcttccgacaactcgaccaaccaggccaccgccccctctcatcccgtcatccaaaaccacagtggcttcagaaaaaccatcttttataatgggaggctccatctcacagggaacaccaggcacttatttgacttctcataatcaggcttcctacactcaagaaacacccaagccgtcagtgggatctatctctcttggactgccacggcaacaggaatctgccaaatcagctactttgccctacatcaagcaggaagaattttctccccgaagccaaaactcacaacctgagggtctgttggtcagggcccaacatgaaggtgtagtcagaggtaccgcaggagccatacaagaaggaagtataactcggggaactccaaccagcaaaatttcagtggagagcattccatccctacggggctctatcactcagggcaccccggctctgccccagactggcataccaacagaggctttggtgaaggggtccatttcgagaatgcccattgaagacagcagtcctgagaaaggcagagaggaagctgcatccaaaggccatgttatttatgaaggcaaaagtggacatatcttgtcatatgataatattaagaatgcccgagaagggactaggagtccaagaacagctcatgaaatcagtttaaagagaagctatgaatcagtggaaggaaatataaagcaagggatgtcaatgagggagtctcctgtatcagcaccgttagaggggctgatatgccgagcattacccagggggagtcctcattctgacctcaaagaaaggactgtattgtctggctccataatgcaggggacaccaagagcaacaactgaaagctttgaagatggccttaaatatcccaaacaaattaaaagggaaagtcctcccatacgagcatttgaaggtgccattaccaaaggaaaaccatatgatggcatcaccaccatcaaagaaatggggcgttccattcatgagattccaaggcaagatattttaactcaggaaagtcggaaaactccagaagtggtccagagcacacggccgataattgagggttccatttcccagggcacaccaataaagtttgacaacaactcaggtcaatctgccatcaaacacaatgtcaaatccttaatcacggggcctagcaaactatcccgtggaatgcctccgctggaaattgtgccagagaacataaaagtggtagaacggggaaaatatgaggatgtgaaagcaggcgagaccgtgcgttcccggcacacgtcagtggtaagctctggcccctccgttcttaggtccacactgcatgaagctcccaaagcacaactgagccctgggatttatgatgacaccagtgcacggaggacccctgtgagttatcaaaacaccatgtccagaggctcacccatgatgaacagaacttctgatgttacaatttcttctaacaagtctaccaatcatgaaaggaaatcgacactgacccctacccagagggaaagtatcccagcgaagtctccagtgcctggggtggaccctgtcgtgagccacagtccgtttgatccccatcacagaggcagcactgcaggcgaggtttatcggagccacctgcccacgcacttggatccagccatgccttttcacagggctttggatcctgcagcggctgcttacctgtttcagagacagctttcaccaactccaggttacccaagtcagtatcagctttacgcaatggagaacacaagacagacaatcttaaatgattacattacctcacaacagatgcaagtgaacttgcgtccagatgtggccagaggactctccccaagagagcagccactgggtctcccatacccagcaacgagaggaatcattgacctgaccaatatgcctccaacaattttagtgcctcatccagggggaacaagcactcctcccatggacagaatcacttatattcctggtacacagattactttccctcccaggccgtacaactctgcttccatgtctccaggacacccaacacaccttgcagctgctgcaagtgctgagagggaacgggaacgggagcgggagaaggagcgggagcgggaacggattgctgcagcttcctccgacctctacctgcggccaggctcagaacagcctggccgacctggcagtcatggatatgttcgctccccttccccttcagtaagaactcaggagaccatgttgcaacagagacccagtgttttccaaggaaccaatggaaccagtgtaatcacacctttggatccaactgctcagctacgaatcatgtcagtctcttgtacatattttgacaaaaaatgtctcttgcatatacattttaaaatttgtgactgcaatagtctaagtatagtcatgcttttctgcccatgccatgaaggcttttttgttgttgttgcagtttgtccttccatctccccaccacattcccagcaaatggtcttcccttcacagagctgtgatttggttttatttacagccactgcctgctgggggcccttcaataagccaaggcctgccagcctcccgttacaacactgctgcggatgccctggctgctcttgtggatgctgcagcttctgcaccccagatggatgtgtccaaaacaaaagagagtaagcatgaagctgccaggttagaagaaaatttgagaagcaggtcagcagcagttagtgaacagcagcagctagagcagaaaaccctggaggtggagaagagatctgttcagtgtttatacacttcttcagcctttccaagtggcaagccccagcctcattcttcagtagtttattctgaggctgggaaagataaagggcctcctccaaaatccagatatgaggaagagctaaggaccagagggaagactaccattactgcagctaacttcatagacgtgatcatcacccggcaaattgcctcggacaaggatgcgagggaacgtggctctcaaagttcagactcttctagtagcttatcttctcacaggtatgaaacacctagcgatgctattgaggtgataagtcctgccagctcacctgcgccaccccaggagaaactgcagacctatcagccagaggttgttaaggcaaatcaagcggaaaatgatcctaccagacaatatgaaggaccattacatcactatcgaccacagcaggaatcaccatctccccaacaacagctgcccccttcttcacaggcagagggaatggggcaagtgcccaggacccatcggctgatcacacttgctgatcacatctgtcaaattatcacacaagattttgctagaaatcaagtttcctcgcagactccccagcagcctcctacttctacattccagaactcaccttctgctttggtatctacacctgtgaggactaaaacatcaaaccgttacagcccagaatcccaggctcagtctgtccatcatcaaagaccaggttcaagggtctctccagaaaatcttgtggacaaatccaggggaagtaggcctggaaaatccccagagaggagtcacgtctcttcggagccctacgagcccatctccccaccccaggttccggttgtgcatgagaaacaggacagcttgctgctcttgtctcagaggggcgcagagcctgcagagcagaggaatgatgcccgctcaccagggagtataagctacttgccttcattcttcaccaagcttgaaaatacatcacccatggttaaatcaaagaagcaggagatttttcgtaagttgaactcctctggtggaggtgactctgatatggcagctgctcagccaggaactgagatctttaatctgccagcagttactacgtcaggctcagttagctctagaggccattcttttgctgatcctgccagtaatcttgggctggaagacattatcaggaaggctctcatgggaagctttgatgacaaagttgaggatcatggagttgtcatgtcccagcctatgggagtagtgcctggtactgccaacacctcagttgtgaccagtggtgagacacgaagagaggaaggggacccatcacctcattcaggaggagtttgcaaaccaaagctgatcagcaagtcaaacagcaggaaatctaagtctcctatacctgggcaaggctacttaggaacggaacggccctcttcagtctcctctgtacattcagaaggggattaccataggcagacgccagggtgggcctgggaagacaggccctcttcaacaggctcaactcagtttccttataaccctctgactatgcggatgctcagcagtactccaccaacaccgattgcatgtgctccctctgcggtgaaccaagcagctcctcaccaacagaacaggatctgggagcgagagcctgccccactgctctcagcacagtacgagaccctgtcggatagtgatgactgaactgcacaaagtgaggggaacagggtgcaggagagggatctctagtttttgtggtttaatttttagtagcaggtcaaaaacctgccctcctgtgacttattccctgagacttttcaggagagccagcccacagatgatgaagaaatgatggaagttcatttggagagtcaaatgggaaaaaaacaaacaaaaaactgcctttgatacaggcaattcagtggactataataatagtggagggttgagatgtagagtttttaaaaagtgaacagttgctgttcttacatctgtaaagaaaaccataatgtctttaaatcactcttctgtaaatagatgacctttttgcagtgtatatccccttgctgtagtatctggtgtacttatgttcaaatcagcgcatcaactttgggggtgatttttaaaaatctttttgtctatctatctttttaaccctagccttctaaacaacctcatacagcccagttacataatgttggctgtcacgggcattgtacttttatctgatattgtttcctctaaattcagctttccagtgatgtttaaaatcttgtgaaaatgtttagatttttaacacagaccctgtcataaaatctgtacattagggtcaaaaggtaaaagtaacaaattctgccatattgtaaatttccagtgcaggctttaatttttttttttcattagtagcactgaaaaaatattactgcatgggtatgttctagttcagtttataaagttttaaaggcttatttgaggcatacctcactgttacgcacactggtaatttaaccatgcccctaagtattccttttctcctgcatttgatgcagcccaacaaagcttttgttttgaaataaatttgactaccctgtccatagctacagtagattatttgtggtttaaggctcctggtgtctcaggttccaaaggaaaagcttacatatttttcccttagtttgaatatatgattggttgggttaaaagataatgatctgtgtagtatttagataagctttatgctgcatcctgaaaaactcatggtgaacacagtcctttttccccatcactatggaccagcatttactctcactttgctcccttgggacaagagtttactgttaaatgttttcatttcacagagtctcaaggtgcaaataatttaaaagactgaattctaaactaattatggtactagagggccagttttatctttcattaagaattgcttgctgaattttaaagtttttttcatacaatttatcatagcatttaagtatctttctataacatagatactaacagttttgggagaatgccactggtaactggaaaggggagaaacagatctctcaggatgataaaaattagcactttacagactttcaagtagacctaaacttttaaacaaaagtactcaaggcttttaaggaagcagctctgtgattagctactgaccaagaccctcctatcactggtgtctaatccctatgttacagatgaagacacaggtttagtactttgcccatatagttaaattagtgacagagataggccataagcccacatttgtcttcagtcaaagctttcactcctgtccctgttccactcctgtatacctgaggtccccaacataaactttagatcaggcttagtggtcagcattcctagtacttggaaagttggtattttttacaacagatatatgtaaacatataaaaatttcaaaatgaatgaaaaacagtgactaaatgttccacttcacagttttctgctgaatttttttttttcaggtactggtaatattttagagtttgttaataatttatattgccaacctaccataaaagagattatgatggtatttttctatgaccctgagggtcttaagctattctgagtcagaatacagttgacccttgaacaacacgggtttgaactgtgtgggtccacttatacatggattttcttccacctctgccacccaagatagcaagaccaaccccttctcatcctcagcctattcaacatgaagatgacaaggatgaagaccttcatgatgatccacttccacttaatgaatagtaaatatattttctcttccttataatcttaacaaacattttctcttctctagcttactttattgtaagaatacagtatataatacatatacaaaatatgtgtcaatcgactatgttatccgtaagacttctggtcagcagtaggccatgagtagttaagttttggaggagtcaaagttagatgtggatttttgactacttagggggtctatgcccctaactcctgcattatttgaaggtcaaccgtatagtttctgagaacatgtcagatcagagcctaacttcttactcttgcagttctacctgaggacccgaaggtgaggtgctgtgaaccactccctccatcctcatcataatgcatgtgcgtattactttatttaccatcacctggagaagaaatctcagaatgagagttaaaatccaataatagttcttgggttcaaaataaatgaaaggacagaattctcacatggtttacctatggaggttcaccttatcatgatttaagtggtaagcacagagcagcactgacaacttactgtggttcactgcaaaccaaaacatgatattctttgtagacttagatttcagtgttctgacactatatcccttacaccgtgatttttttagcacccagaactaaattaaggtcttcctaaatactcttcataaaagtattctgacagccagttttccactgcatgtttatgactgcaaatttcataatgcttttaattttggtacactgagtgattctattttaaaaatatttatgcccagaaaactccagtgaccattggacagttaaaaaattttaatgacacgattttaaccaattcacttttgaatttagaccaatcagtaaaggagatcagtcctccttttgcttcagtaccttattttacaacagtgtaaatgaactgtaatgaaaacacccacatgaagagactgtcctgaaaactcctagtgtttccaacaacgagaccatgagctgagtcactgtggatgatttaaaattaataaataaataaaacttggaatgaaaaacctttcagtaacccctgcagttgtgaaaaggtaaaaacattctcaatgcaaaaggtgagtggttgacattaatttttttaagaaatca

SEQ ID NO: 448587 - DNA, 8983 bp, Homo sapiens
gggttgagtcaagatggcggccaaggtggcgaagcagcagccgcggcggcggcggcggctggagtgagcgtccgactcgccgcgccgaacgaggtcccggtgtagggccgcgcgccgtggccgcgtcccactcctcaggccggggcgcacgtcggctcccacgcttagccagctcccggtggtttcctagaaacatgattgtttattggcattgatctcacagtctggtgaggacttctttactgataatgtcaagttcaggttatcctcccaaccaaggagcattcagcacagaacaaagtcgttatcctcctcactctgtccagtatacatttcccaacacccgccaccagcaggagttcgcagtccctgattatcgttcctctcatcttgaagtgagtcaggcatcacagcttttgcagcaacagcagcagcaacagcttcgaaggcgaccttccttgctttcagaatttcacccaggttctgacaggcctcaagaaaggagaactagttatgaaccgtttcatccaggcccatccccagtggatcatgattcactggaatcgaagcgaccacgtctggaacaggtttctgattctcattttcagcgtgtcagtgctgcggttttgcctttagtgcacccgctgccagaagggctgagggcttctgcagatgctaagaaggatccagcattcggaggcaaacatgaagctccatcctctccaatttcggggcaaccatgtggagatgatcaaaatgcttcaccttcaaaactctcaaaggaagagttaatacagagtatggatcgtgtagatcgagaaattgcaaaagtagaacagcagatccttaaactgaaaaagaaacaacaacagcttgaagaagaggcagctaaacctcctgagcctgagaagcccgtgtcccctcctcctgtggagcagaaacaccgcagtattgtccaaattatttatgatgagaatcggaaaaaagcagaagaagctcataaaatttttgaaggtcttggcccaaaagttgaactgccactgtataaccagccatcagataccaaggtgtaccatgagaacatcaagacaaaccaggtgatgaggaaaaaactcattttattttttaaaagaagaaatcatgcaagaaaacaaagggaacaaaaaatctgccagcgttatgatcagctcatggaggcatgggagaaaaaagtggacagaatagaaaataatcctcggaggaaagctaaagaaagcaaaacaagggaatactatgaaaagcagtttccagaaattcgaaaacaaagagaacagcaagaaagatttcagcgagttgggcagaggggagctggtctttcagccaccattgctaggagtgagcatgagatttctgaaattattgatgggctctctgagcaggagaataatgagaaacaaatgcggcagctctctgtgattccacctatgatgtttgatgcagaacaaagacgagtcaagttcattaacatgaatgggcttatggaggaccctatgaaagtgtataaagataggcagtttatgaatgtttggactgaccatgaaaaggagatctttaaggacaagtttatccagcatccaaaaaactttggactaattgcatcatacttggagaggaagagtgttcctgattgtgttttgtattactatttaaccaagaaaaatgagaattataaagccctcgtcagaaggaattatgggaaacgcagaggcagaaaccagcaaattgctcgaccctcgcaagaagaaaaagtagaagaaaaagaagaggataaagcagaaaaaacagaaaaaaaagaagaagaaaagaaagatgaagaggaaaaagatgaaaaagaagactccaaagaaaataccaaggaaaaggacaagatagatggtacagcagaagaaactgaggaaagagagcaagccacaccccgggggcgaaagactgccaacagtcagggccgccgtaagggccggatcaccaggtccatgacaaacgaagctgcagctgccagtgctgcagccgcagcggctactgaagagcccccaccacctctgccaccgccaccagaacccatttctacagagcctgtggagacctctcgatggacagaagaagaaatggaagttgctaaaaaaggtctagtagaacatggtcgtaactgggcagcaattgctaaaatggtgggaacgaaaagtgaagctcaatgtaaaaacttctattttaactataaaaggcgacacaatcttgacaacctcttacagcagcataaacagaaaacttcacgaaaacctcgtgaagagcgagatgtgtctcaatgtgaaagtgtcgcttccactgtttctgctcaggaggatgaagatattgaagcctccaatgaagaagaaaatccagaagacagcgaaggtgcagaaaatagttctgatacagaaagtgctccttctccttcaccagttgaagctgtcaagcccagcgaggacagtcctgaaaatgctacttctcgaggaaacacagaacctgcggttgagcttgagcccaccacggaaactgcacccagtacatctccctccttagcagttccaagtacaaaaccagctgaagatgaaagtgtggagacccaggtgaatgacagcatcagtgctgagacagcagagcagatggatgtagatcagcaggagcacagtgctgaagagggttctgtttgtgatcccccacccgctaccaaagctgactctgtggacgttgaagtgagggtgccagaaaaccatgcatctaaagttgaaggtgataataccaaagaaagagacttggatagagccagtgagaaggtggaacctagagatgaagatttggtggtagctcagcaaataaatgcccaaaggcccgagccccagtcagacaatgattccagtgccacgtgcagcgctgatgaggatgtggatggagagccagagaggcagagaatgtttcctatggactcaaagccttcactgttaaaccccactggatctatactcgtctcatctccgttaaaaccaaatccactggatctgccacagcttcagcatcgagctgctgttatcccaccaatggtatcctgcaccccatgtaacataccaattggaaccccagtgagcggctatgctctctaccagcgacacattaaagcaatgcatgagtcagcactcctggaggagcagcggcagagacaagaacagatagatttggaatgtagaagttctacaagtccatgtggcacatccaagagtccaaacagagagtgggaagtccttcagcctgctccacatcaagtgataactaatctccctgaaggcgttcggcttccgacaactcgaccaaccaggccaccgccccctctcatcccgtcatccaaaaccacagtggcttcagaaaaaccatcttttataatgggaggctccatctcacagggaacaccaggcacttatttgacttctcataatcaggcttcctacactcaagaaacacccaagccgtcagtgggatctatctctcttggactgccacggcaacaggaatctgccaaatcagctactttgccctacatcaagcaggaagaattttctccccgaagccaaaactcacaacctgagggtctgttggtcagggcccaacatgaaggtgtagtcagaggtaccgcaggagccatacaagaaggaagtataactcggggaactccaaccagcaaaatttcagtggagagcattccatccctacggggctctatcactcagggcaccccggctctgccccagactggcataccaacagaggctttggtgaaggggtccatttcgagaatgcccattgaagacagcagtcctgagaaaggcagagaggaagctgcatccaaaggccatgttatttatgaaggcaaaagtggacatatcttgtcatatgataatattaagaatgcccgagaagggactaggagtccaagaacagctcatgaaatcagtttaaagagaagctatgaatcagtggaaggaaatataaagcaagggatgtcaatgagggagtctcctgtatcagcaccgttagaggggctgatatgccgagcattacccagggggagtcctcattctgacctcaaagaaaggactgtattgtctggctccataatgcaggggacaccaagagcaacaactgaaagctttgaagatggccttaaatatcccaaacaaattaaaagggaaagtcctcccatacgagcatttgaaggtgccattaccaaaggaaaaccatatgatggcatcaccaccatcaaagaaatggggcgttccattcatgagattccaaggcaagatattttaactcaggaaagtcggaaaactccagaagtggtccagagcacacggccgataattgagggttccatttcccagggcacaccaataaagtttgacaacaactcaggtcaatctgccatcaaacacaatgtcaaatccttaatcacggggcctagcaaactatcccgtggaatgcctccgctggaaattgtgccagagaacataaaagtggtagaacggggaaaatatgaggatgtgaaagcaggcgagaccgtgcgttcccggcacacgtcagtggtaagctctggcccctccgttcttaggtccacactgcatgaagctcccaaagcacaactgagccctgggatttatgatgacaccagtgcacggaggacccctgtgagttatcaaaacaccatgtccagaggctcacccatgatgaacagaacttctgatgttacaatttcttctaacaagtctaccaatcatgaaaggaaatcgacactgacccctacccagagggaaagtatcccagcgaagtctccagtgcctggggtggaccctgtcgtgagccacagtccgtttgatccccatcacagaggcagcactgcaggcgaggtttatcggagccacctgcccacgcacttggatccagccatgccttttcacagggctttggatcctgcagcggctgcttacctgtttcagagacagctttcaccaactccaggttacccaagtcagtatcagctttacgcaatggagaacacaagacagacaatcttaaatgattacattacctcacaacagatgcaagtgaacttgcgtccagatgtggccagaggactctccccaagagagcagccactgggtctcccatacccagcaacgagaggaatcattgacctgaccaatatgcctccaacaattttagtgcctcatccagggggaacaagcactcctcccatggacagaatcacttatattcctggtacacagattactttccctcccaggccgtacaactctgcttccatgtctccaggacacccaacacaccttgcagctgctgcaagtgctgagagggaacgggaacgggagcgggagaaggagcgggagcgggaacggattgctgcagcttcctccgacctctacctgcggccaggctcagaacagcctggccgacctggcagtcatggatatgttcgctccccttccccttcagtaagaactcaggagaccatgttgcaacagagacccagtgttttccaaggaaccaatggaaccagtgtaatcacacctttggatccaactgctcagctacgaatcatgccactgcctgctgggggcccttcaataagccaaggcctgccagcctcccgttacaacactgctgcggatgccctggctgctcttgtggatgctgcagcttctgcaccccagatggatgtgtccaaaacaaaagagagtaagcatgaagctgccaggttagaagaaaatttgagaagcaggtcagcagcagttagtgaacagcagcagctagagcagaaaaccctggaggtggagaagagatctgttcagtgtttatacacttcttcagcctttccaagtggcaagccccagcctcattcttcagtagtttattctgaggctgggaaagataaagggcctcctccaaaatccagatatgaggaagagctaaggaccagagggaagactaccattactgcagctaacttcatagacgtgatcatcacccggcaaattgcctcggacaaggatgcgagggaacgtggctctcaaagttcagactcttctagtagcttatcttctcacaggtatgaaacacctagcgatgctattgaggtgataagtcctgccagctcacctgcgccaccccaggagaaactgcagacctatcagccagaggttgttaaggcaaatcaagcggaaaatgatcctaccagacaatatgaaggaccattacatcactatcgaccacagcaggaatcaccatctccccaacaacagctgcccccttcttcacaggcagagggaatggggcaagtgcccaggacccatcggctgatcacacttgctgatcacatctgtcaaattatcacacaagattttgctagaaatcaagtttcctcgcagactccccagcagcctcctacttctacattccagaactcaccttctgctttggtatctacacctgtgaggactaaaacatcaaaccgttacagcccagaatcccaggctcagtctgtccatcatcaaagaccaggttcaagggtctctccagaaaatcttgtggacaaatccaggggaagtaggcctggaaaatccccagagaggagtcacgtctcttcggagccctacgagcccatctccccaccccaggttccggttgtgcatgagaaacaggacagcttgctgctcttgtctcagaggggcgcagagcctgcagagcagaggaatgatgcccgctcaccagggagtataagctacttgccttcattcttcaccaagcttgaaaatacatcacccatggttaaatcaaagaagcaggagatttttcgtaagttgaactcctctggtggaggtgactctgatatggcagctgctcagccaggaactgagatctttaatctgccagcagttactacgtcaggctcagttagctctagaggccattcttttgctgatcctgccagtaatcttgggctggaagacattatcaggaaggctctcatgggaagctttgatgacaaagttgaggatcatggagttgtcatgtcccagcctatgggagtagtgcctggtactgccaacacctcagttgtgaccagtggtgagacacgaagagaggaaggggacccatcacctcattcaggaggagtttgcaaaccaaagctgatcagcaagtcaaacagcaggaaatctaagtctcctatacctgggcaaggctacttaggaacggaacggccctcttcagtctcctctgtacattcagaaggggattaccataggcagacgccagggtgggcctgggaagacaggccctcttcaacaggctcaactcagtttccttataaccctctgactatgcggatgctcagcagtactccaccaacaccgattgcatgtgctccctctgcggtgaaccaagcagctcctcaccaacagaacaggatctgggagcgagagcctgccccactgctctcagcacagtacgagaccctgtcggatagtgatgactgaactgcacaaagtgaggggaacagggtgcaggagagggatctctagtttttgtggtttaatttttagtagcaggtcaaaaacctgccctcctgtgacttattccctgagacttttcaggagagccagcccacagatgatgaagaaatgatggaagttcatttggagagtcaaatgggaaaaaaacaaacaaaaaactgcctttgatacaggcaattcagtggactataataatagtggagggttgagatgtagagtttttaaaaagtgaacagttgctgttcttacatctgtaaagaaaaccataatgtctttaaatcactcttctgtaaatagatgacctttttgcagtgtatatccccttgctgtagtatctggtgtacttatgttcaaatcagcgcatcaactttgggggtgatttttaaaaatctttttgtctatctatctttttaaccctagccttctaaacaacctcatacagcccagttacataatgttggctgtcacgggcattgtacttttatctgatattgtttcctctaaattcagctttccagtgatgtttaaaatcttgtgaaaatgtttagatttttaacacagaccctgtcataaaatctgtacattagggtcaaaaggtaaaagtaacaaattctgccatattgtaaatttccagtgcaggctttaatttttttttttcattagtagcactgaaaaaatattactgcatgggtatgttctagttcagtttataaagttttaaaggcttatttgaggcatacctcactgttacgcacactggtaatttaaccatgcccctaagtattccttttctcctgcatttgatgcagcccaacaaagcttttgttttgaaataaatttgactaccctgtccataaaaaaaaaaaaaaaaaaaaaaaaaaaaaaaaagaacaacaaaaaaaaaaaagacaaaaaaaaaaaaaaaaaaaaaaacacacaaaacaaaagaacaaaaaaaaaacaagaaaaaaaaaggaaaaaagaaaaacaaaaacaacagagagagggagcggggggcgggcatcaataattccgatgggcggggcgacgacacgcaacgcccccgtattgttagtactagcggcgaccacgaggggagaggagcaacaacaaggaggcgcgagagcaaacaccaacgcgaagcagaacaacccccgccgcacctcaagaggaagacacctccgggggaggaaggagcagcaacacaccacaaccagagaacccgcgcagataaaaaataaaaccggtgcggaggtggacacacgccactaaccacgcgccgcgacccgacccacacgcgtagtgacacaacacagggcgcgagaaga

SEQ ID NO: 448588 - DNA, 6385 bp, Homo sapiens
aaactatatgtgctaggtcgagcgcctggtgttaattcggcagagtgtactcacggggcctagcaaactatcccgtggaatgcctccgctggaaattgtgccagagaacataaaagtggtagaacggggaaaatatgaggatgtgaaagcaggcgagaccgtgcgttcccggcacacgtcagtggtaagctctggcccctccgttcttaggtccacactgcatgaagctcccaaagcacaactgagccctgggatttatgatgacaccagtgcacggaggacccctgtgagttatcaaaacaccatgtccagaggctcacccatgatgaacagaacttctgatgttacaatttcttctaacaagtctaccaatcatgaaaggaaatcgacactgacccctacccagagggaaagtatcccagcgaagtctccagtgcctggggtggaccctgtcgtgagccacagtccgtttgatccccatcacagaggcagcactgcaggcgaggtttatcggagccacctgcccacgcacttggatccagccatgccttttcacagggctttggatcctgcagcggctgcttacctgtttcagagacagctttcaccaactccaggttacccaagtcagtatcagctttacgcaatggagaacacaagacagacaatcttaaatgattacattacctcacaacagatgcaagtgaacttgcgtccagatgtggccagaggactctccccaagagagcagccactgggtctcccatacccagcaacgagaggaatcattgacctgaccaatatgcctccaacaattttagtgcctcatccagggggaacaagcactcctcccatggacagaatcacttatattcctggtacacagattactttccctcccaggccgtacaactctgcttccatgtctccaggacacccaacacaccttgcagctgctgcaagtgctgagagggaacgggaacgggagcgggagaaggagcgggagcgggaacggattgctgcagcttcctccgacctctacctgcggccaggctcagaacagcctggccgacctggcagtcatggatatgttcgctccccttccccttcagtaagaactcaggagaccatgttgcaacagagacccagtgttttccaaggaaccaatggaaccagtgtaatcacacctttggatccaactgctcagctacgaatcatgccactgcctgctgggggcccttcaataagccaaggcctgccagcctcccgttacaacactgctgcggatgccctggctgctcttgtggatgctgcagcttctgcaccccagatggatgtgtccaaaacaaaagagagtaagcatgaagctgccaggttagaagaaaatttgagaagcaggtcagcagcagttagtgaacagcagcagctagagcagaaaaccctggaggtggagaagagatctgttcagtgtttatacacttcttcagcctttccaagtggcaagccccagcctcattcttcagtagtttattctgaggctgggaaagataaagggcctcctccaaaatccagatatgaggaagagctaaggaccagagggaagactaccattactgcagctaacttcatagacgtgatcatcacccggcaaattgcctcggacaaggatgcgagggaacgtggctctcaaagttcagactcttctagtagcttatcttctcacaggtatgaaacacctagcgatgctattgaggtgataagtcctgccagctcacctgcgccaccccaggagaaactgcagacctatcagccagaggttgttaaggcaaatcaagcggaaaatgatcctaccagacaatatgaaggaccattacatcactatcgaccacagcaggaatcaccatctccccaacaacagctgcccccttcttcacaggcagagggaatggggcaagtgcccaggacccatcggctgatcacacttgctgatcacatctgtcaaattatcacacaagattttgctagaaatcaagtttcctcgcagactccccagcagcctcctacttctacattccagaactcaccttctgctttggtatctacacctgtgaggactaaaacatcaaaccgttacagcccagaatcccaggctcagtctgtccatcatcaaagaccaggttcaagggtctctccagaaaatcttgtggacaaatccaggggaagtaggcctggaaaatccccagagaggagtcacgtctcttcggagccctacgagcccatctccccaccccaggttccggttgtgcatgagaaacaggacagcttgctgctcttgtctcagaggggcgcagagcctgcagagcagaggaatgatgcccgctcaccagggagtataagctacttgccttcattcttcaccaagcttgaaaatacatcacccatggttaaatcaaagaagcaggagatttttcgtaagttgaactcctctggtggaggtgactctgatatggcagctgctcagccaggaactgagatctttaatctgccagcagttactacgtcaggctcagttagctctagaggccattcttttgctgatcctgccagtaatcttgggctggaagacattatcaggaaggctctcatgggaagctttgatgacaaagttgaggatcatggagttgtcatgtcccagcctatgggagtagtgcctggtactgccaacacctcagttgtgaccagtggtgagacacgaagagaggaaggggacccatcacctcattcaggaggagtttgcaaaccaaagctgatcagcaagtcaaacagcaggaaatctaagtctcctatacctgggcaaggctacttaggaacggaacggccctcttcagtctcctctgtacattcagaaggggattaccataggcagacgccagggtgggcctgggaagacaggccctcttcaacaggctcaactcagtttccttataaccctctgactatgcggatgctcagcagtactccaccaacaccgattgcatgtgctccctctgcggtgaaccaagcagctcctcaccaacagaacaggatctgggagcgagagcctgccccactgctctcagcacagtacgagaccctgtcggatagtgatgactgaactgcacaaagtgaggggaacagggtgcaggagagggatctctagtttttgtggtttaatttttagtagcaggtcaaaaacctgccctcctgtgacttattccctgagacttttcaggagagccagcccacagatgatgaagaaatgatggaagttcatttggagagtcaaatgggaaaaaaacaaacaaaaaactgcctttgatacaggcaattcagtggactataataatagtggagggttgagatgtagagtttttaaaaagtgaacagttgctgttcttacatctgtaaagaaaaccataatgtctttaaatcactcttctgtaaatagatgacctttttgcagtgtatatccccttgctgtagtatctggtgtacttatgttcaaatcagcgcatcaactttgggggtgatttttaaaaatctttttgtctatctatctttttaaccctagccttctaaacaacctcatacagcccagttacataatgttggctgtcacgggcattgtacttttatctgatattgtttcctctaaattcagctttccagtgatgtttaaaatcttgtgaaaatgtttagatttttaacacagaccctgtcataaaatctgtacattagggtcaaaaggtaaaagtaacaaattctgccatattgtaaatttccagtgcaggctttaatttttttttttcattagtagcactgaaaaaatattactgcatgggtatgttctagttcagtttataaagttttaaaggcttatttgaggcatacctcactgttacgcacactggtaatttaaccatgcccctaagtattccttttctcctgcatttgatgcagcccaacaaagcttttgttttgaaataaatttgactaccctgtccatagctacagtagattatttgtggtttaaggctcctggtgtctcaggttccaaaggaaaagcttacatatttttcccttagtttgaatatatgattggttgggttaaaagataatgatctgtgtagtatttagataagctttatgctgcatcctgaaaaactcatggtgaacacagtcctttttccccatcactatggaccagcatttactctcactttgctcccttgggacaagagtttactgttaaatgttttcatttcacagagtctcaaggtgcaaataatttaaaagactgaattctaaactaattatggtactagagggccagttttatctttcattaagaattgcttgctgaattttaaagtttttttcatacaatttatcatagcatttaagtatctttctataacatagatactaacagttttgggagaatgccactggtaactggaaaggggagaaacagatctctcaggatgataaaaattagcactttacagactttcaagtagacctaaacttttaaacaaaagtactcaaggcttttaaggaagcagctctgtgattagctactgaccaagaccctcctatcactggtgtctaatccctatgttacagatgaagacacaggtttagtactttgcccatatagttaaattagtgacagagataggccataagcccacatttgtcttcagtcaaagctttcactcctgtccctgttccactcctgtatacctgaggtccccaacataaactttagatcaggcttagtggtcagcattcctagtacttggaaagttggtattttttacaacagatatatgtaaacatataaaaatttcaaaatgaatgaaaaacagtgactaaatgttccacttcacagttttctgctgaatttttttttttcaggtactggtaatattttagagtttgttaataatttatattgccaacctaccataaaagagattatgatggtatttttctatgaccctgagggtcttaagctattctgagtcagaatacagttgacccttgaacaacacgggtttgaactgtgtgggtccacttatacatggattttcttccacctctgccacccaagatagcaagaccaaccccttctcatcctcagcctattcaacatgaagatgacaaggatgaagaccttcatgatgatccacttccacttaatgaatagtaaatatattttctcttccttataatcttaacaaacattttctcttctctagcttactttattgtaagaatacagtatataatacatatacaaaatatgtgtcaatcgactatgttatccgtaagacttctggtcagcagtaggccatgagtagttaagttttggaggagtcaaagttagatgtggatttttgactacttagggggtctatgcccctaactcctgcattatttgaaggtcaaccgtatagtttctgagaacatgtcagatcagagcctaacttcttactcttgcagttctacctgaggacccgaaggtgaggtgctgtgaaccactccctccatcctcatcataatgcatgtgcgtattactttatttaccatcacctggagaagaaatctcagaatgagagttaaaatccaataatagttcttgggttcaaaataaatgaaaggacagaattctcacatggtttacctatggaggttcaccttatcatgatttaagtggtaagcacagagcagcactgacaacttactgtggttcactgcaaaccaaaacatgatattctttgtagacttagatttcagtgttctgacactatatcccttacaccgtgatttttttagcacccagaactaaattaaggtcttcctaaatactcttcataaaagtattctgacagccagttttccactgcatgtttatgactgcaaatttcataatgcttttaattttggtacactgagtgattctattttaaaaatatttatgcccagaaaactccagtgaccattggacagttaaaaaattttaatgacacgattttaaccaattcacttttgaatttagaccaatcagtaaaggagatcagtcctccttttgcttcagtaccttattttacaacagtgtaaatgaactgtaatgaaaacacccacatgaagagactgtcctgaaaactcctagtgtttccaacaacgagaccatgagctgagtcactgtggatgatttaaaattaataaataaataaaacttggaatgaaaaacctttcagtaacccctgcagttgtgaaaaggtaaaaacattctcaatgcaaaaggtgagtggttgacattaatttttttaagaaatca

SEQ ID NO: 448589 - DNA, 4818 bp, Homo sapiens
tagaaacagcaatcgattcttttttattttttaatgatacagaaaattgtttatattaattttgtttgcttacttctgcatttatattttgttccactagtcctcagacttcttcagtgaataattttttttttctccaaaattaagataagttctttgtttggagctatgtaccacatcctttcaggtgttcttctgaattatatttaatctttgataatgagtgaaaagcacagacattcctggagtaagacatctatgtgttctctcctagatgatcctaccagacaatatgaaggaccattacatcactatcgaccacagcaggaatcaccatctccccaacaacagctgcccccttcttcacaggcagagggaatggggcaagtgcccaggacccatcggctgatcacacttgctgatcacatctgtcaaattatcacacaagattttgctagaaatcaagtttcctcgcagactccccagcagcctcctacttctacattccagaactcaccttctgctttggtatctacacctgtgaggactaaaacatcaaaccgttacagcccagaatcccaggctcagtctgtccatcatcaaagaccaggttcaagggtctctccagaaaatcttgtggacaaatccaggggaagtaggcctggaaaatccccagagaggagtcacgtctcttcggagccctacgagcccatctccccaccccaggttccggttgtgcatgagaaacaggacagcttgctgctcttgtctcagaggggcgcagagcctgcagagcagaggaatgatgcccgctcaccagggagtataagctacttgccttcattcttcaccaagcttgaaaatacatcacccatggttaaatcaaagaagcaggagatttttcgtaagttgaactcctctggtggaggtgactctgatatggcagctgctcagccaggaactgagatctttaatctgccagcagttactacgtcaggctcagttagctctagaggccattcttttgctgatcctgccagtaatcttgggctggaagacattatcaggaaggctctcatgggaagctttgatgacaaagttgaggatcatggagttgtcatgtcccagcctatgggagtagtgcctggtactgccaacacctcagttgtgaccagtggtgagacacgaagagaggaaggggacccatcacctcattcaggaggagtttgcaaaccaaagctgatcagcaagtcaaacagcaggaaatctaagtctcctatacctgggcaaggctacttaggaacggaacggccctcttcagtctcctctgtacattcagaaggggattaccataggcagacgccagggtgggcctgggaagacaggccctcttcaacaggctcaactcagtttccttataaccctctgactatgcggatgctcagcagtactccaccaacaccgattgcatgtgctccctctgcggtgaaccaagcagctcctcaccaacagaacaggatctgggagcgagagcctgccccactgctctcagcacagtacgagaccctgtcggatagtgatgactgaactgcacaaagtgaggggaacagggtgcaggagagggatctctagtttttgtggtttaatttttagtagcaggtcaaaaacctgccctcctgtgacttattccctgagacttttcaggagagccagcccacagatgatgaagaaatgatggaagttcatttggagagtcaaatgggaaaaaaacaaacaaaaaactgcctttgatacaggcaattcagtggactataataatagtggagggttgagatgtagagtttttaaaaagtgaacagttgctgttcttacatctgtaaagaaaaccataatgtctttaaatcactcttctgtaaatagatgacctttttgcagtgtatatccccttgctgtagtatctggtgtacttatgttcaaatcagcgcatcaactttgggggtgatttttaaaaatctttttgtctatctatctttttaaccctagccttctaaacaacctcatacagcccagttacataatgttggctgtcacgggcattgtacttttatctgatattgtttcctctaaattcagctttccagtgatgtttaaaatcttgtgaaaatgtttagatttttaacacagaccctgtcataaaatctgtacattagggtcaaaaggtaaaagtaacaaattctgccatattgtaaatttccagtgcaggctttaatttttttttttcattagtagcactgaaaaaatattactgcatgggtatgttctagttcagtttataaagttttaaaggcttatttgaggcatacctcactgttacgcacactggtaatttaaccatgcccctaagtattccttttctcctgcatttgatgcagcccaacaaagcttttgttttgaaataaatttgactaccctgtccatagctacagtagattatttgtggtttaaggctcctggtgtctcaggttccaaaggaaaagcttacatatttttcccttagtttgaatatatgattggttgggttaaaagataatgatctgtgtagtatttagataagctttatgctgcatcctgaaaaactcatggtgaacacagtcctttttccccatcactatggaccagcatttactctcactttgctcccttgggacaagagtttactgttaaatgttttcatttcacagagtctcaaggtgcaaataatttaaaagactgaattctaaactaattatggtactagagggccagttttatctttcattaagaattgcttgctgaattttaaagtttttttcatacaatttatcatagcatttaagtatctttctataacatagatactaacagttttgggagaatgccactggtaactggaaaggggagaaacagatctctcaggatgataaaaattagcactttacagactttcaagtagacctaaacttttaaacaaaagtactcaaggcttttaaggaagcagctctgtgattagctactgaccaagaccctcctatcactggtgtctaatccctatgttacagatgaagacacaggtttagtactttgcccatatagttaaattagtgacagagataggccataagcccacatttgtcttcagtcaaagctttcactcctgtccctgttccactcctgtatacctgaggtccccaacataaactttagatcaggcttagtggtcagcattcctagtacttggaaagttggtattttttacaacagatatatgtaaacatataaaaatttcaaaatgaatgaaaaacagtgactaaatgttccacttcacagttttctgctgaatttttttttttcaggtactggtaatattttagagtttgttaataatttatattgccaacctaccataaaagagattatgatggtatttttctatgaccctgagggtcttaagctattctgagtcagaatacagttgacccttgaacaacacgggtttgaactgtgtgggtccacttatacatggattttcttccacctctgccacccaagatagcaagaccaaccccttctcatcctcagcctattcaacatgaagatgacaaggatgaagaccttcatgatgatccacttccacttaatgaatagtaaatatattttctcttccttataatcttaacaaacattttctcttctctagcttactttattgtaagaatacagtatataatacatatacaaaatatgtgtcaatcgactatgttatccgtaagacttctggtcagcagtaggccatgagtagttaagttttggaggagtcaaagttagatgtggatttttgactacttagggggtctatgcccctaactcctgcattatttgaaggtcaaccgtatagtttctgagaacatgtcagatcagagcctaacttcttactcttgcagttctacctgaggacccgaaggtgaggtgctgtgaaccactccctccatcctcatcataatgcatgtgcgtattactttatttaccatcacctggagaagaaatctcagaatgagagttaaaatccaataatagttcttgggttcaaaataaatgaaaggacagaattctcacatggtttacctatggaggttcaccttatcatgatttaagtggtaagcacagagcagcactgacaacttactgtggttcactgcaaaccaaaacatgatattctttgtagacttagatttcagtgttctgacactatatcccttacaccgtgatttttttagcacccagaactaaattaaggtcttcctaaatactcttcataaaagtattctgacagccagttttccactgcatgtttatgactgcaaatttcataatgcttttaattttggtacactgagtgattctattttaaaaatatttatgcccagaaaactccagtgaccattggacagttaaaaaattttaatgacacgattttaaccaattcacttttgaatttagaccaatcagtaaaggagatcagtcctccttttgcttcagtaccttattttacaacagtgtaaatgaactgtaatgaaaacacccacatgaagagactgtcctgaaaactcctagtgtttccaacaacgagaccatgagctgagtcactgtggatgatttaaaattaataaataaataaaacttggaatgaaaaacctttcagtaacccctgcagttgtgaaaaggtaaaaacattctcaatgcaaaaggtgagtggttgacattaatttttttaagaaatca

SEQ ID NO: 448590 - DNA, 4406 bp, Homo sapiens
ccttcatttctcattcacagcaaattatcacacaagattttgctagaaatcaagtttcctcgcagactccccagcagcctcctacttctacattccagaactcaccttctgctttggtatctacacctgtgaggactaaaacatcaaaccgttacagcccagaatcccaggctcagtctgtccatcatcaaagaccaggttcaagggtctctccagaaaatcttgtggacaaatccaggggaagtaggcctggaaaatccccagagaggagtcacgtctcttcggagccctacgagcccatctccccaccccaggttccggttgtgcatgagaaacaggacagcttgctgctcttgtctcagaggggcgcagagcctgcagagcagaggaatgatgcccgctcaccagggagtataagctacttgccttcattcttcaccaagcttgaaaatacatcacccatggttaaatcaaagaagcaggagatttttcgtaagttgaactcctctggtggaggtgactctgatatggcagctgctcagccaggaactgagatctttaatctgccagcagttactacgtcaggctcagttagctctagaggccattcttttgctgatcctgccagtaatcttgggctggaagacattatcaggaaggctctcatgggaagctttgatgacaaagttgaggatcatggagttgtcatgtcccagcctatgggagtagtgcctggtactgccaacacctcagttgtgaccagtggtgagacacgaagagaggaaggggacccatcacctcattcaggaggagtttgcaaaccaaagctgatcagcaagtcaaacagcaggaaatctaagtctcctatacctgggcaaggctacttaggaacggaacggccctcttcagtctcctctgtacattcagaaggggattaccataggcagacgccagggtgggcctgggaagacaggccctcttcaacaggctcaactcagtttccttataaccctctgactatgcggatgctcagcagtactccaccaacaccgattgcatgtgctccctctgcggtgaaccaagcagctcctcaccaacagaacaggatctgggagcgagagcctgccccactgctctcagcacagtacgagaccctgtcggatagtgatgactgaactgcacaaagtgaggggaacagggtgcaggagagggatctctagtttttgtggtttaatttttagtagcaggtcaaaaacctgccctcctgtgacttattccctgagacttttcaggagagccagcccacagatgatgaagaaatgatggaagttcatttggagagtcaaatgggaaaaaaacaaacaaaaaactgcctttgatacaggcaattcagtggactataataatagtggagggttgagatgtagagtttttaaaaagtgaacagttgctgttcttacatctgtaaagaaaaccataatgtctttaaatcactcttctgtaaatagatgacctttttgcagtgtatatccccttgctgtagtatctggtgtacttatgttcaaatcagcgcatcaactttgggggtgatttttaaaaatctttttgtctatctatctttttaaccctagccttctaaacaacctcatacagcccagttacataatgttggctgtcacgggcattgtacttttatctgatattgtttcctctaaattcagctttccagtgatgtttaaaatcttgtgaaaatgtttagatttttaacacagaccctgtcataaaatctgtacattagggtcaaaaggtaaaagtaacaaattctgccatattgtaaatttccagtgcaggctttaatttttttttttcattagtagcactgaaaaaatattactgcatgggtatgttctagttcagtttataaagttttaaaggcttatttgaggcatacctcactgttacgcacactggtaatttaaccatgcccctaagtattccttttctcctgcatttgatgcagcccaacaaagcttttgttttgaaataaatttgactaccctgtccatagctacagtagattatttgtggtttaaggctcctggtgtctcaggttccaaaggaaaagcttacatatttttcccttagtttgaatatatgattggttgggttaaaagataatgatctgtgtagtatttagataagctttatgctgcatcctgaaaaactcatggtgaacacagtcctttttccccatcactatggaccagcatttactctcactttgctcccttgggacaagagtttactgttaaatgttttcatttcacagagtctcaaggtgcaaataatttaaaagactgaattctaaactaattatggtactagagggccagttttatctttcattaagaattgcttgctgaattttaaagtttttttcatacaatttatcatagcatttaagtatctttctataacatagatactaacagttttgggagaatgccactggtaactggaaaggggagaaacagatctctcaggatgataaaaattagcactttacagactttcaagtagacctaaacttttaaacaaaagtactcaaggcttttaaggaagcagctctgtgattagctactgaccaagaccctcctatcactggtgtctaatccctatgttacagatgaagacacaggtttagtactttgcccatatagttaaattagtgacagagataggccataagcccacatttgtcttcagtcaaagctttcactcctgtccctgttccactcctgtatacctgaggtccccaacataaactttagatcaggcttagtggtcagcattcctagtacttggaaagttggtattttttacaacagatatatgtaaacatataaaaatttcaaaatgaatgaaaaacagtgactaaatgttccacttcacagttttctgctgaatttttttttttcaggtactggtaatattttagagtttgttaataatttatattgccaacctaccataaaagagattatgatggtatttttctatgaccctgagggtcttaagctattctgagtcagaatacagttgacccttgaacaacacgggtttgaactgtgtgggtccacttatacatggattttcttccacctctgccacccaagatagcaagaccaaccccttctcatcctcagcctattcaacatgaagatgacaaggatgaagaccttcatgatgatccacttccacttaatgaatagtaaatatattttctcttccttataatcttaacaaacattttctcttctctagcttactttattgtaagaatacagtatataatacatatacaaaatatgtgtcaatcgactatgttatccgtaagacttctggtcagcagtaggccatgagtagttaagttttggaggagtcaaagttagatgtggatttttgactacttagggggtctatgcccctaactcctgcattatttgaaggtcaaccgtatagtttctgagaacatgtcagatcagagcctaacttcttactcttgcagttctacctgaggacccgaaggtgaggtgctgtgaaccactccctccatcctcatcataatgcatgtgcgtattactttatttaccatcacctggagaagaaatctcagaatgagagttaaaatccaataatagttcttgggttcaaaataaatgaaaggacagaattctcacatggtttacctatggaggttcaccttatcatgatttaagtggtaagcacagagcagcactgacaacttactgtggttcactgcaaaccaaaacatgatattctttgtagacttagatttcagtgttctgacactatatcccttacaccgtgatttttttagcacccagaactaaattaaggtcttcctaaatactcttcataaaagtattctgacagccagttttccactgcatgtttatgactgcaaatttcataatgcttttaattttggtacactgagtgattctattttaaaaatatttatgcccagaaaactccagtgaccattggacagttaaaaaattttaatgacacgattttaaccaattcacttttgaatttagaccaatcagtaaaggagatcagtcctccttttgcttcagtaccttattttacaacagtgtaaatgaactgtaatgaaaacacccacatgaagagactgtcctgaaaactcctagtgtttccaacaacgagaccatgagctgagtcactgtggatgatttaaaattaataaataaataaaacttggaatgaaaaacctttcagtaacccctgcagttgtgaaaaggtaaaaacattctcaatgcaaaaggtgagtggttgacattaatttttttaagaaatca

SEQ ID NO: 448591 - DNA, 5182 bp, Homo sapiens
cgctgcactccagcctgggcggcagagtgagctccgtcttaaaaataaattaattaataaattaattaatttcacattctggctgagcacagtggcccatgcctgtaatcccagcactttaggaggctgaggtgggtagatcacctgaggtcaggagttcgagaccagcctggccaaaatggtgaaactccgtctctactaaaaatacaaaaattagctgggcatggtggcggggggcctataatcccagctgctcgggaggctgaggcaggagaactgcttgaacccaggaggcagaggttgcagtgagcctagatcacgccattgcactccagcctgggtgacaagaataaaacaccaccatctcaaaggaaaaaaaaaaaaaaaaaaaaaaaaagaactttcacattctttgggacacatcatttggctgcccacttgctttctgcattctttttttctctttaaaattcttagcgtcaagttgggaatgacggaaacaccaatttatgtcccaaattcttcccctttctggcacactgctttattataggcggttcccaggtcttatgctgttatcattcaaactgcagattacaagttgcacagtcagcaggaatgaaaaggatcaacagagtcttttgttttttccagcaaatatcctgagtttccagttagccatgcagggaaacacagtcattttcatagtattcactgtggtggctttcctctggatcacatcccaggctgcctcaaacctgttggtatttgtggcggtcatcccagagtccaaggtttcttcttcgtcagaaagccttggttcctgttctgagaacagcattttcctatttgtttttctccagcagtgcaaagttcctttcccttttctgggttacactgcttctttttttatttatttatttatttttggtaaacagatgggagagtctcactgtgttgcccaggctggcctcaaattcctatgctcaagcagtcctaccgcctcagcctgctgagtagctgggggactaggagtgcaccactgcacacagcttattgctcttcttttgatgttcctaccttacctatttcctgatttccctttaaaaatagcctgggcaacagagtgagaccctgtctcaaaaaaaaaaaatacttccattttatcttcacttaatgggtgagaaataaaggttgagatcatgaaaaataaaaagattaattttattataggaattttttgagactttagtttggtatatatgattatcacatcttaattaacttgaatgtttgcttaaatatagcagctgctcagccaggaactgagatctttaatctgccagcagttactacgtcaggctcagttagctctagaggccattcttttgctgatcctgccagtaatcttgggctggaagacattatcaggaaggctctcatgggaagctttgatgacaaagttgaggatcatggagttgtcatgtcccagcctatgggagtagtgcctggtactgccaacacctcagttgtgaccagtggtgagacacgaagagaggaaggggacccatcacctcattcaggaggagtttgcaaaccaaagctgatcagcaagtcaaacagcaggaaatctaagtctcctatacctgggcaaggctacttaggaacggaacggccctcttcagtctcctctgtacattcagaaggggattaccataggcagacgccagggtgggcctgggaagacaggccctcttcaacaggctcaactcagtttccttataaccctctgactatgcggatgctcagcagtactccaccaacaccgattgcatgtgctccctctgcggtgaaccaagcagctcctcaccaacagaacaggatctgggagcgagagcctgccccactgctctcagcacagtacgagaccctgtcggatagtgatgactgaactgcacaaagtgaggggaacagggtgcaggagagggatctctagtttttgtggtttaatttttagtagcaggtcaaaaacctgccctcctgtgacttattccctgagacttttcaggagagccagcccacagatgatgaagaaatgatggaagttcatttggagagtcaaatgggaaaaaaacaaacaaaaaactgcctttgatacaggcaattcagtggactataataatagtggagggttgagatgtagagtttttaaaaagtgaacagttgctgttcttacatctgtaaagaaaaccataatgtctttaaatcactcttctgtaaatagatgacctttttgcagtgtatatccccttgctgtagtatctggtgtacttatgttcaaatcagcgcatcaactttgggggtgatttttaaaaatctttttgtctatctatctttttaaccctagccttctaaacaacctcatacagcccagttacataatgttggctgtcacgggcattgtacttttatctgatattgtttcctctaaattcagctttccagtgatgtttaaaatcttgtgaaaatgtttagatttttaacacagaccctgtcataaaatctgtacattagggtcaaaaggtaaaagtaacaaattctgccatattgtaaatttccagtgcaggctttaatttttttttttcattagtagcactgaaaaaatattactgcatgggtatgttctagttcagtttataaagttttaaaggcttatttgaggcatacctcactgttacgcacactggtaatttaaccatgcccctaagtattccttttctcctgcatttgatgcagcccaacaaagcttttgttttgaaataaatttgactaccctgtccatagctacagtagattatttgtggtttaaggctcctggtgtctcaggttccaaaggaaaagcttacatatttttcccttagtttgaatatatgattggttgggttaaaagataatgatctgtgtagtatttagataagctttatgctgcatcctgaaaaactcatggtgaacacagtcctttttccccatcactatggaccagcatttactctcactttgctcccttgggacaagagtttactgttaaatgttttcatttcacagagtctcaaggtgcaaataatttaaaagactgaattctaaactaattatggtactagagggccagttttatctttcattaagaattgcttgctgaattttaaagtttttttcatacaatttatcatagcatttaagtatctttctataacatagatactaacagttttgggagaatgccactggtaactggaaaggggagaaacagatctctcaggatgataaaaattagcactttacagactttcaagtagacctaaacttttaaacaaaagtactcaaggcttttaaggaagcagctctgtgattagctactgaccaagaccctcctatcactggtgtctaatccctatgttacagatgaagacacaggtttagtactttgcccatatagttaaattagtgacagagataggccataagcccacatttgtcttcagtcaaagctttcactcctgtccctgttccactcctgtatacctgaggtccccaacataaactttagatcaggcttagtggtcagcattcctagtacttggaaagttggtattttttacaacagatatatgtaaacatataaaaatttcaaaatgaatgaaaaacagtgactaaatgttccacttcacagttttctgctgaatttttttttttcaggtactggtaatattttagagtttgttaataatttatattgccaacctaccataaaagagattatgatggtatttttctatgaccctgagggtcttaagctattctgagtcagaatacagttgacccttgaacaacacgggtttgaactgtgtgggtccacttatacatggattttcttccacctctgccacccaagatagcaagaccaaccccttctcatcctcagcctattcaacatgaagatgacaaggatgaagaccttcatgatgatccacttccacttaatgaatagtaaatatattttctcttccttataatcttaacaaacattttctcttctctagcttactttattgtaagaatacagtatataatacatatacaaaatatgtgtcaatcgactatgttatccgtaagacttctggtcagcagtaggccatgagtagttaagttttggaggagtcaaagttagatgtggatttttgactacttagggggtctatgcccctaactcctgcattatttgaaggtcaaccgtatagtttctgagaacatgtcagatcagagcctaacttcttactcttgcagttctacctgaggacccgaaggtgaggtgctgtgaaccactccctccatcctcatcataatgcatgtgcgtattactttatttaccatcacctggagaagaaatctcagaatgagagttaaaatccaataatagttcttgggttcaaaataaatgaaaggacagaattctcacatggtttacctatggaggttcaccttatcatgatttaagtggtaagcacagagcagcactgacaacttactgtggttcactgcaaaccaaaacatgatattctttgtagacttagatttcagtgttctgacactatatcccttacaccgtgatttttttagcacccagaactaaattaaggtcttcctaaatactcttcataaaagtattctgacagccagttttccactgcatgtttatgactgcaaatttcataatgcttttaattttggtacactgagtgattctattttaaaaatatttatgcccagaaaactccagtgaccattggacagttaaaaaattttaatgacacgattttaaccaattcacttttgaatttagaccaatcagtaaaggagatcagtcctccttttgcttcagtaccttattttacaacagtgtaaatgaactgtaatgaaaacacccacatgaagagactgtcctgaaaactcctagtgtttccaacaacgagaccatgagctgagtcactgtggatgatttaaaattaataaataaataaaacttggaatgaaaaacctttcagtaacccctgcagttgtgaaaaggtaaaaacattctcaatgcaaaaggtgagtggttgacattaatttttttaagaaatca

SEQ ID NO: 448592 - DNA, 7461 bp, Homo sapiens
  misc_feature (7358)..(7358): n is a, c, g, or t
  misc_feature (7371)..(7371): n is a, c, g, or t
  misc_feature (7387)..(7387): n is a, c, g, or t
gggttgagtcaagatggcggccaaggtggcgaagcagcagccgcggcggcggcggcggctggagtgagcgtccgactcgccgcgccgaacgaggtcccggtgtagggccgcgcgccgtggccgcgtcccactcctcaggccggggcgcacgtcggctcccacgcttagccagctcccggtggtttcctagaaacatgattgtttattggcattgatctcacagtctggtgaggacttctttactgataatgtcaagttcaggttatcctcccaaccaaggagcattcagcacagaacaaagtcgttatcctcctcactctgtccagtatacatttcccaacacccgccaccagcaggagttcgcagtccctgattatcgttcctctcatcttgaagtgagtcaggcatcacagcttttgcagcaacagcagcagcaacagcttcgaaggcgaccttccttgctttcagaatttcacccaggttctgacaggcctcaagaaaggagaactagttatgaaccgtttcatccaggcccatccccagtggatcatgattcactggaatcgaagcgaccacgtctggaacaggtttctgattctcattttcagcgtgtcagtgctgcggttttgcctttagtgcacccgctgccagaagggctgagggcttctgcagatgctaagaaggatccagcattcggaggcaaacatgaagctccatcctctccaatttcggggcaaccatgtggagatgatcaaaatgcttcaccttcaaaactctcaaaggaagagttaatacagagtatggatcgtgtagatcgagaaattgcaaaagtagaacagcagatccttaaactgaaaaagaaacaacaacagcttgaagaagaggcagctaaacctcctgagcctgagaagcccgtgtcccctcctcctgtggagcagaaacaccgcagtattgtccaaattatttatgatgagaatcggaaaaaagcagaagaagctcataaaatttttgaaggtcttggcccaaaagttgaactgccactgtataaccagccatcagataccaaggtgtaccatgagaacatcaagacaaaccaggtgatgaggaaaaaactcattttattttttaaaagaagaaatcatgcaagaaaacaaagggaacaaaaaatctgccagcgttatgatcagctcatggaggcatgggagaaaaaagtggacagaatagaaaataatcctcggaggaaagctaaagaaagcaaaacaagggaatactatgaaaagcagtttccagaaattcgaaaacaaagagaacagcaagaaagatttcagcgagttgggcagaggggagctggtctttcagccaccattgctaggagtgagcatgagatttctgaaattattgatgggctctctgagcaggagaataatgagaaacaaatgcggcagctctctgtgattccacctatgatgtttgatgcagaacaaagacgagtcaagttcattaacatgaatgggcttatggaggaccctatgaaagtgtataaagataggcagtttatgaatgtttggactgaccatgaaaaggagatctttaaggacaagtttatccagcatccaaaaaactttggactaattgcatcatacttggagaggaagagtgttcctgattgtgttttgtattactatttaaccaagaaaaatgagaattataaagccctcgtcagaaggaattatgggaaacgcagaggcagaaaccagcaaattgctcgaccctcgcaagaagaaaaagtagaagaaaaagaagaggataaagcagaaaaaacagaaaaaaaagaagaagaaaagaaagatgaagaggaaaaagatgaaaaagaagactccaaagaaaataccaaggaaaaggacaagatagatggtacagcagaagaaactgaggaaagagagcaagccacaccccgggggcgaaagactgccaacagtcagggccgccgtaagggccggatcaccaggtccatgacaaacgaagctgcagctgccagtgctgcagccgcagcggctactgaagagcccccaccacctctgccaccgccaccagaacccatttctacagagcctgtggagacctctcgatggacagaagaagaaatggaagttgctaaaaaaggtctagtagaacatggtcgtaactgggcagcaattgctaaaatggtgggaacgaaaagtgaagctcaatgtaaaaacttctattttaactataaaaggcgacacaatcttgacaacctcttacagcagcataaacagaaaacttcacgaaaacctcgtgaagagcgagatgtgtctcaatgtgaaagtgtcgcttccactgtttctgctcaggaggatgaagatattgaagcctccaatgaagaagaaaatccagaagacagcgaaggtgcagaaaatagttctgatacagaaagtgctccttctccttcaccagttgaagctgtcaagcccagcgaggacagtcctgaaaatgctacttctcgaggaaacacagaacctgcggttgagcttgagcccaccacggaaactgcacccagtacatctccctccttagcagttccaagtacaaaaccagctgaagatgaaagtgtggagacccaggtgaatgacagcatcagtgctgagacagcagagcagatggatgtagatcagcaggagcacagtgctgaagagggttctgtttgtgatcccccacccgctaccaaagctgactctgtggacgttgaagtgagggtgccagaaaaccatgcatctaaagttgaaggtgataataccaaagaaagagacttggatagagccagtgagaaggtggaacctagagatgaagatttggtggtagctcagcaaataaatgcccaaaggcccgagccccagtcagacaatgattccagtgccacgtgcagcgctgatgaggatgtggatggagagccagagaggcagagaatgtttcctatggactcaaagccttcactgttaaaccccactggatctatactcgtctcatctccgttaaaaccaaatccactggatctgccacagcttcagcatcgagctgctgttatcccaccaatggtatcctgcaccccatgtaacataccaattggaaccccagtgagcggctatgctctctaccagcgacacattaaagcaatgcatgagtcagcactcctggaggagcagcggcagagacaagaacagatagatttggaatgtagaagttctacaagtccatgtggcacatccaagagtccaaacagagagtgggaagtccttcagcctgctccacatcaagtgataactaatctccctgaaggcgttcggcttccgacaactcgaccaaccaggccaccgccccctctcatcccgtcatccaaaaccacagtggcttcagaaaaaccatcttttataatgggaggctccatctcacagggaacaccaggcacttatttgacttctcataatcaggcttcctacactcaagaaacacccaagccgtcagtgggatctatctctcttggactgccacggcaacaggaatctgccaaatcagctactttgccctacatcaagcaggaagaattttctccccgaagccaaaactcacaacctgagggtctgttggtcagggcccaacatgaaggtgtagtcagaggtaccgcaggagccatacaagaaggaagtataactcggggaactccaaccagcaaaatttcagtggagagcattccatccctacggggctctatcactcagggcaccccggctctgccccagactggcataccaacagaggctttggtgaaggggtccatttcgagaatgcccattgaagacagcagtcctgagaaaggcagagaggaagctgcatccaaaggccatgttatttatgaaggcaaaagtggacatatcttgtcatatgataatattaagaatgcccgagaagggactaggagtccaagaacagctcatgaaatcagtttaaagagaagctatgaatcagtggaaggaaatataaagcaagggatgtcaatgagggagtctcctgtatcagcaccgttagaggggctgatatgccgagcattacccagggggagtcctcattctgacctcaaagaaaggactgtattgtctggctccataatgcaggggacaccaagagcaacaactgaaagctttgaagatggccttaaatatcccaaacaaattaaaagggaaagtcctcccatacgagcatttgaaggtgccattaccaaaggaaaaccatatgatggcatcaccaccatcaaagaaatggggcgttccattcatgagattccaaggcaagatattttaactcaggaaagtcggaaaactccagaagtggtccagagcacacggccgataattgagggttccatttcccagggcacaccaataaagtttgacaacaactcaggtcaatctgccatcaaacacaatgtcaaatccttaatcacggggcctagcaaactatcccgtggaatgcctccgctggaaattgtgccagagaacataaaagtggtagaacggggaaaatatgaggatgtgaaagcaggcgagaccgtgcgttcccggcacacgtcagtggtaagctctggcccctccgttcttaggtccacactgcatgaagctcccaaagcacaactgagccctgggatttatgatgacaccagtgcacggaggacccctgtgagttatcaaaacaccatgtccagaggctcacccatgatgaacagaacttctgatgttacaatttcttctaacaagtctaccaatcatgaaaggaaatcgacactgacccctacccagagggaaagtatcccagcgaagtctccagtgcctggggtggaccctgtcgtgagccacagtccgtttgatccccatcacagaggcagcactgcaggcgaggtttatcggagccacctgcccacgcacttggatccagccatgccttttcacagggctttggatcctgcagcggctgcttacctgtttcagagacagctttcaccaactccaggttacccaagtcagtatcagctttacgcaatggagaacacaagacagacaatcttaaatgattacattacctcacaacagatgcaagtgaacttgcgtccagatgtggccagaggactctccccaagagagcagccactgggtctcccatacccagcaacgagaggaatcattgacctgaccaatatgcctccaacaattttagtgcctcatccagggggaacaagcactcctcccatggacagaatcacttatattcctggtacacagattactttccctcccaggccgtacaactctgcttccatgtctccaggacacccaacacaccttgcagctgctgcaagtgctgagagggaacgggaacgggagcgggagaaggagcgggagcgggaacggattgctgcagcttcctccgacctctacctgcggccaggctcagaacagcctggccgacctggcagtcatggatatgttcgctccccttccccttcagtaagaactcaggagaccatgttgcaacagagacccagtgttttccaaggaaccaatggaaccagtgtaatcacacctttggatccaactgctcagctacgaatcatgccactgcctgctgggggcccttcaataagccaaggcctgccagcctcccgttacaacactgctgcggatgccctggctgctcttgtggatgctgcagcttctgcaccccagatggatgtgtccaaaacaaaagagagtaagcatgaagctgccaggttagaagaaaatttgagaagcaggtcagcagcagttagtgaacagcagcagctagagcagaaaaccctggaggtggagaagagatctgttcagtgtttatacacttcttcagcctttccaagtggcaagccccagcctcattcttcagtagtttattctgaggctgggaaagataaagggcctcctccaaaatccagatatgaggaagagctaaggaccagagggaagactaccattactgcagctaacttcatagacgtgatcatcacccggcaaattgcctcggacaaggatgcgagggaacgtggctctcaaagttcagactcttctagtagcttatcttctcacaggtatgaaacacctagcgatgctattgaggtgataagtcctgccagctcacctgcgccaccccaggagaaactgcagacctatcagccagaggttgttaaggcaaatcaagcggaaaatgatcctaccagacaatatgaaggaccattacatcactatcgaccacagcaggaatcaccatctccccaacaacagctgcccccttcttcacaggcagagggaatggggcaagtgcccaggacccatcggctgatcacacttgctgatcacatctgtcaaattatcacacaagattttgctagaaatcaagtttcctcgcagactccccagcagcctcctacttctacattccagaactcaccttctgctttggtatctacacctgtgaggactaaaacatcaaaccgttacagcccagaatcccaggctcagtctgtccatcatcaaagaccaggttcaagggtctctccagaaaatcttgtggacaaatccaggggaagtaggcctggaaaatccccagagaggagtcacgtctcttcggagccctacgagcccatctccccaccccaggttccggttgtgcatgagaaacaggacagcttgctgctcttgtctcagaggggcgcagagcctgcagagcagaggaatgatgcccgctcaccagggagtataagctacttgccttcattcttcaccaagcttgaaaatacatcacccatggttaaatcaaagaagcaggagatttttcgtaagttgaactcctctggtggaggtgactctgatatggcagctgctcagccaggaactgagatctttaatctgccagcagttactacgtcaggctcagttagctctagaggccattcttttgctgatcctgccagtaatcttgggctggaagacattatcaggaaggctctcatgggaagctttgatgacaaagttgaggatcatggagttgtcatgtcccagcctatgggagtagtgcctggtactgccaacacctcagttgtgaccagtggtgagacacgaagagaggaaggggacccatcacctcattcaggtacagctttcattttagtgcttttctgctgcttttccccaaaaaagccagtttatttcccaaattctgatgcatcactaagacatttcatttatgtctttatgtgntcagagtcacctnttagggtttccgttanttaaaaaaggtttttgaaaacctacccagacattataatatgaacagaaataaaatggaagaaaatttttaccc

SEQ ID NO: 448593 - DNA, 4092 bp, Homo sapiens
gatgagcaaagaaagtggtttcttgagattgaatctgcccctgaagatgctgtgaacatggctgaaatgacaacaaaggatttagaatactacattacataaacccagttaataaagaagggtttgagggatcaactccaattttgaaagttctactgtggctaaaatgctatcattgcatgctacaaataagtctttcatgaaaggaaaagaaattgccacagccatcccagcctttggcaaccgccatgcagattagtcagcagccatcaacatggaggcaagaccatccaccagcaaaataattgtgacttactaaaccctcagtatctctgaggtatgcctgtagtattttatttcattgagtaccaggatctggattcttcatgttaccattctgcttttttttcatttagcaatatataatcattagcattttggtaatttttgagaacttaatatattaatactttaacttgaatttcactttcaggaggagtttgcaaaccaaagctgatcagcaagtcaaacagcaggaaatctaagtctcctatacctgggcaaggctacttaggaacggaacggccctcttcagtctcctctgtacattcagaaggggattaccataggcagacgccagggtgggcctgggaagacaggccctcttcaacaggctcaactcagtttccttataaccctctgactatgcggatgctcagcagtactccaccaacaccgattgcatgtgctccctctgcggtgaaccaagcagctcctcaccaacagaacaggatctgggagcgagagcctgccccactgctctcagcacagtacgagaccctgtcggatagtgatgactgaactgcacaaagtgaggggaacagggtgcaggagagggatctctagtttttgtggtttaatttttagtagcaggtcaaaaacctgccctcctgtgacttattccctgagacttttcaggagagccagcccacagatgatgaagaaatgatggaagttcatttggagagtcaaatgggaaaaaaacaaacaaaaaactgcctttgatacaggcaattcagtggactataataatagtggagggttgagatgtagagtttttaaaaagtgaacagttgctgttcttacatctgtaaagaaaaccataatgtctttaaatcactcttctgtaaatagatgacctttttgcagtgtatatccccttgctgtagtatctggtgtacttatgttcaaatcagcgcatcaactttgggggtgatttttaaaaatctttttgtctatctatctttttaaccctagccttctaaacaacctcatacagcccagttacataatgttggctgtcacgggcattgtacttttatctgatattgtttcctctaaattcagctttccagtgatgtttaaaatcttgtgaaaatgtttagatttttaacacagaccctgtcataaaatctgtacattagggtcaaaaggtaaaagtaacaaattctgccatattgtaaatttccagtgcaggctttaatttttttttttcattagtagcactgaaaaaatattactgcatgggtatgttctagttcagtttataaagttttaaaggcttatttgaggcatacctcactgttacgcacactggtaatttaaccatgcccctaagtattccttttctcctgcatttgatgcagcccaacaaagcttttgttttgaaataaatttgactaccctgtccatagctacagtagattatttgtggtttaaggctcctggtgtctcaggttccaaaggaaaagcttacatatttttcccttagtttgaatatatgattggttgggttaaaagataatgatctgtgtagtatttagataagctttatgctgcatcctgaaaaactcatggtgaacacagtcctttttccccatcactatggaccagcatttactctcactttgctcccttgggacaagagtttactgttaaatgttttcatttcacagagtctcaaggtgcaaataatttaaaagactgaattctaaactaattatggtactagagggccagttttatctttcattaagaattgcttgctgaattttaaagtttttttcatacaatttatcatagcatttaagtatctttctataacatagatactaacagttttgggagaatgccactggtaactggaaaggggagaaacagatctctcaggatgataaaaattagcactttacagactttcaagtagacctaaacttttaaacaaaagtactcaaggcttttaaggaagcagctctgtgattagctactgaccaagaccctcctatcactggtgtctaatccctatgttacagatgaagacacaggtttagtactttgcccatatagttaaattagtgacagagataggccataagcccacatttgtcttcagtcaaagctttcactcctgtccctgttccactcctgtatacctgaggtccccaacataaactttagatcaggcttagtggtcagcattcctagtacttggaaagttggtattttttacaacagatatatgtaaacatataaaaatttcaaaatgaatgaaaaacagtgactaaatgttccacttcacagttttctgctgaatttttttttttcaggtactggtaatattttagagtttgttaataatttatattgccaacctaccataaaagagattatgatggtatttttctatgaccctgagggtcttaagctattctgagtcagaatacagttgacccttgaacaacacgggtttgaactgtgtgggtccacttatacatggattttcttccacctctgccacccaagatagcaagaccaaccccttctcatcctcagcctattcaacatgaagatgacaaggatgaagaccttcatgatgatccacttccacttaatgaatagtaaatatattttctcttccttataatcttaacaaacattttctcttctctagcttactttattgtaagaatacagtatataatacatatacaaaatatgtgtcaatcgactatgttatccgtaagacttctggtcagcagtaggccatgagtagttaagttttggaggagtcaaagttagatgtggatttttgactacttagggggtctatgcccctaactcctgcattatttgaaggtcaaccgtatagtttctgagaacatgtcagatcagagcctaacttcttactcttgcagttctacctgaggacccgaaggtgaggtgctgtgaaccactccctccatcctcatcataatgcatgtgcgtattactttatttaccatcacctggagaagaaatctcagaatgagagttaaaatccaataatagttcttgggttcaaaataaatgaaaggacagaattctcacatggtttacctatggaggttcaccttatcatgatttaagtggtaagcacagagcagcactgacaacttactgtggttcactgcaaaccaaaacatgatattctttgtagacttagatttcagtgttctgacactatatcccttacaccgtgatttttttagcacccagaactaaattaaggtcttcctaaatactcttcataaaagtattctgacagccagttttccactgcatgtttatgactgcaaatttcataatgcttttaattttggtacactgagtgattctattttaaaaatatttatgcccagaaaactccagtgaccattggacagttaaaaaattttaatgacacgattttaaccaattcacttttgaatttagaccaatcagtaaaggagatcagtcctccttttgcttcagtaccttattttacaacagtgtaaatgaactgtaatgaaaacacccacatgaagagactgtcctgaaaactcctagtgtttccaacaacgagaccatgagctgagtcactgtggatgatttaaaattaataaataaataaaacttggaatgaaaaacctttcagtaacccctgcagttgtgaaaaggtaaaaacattctcaatgcaaaaggtgagtggttgacattaatttttttaagaaatca

SEQ ID NO: 448594 - DNA, 6213 bp, Homo sapiens
gggttgagtcaagatggcggccaaggtggcgaagcagcagccgcggcggcggcggcggctggagtgagcgtccgactcgccgcgccgaacgaggtcccggtgtagggccgcgcgccgtggccgcgtcccactcctcaggccggggcgcacgtcggctcccacgcttagccagctcccggtggtttcctagaaacatgattgtttattggcattgatctcacagtctggtgaggacttctttactgataatgtcaagttcaggttatcctcccaaccaaggagcattcagcacagaacaaagtcgttatcctcctcactctgtccagtatacatttcccaacacccgccaccagcaggagttcgcagtccctgattatcgttcctctcatcttgaagtgagtcaggcatcacagcttttgcagcaacagcagcagcaacagcttcgaaggcgaccttccttgctttcagaatttcacccaggttctgacaggcctcaagaaaggagaactagttatgaaccgtttcatccaggcccatccccagtggatcatgattcactggaatcgaagcgaccacgtctggaacaggtttctgattctcattttcagcgtgtcagtgctgcggttttgcctttagtgcacccgctgccagaagggctgagggcttctgcagatgctaagaaggatccagcattcggaggcaaacatgaagctccatcctctccaatttcggggcaaccatgtggagatgatcaaaatgcttcaccttcaaaactctcaaaggaagagttaatacagagtatggatcgtgtagatcgagaaattgcaaaagtagaacagcagatccttaaactgaaaaagaaacaacaacagcttgaagaagaggcagctaaacctcctgagcctgagaagcccgtgtcccctcctcctgtggagcagaaacaccgcagtattgtccaaattatttatgatgagaatcggaaaaaagcagaagaagctcataaaatttttgaaggtcttggcccaaaagttgaactgccactgtataaccagccatcagataccaaggtgtaccatgagaacatcaagacaaaccaggtgatgaggaaaaaactcattttattttttaaaagaagaaatcatgcaagaaaacaaagggaacaaaaaatctgccagcgttatgatcagctcatggaggcatgggagaaaaaagtggacagaatagaaaataatcctcggaggaaagctaaagaaagcaaaacaagggaatactatgaaaagcagtttccagaaattcgaaaacaaagagaacagcaagaaagatttcagcgagttgggcagaggggagctggtctttcagccaccattgctaggagtgagcatgagatttctgaaattattgatgggctctctgagcaggagaataatgagaaacaaatgcggcagctctctgtgattccacctatgatgtttgatgcagaacaaagacgagtcaagttcattaacatgaatgggcttatggaggaccctatgaaagtgtataaagataggcagtttatgaatgtttggactgaccatgaaaaggagatctttaaggacaagtttatccagcatccaaaaaactttggactaattgcatcatacttggagaggaagagtgttcctgattgtgttttgtattactatttaaccaagaaaaatgagaattataaagccctcgtcagaaggaattatgggaaacgcagaggcagaaaccagcaaattgctcgaccctcgcaagaagaaaaagtagaagaaaaagaagaggataaagcagaaaaaacagaaaaaaaagaagaagaaaagaaagatgaagaggaaaaagatgaaaaagaagactccaaagaaaataccaaggaaaaggacaagatagatggtacagcagaagaaactgaggaaagagagcaagccacaccccgggggcgaaagactgccaacagtcagggccgccgtaagggccggatcaccaggtccatgacaaacgaagctgcagctgccagtgctgcagccgcagcggctactgaagagcccccaccacctctgccaccgccaccagaacccatttctacagagcctgtggagacctctcgatggacagaagaagaaatggaagttgctaaaaaaggtctagtagaacatggtcgtaactgggcagcaattgctaaaatggtgggaacgaaaagtgaagctcaatgtaaaaacttctattttaactataaaaggcgacacaatcttgacaacctcttacagcagcataaacagaaaacttcacgaaaacctcgtgaagagcgagatgtgtctcaatgtgaaagtgtcgcttccactgtttctgctcaggaggatgaagatattgaagcctccaatgaagaagaaaatccagaagacagcgaaggtgcagaaaatagttctgatacagaaagtgctccttctccttcaccagttgaagctgtcaagcccagcgaggacagtcctgaaaatgctacttctcgaggaaacacagaacctgcggttgagcttgagcccaccacggaaactgcacccagtacatctccctccttagcagttccaagtacaaaaccagctgaagatgaaagtgtggagacccaggtgaatgacagcatcagtgctgagacagcagagcagatggatgtagatcagcaggagcacagtgctgaagagggttctgtttgtgatcccccacccgctaccaaagctgactctgtggacgttgaagtgagggtgccagaaaaccatgcatctaaagttgaaggtgataataccaaagaaagagacttggatagagccagtgagaaggtggaacctagagatgaagatttggtggtagctcagcaaataaatgcccaaaggcccgagccccagtcagacaatgattccagtgccacgtgcagcgctgatgaggatgtggatggagagccagagaggcagagaatgtttcctatggactcaaagccttcactgttaaaccccactggatctatactcgtctcatctccgttaaaaccaaatccactggatctgccacagcttcagcatcgagctgctgttatcccaccaatggtatcctgcaccccatgtaacataccaattggaaccccagtgagcggctatgctctctaccagcgacacattaaagcaatgcatgagtcagcactcctggaggagcagcggcagagacaagaacagatagatttggaatgtagaagttctacaagtccatgtggcacatccaagagtccaaacagagagtgggaagtccttcagcctgctccacatcaagtgataactaatctccctgaaggcgttcggcttccgacaactcgaccaaccaggccaccgccccctctcatcccgtcatccaaaaccacagtggcttcagaaaaaccatcttttataatgggaggctccatctcacagggaacaccaggcacttatttgacttctcataatcaggcttcctacactcaagaaacacccaagccgtcagtgggatctatctctcttggactgccacggcaacaggaatctgccaaatcagctactttgccctacatcaagcaggaagaattttctccccgaagccaaaactcacaacctgagggtctgttggtcagggcccaacatgaaggtgtagtcagaggtaccgcaggagccatacaagaaggaagtataactcggggaactccaaccagcaaaatttcagtggagagcattccatccctacggggctctatcactcagggcaccccggctctgccccagactggcataccaacagaggctttggtgaaggggtccatttcgagaatgcccattgaagacagcagtcctgagaaaggcagagaggaagctgcatccaaaggccatgttatttatgaaggcaaaagtggacatatcttgtcatatgataatattaagaatgcccgagaagggactaggagtccaagaacagctcatgaaatcagtttaaagagaagctatgaatcagtggaaggaaatataaagcaagggatgtcaatgagggagtctcctgtatcagcaccgttagaggggctgatatgccgagcattacccagggggagtcctcattctgacctcaaagaaaggactgtattgtctggctccataatgcaggggacaccaagagcaacaactgaaagctttgaagatggccttaaatatcccaaacaaattaaaagggaaagtcctcccatacgagcatttgaaggtgccattaccaaaggaaaaccatatgatggcatcaccaccatcaaagaaatggggcgttccattcatgagattccaaggcaagatattttaactcaggaaagtcggaaaactccagaagtggtccagagcacacggccgataattgagggttccatttcccagggcacaccaataaagtttgacaacaactcaggtcaatctgccatcaaacacaatgtcaaatccttaatcacggggcctagcaaactatcccgtggaatgcctccgctggaaattgtgccagagaacataaaagtggtagaacggggaaaatatgaggatgtgaaagcaggcgagaccgtgcgttcccggcacacgtcagtggtaagctctggcccctccgttcttaggtccacactgcatgaagctcccaaagcacaactgagccctgggatttatgatgacaccagtgcacggaggacccctgtgagttatcaaaacaccatgtccagaggctcacccatgatgaacagaacttctgatgttacaatttcttctaacaagtctaccaatcatgaaaggaaatcgacactgacccctacccagagggaaagtatcccagcgaagtctccagtgcctggggtggaccctgtcgtgagccacagtccgtttgatccccatcacagaggcagcactgcaggcgaggtttatcggagccacctgcccacgcacttggatccagccatgccttttcacagggctttggatcctgcagcggctgcttacctgtttcagagacagctttcaccaactccaggttacccaagtcagtatcagctttacgcaatggagaacacaagacagacaatcttaaatgattacattacctcacaacagatgcaagtgaacttgcgtccagatgtggccagaggactctccccaagagagcagccactgggtctcccatacccagcaacgagaggaatcattgacctgaccaatatgcctccaacaattttagtgcctcatccagggggaacaagcactcctcccatggacagaatcacttatattcctggtacacagattactttccctcccaggccgtacaactctgcttccatgtctccaggacacccaacacaccttgcagctgctgcaagtgctgagagggaacgggaacgggagcgggagaaggagcgggagcgggaacggattgctgcagcttcctccgacctctacctgcggccaggctcagaacagcctggccgacctggcagtcatggatatgttcgctccccttccccttcagtaagaactcaggagaccatgttgcaacagagacccagtgttttccaaggaaccaatggaaccagtgtaatcacacctttggatccaactgctcagctacgaatcatgtcagtctcttgtacatattttgacaaaaaatgtctcttgcatatacattttaaaatttgtgactgcaatagtctaagtatagtcatgcttttctgcccatgccatgaaggcttttttgttgttgttgcagtttgtccttccatctccccaccacattcccagcaaatggtcttcccttcacagagctgtgatttggttttatttacagccactgcctgctgggggcccttcaataagccaaggcctgccagcctcccgttacaacactgctgcggatgccctggctgctcttgtggatgctgcagcttctgcaccccagatggatgtgtccaaaacaaaagagagccagcctgggcaagatggtgaaaccctgtctctactaaaaatataaacagctggtcatggtggcgtgcacctgtaatcccagctactcaggaggctgaagcatgagaatcatttgaacctgggaggcagaggttgcagtgagccaagattgtgccactgcattccagcctgggcaacaaagtga

SEQ ID NO: 448595 - DNA, 4855 bp, Homo sapiens
gggttgagtcaagatggcggccaaggtggcgaagcagcagccgcggcggcggcggcggctggagtgagcgtccgactcgccgcgccgaacgaggtcccggtgtagggccgcgcgccgtggccgcgtcccactcctcaggccggggcgcacgtcggctcccacgcttagccagctcccggtggtttcctagaaacatgattgtttattggcattgatctcacagtctggtgaggacttctttactgataatgtcaagttcaggttatcctcccaaccaaggagcattcagcacagaacaaagtcgttatcctcctcactctgtccagtatacatttcccaacacccgccaccagcaggagttcgcagtccctgattatcgttcctctcatcttgaagtgagtcaggcatcacagcttttgcagcaacagcagcagcaacagcttcgaaggcgaccttccttgctttcagaatttcacccaggttctgacaggcctcaagaaaggagaactagttatgaaccgtttcatccaggcccatccccagtggatcatgattcactggaatcgaagcgaccacgtctggaacaggtttctgattctcattttcagcgtgtcagtgctgcggttttgcctttagtgcacccgctgccagaagggctgagggcttctgcagatgctaagaaggatccagcattcggaggcaaacatgaagctccatcctctccaatttcggggcaaccatgtggagatgatcaaaatgcttcaccttcaaaactctcaaaggaagagttaatacagagtatggatcgtgtagatcgagaaattgcaaaagtagaacagcagatccttaaactgaaaaagaaacaacaacagcttgaagaagaggcagctaaacctcctgagcctgagaagcccgtgtcccctcctcctgtggagcagaaacaccgcagtattgtccaaattatttatgatgagaatcggaaaaaagcagaagaagctcataaaatttttgaaggtcttggcccaaaagttgaactgccactgtataaccagccatcagataccaaggtgtaccatgagaacatcaagacaaaccaggtgatgaggaaaaaactcattttattttttaaaagaagaaatcatgcaagaaaacaaagggaacaaaaaatctgccagcgttatgatcagctcatggaggcatgggagaaaaaagtggacagaatagaaaataatcctcggaggaaagctaaagaaagcaaaacaagggaatactatgaaaagcagtttccagaaattcgaaaacaaagagaacagcaagaaagatttcagcgagttgggcagaggggagctggtctttcagccaccattgctaggagtgagcatgagatttctgaaattattgatgggctctctgagcaggagaataatgagaaacaaatgcggcagctctctgtgattccacctatgatgtttgatgcagaacaaagacgagtcaagttcattaacatgaatgggcttatggaggaccctatgaaagtgtataaagataggcagtttatgaatgtttggactgaccatgaaaaggagatctttaaggacaagtttatccagcatccaaaaaactttggactaattgcatcatacttggagaggaagagtgttcctgattgtgttttgtattactatttaaccaagaaaaatgagaattataaagccctcgtcagaaggaattatgggaaacgcagaggcagaaaccagcaaattgctcgaccctcgcaagaagaaaaagtagaagaaaaagaagaggataaagcagaaaaaacagaaaaaaaagaagaagaaaagaaagatgaagaggaaaaagatgaaaaagaagactccaaagaaaataccaaggaaaaggacaagatagatggtacagcagaagaaactgaggaaagagagcaagccacaccccgggggcgaaagactgccaacagtcagggccgccgtaagggccggatcaccaggtccatgacaaacgaagctgcagctgccagtgctgcagccgcagcggctactgaagagcccccaccacctctgccaccgccaccagaacccatttctacagagcctgtggagacctctcgatggacagaagaagaaatggaagttgctaaaaaaggtctagtagaacatggtcgtaactgggcagcaattgctaaaatggtgggaacgaaaagtgaagctcaatgtaaaaacttctattttaactataaaaggcgacacaatcttgacaacctcttacagcagcataaacagaaaacttcacgaaaacctcgtgaagagcgagatgtgtctcaatgtgaaagtgtcgcttccactgtttctgctcaggaggatgaagatattgaagcctccaatgaagaagaaaatccagaagacagcgaaggtgcagaaaatagttctgatacagaaagtgctccttctccttcaccagttgaagctgtcaagcccagcgaggacagtcctgaaaatgctacttctcgaggaaacacagaacctgcggttgagcttgagcccaccacggaaactgcacccagtacatctccctccttagcagttccaagtacaaaaccagctgaagatgaaagtgtggagacccaggtgaatgacagcatcagtgctgagacagcagagcagatggatgtagatcagcaggagcacagtgctgaagagggttctgtttgtgatcccccacccgctaccaaagctgactctgtggacgttgaagtgagggtgccagaaaaccatgcatctaaagttgaaggtgataataccaaagaaagagacttggatagagccagtgagaaggtggaacctagagatgaagatttggtggtagctcagcaaataaatgcccaaaggcccgagccccagtcagacaatgattccagtgccacgtgcagcgctgatgaggatgtggatggagagccagagaggcagagaatgtttcctatggactcaaagccttcactgttaaaccccactggatctatactcgtctcatctccgttaaaaccaaatccactggatctgccacagcttcagcatcgagctgctgttatcccaccaatggtatcctgcaccccatgtaacataccaattggaaccccagtgagcggctatgctctctaccagcgacacattaaagcaatgcatgagtcagcactcctggaggagcagcggcagagacaagaacagatagatttggaatgtagaagttctacaagtccatgtggcacatccaagagtccaaacagagagtgggaagtccttcagcctgctccacatcaagtgataactaatctccctgaaggcgttcggcttccgacaactcgaccaaccaggccaccgccccctctcatcccgtcatccaaaaccacagtggcttcagaaaaaccatcttttataatgggaggctccatctcacagggaacaccaggcacttatttgacttctcataatcaggcttcctacactcaagaaacacccaagccgtcagtgggatctatctctcttggactgccacggcaacaggaatctgccaaatcagctactttgccctacatcaagcaggaagaattttctccccgaagccaaaactcacaacctgagggtctgttggtcagggcccaacatgaaggtgtagtcagaggtaccgcaggagccatacaagaaggaagtataactcggggaactccaaccagcaaaatttcagtggagagcattccatccctacggggctctatcactcagggcaccccggctctgccccagactggcataccaacagaggctttggtgaaggggtccatttcgagaatgcccattgaagacagcagtcctgagaaaggcagagaggaagctgcatccaaaggccatgttatttatgaaggcaaaagtggacatatcttgtcatatgataatattaagaatgcccgagaagggactaggagtccaagaacagctcatgaaatcagtttaaagagaagctatgaatcagtggaaggaaatataaagcaagggatgtcaatgagggagtctcctgtatcagcaccgttagaggggctgatatgccgagcattacccagggggagtcctcattctgacctcaaagaaaggactgtattgtctggctccataatgcaggggacaccaagagcaacaactgaaagctttgaagatggccttaaatatcccaaacaaattaaaagggaaagtcctcccatacgagcatttgaaggtgccattaccaaaggaaaaccatatgatggcatcaccaccatcaaagaaatggggcgttccattcatgagattccaaggcaagatattttaactcaggaaagtcggaaaactccagaagtggtccagagcacacggccgataattgagggttccatttcccagggcacaccaataaagtttgacaacaactcaggtcaatctgccatcaaacacaatgtcaaatccttaatcacggggcctagcaaactatcccgtggaatgcctccgctggaaattgtgccagagaacataaaagtggtagaacggggaaaatatgaggatgtgaaagcaggcgagaccgtgcgttcccggcacacgtcagtggtaagctctggcccctccgttcttaggtccacactgcatgaagctcccaaagcacaactgagccctgggatttatgatgacaccagtgcacggaggacccctgtgagttatcaaaacaccatgtccagaggctcacccatgatgaacagaacttctgatggtatgttacttttgttgcttggtctgatactttttattgcatttaa

SEQ ID NO: 448596 - DNA, 4610 bp, Homo sapiens
gggttgagtcaagatggcggccaaggtggcgaagcagcagccgcggcggcggcggcggctggagtgagcgtccgactcgccgcgccgaacgaggtcccggtgtagggccgcgcgccgtggccgcgtcccactcctcaggccggggcgcacgtcggctcccacgcttagccagctcccggtggtttcctagaaacatgattgtttattggcattgatctcacagtctggtgaggacttctttactgataatgtcaagttcaggttatcctcccaaccaaggagcattcagcacagaacaaagtcgttatcctcctcactctgtccagtatacatttcccaacacccgccaccagcaggagttcgcagtccctgattatcgttcctctcatcttgaagtgagtcaggcatcacagcttttgcagcaacagcagcagcaacagcttcgaaggcgaccttccttgctttcagaatttcacccaggttctgacaggcctcaagaaaggagaactagttatgaaccgtttcatccaggcccatccccagtggatcatgattcactggaatcgaagcgaccacgtctggaacaggtttctgattctcattttcagcgtgtcagtgctgcggttttgcctttagtgcacccgctgccagaagggctgagggcttctgcagatgctaagaaggatccagcattcggaggcaaacatgaagctccatcctctccaatttcggggcaaccatgtggagatgatcaaaatgcttcaccttcaaaactctcaaaggaagagttaatacagagtatggatcgtgtagatcgagaaattgcaaaagtagaacagcagatccttaaactgaaaaagaaacaacaacagcttgaagaagaggcagctaaacctcctgagcctgagaagcccgtgtcccctcctcctgtggagcagaaacaccgcagtattgtccaaattatttatgatgagaatcggaaaaaagcagaagaagctcataaaatttttgaaggtcttggcccaaaagttgaactgccactgtataaccagccatcagataccaaggtgtaccatgagaacatcaagacaaaccaggtgatgaggaaaaaactcattttattttttaaaagaagaaatcatgcaagaaaacaaagggaacaaaaaatctgccagcgttatgatcagctcatggaggcatgggagaaaaaagtggacagaatagaaaataatcctcggaggaaagctaaagaaagcaaaacaagggaatactatgaaaagcagtttccagaaattcgaaaacaaagagaacagcaagaaagatttcagcgagttgggcagaggggagctggtctttcagccaccattgctaggagtgagcatgagatttctgaaattattgatgggctctctgagcaggagaataatgagaaacaaatgcggcagctctctgtgattccacctatgatgtttgatgcagaacaaagacgagtcaagttcattaacatgaatgggcttatggaggaccctatgaaagtgtataaagataggcagtttatgaatgtttggactgaccatgaaaaggagatctttaaggacaagtttatccagcatccaaaaaactttggactaattgcatcatacttggagaggaagagtgttcctgattgtgttttgtattactatttaaccaagaaaaatgagaattataaagccctcgtcagaaggaattatgggaaacgcagaggcagaaaccagcaaattgctcgaccctcgcaagaagaaaaagtagaagaaaaagaagaggataaagcagaaaaaacagaaaaaaaagaagaagaaaagaaagatgaagaggaaaaagatgaaaaagaagactccaaagaaaataccaaggaaaaggacaagatagatggtacagcagaagaaactgaggaaagagagcaagccacaccccgggggcgaaagactgccaacagtcagggccgccgtaagggccggatcaccaggtccatgacaaacgaagctgcagctgccagtgctgcagccgcagcggctactgaagagcccccaccacctctgccaccgccaccagaacccatttctacagagcctgtggagacctctcgatggacagaagaagaaatggaagttgctaaaaaaggtctagtagaacatggtcgtaactgggcagcaattgctaaaatggtgggaacgaaaagtgaagctcaatgtaaaaacttctattttaactataaaaggcgacacaatcttgacaacctcttacagcagcataaacagaaaacttcacgaaaacctcgtgaagagcgagatgtgtctcaatgtgaaagtgtcgcttccactgtttctgctcaggaggatgaagatattgaagcctccaatgaagaagaaaatccagaagacagcgaaggtgcagaaaatagttctgatacagaaagtgctccttctccttcaccagttgaagctgtcaagcccagcgaggacagtcctgaaaatgctacttctcgaggaaacacagaacctgcggttgagcttgagcccaccacggaaactgcacccagtacatctccctccttagcagttccaagtacaaaaccagctgaagatgaaagtgtggagacccaggtgaatgacagcatcagtgctgagacagcagagcagatggatgtagatcagcaggagcacagtgctgaagagggttctgtttgtgatcccccacccgctaccaaagctgactctgtggacgttgaagtgagggtgccagaaaaccatgcatctaaagttgaaggtgataataccaaagaaagagacttggatagagccagtgagaaggtggaacctagagatgaagatttggtggtagctcagcaaataaatgcccaaaggcccgagccccagtcagacaatgattccagtgccacgtgcagcgctgatgaggatgtggatggagagccagagaggcagagaatgtttcctatggactcaaagccttcactgttaaaccccactggatctatactcgtctcatctccgttaaaaccaaatccactggatctgccacagcttcagcatcgagctgctgttatcccaccaatggtatcctgcaccccatgtaacataccaattggaaccccagtgagcggctatgctctctaccagcgacacattaaagcaatgcatgagtcagcactcctggaggagcagcggcagagacaagaacagatagatttggaatgtagaagttctacaagtccatgtggcacatccaagagtccaaacagagagtgggaagtccttcagcctgctccacatcaagtgataactaatctccctgaaggcgttcggcttccgacaactcgaccaaccaggccaccgccccctctcatcccgtcatccaaaaccacagtggcttcagaaaaaccatcttttataatgggaggctccatctcacagggaacaccaggcacttatttgacttctcataatcaggcttcctacactcaagaaacacccaagccgtcagtgggatctatctctcttggactgccacggcaacaggaatctgccaaatcagctactttgccctacatcaagcaggaagaattttctccccgaagccaaaactcacaacctgagggtctgttggtcagggcccaacatgaaggtgtagtcagaggtaccgcaggagccatacaagaaggaagtataactcggggaactccaaccagcaaaatttcagtggagagcattccatccctacggggctctatcactcagggcaccccggctctgccccagactggcataccaacagaggctttggtgaaggggtccatttcgagaatgcccattgaagacagcagtcctgagaaaggcagagaggaagctgcatccaaaggccatgttatttatgaaggcaaaagtggacatatcttgtcatatgatagtaagtattgtatgtatgcaccaaagccagtattacaatatgtgctaaaaacataggcttgggttttcccgcatttctgctctctgggagtcagtttatctttgctgagcctatgttttctctcagtaaatggggttagtaatacttgtctcatgagaattttgtgaataacagcttagtcgataaaaagtaattaacaacgcagagctcatattaaatgtcccataggtggtagctaagattgtcgactgtggtcagtcagtttagcttaggtaaagagcctttgttgaactttaatggaatacttttattttgaagagattcatgttttatgaattaagaattagagggtagataggctgggcgcggtggttcacgcctatctactatctaatcccagtactttgggaggccaaggcaggtggatcgcctggggtcgggagttcaagaccggcctgaccaacatggagaaaccccatctctactagaaatacaaagttagccaggcatggtggtgcatgcctgtaatcccagctactcgggaggctgaagcaggagaatcgcttgaatccgggaggcggaggttgctgtgagccgagatcgcgccatttccagcctgggcaacaagagggaaactccgtctc

SEQ ID NO: 448597 - DNA, 3788 bp, Homo sapiens
  misc_feature (3498)..(3498): n is a, c, g, or t
gggttgagtcaagatggcggccaaggtggcgaagcagcagccgcggcggcggcggcggctggagtgagcgtccgactcgccgcgccgaacgaggtcccggtgtagggccgcgcgccgtggccgcgtcccactcctcaggccggggcgcacgtcggctcccacgcttagccagctcccggtggtttcctagaaacatgattgtttattggcattgatctcacagtctggtgaggacttctttactgataatgtcaagttcaggttatcctcccaaccaaggagcattcagcacagaacaaagtcgttatcctcctcactctgtccagtatacatttcccaacacccgccaccagcaggagttcgcagtccctgattatcgttcctctcatcttgaagtgagtcaggcatcacagcttttgcagcaacagcagcagcaacagcttcgaaggcgaccttccttgctttcagaatttcacccaggttctgacaggcctcaagaaaggagaactagttatgaaccgtttcatccaggcccatccccagtggatcatgattcactggaatcgaagcgaccacgtctggaacaggtttctgattctcattttcagcgtgtcagtgctgcggttttgcctttagtgcacccgctgccagaagggctgagggcttctgcagatgctaagaaggatccagcattcggaggcaaacatgaagctccatcctctccaatttcggggcaaccatgtggagatgatcaaaatgcttcaccttcaaaactctcaaaggaagagttaatacagagtatggatcgtgtagatcgagaaattgcaaaagtagaacagcagatccttaaactgaaaaagaaacaacaacagcttgaagaagaggcagctaaacctcctgagcctgagaagcccgtgtcccctcctcctgtggagcagaaacaccgcagtattgtccaaattatttatgatgagaatcggaaaaaagcagaagaagctcataaaatttttgaaggtcttggcccaaaagttgaactgccactgtataaccagccatcagataccaaggtgtaccatgagaacatcaagacaaaccaggtgatgaggaaaaaactcattttattttttaaaagaagaaatcatgcaagaaaacaaagggaacaaaaaatctgccagcgttatgatcagctcatggaggcatgggagaaaaaagtggacagaatagaaaataatcctcggaggaaagctaaagaaagcaaaacaagggaatactatgaaaagcagtttccagaaattcgaaaacaaagagaacagcaagaaagatttcagcgagttgggcagaggggagctggtctttcagccaccattgctaggagtgagcatgagatttctgaaattattgatgggctctctgagcaggagaataatgagaaacaaatgcggcagctctctgtgattccacctatgatgtttgatgcagaacaaagacgagtcaagttcattaacatgaatgggcttatggaggaccctatgaaagtgtataaagataggcagtttatgaatgtttggactgaccatgaaaaggagatctttaaggacaagtttatccagcatccaaaaaactttggactaattgcatcatacttggagaggaagagtgttcctgattgtgttttgtattactatttaaccaagaaaaatgagaattataaagccctcgtcagaaggaattatgggaaacgcagaggcagaaaccagcaaattgctcgaccctcgcaagaagaaaaagtagaagaaaaagaagaggataaagcagaaaaaacagaaaaaaaagaagaagaaaagaaagatgaagaggaaaaagatgaaaaagaagactccaaagaaaataccaaggaaaaggacaagatagatggtacagcagaagaaactgaggaaagagagcaagccacaccccgggggcgaaagactgccaacagtcagggccgccgtaagggccggatcaccaggtccatgacaaacgaagctgcagctgccagtgctgcagccgcagcggctactgaagagcccccaccacctctgccaccgccaccagaacccatttctacagagcctgtggagacctctcgatggacagaagaagaaatggaagttgctaaaaaaggtctagtagaacatggtcgtaactgggcagcaattgctaaaatggtgggaacgaaaagtgaagctcaatgtaaaaacttctattttaactataaaaggcgacacaatcttgacaacctcttacagcagcataaacagaaaacttcacgaaaacctcgtgaagagcgagatgtgtctcaatgtgaaagtgtcgcttccactgtttctgctcaggaggatgaagatattgaagcctccaatgaagaagaaaatccagaagacagcgaaggtgcagaaaatagttctgatacagaaagtgctccttctccttcaccagttgaagctgtcaagcccagcgaggacagtcctgaaaatgctacttctcgaggaaacacagaacctgcggttgagcttgagcccaccacggaaactgcacccagtacatctccctccttagcagttccaagtacaaaaccagctgaagatgaaagtgtggagacccaggtgaatgacagcatcagtgctgagacagcagagcagatggatgtagatcagcaggagcacagtgctgaagagggttctgtttgtgatcccccacccgctaccaaagctgactctgtggacgttgaagtgagggtgccagaaaaccatgcatctaaagttgaaggtgataataccaaagaaagagacttggatagagccagtgagaaggtggaacctagagatgaagatttggtggtagctcagcaaataaatgcccaaaggcccgagccccagtcagacaatgattccagtgccacgtgcagcgctgatgaggatgtggatggagagccagagaggcagagaatgtttcctatggactcaaagccttcactgttaaaccccactggatctatactcgtctcatctccgttaaaaccaaatccactggatctgccacagcttcagcatcgagctgctgttatcccaccaatggtatcctgcaccccatgtaacataccaattggaaccccagtgagcggctatgctctctaccagcgacacattaaagcaatgcatgagtcagcactcctggaggagcagcggcagagacaagaacagatagatttggaatgtagaagttctacaagtccatgtggcacatccaagagtccaaacagagagtgggaagtccttcagcctgctccacatcaagtgataactaatctccctgaaggcgttcggcttccgacaactcgaccaaccaggccaccgccccctctcatcccgtcatccaaaagcaacgtgggatccgtgccattgtgaagaacagagaaaatgcatgtaaaattccttgcatataacaggcactttatanatggcagctagagttagaattttaactcaatgaacacagatacaaggagccttttaactgggagcaaagagaattaaactctaagtagagcacctaagtgcatgtctgtgtttgaacacatttcatcacatttataataaccctgagggattaggaaggggttcagttggagagagagcagcacttggtagaagaaacgtgtgtctgggggtcagacacacctggttcaaatcccagcagcactacttctagccttgtgccacaatgcacgtgatcgggatcctctagat

SEQ ID NO: 448598 - DNA, 3025 bp, Homo sapiens
gggttgagtcaagatggcggccaaggtggcgaagcagcagccgcggcggcggcggcggctggagtgagcgtccgactcgccgcgccgaacgaggtcccggtgtagggccgcgcgccgtggccgcgtcccactcctcaggccggggcgcacgtcggctcccacgcttagccagctcccggtggtttcctagaaacatgattgtttattggcattgatctcacagtctggtgaggacttctttactgataatgtcaagttcaggttatcctcccaaccaaggagcattcagcacagaacaaagtcgttatcctcctcactctgtccagtatacatttcccaacacccgccaccagcaggagttcgcagtccctgattatcgttcctctcatcttgaagtgagtcaggcatcacagcttttgcagcaacagcagcagcaacagcttcgaaggcgaccttccttgctttcagaatttcacccaggttctgacaggcctcaagaaaggagaactagttatgaaccgtttcatccaggcccatccccagtggatcatgattcactggaatcgaagcgaccacgtctggaacaggtttctgattctcattttcagcgtgtcagtgctgcggttttgcctttagtgcacccgctgccagaagggctgagggcttctgcagatgctaagaaggatccagcattcggaggcaaacatgaagctccatcctctccaatttcggggcaaccatgtggagatgatcaaaatgcttcaccttcaaaactctcaaaggaagagttaatacagagtatggatcgtgtagatcgagaaattgcaaaagtagaacagcagatccttaaactgaaaaagaaacaacaacagcttgaagaagaggcagctaaacctcctgagcctgagaagcccgtgtcccctcctcctgtggagcagaaacaccgcagtattgtccaaattatttatgatgagaatcggaaaaaagcagaagaagctcataaaatttttgaaggtcttggcccaaaagttgaactgccactgtataaccagccatcagataccaaggtgtaccatgagaacatcaagacaaaccaggtgatgaggaaaaaactcattttattttttaaaagaagaaatcatgcaagaaaacaaagggaacaaaaaatctgccagcgttatgatcagctcatggaggcatgggagaaaaaagtggacagaatagaaaataatcctcggaggaaagctaaagaaagcaaaacaagggaatactatgaaaagcagtttccagaaattcgaaaacaaagagaacagcaagaaagatttcagcgagttgggcagaggggagctggtctttcagccaccattgctaggagtgagcatgagatttctgaaattattgatgggctctctgagcaggagaataatgagaaacaaatgcggcagctctctgtgattccacctatgatgtttgatgcagaacaaagacgagtcaagttcattaacatgaatgggcttatggaggaccctatgaaagtgtataaagataggcagtttatgaatgtttggactgaccatgaaaaggagatctttaaggacaagtttatccagcatccaaaaaactttggactaattgcatcatacttggagaggaagagtgttcctgattgtgttttgtattactatttaaccaagaaaaatgagaattataaagccctcgtcagaaggaattatgggaaacgcagaggcagaaaccagcaaattgctcgaccctcgcaagaagaaaaagtagaagaaaaagaagaggataaagcagaaaaaacagaaaaaaaagaagaagaaaagaaagatgaagaggaaaaagatgaaaaagaagactccaaagaaaataccaaggaaaaggacaagatagatggtacagcagaagaaactgaggaaagagagcaagccacaccccgggggcgaaagactgccaacagtcagggccgccgtaagggccggatcaccaggtccatgacaaacgaagctgcagctgccagtgctgcagccgcagcggctactgaagagcccccaccacctctgccaccgccaccagaacccatttctacagagcctgtggagacctctcgatggacagaagaagaaatggaagttgctaaaaaaggtctagtagaacatggtcgtaactgggcagcaattgctaaaatggtgggaacgaaaagtgaagctcaatgtaaaaacttctattttaactataaaaggcgacacaatcttgacaacctcttacagcagcataaacagaaaacttcacgaaaacctcgtgaagagcgagatgtgtctcaatgtgaaagtgtcgcttccactgtttctgctcaggaggatgaagatattgaagcctccaatgaagaagaaaatccagaagacagcgaaggtgcagaaaatagttctgatacagaaagtgctccttctccttcaccagttgaagctgtcaagcccagcgaggacagtcctgaaaatgctacttctcgaggaaacacagaacctgcggttgagcttgagcccaccacggaaactgcacccagtacatctccctccttagcagttccaagtacaaaaccagctgaagatgaaagtgtggagacccaggtgaatgacagcatcagtgctgagacagcagagcagatggatgtagatcagcaggagcacagtgctgaagagggttctgtttgtgatcccccacccgctaccaaagctgactctgtggacgttgaagtgagggtgccagaaaaccatgcatctaaagttgaaggtgataataccaaagaaagagacttggatagagccagtgagaaggtggaacctagagatgaagatttggtggtagctcagcaaataaatgcccaaaggcccgagccccagtcagacaatgattccagtggtgaataagcaactttctacagttttgcaccacggcgagcaccaccaatacatgcagcaccaccaatacaggcagcaccaccaataca

SEQ ID NO: 448599 - DNA, 2004 bp, Homo sapiens
gggttgagtcaagatggcggccaaggtggcgaagcagcagccgcggcggcggcggcggctggagtgagcgtccgactcgccgcgccgaacgaggtcccggtgtagggccgcgcgccgtggccgcgtcccactcctcaggccggggcgcacgtcggctcccacgcttagccagctcccggtggtttcctagaaacatgattgtttattggcattgatctcacagtctggtgaggacttctttactgataatgtcaagttcaggttatcctcccaaccaaggagcattcagcacagaacaaagtcgttatcctcctcactctgtccagtatacatttcccaacacccgccaccagcaggagttcgcagtccctgattatcgttcctctcatcttgaagtgagtcaggcatcacagcttttgcagcaacagcagcagcaacagcttcgaaggcgaccttccttgctttcagaatttcacccaggttctgacaggcctcaagaaaggagaactagttatgaaccgtttcatccaggcccatccccagtggatcatgattcactggaatcgaagcgaccacgtctggaacaggtttctgattctcattttcagcgtgtcagtgctgcggttttgcctttagtgcacccgctgccagaagggctgagggcttctgcagatgctaagaaggatccagcattcggaggcaaacatgaagctccatcctctccaatttcggggcaaccatgtggagatgatcaaaatgcttcaccttcaaaactctcaaaggaagagttaatacagagtatggatcgtgtagatcgagaaattgcaaaagtagaacagcagatccttaaactgaaaaagaaacaacaacagcttgaagaagaggcagctaaacctcctgagcctgagaagcccgtgtcccctcctcctgtggagcagaaacaccgcagtattgtccaaattatttatgatgagaatcggaaaaaagcagaagaagctcataaaatttttgaaggtcttggcccaaaagttgaactgccactgtataaccagccatcagataccaaggtgtaccatgagaacatcaagacaaaccaggtgatgaggaaaaaactcattttattttttaaaagaagaaatcatgcaagaaaacaaagggaacaaaaaatctgccagcgttatgatcagctcatggaggcatgggagaaaaaagtggacagaatagaaaataatcctcggaggaaagctaaagaaagcaaaacaagggaatactatgaaaagcagtttccagaaattcgaaaacaaagagaacagcaagaaagatttcagcgagttgggcagaggggagctggtctttcagccaccattgctaggagtgagcatgagatttctgaaattattgatgggctctctgagcaggagaataatgagaaacaaatgcggcagctctctgtgattccacctatgatgtttgatgcagaacaaagacgagtcaagttcattaacatgaatgggcttatggaggaccctatgaaagtgtataaagataggcagtttatgaatgtttggactgaccatgaaaaggagatctttaaggacaagtttatccagcatccaaaaaactttggactaattgcatcatacttggagaggaagagtgttcctgattgtgttttgtattactatttaaccaagaaaaatgagaattataaagccctcgtcagaaggaattatgggaaacgcagaggcagaaaccagcaaattgctcgaccctcgcaagaagaaaaagtagaagaaaaagaagaggataaagcagaaaaaacagaaaaaaaagaagaagaaaagaaagatgaagaggaaaaagatgaaaaagaagactccaaagaaaataccaaggaaaagtagaagaaaaagaagaggataaagcagaaaaaacagaaaaaaaagaagaagaaaagaaagatgaagaggaaaaagatgaaaaagaagactccaaaaaaaaaaa

SEQ ID NO: 448600 - DNA, 1475 bp, Homo sapiens
gggttgagtcaagatggcggccaaggtggcgaagcagcagccgcggcggcggcggcggctggagtgagcgtccgactcgccgcgccgaacgaggtcccggtgtagggccgcgcgccgtggccgcgtcccactcctcaggccggggcgcacgtcggctcccacgcttagccagctcccggtggtttcctagaaacatgattgtttattggcattgatctcacagtctggtgaggacttctttactgataatgtcaagttcaggttatcctcccaaccaaggagcattcagcacagaacaaagtcgttatcctcctcactctgtccagtatacatttcccaacacccgccaccagcaggagttcgcagtccctgattatcgttcctctcatcttgaagtgagtcaggcatcacagcttttgcagcaacagcagcagcaacagcttcgaaggcgaccttccttgctttcagaatttcacccaggttctgacaggcctcaagaaaggagaactagttatgaaccgtttcatccaggcccatccccagtggatcatgattcactggaatcgaagcgaccacgtctggaacaggtttctgattctcattttcagcgtgtcagtgctgcggttttgcctttagtgcacccgctgccagaagggctgagggcttctgcagatgctaagaaggatccagcattcggaggcaaacatgaagctccatcctctccaatttcggggcaaccatgtggagatgatcaaaatgcttcaccttcaaaactctcaaaggaagagttaatacagagtatggatcgtgtagatcgagaaattgcaaaagtagaacagcagatccttaaactgaaaaagaaacaacaacagcttgaagaagaggcagctaaacctcctgagcctgagaagcccgtgtcccctcctcctgtggagcagaaacaccgcagtattgtccaaattatttatgatgagaatcggaaaaaagcagaagaagctcataaaatttttgaaggtcttggcccaaaagttgaactgccactgtataaccagccatcagataccaaggtgtaccatgagaacatcaagacgtaagtattgatcatctttggagttcttcaattaaagaccgtatattctataaagagatcatttttgttatctgctgacattattataatatattgtaggtatgttttagatttgtgtaatttgctgtcgttttattatatgttatcttcctctggcttcttgggggttggggtaacagctttgagtttccgaggccaaaaaatgaaataaattattgcataaaactagctggttttataatctgctagtaaaaaaggtggatacttaacattgaaatggcttaccttgaggcttgaattttttgcctcctgttttgtctttttttcagtggagtacctgcaaggcgcatgatgaagtaagataatgaagctttttcatttaaga

SEQ ID NO: 448601 - DNA, 738 bp, Homo sapiens
  misc_feature (73)..(73): n is a, c, g, or t
tttttatttttattttttagatggagtctcactctgtcgcccaggcaggagtgcagcagcgtgagctcagctnactgcaacctctgtctcccacactcaagcgattcccctgcctaggcctcccaaagtgctgggattacaggcatgagccactgcacccggcccagaattaaaatcttaaaggatgcttcctcttagttttttttttaaactctatctaatgaaaatttgtgttgtttggttatgaaataaatctgattaattctctttgagctcttggtccatgagaccttcatggattaattggttaccctacagaatctgcaagcaaagcttagtagcctgtgttatctccagtggttaatcactgctgggtgtggtgtgcagcacatgcttgactctttctttctggatctcttagcaacagcttgaagaagaggcagctaaacctcctgagcctgagaagcccgtgtcccctcctcctgtggagcagaaacaccgcagtattgtccaaattatttatgatgagaatcgggtaagctcataccatctctggcagcacaggcttcctgagtaggtgggactgcaggcatgtgccaccatccccagctaatttttgtatttttagtagagatggggttctgccatattggtcaggctggtcttgaactcctgacctcaagtgatccaccttcttcggcctcccaaagtgctgggattacaggcatgagccaccac

SEQ ID NO: 448602 - DNA, 446 bp, Homo sapiens
cccagggggagtcctcattctgacctcaaagaaaggactgtattgtctggctccataatgcagggtaaactttctgcttgttttgcatttttatttataactgcctccctggcaaaatagtttgacattaatttacagtgtatttctgcttttcaagttattttcccttttgaaatattaaagtcttggttattacttttctgcctctgagctacataatttattggaagatgatagttgcttaatcttttaatatagagatatctttattatgcaagaaccattctgtgactattatgaatgatgcattaatatcatatctcaagcaaccctaaagaaataatgattgataaatactgatttgaggatctactgtaaacagaaagttaattagaaactacaagatgtcaaggcattattttaaattatgttaaaatatatgtaac

SEQ ID NO: 448603 - DNA, 432 bp, Homo sapiens
gaagtaccctaagagtgattggcgagagagaaaaaatttttgaagactgatgtttgctatgctaagcagaagtttgaaataagcatcagcttgaaagctgtggtttgaaagggagttgaatatttcaaccccacaaatagtatttgtgacaaatatgtatacaggcttacgtgaatgagaaatttaaaatagaaatgttcattgttggtttcatcttacattttttaattagtgatttaaaaattcaggaatgactgagagaggtaacatgttgtaaactaggaaatggactagtttaaaatcatttttctttccttttaaaagtccttcagcctgctccacatcaagtgataactaatctccctgaaggcgttcggcttccgacaactcgaccaaccaggccaccgccccctctcatcccgtcatccaaaa

SEQ ID NO: 448604 - DNA, 670 bp, Homo sapiens
tttcttgttgcttttatggaagagagtttttggaagtccttattactttgctgtatttgctgataccactctccatagcatttttagtcggaatgaatattaataatagtagcttacattttgattgcaacatataagtgctttatttatgtaatttattaatagtaaatactatttacatgtaatgtatggtaattttagaagacatatcctactccctttaaaattttttttatatttaagcaatctacgatgaagattttcttgctttacaaaaactattcttggttttgggtagaaggggtataattttttttttttttaaacagaaatgggaatgctgactttgtgaaattgaccttgtgaaaaaaacaatgtttgcttaatctttaaatttttttttgtttttttcttagggaacaccaggcacttatttgacttctcataatcaggcttcctacactcaagaaacacccaagccgtcagtgggatctatctctcttggactgccacggcaacaggaatctgccaaatcaggtcagtgagttaatacagtcataatgcatctacgtttgtagcatcacagccagtaatttagtactggattgtttcatgtttctctgcctttccacagctactttgccctacatcaagcaggaagaattttctc

SEQ ID NO: 448605 - DNA, 177 bp, Homo sapiens
cgcggctccgcgggctggggggagggagaggggttgagtcaagatggcggccaaggtggcgaagcagcagccgcggcggcggcggcggctggagtgagcgtccgactcgccgcgccgaacgaggtcccggtgtagggccgcgcgccgtggccgcgtcccactcctcaggccggggcg

SEQ ID NO: 448606 - DNA, 294 bp, Homo sapiens
gccggtccgttatggtggtgctgactctgtggacgttgaagtgagggtgccagaaaaccatgcatctaaagttgaaggtgataataccaaagaaagagacttggatagagccagtgagaaggtggaacctagagatgaagatttggtggtagctcagcaaataaatgcccaaaggcccgagccccagtcagacaatgattccagtggtgaataagcaactttctacagttttgcaccacggcgagcaccaccaatacatgcagcaccaccaatacaggcagcaccaccaataca

SEQ ID NO: 448607 - DNA, 673 bp, Homo sapiens
gggttgagtcaagatggcggccaaggtggcgaagcagcagccgcggcggcggcggcggctggagtgagcgtccgactcgccgcgccgaacgaggtcccggtgtagggccgcgcgccgtggccgcgtcccactcctcaggccggggcgcacgtcggctcccacgcttagccagctcccgagtttcactcttgttgcccaggctggagtgcaatggcacgatctcggctcaccgcaacctctgcctcttgggttcaagcgattctcctgcctcagcctctcgagtagctgggattacaggcatgtgccaccacgcctggctaatttttatattttcagtagagacggggtttcaccatgttggtcaggctggtctcgaactctcaacctcaggtgatccacccgcctcagcctcccaaagtgctgggattacaggtgtgagccaccgcacccggcccatatagagaaatactgtttagcaatagaaagaaccataaattgatgagaataattgccaagatgtttttttttttttttttttttgagacggagtctcactctgttgcccaggctagagggtagtggcgcaatctcggctcactgcaagctctgcctcctgggttcatgccattctcccgcctcagcctcctgagtagctggaactacaggcgcccgc

SEQ ID NO: 448608 - DNA, 8630 bp, Homo sapiens
gggttgagtcaagatggcggccaaggtggcgaagcagcagccgcggcggcggcggcggctggagtgagcgtccgactcgccgcgccgaacgaggtcccggtgtagggccgcgcgccgtggccgcgtcccactcctcaggccggggcgcacgtcggctcccacgcttagccagctcccgagtttcactcttgttgcccaggctggagtgcaatggcacgatctcggctcaccgcaacctctgcctcttgggttcaagcgattctcctgcctcagcctctcgagtagctgggattacaggtggtttcctagaaacatgattgtttattggcattgatctcacagtctggtgaggacttctttactgataatgtcaagttcaggttatcctcccaaccaaggagcattcagcacagaacaaagtcgttatcctcctcactctgtccagtatacatttcccaacacccgccaccagcaggagttcgcagtccctgattatcgttcctctcatcttgaagtgagtcaggcatcacagcttttgcagcaacagcagcagcaacagcttcgaaggcgaccttccttgctttcagaatttcacccaggttctgacaggcctcaagaaaggagaactagttatgaaccgtttcatccaggcccatccccagtggatcatgattcactggaatcgaagcgaccacgtctggaacaggtttctgattctcattttcagcgtgtcagtgctgcggttttgcctttagtgcacccgctgccagaagggctgagggcttctgcagatgctaagaaggatccagcattcggaggcaaacatgaagctccatcctctccaatttcggggcaaccatgtggagatgatcaaaatgcttcaccttcaaaactctcaaaggaagagttaatacagagtatggatcgtgtagatcgagaaattgcaaaagtagaacagcagatccttaaactgaaaaagaaacaacaacagcttgaagaagaggcagctaaacctcctgagcctgagaagcccgtgtcccctcctcctgtggagcagaaacaccgcagtattgtccaaattatttatgatgagaatcggaaaaaagcagaagaagctcataaaatttttgaaggtcttggcccaaaagttgaactgccactgtataaccagccatcagataccaaggtgtaccatgagaacatcaagacaaaccaggtgatgaggaaaaaactcattttattttttaaaagaagaaatcatgcaagaaaacaaagggaacaaaaaatctgccagcgttatgatcagctcatggaggcatgggagaaaaaagtggacagaatagaaaataatcctcggaggaaagctaaagaaagcaaaacaagggaatactatgaaaagcagtttccagaaattcgaaaacaaagagaacagcaagaaagatttcagcgagttgggcagaggggagctggtctttcagccaccattgctaggagtgagcatgagatttctgaaattattgatgggctctctgagcaggagaataatgagaaacaaatgcggcagctctctgtgattccacctatgatgtttgatgcagaacaaagacgagtcaagttcattaacatgaatgggcttatggaggaccctatgaaagtgtataaagataggcagtttatgaatgtttggactgaccatgaaaaggagatctttaaggacaagtttatccagcatccaaaaaactttggactaattgcatcatacttggagaggaagagtgttcctgattgtgttttgtattactatttaaccaagaaaaatgagaattataaagccctcgtcagaaggaattatgggaaacgcagaggcagaaaccagcaaattgctcgaccctcgcaagaagaaaaagtagaagaaaaagaagaggataaagcagaaaaaacagaaaaaaaagaagaagaaaagaaagatgaagaggaaaaagatgaaaaagaagactccaaagaaaataccaaggaaaaggacaagatagatggtacagcagaagaaactgaggaaagagagcaagccacaccccgggggcgaaagactgccaacagtcagggccgccgtaagggccggatcaccaggtccatgacaaacgaagctgcagctgccagtgctgcagccgcagcggctactgaagagcccccaccacctctgccaccgccaccagaacccatttctacagagcctgtggagacctctcgatggacagaagaagaaatggaagttgctaaaaaaggtctagtagaacatggtcgtaactgggcagcaattgctaaaatggtgggaacgaaaagtgaagctcaatgtaaaaacttctattttaactataaaaggcgacacaatcttgacaacctcttacagcagcataaacagaaaacttcacgaaaacctcgtgaagagcgagatgtgtctcaatgtgaaagtgtcgcttccactgtttctgctcaggaggatgaagatattgaagcctccaatgaagaagaaaatccagaagacagcgaaggtgcagaaaatagttctgatacagaaagtgctccttctccttcaccagttgaagctgtcaagcccagcgaggacagtcctgaaaatgctacttctcgaggaaacacagaacctgcggttgagcttgagcccaccacggaaactgcacccagtacatctccctccttagcagttccaagtacaaaaccagctgaagatgaaagtgtggagacccaggtgaatgacagcatcagtgctgagacagcagagcagatggatgtagatcagcaggagcacagtgctgaagagggttctgtttgtgatcccccacccgctaccaaagctgactctgtggacgttgaagtgagggtgccagaaaaccatgcatctaaagttgaaggtgataataccaaagaaagagacttggatagagccagtgagaaggtggaacctagagatgaagatttggtggtagctcagcaaataaatgcccaaaggcccgagccccagtcagacaatgattccagtgccacgtgcagcgctgatgaggatgtggatggagagccagagaggcagagaatgtttcctatggactcaaagccttcactgttaaaccccactggatctatactcgtctcatctccgttaaaaccaaatccactggatctgccacagcttcagcatcgagctgctgttatcccaccaatggtatcctgcaccccatgtaacataccaattggaaccccagtgagcggctatgctctctaccagcgacacattaaagcaatgcatgagtcagcactcctggaggagcagcggcagagacaagaacagatagatttggaatgtagaagttctacaagtccatgtggcacatccaagagtccaaacagagagtgggaagtccttcagcctgctccacatcaagtgataactaatctccctgaaggcgttcggcttccgacaactcgaccaaccaggccaccgccccctctcatcccgtcatccaaaaccacagtggcttcagaaaaaccatcttttataatgggaggctccatctcacagggaacaccaggcacttatttgacttctcataatcaggcttcctacactcaagaaacacccaagccgtcagtgggatctatctctcttggactgccacggcaacaggaatctgccaaatcagctactttgccctacatcaagcaggaagaattttctccccgaagccaaaactcacaacctgagggtctgttggtcagggcccaacatgaaggtgtagtcagaggtaccgcaggagccatacaagaaggaagtataactcggggaactccaaccagcaaaatttcagtggagagcattccatccctacggggctctatcactcagggcaccccggctctgccccagactggcataccaacagaggctttggtgaaggggtccatttcgagaatgcccattgaagacagcagtcctgagaaaggcagagaggaagctgcatccaaaggccatgttatttatgaaggcaaaagtggacatatcttgtcatatgataatattaagaatgcccgagaagggactaggagtccaagaacagctcatgaaatcagtttaaagagaagctatgaatcagtggaaggaaatataaagcaagggatgtcaatgagggagtctcctgtatcagcaccgttagaggggctgatatgccgagcattacccagggggagtcctcattctgacctcaaagaaaggactgtattgtctggctccataatgcaggggacaccaagagcaacaactgaaagctttgaagatggccttaaatatcccaaacaaattaaaagggaaagtcctcccatacgagcatttgaaggtgccattaccaaaggaaaaccatatgatggcatcaccaccatcaaagaaatggggcgttccattcatgagattccaaggcaagatattttaactcaggaaagtcggaaaactccagaagtggtccagagcacacggccgataattgagggttccatttcccagggcacaccaataaagtttgacaacaactcaggtcaatctgccatcaaacacaatgtcaaatccttaatcacggggcctagcaaactatcccgtggaatgcctccgctggaaattgtgccagagaacataaaagtggtagaacggggaaaatatgaggatgtgaaagcaggcgagaccgtgcgttcccggcacacgtcagtggtaagctctggcccctccgttcttaggtccacactgcatgaagctcccaaagcacaactgagccctgggatttatgatgacaccagtgcacggaggacccctgtgagttatcaaaacaccatgtccagaggctcacccatgatgaacagaacttctgatgttacaatttcttctaacaagtctaccaatcatgaaaggaaatcgacactgacccctacccagagggaaagtatcccagcgaagtctccagtgcctggggtggaccctgtcgtgagccacagtccgtttgatccccatcacagaggcagcactgcaggcgaggtttatcggagccacctgcccacgcacttggatccagccatgccttttcacagggctttggatcctgcagcggctgcttacctgtttcagagacagctttcaccaactccaggttacccaagtcagtatcagctttacgcaatggagaacacaagacagacaatcttaaatgattacattacctcacaacagatgcaagtgaacttgcgtccagatgtggccagaggactctccccaagagagcagccactgggtctcccatacccagcaacgagaggaatcattgacctgaccaatatgcctccaacaattttagtgcctcatccagggggaacaagcactcctcccatggacagaatcacttatattcctggtacacagattactttccctcccaggccgtacaactctgcttccatgtctccaggacacccaacacaccttgcagctgctgcaagtgctgagagggaacgggaacgggagcgggagaaggagcgggagcgggaacggattgctgcagcttcctccgacctctacctgcggccaggctcagaacagcctggccgacctggcagtcatggatatgttcgctccccttccccttcagtaagaactcaggagaccatgttgcaacagagacccagtgttttccaaggaaccaatggaaccagtgtaatcacacctttggatccaactgctcagctacgaatcatgccactgcctgctgggggcccttcaataagccaaggcctgccagcctcccgttacaacactgctgcggatgccctggctgctcttgtggatgctgcagcttctgcaccccagatggatgtgtccaaaacaaaagagagtaagcatgaagctgccaggttagaagaaaatttgagaagcaggtcagcagcagttagtgaacagcagcagctagagcagaaaaccctggaggtggagaagagatctgttcagtgtttatacacttcttcagcctttccaagtggcaagccccagcctcattcttcagtagtttattctgaggctgggaaagataaagggcctcctccaaaatccagatatgaggaagagctaaggaccagagggaagactaccattactgcagctaacttcatagacgtgatcatcacccggcaaattgcctcggacaaggatgcgagggaacgtggctctcaaagttcagactcttctagtagcttatcttctcacaggtatgaaacacctagcgatgctattgaggtgataagtcctgccagctcacctgcgccaccccaggagaaactgcagacctatcagccagaggttgttaaggcaaatcaagcggaaaatgatcctaccagacaatatgaaggaccattacatcactatcgaccacagcaggaatcaccatctccccaacaacagctgcccccttcttcacaggcagagggaatggggcaagtgcccaggacccatcggctgatcacacttgctgatcacatctgtcaaattatcacacaagattttgctagaaatcaagtttcctcgcagactccccagcagcctcctacttctacattccagaactcaccttctgctttggtatctacacctgtgaggactaaaacatcaaaccgttacagcccagaatcccaggctcagtctgtccatcatcaaagaccaggttcaagggtctctccagaaaatcttgtggacaaatccaggggaagtaggcctggaaaatccccagagaggagtcacgtctcttcggagccctacgagcccatctccccaccccaggttccggttgtgcatgagaaacaggacagcttgctgctcttgtctcagaggggcgcagagcctgcagagcagaggaatgatgcccgctcaccagggagtataagctacttgccttcattcttcaccaagcttgaaaatacatcacccatggttaaatcaaagaagcaggagatttttcgtaagttgaactcctctggtggaggtgactctgatatggcagctgctcagccaggaactgagatctttaatctgccagcagttactacgtcaggctcagttagctctagaggccattcttttgctgatcctgccagtaatcttgggctggaagacattatcaggaaggctctcatgggaagctttgatgacaaagttgaggatcatggagttgtcatgtcccagcctatgggagtagtgcctggtactgccaacacctcagttgtgaccagtggtgagacacgaagagaggaaggggacccatcacctcattcaggaggagtttgcaaaccaaagctgatcagcaagtcaaacagcaggaaatctaagtctcctatacctgggcaaggctacttaggaacggaacggccctcttcagtctcctctgtacattcagaaggggattaccataggcagacgccagggtgggcctgggaagacaggccctcttcaacaggctcaactcagtttccttataaccctctgactatgcggatgctcagcagtactccaccaacaccgattgcatgtgctccctctgcggtgaaccaagcagctcctcaccaacagaacaggatctgggagcgagagcctgccccactgctctcagcacagtacgagaccctgtcggatagtgatgactgaactgcacaaagtgaggggaacagggtgcaggagagggatctctagtttttgtggtttaatttttagtagcaggtcaaaaacctgccctcctgtgacttattccctgagacttttcaggagagccagcccacagatgatgaagaaatgatggaagttcatttggagagtcaaatgggaaaaaaacaaacaaaaaactgcctttgatacaggcaattcagtggactataataatagtggagggttgagatgtagagtttttaaaaagtgaacagttgctgttcttacatctgtaaagaaaaccataatgtctttaaatcactcttctgtaaatagatgacctttttgcagtgtatatccccttgctgtagtatctggtgtacttatgttcaaatcagcgcatcaactttgggggtgatttttaaaaatctttttgtctatctatctttttaaccctagccttctaaacaacctcatacagcccagttacataatgttggctgtcacgggcattgtacttttatctgatattgtttcctctaaattcagctttccagtgatgtttaaaatcttgtgaaaatgtttagatttttaacacagaccctgtcataaaatctgtacattagggtcaaaaggtaaaagtaacaaattctgccatattgtaaatttccagtgcaggctttaatttttttttttcattagtagcactgaaaaaatattactgcatgggtatgttctagttcagtttataaagttttaaaggcttatttgaggcatacctcactgttacgcacactggtaatttaaccatgcccctaagtattccttttctcctgcatttgatgcagcccaacaaagcttttgttttgaaataaatttgactaccctgtccata

SEQ ID NO: 448609 - DNA, 7735 bp, Homo sapiens
tctcctagggagctactactgctgtctaaacctctgtgaaatggtagcccaaaaaagccatcaaaggatcacaggagataaaacaccaatcagtgtaagctgttaaagatgactgtgattaaataaccaaatatcaaatatccaataaggtaattaaatttagattaaaaaaaaactaagcaccagctgtacatacattattaaatgttctaatctctttcctgattcatagccatattctacatgatgatcaaagactgtccactgtataaccagccatcagataccaaggtgtaccatgagaacatcaagacaaaccaggtgatgaggaaaaaactcattttattttttaaaagaagaaatcatgcaagaaaacaaagggaacaaaaaatctgccagcgttatgatcagctcatggaggcatgggagaaaaaagtggacagaatagaaaataatcctcggaggaaagctaaagaaagcaaaacaagggaatactatgaaaagcagtttccagaaattcgaaaacaaagagaacagcaagaaagatttcagcgagttgggcagaggggagctggtctttcagccaccattgctaggagtgagcatgagatttctgaaattattgatgggctctctgagcaggagaataatgagaaacaaatgcggcagctctctgtgattccacctatgatgtttgatgcagaacaaagacgagtcaagttcattaacatgaatgggcttatggaggaccctatgaaagtgtataaagataggcagtttatgaatgtttggactgaccatgaaaaggagatctttaaggacaagtttatccagcatccaaaaaactttggactaattgcatcatacttggagaggaagagtgttcctgattgtgttttgtattactatttaaccaagaaaaatgagaattataaagccctcgtcagaaggaattatgggaaacgcagaggcagaaaccagcaaattgctcgaccctcgcaagaagaaaaagtagaagaaaaagaagaggataaagcagaaaaaacagaaaaaaaagaagaagaaaagaaagatgaagaggaaaaagatgaaaaagaagactccaaagaaaataccaaggaaaaggacaagatagatggtacagcagaagaaactgaggaaagagagcaagccacaccccgggggcgaaagactgccaacagtcagggccgccgtaagggccggatcaccaggtccatgacaaacgaagctgcagctgccagtgctgcagccgcagcggctactgaagagcccccaccacctctgccaccgccaccagaacccatttctacagagcctgtggagacctctcgatggacagaagaagaaatggaagttgctaaaaaaggtctagtagaacatggtcgtaactgggcagcaattgctaaaatggtgggaacgaaaagtgaagctcaatgtaaaaacttctattttaactataaaaggcgacacaatcttgacaacctcttacagcagcataaacagaaaacttcacgaaaacctcgtgaagagcgagatgtgtctcaatgtgaaagtgtcgcttccactgtttctgctcaggaggatgaagatattgaagcctccaatgaagaagaaaatccagaagacagcgaaggtgcagaaaatagttctgatacagaaagtgctccttctccttcaccagttgaagctgtcaagcccagcgaggacagtcctgaaaatgctacttctcgaggaaacacagaacctgcggttgagcttgagcccaccacggaaactgcacccagtacatctccctccttagcagttccaagtacaaaaccagctgaagatgaaagtgtggagacccaggtgaatgacagcatcagtgctgagacagcagagcagatggatgtagatcagcaggagcacagtgctgaagagggttctgtttgtgatcccccacccgctaccaaagctgactctgtggacgttgaagtgagggtgccagaaaaccatgcatctaaagttgaaggtgataataccaaagaaagagacttggatagagccagtgagaaggtggaacctagagatgaagatttggtggtagctcagcaaataaatgcccaaaggcccgagccccagtcagacaatgattccagtgccacgtgcagcgctgatgaggatgtggatggagagccagagaggcagagaatgtttcctatggactcaaagccttcactgttaaaccccactggatctatactcgtctcatctccgttaaaaccaaatccactggatctgccacagcttcagcatcgagctgctgttatcccaccaatggtatcctgcaccccatgtaacataccaattggaaccccagtgagcggctatgctctctaccagcgacacattaaagcaatgcatgagtcagcactcctggaggagcagcggcagagacaagaacagatagatttggaatgtagaagttctacaagtccatgtggcacatccaagagtccaaacagagagtgggaagtccttcagcctgctccacatcaagtgataactaatctccctgaaggcgttcggcttccgacaactcgaccaaccaggccaccgccccctctcatcccgtcatccaaaaccacagtggcttcagaaaaaccatcttttataatgggaggctccatctcacagggaacaccaggcacttatttgacttctcataatcaggcttcctacactcaagaaacacccaagccgtcagtgggatctatctctcttggactgccacggcaacaggaatctgccaaatcagctactttgccctacatcaagcaggaagaattttctccccgaagccaaaactcacaacctgagggtctgttggtcagggcccaacatgaaggtgtagtcagaggtaccgcaggagccatacaagaaggaagtataactcggggaactccaaccagcaaaatttcagtggagagcattccatccctacggggctctatcactcagggcaccccggctctgccccagactggcataccaacagaggctttggtgaaggggtccatttcgagaatgcccattgaagacagcagtcctgagaaaggcagagaggaagctgcatccaaaggccatgttatttatgaaggcaaaagtggacatatcttgtcatatgataatattaagaatgcccgagaagggactaggagtccaagaacagctcatgaaatcagtttaaagagaagctatgaatcagtggaaggaaatataaagcaagggatgtcaatgagggagtctcctgtatcagcaccgttagaggggctgatatgccgagcattacccagggggagtcctcattctgacctcaaagaaaggactgtattgtctggctccataatgcaggggacaccaagagcaacaactgaaagctttgaagatggccttaaatatcccaaacaaattaaaagggaaagtcctcccatacgagcatttgaaggtgccattaccaaaggaaaaccatatgatggcatcaccaccatcaaagaaatggggcgttccattcatgagattccaaggcaagatattttaactcaggaaagtcggaaaactccagaagtggtccagagcacacggccgataattgagggttccatttcccagggcacaccaataaagtttgacaacaactcaggtcaatctgccatcaaacacaatgtcaaatccttaatcacggggcctagcaaactatcccgtggaatgcctccgctggaaattgtgccagagaacataaaagtggtagaacggggaaaatatgaggatgtgaaagcaggcgagaccgtgcgttcccggcacacgtcagtggtaagctctggcccctccgttcttaggtccacactgcatgaagctcccaaagcacaactgagccctgggatttatgatgacaccagtgcacggaggacccctgtgagttatcaaaacaccatgtccagaggctcacccatgatgaacagaacttctgatgttacaatttcttctaacaagtctaccaatcatgaaaggaaatcgacactgacccctacccagagggaaagtatcccagcgaagtctccagtgcctggggtggaccctgtcgtgagccacagtccgtttgatccccatcacagaggcagcactgcaggcgaggtttatcggagccacctgcccacgcacttggatccagccatgccttttcacagggctttggatcctgcagcggctgcttacctgtttcagagacagctttcaccaactccaggttacccaagtcagtatcagctttacgcaatggagaacacaagacagacaatcttaaatgattacattacctcacaacagatgcaagtgaacttgcgtccagatgtggccagaggactctccccaagagagcagccactgggtctcccatacccagcaacgagaggaatcattgacctgaccaatatgcctccaacaattttagtgcctcatccagggggaacaagcactcctcccatggacagaatcacttatattcctggtacacagattactttccctcccaggccgtacaactctgcttccatgtctccaggacacccaacacaccttgcagctgctgcaagtgctgagagggaacgggaacgggagcgggagaaggagcgggagcgggaacggattgctgcagcttcctccgacctctacctgcggccaggctcagaacagcctggccgacctggcagtcatggatatgttcgctccccttccccttcagtaagaactcaggagaccatgttgcaacagagacccagtgttttccaaggaaccaatggaaccagtgtaatcacacctttggatccaactgctcagctacgaatcatgccactgcctgctgggggcccttcaataagccaaggcctgccagcctcccgttacaacactgctgcggatgccctggctgctcttgtggatgctgcagcttctgcaccccagatggatgtgtccaaaacaaaagagagtaagcatgaagctgccaggttagaagaaaatttgagaagcaggtcagcagcagttagtgaacagcagcagctagagcagaaaaccctggaggtggagaagagatctgttcagtgtttatacacttcttcagcctttccaagtggcaagccccagcctcattcttcagtagtttattctgaggctgggaaagataaagggcctcctccaaaatccagatatgaggaagagctaaggaccagagggaagactaccattactgcagctaacttcatagacgtgatcatcacccggcaaattgcctcggacaaggatgcgagggaacgtggctctcaaagttcagactcttctagtagcttatcttctcacaggtatgaaacacctagcgatgctattgaggtgataagtcctgccagctcacctgcgccaccccaggagaaactgcagacctatcagccagaggttgttaaggcaaatcaagcggaaaatgatcctaccagacaatatgaaggaccattacatcactatcgaccacagcaggaatcaccatctccccaacaacagctgcccccttcttcacaggcagagggaatggggcaagtgcccaggacccatcggctgatcacacttgctgatcacatctgtcaaattatcacacaagattttgctagaaatcaagtttcctcgcagactccccagcagcctcctacttctacattccagaactcaccttctgctttggtatctacacctgtgaggactaaaacatcaaaccgttacagcccagaatcccaggctcagtctgtccatcatcaaagaccaggttcaagggtctctccagaaaatcttgtggacaaatccaggggaagtaggcctggaaaatccccagagaggagtcacgtctcttcggagccctacgagcccatctccccaccccaggttccggttgtgcatgagaaacaggacagcttgctgctcttgtctcagaggggcgcagagcctgcagagcagaggaatgatgcccgctcaccagggagtataagctacttgccttcattcttcaccaagcttgaaaatacatcacccatggttaaatcaaagaagcaggagatttttcgtaagttgaactcctctggtggaggtgactctgatatggcagctgctcagccaggaactgagatctttaatctgccagcagttactacgtcaggctcagttagctctagaggccattcttttgctgatcctgccagtaatcttgggctggaagacattatcaggaaggctctcatgggaagctttgatgacaaagttgaggatcatggagttgtcatgtcccagcctatgggagtagtgcctggtactgccaacacctcagttgtgaccagtggtgagacacgaagagaggaaggggacccatcacctcattcaggaggagtttgcaaaccaaagctgatcagcaagtcaaacagcaggaaatctaagtctcctatacctgggcaaggctacttaggaacggaacggccctcttcagtctcctctgtacattcagaaggggattaccataggcagacgccagggtgggcctgggaagacaggccctcttcaacaggctcaactcagtttccttataaccctctgactatgcggatgctcagcagtactccaccaacaccgattgcatgtgctccctctgcggtgaaccaagcagctcctcaccaacagaacaggatctgggagcgagagcctgccccactgctctcagcacagtacgagaccctgtcggatagtgatgactgaactgcacaaagtgaggggaacagggtgcaggagagggatctctagtttttgtggtttaatttttagtagcaggtcaaaaacctgccctcctgtgacttattccctgagacttttcaggagagccagcccacagatgatgaagaaatgatggaagttcatttggagagtcaaatgggaaaaaaacaaacaaaaaactgcctttgatacaggcaattcagtggactataataatagtggagggttgagatgtagagtttttaaaaagtgaacagttgctgttcttacatctgtaaagaaaaccataatgtctttaaatcactcttctgtaaatagatgacctttttgcagtgtatatccccttgctgtagtatctggtgtacttatgttcaaatcagcgcatcaactttgggggtgatttttaaaaatctttttgtctatctatctttttaaccctagccttctaaacaacctcatacagcccagttacataatgttggctgtcacgggcattgtacttttatctgatattgtttcctctaaattcagctttccagtgatgtttaaaatcttgtgaaaatgtttagatttttaacacagaccctgtcataaaatctgtacattagggtcaaaaggtaaaagtaacaaattctgccatattgtaaatttccagtgcaggctttaatttttttttttcattagtagcactgaaaaaatattactgcatgggtatgttctagttcagtttataaagttttaaaggcttatttgaggcatacctcactgttacgcacactggtaatttaaccatgcccctaagtattccttttctcctgcatttgatgcagcccaacaaagcttttgttttgaaataaatttgactaccctgtccata

SEQ ID NO: 448610 - DNA, 10850 bp, Homo sapiens
gggttgagtcaagatggcggccaaggtggcgaagcagcagccgcggcggcggcggcggctggagtgagcgtccgactcgccgcgccgaacgaggtcccggtgtagggccgcgcgccgtggccgcgtcccactcctcaggccggggcgcacgtcggctcccacgcttagccagctcccggtggtttcctagaaacatgattgtttattggcattgatctcacagtctggtgaggacttctttactgataatgtcaagttcaggttatcctcccaaccaaggagcattcagcacagaacaaagtcgttatcctcctcactctgtccagtatacatttcccaacacccgccaccagcaggagttcgcagtccctgattatcgttcctctcatcttgaagtgagtcaggcatcacagcttttgcagcaacagcagcagcaacagcttcgaaggcgaccttccttgctttcagaatttcacccaggttctgacaggcctcaagaaaggagaactagttatgaaccgtttcatccaggcccatccccagtggatcatgattcactggaatcgaagcgaccacgtctggaacaggtttctgattctcattttcagcgtgtcagtgctgcggttttgcctttagtgcacccgctgccagaagggctgagggcttctgcagatgctaagaaggatccagcattcggaggcaaacatgaagctccatcctctccaatttcggggcaaccatgtggagatgatcaaaatgcttcaccttcaaaactctcaaaggaagagttaatacagagtatggatcgtgtagatcgagaaattgcaaaagtagaacagcagatccttaaactgaaaaagaaacaacaacagcttgaagaagaggcagctaaacctcctgagcctgagaagcccgtgtcccctcctcctgtggagcagaaacaccgcagtattgtccaaattatttatgatgagaatcggaaaaaagcagaagaagctcataaaatttttgaaggtcttggcccaaaagttgaactgccactgtataaccagccatcagataccaaggtgtaccatgagaacatcaagacaaaccaggtgatgaggaaaaaactcattttattttttaaaagaagaaatcatgcaagaaaacaaagggaacaaaaaatctgccagcgttatgatcagctcatggaggcatgggagaaaaaagtggacagaatagaaaataatcctcggaggaaagctaaagaaagcaaaacaagggaatactatgaaaagcagtttccagaaattcgaaaacaaagagaacagcaagaaagatttcagcgagttgggcagaggggagctggtctttcagccaccattgctaggagtgagcatgagatttctgaaattattgatgggctctctgagcaggagaataatgagaaacaaatgcggcagctctctgtgattccacctatgatgtttgatgcagaacaaagacgagtcaagttcattaacatgaatgggcttatggaggaccctatgaaagtgtataaagataggcagtttatgaatgtttggactgaccatgaaaaggagatctttaaggacaagtttatccagcatccaaaaaactttggactaattgcatcatacttggagaggaagagtgttcctgattgtgttttgtattactatttaaccaagaaaaatgagaattataaagccctcgtcagaaggaattatgggaaacgcagaggcagaaaccagcaaattgctcgaccctcgcaagaagaaaaagtagaagaaaaagaagaggataaagcagaaaaaacagaaaaaaaagaagaagaaaagaaagatgaagaggaaaaagatgaaaaagaagactccaaagaaaataccaaggaaaaggacaagatagatggtacagcagaagaaactgaggaaagagagcaagccacaccccgggggcgaaagactgccaacagtcagggccgccgtaagggccggatcaccaggtccatgacaaacgaagctgcagctgccagtgctgcagccgcagcggctactgaagagcccccaccacctctgccaccgccaccagaacccatttctacagagcctgtggagacctctcgatggacagaagaagaaatggaagttgctaaaaaaggtctagtagaacatggtcgtaactgggcagcaattgctaaaatggtgggaacgaaaagtgaagctcaatgtaaaaacttctattttaactataaaaggcgacacaatcttgacaacctcttacagcagcataaacagaaaacttcacgaaaacctcgtgaagagcgagatgtgtctcaatgtgaaagtgtcgcttccactgtttctgctcaggaggatgaagatattgaagcctccaatgaagaagaaaatccagaagacagcgaaggtgcagaaaatagttctgatacagaaagtgctccttctccttcaccagttgaagctgtcaagcccagcgaggacagtcctgaaaatgctacttctcgaggaaacacagaacctgcggttgagcttgagcccaccacggaaactgcacccagtacatctccctccttagcagttccaagtacaaaaccagctgaagatgaaagtgtggagacccaggtgaatgacagcatcagtgctgagacagcagagcagatggatgtagatcagcaggagcacagtgctgaagagggttctgtttgtgatcccccacccgctaccaaagctgactctgtggacgttgaagtgagggtgccagaaaaccatgcatctaaagttgaaggtgataataccaaagaaagagacttggatagagccagtgagaaggtggaacctagagatgaagatttggtggtagctcagcaaataaatgcccaaaggcccgagccccagtcagacaatgattccagtgccacgtgcagcgctgatgaggatgtggatggagagccagagaggcagagaatgtttcctatggactcaaagccttcactgttaaaccccactggatctatactcgtctcatctccgttaaaaccaaatccactggatctgccacagcttcagcatcgagctgctgttatcccaccaatggtatcctgcaccccatgtaacataccaattggaaccccagtgagcggctatgctctctaccagcgacacattaaagcaatgcatgagtcagcactcctggaggagcagcggcagagacaagaacagatagatttggaatgtagaagttctacaagtccatgtggcacatccaagagtccaaacagagagtgggaagtccttcagcctgctccacatcaagtgataactaatctccctgaaggcgttcggcttccgacaactcgaccaaccaggccaccgccccctctcatcccgtcatccaaaaccacagtggcttcagaaaaaccatcttttataatgggaggctccatctcacagggaacaccaggcacttatttgacttctcataatcaggcttcctacactcaagaaacacccaagccgtcagtgggatctatctctcttggactgccacggcaacaggaatctgccaaatcagctactttgccctacatcaagcaggaagaattttctccccgaagccaaaactcacaacctgagggtctgttggtcagggcccaacatgaaggtgtagtcagaggtaccgcaggagccatacaagaaggaagtataactcggggaactccaaccagcaaaatttcagtggagagcattccatccctacggggctctatcactcagggcaccccggctctgccccagactggcataccaacagaggctttggtgaaggggtccatttcgagaatgcccattgaagacagcagtcctgagaaaggcagagaggaagctgcatccaaaggccatgttatttatgaaggcaaaagtggacatatcttgtcatatgataatattaagaatgcccgagaagggactaggagtccaagaacagctcatgaaatcagtttaaagagaagctatgaatcagtggaaggaaatataaagcaagggatgtcaatgagggagtctcctgtatcagcaccgttagaggggctgatatgccgagcattacccagggggagtcctcattctgacctcaaagaaaggactgtattgtctggctccataatgcaggggacaccaagagcaacaactgaaagctttgaagatggccttaaatatcccaaacaaattaaaagggaaagtcctcccatacgagcatttgaaggtgccattaccaaaggaaaaccatatgatggcatcaccaccatcaaagaaatggggcgttccattcatgagattccaaggcaagatattttaactcaggaaagtcggaaaactccagaagtggtccagagcacacggccgataattgagggttccatttcccagggcacaccaataaagtttgacaacaactcaggtcaatctgccatcaaacacaatgtcaaatccttaatcacggggcctagcaaactatcccgtggaatgcctccgctggaaattgtgccagagaacataaaagtggtagaacggggaaaatatgaggatgtgaaagcaggcgagaccgtgcgttcccggcacacgtcagtggtaagctctggcccctccgttcttaggtccacactgcatgaagctcccaaagcacaactgagccctgggatttatgatgacaccagtgcacggaggacccctgtgagttatcaaaacaccatgtccagaggctcacccatgatgaacagaacttctgatgttacaatttcttctaacaagtctaccaatcatgaaaggaaatcgacactgacccctacccagagggaaagtatcccagcgaagtctccagtgcctggggtggaccctgtcgtgagccacagtccgtttgatccccatcacagaggcagcactgcaggcgaggtttatcggagccacctgcccacgcacttggatccagccatgccttttcacagggctttggatcctgcagcggctgcttacctgtttcagagacagctttcaccaactccaggttacccaagtcagtatcagctttacgcaatggagaacacaagacagacaatcttaaatgattacattacctcacaacagatgcaagtgaacttgcgtccagatgtggccagaggactctccccaagagagcagccactgggtctcccatacccagcaacgagaggaatcattgacctgaccaatatgcctccaacaattttagtgcctcatccagggggaacaagcactcctcccatggacagaatcacttatattcctggtacacagattactttccctcccaggccgtacaactctgcttccatgtctccaggacacccaacacaccttgcagctgctgcaagtgctgagagggaacgggaacgggagcgggagaaggagcgggagcgggaacggattgctgcagcttcctccgacctctacctgcggccaggctcagaacagcctggccgacctggcagtcatggatatgttcgctccccttccccttcagtaagaactcaggagaccatgttgcaacagagacccagtgttttccaaggaaccaatggaaccagtgtaatcacacctttggatccaactgctcagctacgaatcatgccactgcctgctgggggcccttcaataagccaaggcctgccagcctcccgttacaacactgctgcggatgccctggctgctcttgtggatgctgcagcttctgcaccccagatggatgtgtccaaaacaaaagagagtaagcatgaagctgccaggttagaagaaaatttgagaagcaggtcagcagcagttagtgaacagcagcagctagagcagaaaaccctggaggtggagaagagatctgttcagtgtttatacacttcttcagcctttccaagtggcaagccccagcctcattcttcagtagtttattctgaggctgggaaagataaagggcctcctccaaaatccagatatgaggaagagctaaggaccagagggaagactaccattactgcagctaacttcatagacgtgatcatcacccggcaaattgcctcggacaaggatgcgagggaacgtggctctcaaagttcagactcttctagtagcttatcttctcacaggtatgaaacacctagcgatgctattgaggtgataagtcctgccagctcacctgcgccaccccaggagaaactgcagacctatcagccagaggttgttaaggcaaatcaagcggaaaatgatcctaccagacaatatgaaggaccattacatcactatcgaccacagcaggaatcaccatctccccaacaacagctgcccccttcttcacaggcagagggaatggggcaagtgcccaggacccatcggctgatcacacttgctgatcacatctgtcaaattatcacacaagattttgctagaaatcaagtttcctcgcagactccccagcagcctcctacttctacattccagaactcaccttctgctttggtatctacacctgtgaggactaaaacatcaaaccgttacagcccagaatcccaggctcagtctgtccatcatcaaagaccaggttcaagggtctctccagaaaatcttgtggacaaatccaggggaagtaggcctggaaaatccccagagaggagtcacgtctcttcggagccctacgagcccatctccccaccccaggttccggttgtgcatgagaaacaggacagcttgctgctcttgtctcagaggggcgcagagcctgcagagcagaggaatgatgcccgctcaccagggagtataagctacttgccttcattcttcaccaagcttgaaaatacatcacccatggttaaatcaaagaagcaggagatttttcgtaagttgaactcctctggtggaggtgactctgatatggcagctgctcagccaggaactgagatctttaatctgccagcagttactacgtcaggctcagttagctctagaggccattcttttgctgatcctgccagtaatcttgggctggaagacattatcaggaaggctctcatgggaagctttgatgacaaagttgaggatcatggagttgtcatgtcccagcctatgggagtagtgcctggtactgccaacacctcagttgtgaccagtggtgagacacgaagagaggaaggggacccatcacctcattcaggaggagtttgcaaaccaaagctgatcagcaagtcaaacagcaggaaatctaagtctcctatacctgggcaaggctacttaggaacggaacggccctcttcagtctcctctgtacattcagaaggggattaccataggcagacgccagggtgggcctgggaagacaggccctcttcaacaggctcaactcagtttccttataaccctctgactatgcggatgctcagcagtactccaccaacaccgattgcatgtgctccctctgcggtgaaccaagcagctcctcaccaacagaacaggatctgggagcgagagcctgccccactgctctcagcacagtacgagaccctgtcggatagtgatgactgaactgcacaaagtgaggggaacagggtgcaggagagggatctctagtttttgtggtttaatttttagtagcaggtcaaaaacctgccctcctgtgacttattccctgagacttttcaggagagccagcccacagatgatgaagaaatgatggaagttcatttggagagtcaaatgggaaaaaaacaaacaaaaaactgcctttgatacaggcaattcagtggactataataatagtggagggttgagatgtagagtttttaaaaagtgaacagttgctgttcttacatctgtaaagaaaaccataatgtctttaaatcactcttctgtaaatagatgacctttttgcagtgtatatccccttgctgtagtatctggtgtacttatgttcaaatcagcgcatcaactttgggggtgatttttaaaaatctttttgtctatctatctttttaaccctagccttctaaacaacctcatacagcccagttacataatgttggctgtcacgggcattgtacttttatctgatattgtttcctctaaattcagctttccagtgatgtttaaaatcttgtgaaaatgtttagatttttaacacagaccctgtcataaaatctgtacattagggtcaaaaggtaaaagtaacaaattctgccatattgtaaatttccagtgcaggctttaatttttttttttcattagtagcactgaaaaaatattactgcatgggtatgttctagttcagtttataaagttttaaaggcttatttgaggcatacctcactgttacgcacactggtaatttaaccatgcccctaagtattccttttctcctgcatttgatgcagcccaacaaagcttttgttttgaaataaatttgactaccctgtccatagctacagtagattatttgtggtttaaggctcctggtgtctcaggttccaaaggaaaagcttacatatttttcccttagtttgaatatatgattggttgggttaaaagataatgatctgtgtagtatttagataagctttatgctgcatcctgaaaaactcatggtgaacacagtcctttttccccatcactatggaccagcatttactctcactttgctcccttgggacaagagtttactgttaaatgttttcatttcacagagtctcaaggtgcaaataatttaaaagactgaattctaaactaattatggtactagagggccagttttatctttcattaagaattgcttgctgaattttaaagtttttttcatacaatttatcatagcatttaagtatctttctataacatagatactaacagttttgggagaatgccactggtaactggaaaggggagaaacagatctctcaggatgataaaaattagcactttacagactttcaagtagacctaaacttttaaacaaaagtactcaaggcttttaaggaagcagctctgtgattagctactgaccaagaccctcctatcactggtgtctaatccctatgttacagatgaagacacaggtttagtactttgcccatatagttaaattagtgacagagataggccataagcccacatttgtcttcagtcaaagctttcactcctgtccctgttccactcctgtatacctgaggtccccaacataaactttagatcaggcttagtggtcagcattcctagtacttggaaagttggtattttttacaacagatatatgtaaacatataaaaatttcaaaatgaatgaaaaacagtgactaaatgttccacttcacagttttctgctgaatttttttttttcaggtactggtaatattttagagtttgttaataatttatattgccaacctaccataaaagagattatgatggtatttttctatgaccctgagggtcttaagctattctgagtcagaatacagttgacccttgaacaacacgggtttgaactgtgtgggtccacttatacatggattttcttccacctctgccacccaagatagcaagaccaaccccttctcatcctcagcctattcaacatgaagatgacaaggatgaagaccttcatgatgatccacttccacttaatgaatagtaaatatattttctcttccttataatcttaacaaacattttctcttctctagcttactttattgtaagaatacagtatataatacatatacaaaatatgtgtcaatcgactatgttatccgtaagacttctggtcagcagtaggccatgagtagttaagttttggaggagtcaaagttagatgtggatttttgactacttagggggtctatgcccctaactcctgcattatttgaaggtcaaccgtatagtttctgagaacatgtcagatcagagcctaacttcttactcttgcagttctacctgaggacccgaaggtgaggtgctgtgaaccactccctccatcctcatcataatgcatgtgcgtattactttatttaccatcacctggagaagaaatctcagaatgagagttaaaatccaataatagttcttgggttcaaaataaatgaaaggacagaattctcacatggtttacctatggaggttcaccttatcatgatttaagtggtaagcacagagcagcactgacaacttactgtggttcactgcaaaccaaaacatgatattctttgtagacttagatttcagtgttctgacactatatcccttacaccgtgatttttttagcacccagaactaaattaaggtcttcctaaatactcttcataaaagtattctgacagccagttttccactgcatgtttatgactgcaaatttcataatgcttttaattttggtacactgagtgattctattttaaaaatatttatgcccagaaaactccagtgaccattggacagttaaaaaattttaatgacacgattttaaccaattcacttttgaatttagaccaatcagtaaaggagatcagtcctccttttgcttcagtaccttattttacaacagtgtaaatgaactgtaatgaaaacacccacatgaagagactgtcctgaaaactcctagtgtttccaacaacgagaccatgagctgagtcactgtggatgatttaaaattaataaataaataaaacttggaatgaaaaacctttcagtaacccctgcagttgtgaaaaggtaaaaacattctcaatgcaaaaggtgagtggttgacattaatttttttaagaaatca

SEQ ID NO: 448611 - DNA, 6519 bp, Homo sapiens
tttttaatgtgaccatcagaaaaattaaaattacagatgtgattacattatatgtctattggatggagccgttctagagtgtcagttcagctgggtaaaaggaaattcacaggaagaggcttctagaaatacaccagaatgtcatcatttataggaatgttttttgtttagttttattgttcgttctttttcaatttcatataaattattttcagacattaaaatcctttatgcttttagtttcagaaggtcaagataatttgatctttcacttttatactctgtaggaaactttagccttctcaatggctgtaaatacttcaatgaggtcatcaaaggagtagaattcatcctaaacaactactttcaaacatggtttctatcaccacctgaaacatgttcattatcagatttttatgctgtatcattatctttaaggtgcagaaaatagttctgatacagaaagtgctccttctccttcaccagttgaagctgtcaagcccagcgaggacagtcctgaaaatgctacttctcgaggaaacacagaacctgcggttgagcttgagcccaccacggaaactgcacccagtacatctccctccttagcagttccaagtacaaaaccagctgaagatgaaagtgtggagacccaggtgaatgacagcatcagtgctgagacagcagagcagatggatgtagatcagcaggagcacagtgctgaagagggttctgtttgtgatcccccacccgctaccaaagctgactctgtggacgttgaagtgagggtgccagaaaaccatgcatctaaagttgaaggtgataataccaaagaaagagacttggatagagccagtgagaaggtggaacctagagatgaagatttggtggtagctcagcaaataaatgcccaaaggcccgagccccagtcagacaatgattccagtgccacgtgcagcgctgatgaggatgtggatggagagccagagaggcagagaatgtttcctatggactcaaagccttcactgttaaaccccactggatctatactcgtctcatctccgttaaaaccaaatccactggatctgccacagcttcagcatcgagctgctgttatcccaccaatggtatcctgcaccccatgtaacataccaattggaaccccagtgagcggctatgctctctaccagcgacacattaaagcaatgcatgagtcagcactcctggaggagcagcggcagagacaagaacagatagatttggaatgtagaagttctacaagtccatgtggcacatccaagagtccaaacagagagtgggaagtccttcagcctgctccacatcaagtgataactaatctccctgaaggcgttcggcttccgacaactcgaccaaccaggccaccgccccctctcatcccgtcatccaaaaccacagtggcttcagaaaaaccatcttttataatgggaggctccatctcacagggaacaccaggcacttatttgacttctcataatcaggcttcctacactcaagaaacacccaagccgtcagtgggatctatctctcttggactgccacggcaacaggaatctgccaaatcagctactttgccctacatcaagcaggaagaattttctccccgaagccaaaactcacaacctgagggtctgttggtcagggcccaacatgaaggtgtagtcagaggtaccgcaggagccatacaagaaggaagtataactcggggaactccaaccagcaaaatttcagtggagagcattccatccctacggggctctatcactcagggcaccccggctctgccccagactggcataccaacagaggctttggtgaaggggtccatttcgagaatgcccattgaagacagcagtcctgagaaaggcagagaggaagctgcatccaaaggccatgttatttatgaaggcaaaagtggacatatcttgtcatatgataatattaagaatgcccgagaagggactaggagtccaagaacagctcatgaaatcagtttaaagagaagctatgaatcagtggaaggaaatataaagcaagggatgtcaatgagggagtctcctgtatcagcaccgttagaggggctgatatgccgagcattacccagggggagtcctcattctgacctcaaagaaaggactgtattgtctggctccataatgcaggggacaccaagagcaacaactgaaagctttgaagatggccttaaatatcccaaacaaattaaaagggaaagtcctcccatacgagcatttgaaggtgccattaccaaaggaaaaccatatgatggcatcaccaccatcaaagaaatggggcgttccattcatgagattccaaggcaagatattttaactcaggaaagtcggaaaactccagaagtggtccagagcacacggccgataattgagggttccatttcccagggcacaccaataaagtttgacaacaactcaggtcaatctgccatcaaacacaatgtcaaatccttaatcacggggcctagcaaactatcccgtggaatgcctccgctggaaattgtgccagagaacataaaagtggtagaacggggaaaatatgaggatgtgaaagcaggcgagaccgtgcgttcccggcacacgtcagtggtaagctctggcccctccgttcttaggtccacactgcatgaagctcccaaagcacaactgagccctgggatttatgatgacaccagtgcacggaggacccctgtgagttatcaaaacaccatgtccagaggctcacccatgatgaacagaacttctgatgttacaatttcttctaacaagtctaccaatcatgaaaggaaatcgacactgacccctacccagagggaaagtatcccagcgaagtctccagtgcctggggtggaccctgtcgtgagccacagtccgtttgatccccatcacagaggcagcactgcaggcgaggtttatcggagccacctgcccacgcacttggatccagccatgccttttcacagggctttggatcctgcagcggctgcttacctgtttcagagacagctttcaccaactccaggttacccaagtcagtatcagctttacgcaatggagaacacaagacagacaatcttaaatgattacattacctcacaacagatgcaagtgaacttgcgtccagatgtggccagaggactctccccaagagagcagccactgggtctcccatacccagcaacgagaggaatcattgacctgaccaatatgcctccaacaattttagtgcctcatccagggggaacaagcactcctcccatggacagaatcacttatattcctggtacacagattactttccctcccaggccgtacaactctgcttccatgtctccaggacacccaacacaccttgcagctgctgcaagtgctgagagggaacgggaacgggagcgggagaaggagcgggagcgggaacggattgctgcagcttcctccgacctctacctgcggccaggctcagaacagcctggccgacctggcagtcatggatatgttcgctccccttccccttcagtaagaactcaggagaccatgttgcaacagagacccagtgttttccaaggaaccaatggaaccagtgtaatcacacctttggatccaactgctcagctacgaatcatgccactgcctgctgggggcccttcaataagccaaggcctgccagcctcccgttacaacactgctgcggatgccctggctgctcttgtggatgctgcagcttctgcaccccagatggatgtgtccaaaacaaaagagagtaagcatgaagctgccaggttagaagaaaatttgagaagcaggtcagcagcagttagtgaacagcagcagctagagcagaaaaccctggaggtggagaagagatctgttcagtgtttatacacttcttcagcctttccaagtggcaagccccagcctcattcttcagtagtttattctgaggctgggaaagataaagggcctcctccaaaatccagatatgaggaagagctaaggaccagagggaagactaccattactgcagctaacttcatagacgtgatcatcacccggcaaattgcctcggacaaggatgcgagggaacgtggctctcaaagttcagactcttctagtagcttatcttctcacaggtatgaaacacctagcgatgctattgaggtgataagtcctgccagctcacctgcgccaccccaggagaaactgcagacctatcagccagaggttgttaaggcaaatcaagcggaaaatgatcctaccagacaatatgaaggaccattacatcactatcgaccacagcaggaatcaccatctccccaacaacagctgcccccttcttcacaggcagagggaatggggcaagtgcccaggacccatcggctgatcacacttgctgatcacatctgtcaaattatcacacaagattttgctagaaatcaagtttcctcgcagactccccagcagcctcctacttctacattccagaactcaccttctgctttggtatctacacctgtgaggactaaaacatcaaaccgttacagcccagaatcccaggctcagtctgtccatcatcaaagaccaggttcaagggtctctccagaaaatcttgtggacaaatccaggggaagtaggcctggaaaatccccagagaggagtcacgtctcttcggagccctacgagcccatctccccaccccaggttccggttgtgcatgagaaacaggacagcttgctgctcttgtctcagaggggcgcagagcctgcagagcagaggaatgatgcccgctcaccagggagtataagctacttgccttcattcttcaccaagcttgaaaatacatcacccatggttaaatcaaagaagcaggagatttttcgtaagttgaactcctctggtggaggtgactctgatatggcagctgctcagccaggaactgagatctttaatctgccagcagttactacgtcaggctcagttagctctagaggccattcttttgctgatcctgccagtaatcttgggctggaagacattatcaggaaggctctcatgggaagctttgatgacaaagttgaggatcatggagttgtcatgtcccagcctatgggagtagtgcctggtactgccaacacctcagttgtgaccagtggtgagacacgaagagaggaaggggacccatcacctcattcaggaggagtttgcaaaccaaagctgatcagcaagtcaaacagcaggaaatctaagtctcctatacctgggcaaggctacttaggaacggaacggccctcttcagtctcctctgtacattcagaaggggattaccataggcagacgccagggtgggcctgggaagacaggccctcttcaacaggctcaactcagtttccttataaccctctgactatgcggatgctcagcagtactccaccaacaccgattgcatgtgctccctctgcggtgaaccaagcagctcctcaccaacagaacaggatctgggagcgagagcctgccccactgctctcagcacagtacgagaccctgtcggatagtgatgactgaactgcacaaagtgaggggaacagggtgcaggagagggatctctagtttttgtggtttaatttttagtagcaggtcaaaaacctgccctcctgtgacttattccctgagacttttcaggagagccagcccacagatgatgaagaaatgatggaagttcatttggagagtcaaatgggaaaaaaacaaacaaaaaactgcctttgatacaggcaattcagtggactataataatagtggagggttgagatgtagagtttttaaaaagtgaacagttgctgttcttacatctgtaaagaaaaccataatgtctttaaatcactcttctgtaaatagatgacctttttgcagtgtatatccccttgctgtagtatctggtgtacttatgttcaaatcagcgcatcaactttgggggtgatttttaaaaatctttttgtctatctatctttttaaccctagccttctaaacaacctcatacagcccagttacataatgttggctgtcacgggcattgtacttttatctgatattgtttcctctaaattcagctttccagtgatgtttaaaatcttgtgaaaatgtttagatttttaacacagaccctgtcataaaatctgtacattagggtcaaaaggtaaaagtaacaaattctgccatattgtaaatttccagtgcaggctttaatttttttttttcattagtagcactgaaaaaatattactgcatgggtatgttctagttcagtttataaagttttaaaggcttatttgaggcatacctcactgttacgcacactggtaatttaaccatgcccctaagtattccttttctcctgcatttgatgcagcccaacaaagcttttgttttgaaataaatttgactaccctgtccata

SEQ ID NO: 448612 - DNA, 6990 bp, Homo sapiens
ggtgacatcgtcacagtgggcgagtgccggcctctgagcaagacagtgcgcttcaacgtgctcaaggtcaccaaggctgccggcaccaagaagcagttccagaagttctgaggctggacatcggcccgctccccacatagttcagcgtctgacgtcagacgctgaactatgccacgtgcagcgctgatgaggatgtggatggagagccagagaggcagagaatgtttcctatggactcaaagccttcactgttaaaccccactggatctatactcgtctcatctccgttaaaaccaaatccactggatctgccacagcttcagcatcgagctgctgttatcccaccaatggtatcctgcaccccatgtaacataccaattggaaccccagtgagcggctatgctctctaccagcgacacattaaagcaatgcatgagtcagcactcctggaggagcagcggcagagacaagaacagatagatttggaatgtagaagttctacaagtccatgtggcacatccaagagtccaaacagagagtgggaagtccttcagcctgctccacatcaagtgataactaatctccctgaaggcgttcggcttccgacaactcgaccaaccaggccaccgccccctctcatcccgtcatccaaaaccacagtggcttcagaaaaaccatcttttataatgggaggctccatctcacagggaacaccaggcacttatttgacttctcataatcaggcttcctacactcaagaaacacccaagccgtcagtgggatctatctctcttggactgccacggcaacaggaatctgccaaatcagctactttgccctacatcaagcaggaagaattttctccccgaagccaaaactcacaacctgagggtctgttggtcagggcccaacatgaaggtgtagtcagaggtaccgcaggagccatacaagaaggaagtataactcggggaactccaaccagcaaaatttcagtggagagcattccatccctacggggctctatcactcagggcaccccggctctgccccagactggcataccaacagaggctttggtgaaggggtccatttcgagaatgcccattgaagacagcagtcctgagaaaggcagagaggaagctgcatccaaaggccatgttatttatgaaggcaaaagtggacatatcttgtcatatgataatattaagaatgcccgagaagggactaggagtccaagaacagctcatgaaatcagtttaaagagaagctatgaatcagtggaaggaaatataaagcaagggatgtcaatgagggagtctcctgtatcagcaccgttagaggggctgatatgccgagcattacccagggggagtcctcattctgacctcaaagaaaggactgtattgtctggctccataatgcaggggacaccaagagcaacaactgaaagctttgaagatggccttaaatatcccaaacaaattaaaagggaaagtcctcccatacgagcatttgaaggtgccattaccaaaggaaaaccatatgatggcatcaccaccatcaaagaaatggggcgttccattcatgagattccaaggcaagatattttaactcaggaaagtcggaaaactccagaagtggtccagagcacacggccgataattgagggttccatttcccagggcacaccaataaagtttgacaacaactcaggtcaatctgccatcaaacacaatgtcaaatccttaatcacggggcctagcaaactatcccgtggaatgcctccgctggaaattgtgccagagaacataaaagtggtagaacggggaaaatatgaggatgtgaaagcaggcgagaccgtgcgttcccggcacacgtcagtggtaagctctggcccctccgttcttaggtccacactgcatgaagctcccaaagcacaactgagccctgggatttatgatgacaccagtgcacggaggacccctgtgagttatcaaaacaccatgtccagaggctcacccatgatgaacagaacttctgatgttacaatttcttctaacaagtctaccaatcatgaaaggaaatcgacactgacccctacccagagggaaagtatcccagcgaagtctccagtgcctggggtggaccctgtcgtgagccacagtccgtttgatccccatcacagaggcagcactgcaggcgaggtttatcggagccacctgcccacgcacttggatccagccatgccttttcacagggctttggatcctgcagcggctgcttacctgtttcagagacagctttcaccaactccaggttacccaagtcagtatcagctttacgcaatggagaacacaagacagacaatcttaaatgattacattacctcacaacagatgcaagtgaacttgcgtccagatgtggccagaggactctccccaagagagcagccactgggtctcccatacccagcaacgagaggaatcattgacctgaccaatatgcctccaacaattttagtgcctcatccagggggaacaagcactcctcccatggacagaatcacttatattcctggtacacagattactttccctcccaggccgtacaactctgcttccatgtctccaggacacccaacacaccttgcagctgctgcaagtgctgagagggaacgggaacgggagcgggagaaggagcgggagcgggaacggattgctgcagcttcctccgacctctacctgcggccaggctcagaacagcctggccgacctggcagtcatggatatgttcgctccccttccccttcagtaagaactcaggagaccatgttgcaacagagacccagtgttttccaaggaaccaatggaaccagtgtaatcacacctttggatccaactgctcagctacgaatcatgccactgcctgctgggggcccttcaataagccaaggcctgccagcctcccgttacaacactgctgcggatgccctggctgctcttgtggatgctgcagcttctgcaccccagatggatgtgtccaaaacaaaagagagtaagcatgaagctgccaggttagaagaaaatttgagaagcaggtcagcagcagttagtgaacagcagcagctagagcagaaaaccctggaggtggagaagagatctgttcagtgtttatacacttcttcagcctttccaagtggcaagccccagcctcattcttcagtagtttattctgaggctgggaaagataaagggcctcctccaaaatccagatatgaggaagagctaaggaccagagggaagactaccattactgcagctaacttcatagacgtgatcatcacccggcaaattgcctcggacaaggatgcgagggaacgtggctctcaaagttcagactcttctagtagcttatcttctcacaggtatgaaacacctagcgatgctattgaggtgataagtcctgccagctcacctgcgccaccccaggagaaactgcagacctatcagccagaggttgttaaggcaaatcaagcggaaaatgatcctaccagacaatatgaaggaccattacatcactatcgaccacagcaggaatcaccatctccccaacaacagctgcccccttcttcacaggcagagggaatggggcaagtgcccaggacccatcggctgatcacacttgctgatcacatctgtcaaattatcacacaagattttgctagaaatcaagtttcctcgcagactccccagcagcctcctacttctacattccagaactcaccttctgctttggtatctacacctgtgaggactaaaacatcaaaccgttacagcccagaatcccaggctcagtctgtccatcatcaaagaccaggttcaagggtctctccagaaaatcttgtggacaaatccaggggaagtaggcctggaaaatccccagagaggagtcacgtctcttcggagccctacgagcccatctccccaccccaggttccggttgtgcatgagaaacaggacagcttgctgctcttgtctcagaggggcgcagagcctgcagagcagaggaatgatgcccgctcaccagggagtataagctacttgccttcattcttcaccaagcttgaaaatacatcacccatggttaaatcaaagaagcaggagatttttcgtaagttgaactcctctggtggaggtgactctgatatggcagctgctcagccaggaactgagatctttaatctgccagcagttactacgtcaggctcagttagctctagaggccattcttttgctgatcctgccagtaatcttgggctggaagacattatcaggaaggctctcatgggaagctttgatgacaaagttgaggatcatggagttgtcatgtcccagcctatgggagtagtgcctggtactgccaacacctcagttgtgaccagtggtgagacacgaagagaggaaggggacccatcacctcattcaggaggagtttgcaaaccaaagctgatcagcaagtcaaacagcaggaaatctaagtctcctatacctgggcaaggctacttaggaacggaacggccctcttcagtctcctctgtacattcagaaggggattaccataggcagacgccagggtgggcctgggaagacaggccctcttcaacaggctcaactcagtttccttataaccctctgactatgcggatgctcagcagtactccaccaacaccgattgcatgtgctccctctgcggtgaaccaagcagctcctcaccaacagaacaggatctgggagcgagagcctgccccactgctctcagcacagtacgagaccctgtcggatagtgatgactgaactgcacaaagtgaggggaacagggtgcaggagagggatctctagtttttgtggtttaatttttagtagcaggtcaaaaacctgccctcctgtgacttattccctgagacttttcaggagagccagcccacagatgatgaagaaatgatggaagttcatttggagagtcaaatgggaaaaaaacaaacaaaaaactgcctttgatacaggcaattcagtggactataataatagtggagggttgagatgtagagtttttaaaaagtgaacagttgctgttcttacatctgtaaagaaaaccataatgtctttaaatcactcttctgtaaatagatgacctttttgcagtgtatatccccttgctgtagtatctggtgtacttatgttcaaatcagcgcatcaactttgggggtgatttttaaaaatctttttgtctatctatctttttaaccctagccttctaaacaacctcatacagcccagttacataatgttggctgtcacgggcattgtacttttatctgatattgtttcctctaaattcagctttccagtgatgtttaaaatcttgtgaaaatgtttagatttttaacacagaccctgtcataaaatctgtacattagggtcaaaaggtaaaagtaacaaattctgccatattgtaaatttccagtgcaggctttaatttttttttttcagtgctactaatgaaaaaaaaaactcgtgccgaattcggcacgagagaacaaggggtctgtggaaatcatgagaaaggacttgaatgacgcccgggacctgcatggccaggcagagtcagcagctgcagtgtggaagggacacgtgatggaccgtaggaagaaggcactgaccgactacaagaagctgcgggccttctttgtggaggaggaggagcatttcctgcaggaggctgagaaggaggaggggctccctgaggacgagctggctgaccccactgagcggttcaggtcactgctgcaggcggtctcggagctggagaagaagcatcgcaacctgggcctcagcatgctgctgcagtgatggcgccaacccgtggcagtcccagagctggaggcaggaggatggatcctcatctccatgggaagtgtcagcgtgtggctgccagggaagcgtggcaggcgcctggccttgggtccatctacatagttgcgtgtttcaacaatgtccatttatccttcaccccgaggcgtgttttgggggctgcaaacacctcccggtagaggctggacctgaggacccttcccacctgtgcccgtcccttcctgaagtcctagccacagcccatcctccatgagtcccggcagctctgggtcatgcccttccctggtcacccatctgcccctcacccgtcatccagggaccagaccctgcaccttccatgtgggcccacaaatccttggcaggtacctgaggtgcaccattgagtgtcggatttggggttagcatccagaaagaagaatgcgcatgacgctctgtgaaggctggaactcaggtcttcagggagagaaaggaagactggattgccccttgatgcctcctgaggaggcggcccccctcttgaggtgggcgtgggcccggcccagccttatccaagtcgctctgtccacctcccccttcctggcccccaccccactcctgtgcctcccaggagccctccctgtgttccacctgcctccgcagaaggaagcctctttctctgtttccctgggtgagggggctggcaggtggctaaccccatttagcatttccaggccctgccatggtgtctcatcttgctgttatctctagctctttccctcctcccatttcctttagtagttgaattttgcaaagcttgtagcagtagctcagttgcctgcagcatccttgtgtgtagataaattagtcgacagaaaatcagcactggggacaggattgcaaagtcggggaaatagatgcagacagttgttgagatttggggatagccgggcttgtgagcggtgcccatttccagatgaagcctttcagcccttttgagtccccggcccttggtgcgatgtttgtgagtttgacctgcccagcgtgtgggctggctcaatgctgaataaagtgggtttgtgtc

SEQ ID NO: 448613 - DNA, 10807 bp, Homo sapiens
gggttgagtcaagatggcggccaaggtggcgaagcagcagccgcggcggcggcggcggctggagtgagcgtccgactcgccgcgccgaacgaggtcccggtgtagggccgcgcgccgtggccgcgtcccactcctcaggccggggcgcacgtcggctcccacgcttagccagctcccggtggtttcctagaaacatgattgtttattggcattgatctcacagtctggtgaggacttctttactgataatgtcaagttcaggttatcctcccaaccaaggagcattcagcacagaacaaagtcgttatcctcctcactctgtccagtatacatttcccaacacccgccaccagcaggagttcgcagtccctgattatcgttcctctcatcttgaagtgagtcaggcatcacagcttttgcagcaacagcagcagcaacagcttcgaaggcgaccttccttgctttcagaatttcacccaggttctgacaggcctcaagaaaggagaactagttatgaaccgtttcatccaggcccatccccagtggatcatgattcactggaatcgaagcgaccacgtctggaacaggtttctgattctcattttcagcgtgtcagtgctgcggttttgcctttagtgcacccgctgccagaagggctgagggcttctgcagatgctaagaaggatccagcattcggaggcaaacatgaagctccatcctctccaatttcggggcaaccatgtggagatgatcaaaatgcttcaccttcaaaactctcaaaggaagagttaatacagagtatggatcgtgtagatcgagaaattgcaaaagtagaacagcagatccttaaactgaaaaagaaacaacaacagcttgaagaagaggcagctaaacctcctgagcctgagaagcccgtgtcccctcctcctgtggagcagaaacaccgcagtattgtccaaattatttatgatgagaatcggaaaaaagcagaagaagctcataaaatttttgaaggtcttggcccaaaagttgaactgccactgtataaccagccatcagataccaaggtgtaccatgagaacatcaagacaaaccaggtgatgaggaaaaaactcattttattttttaaaagaagaaatcatgcaagaaaacaaagggaacaaaaaatctgccagcgttatgatcagctcatggaggcatgggagaaaaaagtggacagaatagaaaataatcctcggaggaaagctaaagaaagcaaaacaagggaatactatgaaaagcagtttccagaaattcgaaaacaaagagaacagcaagaaagatttcagcgagttgggcagaggggagctggtctttcagccaccattgctaggagtgagcatgagatttctgaaattattgatgggctctctgagcaggagaataatgagaaacaaatgcggcagctctctgtgattccacctatgatgtttgatgcagaacaaagacgagtcaagttcattaacatgaatgggcttatggaggaccctatgaaagtgtataaagataggcagtttatgaatgtttggactgaccatgaaaaggagatctttaaggacaagtttatccagcatccaaaaaactttggactaattgcatcatacttggagaggaagagtgttcctgattgtgttttgtattactatttaaccaagaaaaatgagaattataaagccctcgtcagaaggaattatgggaaacgcagaggcagaaaccagcaaattgctcgaccctcgcaagaagaaaaagtagaagaaaaagaagaggataaagcagaaaaaacagaaaaaaaagaagaagaaaagaaagatgaagaggaaaaagatgaaaaagaagactccaaagaaaataccaaggaaaaggacaagatagatggtacagcagaagaaactgaggaaagagagcaagccacaccccgggggcgaaagactgccaacagtcagggccgccgtaagggccggatcaccaggtccatgacaaacgaagctgcagctgccagtgctgcagccgcagcggctactgaagagcccccaccacctctgccaccgccaccagaacccatttctacagagcctgtggagacctctcgatggacagaagaagaaatggaagttgctaaaaaaggtctagtagaacatggtcgtaactgggcagcaattgctaaaatggtgggaacgaaaagtgaagctcaatgtaaaaacttctattttaactataaaaggcgacacaatcttgacaacctcttacagcagcataaacagaaaacttcacgaaaacctcgtgaagagcgagatgtgtctcaatgtgaaagtgtcgcttccactgtttctgctcaggaggatgaagatattgaagcctccaatgaagaagaaaatccagaagacagcgaaggtgcagaaaatagttctgatacagaaagtgctccttctccttcaccagttgaagctgtcaagcccagcgaggacagtcctgaaaatgctacttctcgaggaaacacagaacctgcggttgagcttgagcccaccacggaaactgcacccagtacatctccctccttagcagttccaagtacaaaaccagctgaagatgaaagtgtggagacccaggtgaatgacagcatcagtgctgagacagcagagcagatggatgtagatcagcaggagcacagtgctgaagagggttctgtttgtgatcccccacccgctaccaaagctgactctgtggacgttgaagtgagggtgccagaaaaccatgcatctaaagttgaaggtgataataccaaagaaagagacttggatagagccagtgagaaggtggaacctagagatgaagatttggtggtagctcagcaaataaatgcccaaaggcccgagccccagtcagacaatgattccagtgccacgtgcagcgctgatgaggatgtggatggagagccagagaggcagagaatgtttcctatggactcaaagccttcactgttaaaccccactggatctatactcgtctcatctccgttaaaaccaaatccactggatctgccacagcttcagcatcgagctgctgttatcccaccaatggtatcctgcaccccatgtaacataccaattggaaccccagtgagcggctatgctctctaccagcgacacattaaagcaatgcatgagtcagcactcctggaggagcagcggcagagacaagaacagatagatttggaatgtagaagttctacaagtccatgtggcacatccaagagtccaaacagagagtgggaagtccttcagcctgctccacatcaagtgataactaatctccctgaaggcgttcggcttccgacaactcgaccaaccaggccaccgccccctctcatcccgtcatccaaaaccacagtggcttcagaaaaaccatcttttataatgggaggctccatctcacagggaacaccaggcacttatttgacttctcataatcaggcttcctacactcaagaaacacccaagccgtcagtgggatctatctctcttggactgccacggcaacaggaatctgccaaatcagctactttgccctacatcaagcaggaagaattttctccccgaagccaaaactcacaacctgagggtctgttggtcagggcccaacatgaaggtgtagtcagaggtaccgcaggagccatacaagaaggaagtataactcggggaactccaaccagcaaaatttcagtggagagcattccatccctacggggctctatcactcagggcaccccggctctgccccagactggcataccaacagaggctttggtgaaggggtccatttcgagaatgcccattgaagacagcagtcctgagaaaggcagagaggaagctgcatccaaaggccatgttatttatgaaggcaaaagtggacatatcttgtcatatgataatattaagaatgcccgagaagggactaggagtccaagaacagctcatgaaatcagtttaaagagaagctatgaatcagtggaaggaaatataaagcaagggatgtcaatgagggagtctcctgtatcagcaccgttagaggggctgatatgccgagcattacccagggggagtcctcattctgacctcaaagaaaggactgtattgtctggctccataatgcaggggacaccaagagcaacaactgaaagctttgaagatggccttaaatatcccaaacaaattaaaagggaaagtcctcccatacgagcatttgaaggtgccattaccaaaggaaaaccatatgatggcatcaccaccatcaaagaaatggggcgttccattcatgagattccaaggcaagatattttaactcaggaaagtcggaaaactccagaagtggtccagagcacacggccgataattgagggttccatttcccagggcacaccaataaagtttgacaacaactcaggtcaatctgccatcaaacacaatgtcaaatccttaatcacggggcctagcaaactatcccgtggaatgcctccgctggaaattgtgccagagaacataaaagtggtagaacggggaaaatatgaggatgtgaaagcaggcgagaccgtgcgttcccggcacacgtcagtggtaagctctggcccctccgttcttaggtccacactgcatgaagctcccaaagcacaactgagccctgggatttatgatgacaccagtgcacggaggacccctgtgagttatcaaaacaccatgtccagaggctcacccatgatgaacagaacttctgatgttacaatttcttctaacaagtctaccaatcatgaaaggaaatcgacactgacccctacccagagggaaagtatcccagcgaagtctccagtgcctggggtggaccctgtcgtgagccacagtccgtttgatccccatcacagaggcagcactgcaggcgaggtttatcggagccacctgcccacgcacttggatccagccatgccttttcacagggctttggatcctgcagcggctgcttacctgtttcagagacagctttcaccaactccaggttacccaagtcagtatcagctttacgcaatggagaacacaagacagacaatcttaaatgattacattacctcacaacagatgcaagtgaacttgcgtccagatgtggccagaggactctccccaagagagcagccactgggtctcccatacccagcaacgagaggaatcattgacctgaccaatatgcctccaacaattttagtgcctcatccagggggaacaagcactcctcccatggacagaatcacttatattcctggtacacagattactttccctcccaggccgtacaactctgcttccatgtctccaggacacccaacacaccttgcagctgctgcaagtgctgagagggaacgggaacgggagcgggagaaggagcgggagcgggaacggattgctgcagcttcctccgacctctacctgcggccaggctcagaacagcctggccgacctggcagtcatggatatgttcgctccccttccccttcagtaagaactcaggagaccatgttgcaacagagacccagtgttttccaaggaaccaatggaaccagtgtaatcacacctttggatccaactgctcagctacgaatcatgccactgcctgctgggggcccttcaataagccaaggcctgccagcctcccgttacaacactgctgcggatgccctggctgctcttgtggatgctgcagcttctgcaccccagatggatgtgtccaaaacaaaagagagtaagcatgaagctgccaggttagaagaaaatttgagaagcaggtcagcagcagttagtgaacagcagcagctagagcagaaaaccctggaggtggagaagagatctgttcagtgtttatacacttcttcagcctttccaagtggcaagccccagcctcattcttcagtagtttattctgaggctgggaaagataaagggcctcctccaaaatccagatatgaggaagagctaaggaccagagggaagactaccattactgcagctaacttcatagacgtgatcatcacccggcaaattgcctcggacaaggatgcgagggaacgtggctctcaaagttcagactcttctagtagcttatcttctcacaggtatgaaacacctagcgatgctattgaggtgataagtcctgccagctcacctgcgccaccccaggagaaactgcagacctatcagccagaggttgttaaggcaaatcaagcggaaaatgatcctaccagacaatatgaaggaccattacatcactatcgaccacagcaggaatcaccatctccccaacaacagctgcccccttcttcacaggcagagggaatggggcaagtgcccaggacccatcggctgatcacacttgctgatcacatctgtcaaattatcacacaagattttgctagaaatcaagtttcctcgcagactccccagcagcctcctacttctacattccagaactcaccttctgctttggtatctacacctgtgaggactaaaacatcaaaccgttacagcccagaatcccaggctcagtctgtccatcatcaaagaccaggttcaagggtctctccagaaaatcttgtggacaaatccaggggaagtaggcctggaaaatccccagagaggagtcacgtctcttcggagccctacgagcccatctccccaccccaggttccggttgtgcatgagaaacaggacagcttgctgctcttgtctcagaggggcgcagagcctgcagagcagaggaatgatgcccgctcaccagggagtataagctacttgccttcattcttcaccaagcttgaaaatacatcacccatggttaaatcaaagaagcaggagattcagctgctcagccaggaactgagatctttaatctgccagcagttactacgtcaggctcagttagctctagaggccattcttttgctgatcctgccagtaatcttgggctggaagacattatcaggaaggctctcatgggaagctttgatgacaaagttgaggatcatggagttgtcatgtcccagcctatgggagtagtgcctggtactgccaacacctcagttgtgaccagtggtgagacacgaagagaggaaggggacccatcacctcattcaggaggagtttgcaaaccaaagctgatcagcaagtcaaacagcaggaaatctaagtctcctatacctgggcaaggctacttaggaacggaacggccctcttcagtctcctctgtacattcagaaggggattaccataggcagacgccagggtgggcctgggaagacaggccctcttcaacaggctcaactcagtttccttataaccctctgactatgcggatgctcagcagtactccaccaacaccgattgcatgtgctccctctgcggtgaaccaagcagctcctcaccaacagaacaggatctgggagcgagagcctgccccactgctctcagcacagtacgagaccctgtcggatagtgatgactgaactgcacaaagtgaggggaacagggtgcaggagagggatctctagtttttgtggtttaatttttagtagcaggtcaaaaacctgccctcctgtgacttattccctgagacttttcaggagagccagcccacagatgatgaagaaatgatggaagttcatttggagagtcaaatgggaaaaaaacaaacaaaaaactgcctttgatacaggcaattcagtggactataataatagtggagggttgagatgtagagtttttaaaaagtgaacagttgctgttcttacatctgtaaagaaaaccataatgtctttaaatcactcttctgtaaatagatgacctttttgcagtgtatatccccttgctgtagtatctggtgtacttatgttcaaatcagcgcatcaactttgggggtgatttttaaaaatctttttgtctatctatctttttaaccctagccttctaaacaacctcatacagcccagttacataatgttggctgtcacgggcattgtacttttatctgatattgtttcctctaaattcagctttccagtgatgtttaaaatcttgtgaaaatgtttagatttttaacacagaccctgtcataaaatctgtacattagggtcaaaaggtaaaagtaacaaattctgccatattgtaaatttccagtgcaggctttaatttttttttttcattagtagcactgaaaaaatattactgcatgggtatgttctagttcagtttataaagttttaaaggcttatttgaggcatacctcactgttacgcacactggtaatttaaccatgcccctaagtattccttttctcctgcatttgatgcagcccaacaaagcttttgttttgaaataaatttgactaccctgtccatagctacagtagattatttgtggtttaaggctcctggtgtctcaggttccaaaggaaaagcttacatatttttcccttagtttgaatatatgattggttgggttaaaagataatgatctgtgtagtatttagataagctttatgctgcatcctgaaaaactcatggtgaacacagtcctttttccccatcactatggaccagcatttactctcactttgctcccttgggacaagagtttactgttaaatgttttcatttcacagagtctcaaggtgcaaataatttaaaagactgaattctaaactaattatggtactagagggccagttttatctttcattaagaattgcttgctgaattttaaagtttttttcatacaatttatcatagcatttaagtatctttctataacatagatactaacagttttgggagaatgccactggtaactggaaaggggagaaacagatctctcaggatgataaaaattagcactttacagactttcaagtagacctaaacttttaaacaaaagtactcaaggcttttaaggaagcagctctgtgattagctactgaccaagaccctcctatcactggtgtctaatccctatgttacagatgaagacacaggtttagtactttgcccatatagttaaattagtgacagagataggccataagcccacatttgtcttcagtcaaagctttcactcctgtccctgttccactcctgtatacctgaggtccccaacataaactttagatcaggcttagtggtcagcattcctagtacttggaaagttggtattttttacaacagatatatgtaaacatataaaaatttcaaaatgaatgaaaaacagtgactaaatgttccacttcacagttttctgctgaatttttttttttcaggtactggtaatattttagagtttgttaataatttatattgccaacctaccataaaagagattatgatggtatttttctatgaccctgagggtcttaagctattctgagtcagaatacagttgacccttgaacaacacgggtttgaactgtgtgggtccacttatacatggattttcttccacctctgccacccaagatagcaagaccaaccccttctcatcctcagcctattcaacatgaagatgacaaggatgaagaccttcatgatgatccacttccacttaatgaatagtaaatatattttctcttccttataatcttaacaaacattttctcttctctagcttactttattgtaagaatacagtatataatacatatacaaaatatgtgtcaatcgactatgttatccgtaagacttctggtcagcagtaggccatgagtagttaagttttggaggagtcaaagttagatgtggatttttgactacttagggggtctatgcccctaactcctgcattatttgaaggtcaaccgtatagtttctgagaacatgtcagatcagagcctaacttcttactcttgcagttctacctgaggacccgaaggtgaggtgctgtgaaccactccctccatcctcatcataatgcatgtgcgtattactttatttaccatcacctggagaagaaatctcagaatgagagttaaaatccaataatagttcttgggttcaaaataaatgaaaggacagaattctcacatggtttacctatggaggttcaccttatcatgatttaagtggtaagcacagagcagcactgacaacttactgtggttcactgcaaaccaaaacatgatattctttgtagacttagatttcagtgttctgacactatatcccttacaccgtgatttttttagcacccagaactaaattaaggtcttcctaaatactcttcataaaagtattctgacagccagttttccactgcatgtttatgactgcaaatttcataatgcttttaattttggtacactgagtgattctattttaaaaatatttatgcccagaaaactccagtgaccattggacagttaaaaaattttaatgacacgattttaaccaattcacttttgaatttagaccaatcagtaaaggagatcagtcctccttttgcttcagtaccttattttacaacagtgtaaatgaactgtaatgaaaacacccacatgaagagactgtcctgaaaactcctagtgtttccaacaacgagaccatgagctgagtcactgtggatgatttaaaattaataaataaataaaacttggaatgaaaaacctttcagtaacccctgcagttgtgaaaaggtaaaaacattctcaatgcaaaaggtgagtggttgacattaatttttttaagaaatca

SEQ ID NO: 448614 - DNA, 6004 bp, Homo sapiens
tagacattagaattgctattgctaatacatcaaggtctaaaataaatccaccttaatccttgtagctaagtaaaagttccatgtgcactagctcagcatgtgatttttctctactcttttgtacgtggtgtttagcaaatgtatttcagccaggacaaaactcagtgcctttctttcattctctcaatcagcagcggctgcttacctgtttcagagacagctttcaccaactccaggttacccaagtcagtatcagctttacgcaatggagaacacaagacagacaatcttaaatgattacattacctcacaacagatgcaagtgaacttgcgtccagatgtggccagaggactctccccaagagagcagccactgggtctcccatacccagcaacgagaggaatcattgacctgaccaatatgcctccaacaattttagtgcctcatccagggggaacaagcactcctcccatggacagaatcacttatattcctggtacacagattactttccctcccaggccgtacaactctgcttccatgtctccaggacacccaacacaccttgcagctgctgcaagtgctgagagggaacgggaacgggagcgggagaaggagcgggagcgggaacggattgctgcagcttcctccgacctctacctgcggccaggctcagaacagcctggccgacctggcagtcatggatatgttcgctccccttccccttcagtaagaactcaggagaccatgttgcaacagagacccagtgttttccaaggaaccaatggaaccagtgtaatcacacctttggatccaactgctcagctacgaatcatgccactgcctgctgggggcccttcaataagccaaggcctgccagcctcccgttacaacactgctgcggatgccctggctgctcttgtggatgctgcagcttctgcaccccagatggatgtgtccaaaacaaaagagagtaagcatgaagctgccaggttagaagaaaatttgagaagcaggtcagcagcagttagtgaacagcagcagctagagcagaaaaccctggaggtggagaagagatctgttcagtgtttatacacttcttcagcctttccaagtggcaagccccagcctcattcttcagtagtttattctgaggctgggaaagataaagggcctcctccaaaatccagatatgaggaagagctaaggaccagagggaagactaccattactgcagctaacttcatagacgtgatcatcacccggcaaattgcctcggacaaggatgcgagggaacgtggctctcaaagttcagactcttctagtagcttatcttctcacaggtatgaaacacctagcgatgctattgaggtgataagtcctgccagctcacctgcgccaccccaggagaaactgcagacctatcagccagaggttgttaaggcaaatcaagcggaaaatgatcctaccagacaatatgaaggaccattacatcactatcgaccacagcaggaatcaccatctccccaacaacagctgcccccttcttcacaggcagagggaatggggcaagtgcccaggacccatcggctgatcacacttgctgatcacatctgtcaaattatcacacaagattttgctagaaatcaagtttcctcgcagactccccagcagcctcctacttctacattccagaactcaccttctgctttggtatctacacctgtgaggactaaaacatcaaaccgttacagcccagaatcccaggctcagtctgtccatcatcaaagaccaggttcaagggtctctccagaaaatcttgtggacaaatccaggggaagtaggcctggaaaatccccagagaggagtcacgtctcttcggagccctacgagcccatctccccaccccaggttccggttgtgcatgagaaacaggacagcttgctgctcttgtctcagaggggcgcagagcctgcagagcagaggaatgatgcccgctcaccagggagtataagctacttgccttcattcttcaccaagcttgaaaatacatcacccatggttaaatcaaagaagcaggagatttttcgtaagttgaactcctctggtggaggtgactctgatatggcagctgctcagccaggaactgagatctttaatctgccagcagttactacgtcaggctcagttagctctagaggccattcttttgctgatcctgccagtaatcttgggctggaagacattatcaggaaggctctcatgggaagctttgatgacaaagttgaggatcatggagttgtcatgtcccagcctatgggagtagtgcctggtactgccaacacctcagttgtgaccagtggtgagacacgaagagaggaaggggacccatcacctcattcaggaggagtttgcaaaccaaagctgatcagcaagtcaaacagcaggaaatctaagtctcctatacctgggcaaggctacttaggaacggaacggccctcttcagtctcctctgtacattcagaaggggattaccataggcagacgccagggtgggcctgggaagacaggccctcttcaacaggctcaactcagtttccttataaccctctgactatgcggatgctcagcagtactccaccaacaccgattgcatgtgctccctctgcggtgaaccaagcagctcctcaccaacagaacaggatctgggagcgagagcctgccccactgctctcagcacagtacgagaccctgtcggatagtgatgactgaactgcacaaagtgaggggaacagggtgcaggagagggatctctagtttttgtggtttaatttttagtagcaggtcaaaaacctgccctcctgtgacttattccctgagacttttcaggagagccagcccacagatgatgaagaaatgatggaagttcatttggagagtcaaatgggaaaaaaacaaacaaaaaactgcctttgatacaggcaattcagtggactataataatagtggagggttgagatgtagagtttttaaaaagtgaacagttgctgttcttacatctgtaaagaaaaccataatgtctttaaatcactcttctgtaaatagatgacctttttgcagtgtatatccccttgctgtagtatctggtgtacttatgttcaaatcagcgcatcaactttgggggtgatttttaaaaatctttttgtctatctatctttttaaccctagccttctaaacaacctcatacagcccagttacataatgttggctgtcacgggcattgtacttttatctgatattgtttcctctaaattcagctttccagtgatgtttaaaatcttgtgaaaatgtttagatttttaacacagaccctgtcataaaatctgtacattagggtcaaaaggtaaaagtaacaaattctgccatattgtaaatttccagtgcaggctttaatttttttttttcattagtagcactgaaaaaatattactgcatgggtatgttctagttcagtttataaagttttaaaggcttatttgaggcatacctcactgttacgcacactggtaatttaaccatgcccctaagtattccttttctcctgcatttgatgcagcccaacaaagcttttgttttgaaataaatttgactaccctgtccatagctacagtagattatttgtggtttaaggctcctggtgtctcaggttccaaaggaaaagcttacatatttttcccttagtttgaatatatgattggttgggttaaaagataatgatctgtgtagtatttagataagctttatgctgcatcctgaaaaactcatggtgaacacagtcctttttccccatcactatggaccagcatttactctcactttgctcccttgggacaagagtttactgttaaatgttttcatttcacagagtctcaaggtgcaaataatttaaaagactgaattctaaactaattatggtactagagggccagttttatctttcattaagaattgcttgctgaattttaaagtttttttcatacaatttatcatagcatttaagtatctttctataacatagatactaacagttttgggagaatgccactggtaactggaaaggggagaaacagatctctcaggatgataaaaattagcactttacagactttcaagtagacctaaacttttaaacaaaagtactcaaggcttttaaggaagcagctctgtgattagctactgaccaagaccctcctatcactggtgtctaatccctatgttacagatgaagacacaggtttagtactttgcccatatagttaaattagtgacagagataggccataagcccacatttgtcttcagtcaaagctttcactcctgtccctgttccactcctgtatacctgaggtccccaacataaactttagatcaggcttagtggtcagcattcctagtacttggaaagttggtattttttacaacagatatatgtaaacatataaaaatttcaaaatgaatgaaaaacagtgactaaatgttccacttcacagttttctgctgaatttttttttttcaggtactggtaatattttagagtttgttaataatttatattgccaacctaccataaaagagattatgatggtatttttctatgaccctgagggtcttaagctattctgagtcagaatacagttgacccttgaacaacacgggtttgaactgtgtgggtccacttatacatggattttcttccacctctgccacccaagatagcaagaccaaccccttctcatcctcagcctattcaacatgaagatgacaaggatgaagaccttcatgatgatccacttccacttaatgaatagtaaatatattttctcttccttataatcttaacaaacattttctcttctctagcttactttattgtaagaatacagtatataatacatatacaaaatatgtgtcaatcgactatgttatccgtaagacttctggtcagcagtaggccatgagtagttaagttttggaggagtcaaagttagatgtggatttttgactacttagggggtctatgcccctaactcctgcattatttgaaggtcaaccgtatagtttctgagaacatgtcagatcagagcctaacttcttactcttgcagttctacctgaggacccgaaggtgaggtgctgtgaaccactccctccatcctcatcataatgcatgtgcgtattactttatttaccatcacctggagaagaaatctcagaatgagagttaaaatccaataatagttcttgggttcaaaataaatgaaaggacagaattctcacatggtttacctatggaggttcaccttatcatgatttaagtggtaagcacagagcagcactgacaacttactgtggttcactgcaaaccaaaacatgatattctttgtagacttagatttcagtgttctgacactatatcccttacaccgtgatttttttagcacccagaactaaattaaggtcttcctaaatactcttcataaaagtattctgacagccagttttccactgcatgtttatgactgcaaatttcataatgcttttaattttggtacactgagtgattctattttaaaaatatttatgcccagaaaactccagtgaccattggacagttaaaaaattttaatgacacgattttaaccaattcacttttgaatttagaccaatcagtaaaggagatcagtcctccttttgcttcagtaccttattttacaacagtgtaaatgaactgtaatgaaaacacccacatgaagagactgtcctgaaaactcctagtgtttccaacaacgagaccatgagctgagtcactgtggatgatttaaaattaataaataaataaaacttggaatgaaaaacctttcagtaacccctgcagttgtgaaaaggtaaaaacattctcaatgcaaaaggtgagtggttgacattaatttttttaagaaatca

SEQ ID NO: 448615 - DNA, 4269 bp, Homo sapiens
  misc_feature (53)..(53): n is a, c, g, or t
tggtgcatcggtgctgggtgatgctgttcagaggagtcccgtgcgtcagcatncaagacaggttcaagggtctctccagaaaatcttgtggacaaatccaggggaagtaggcctggaaaatccccagagaggagtcacgtctcttcggagccctacgagcccatctccccaccccaggttccggttgtgcatgagaaacaggacagcttgctgctcttgtctcagaggggcgcagagcctgcagagcagaggaatgatgcccgctcaccagggagtataagctacttgccttcattcttcaccaagcttgaaaatacatcacccatggttaaatcaaagaagcaggagatttttcgtaagttgaactcctctggtggaggtgactctgatatggcagctgctcagccaggaactgagatctttaatctgccagcagttactacgtcaggctcagttagctctagaggccattcttttgctgatcctgccagtaatcttgggctggaagacattatcaggaaggctctcatgggaagctttgatgacaaagttgaggatcatggagttgtcatgtcccagcctatgggagtagtgcctggtactgccaacacctcagttgtgaccagtggtgagacacgaagagaggaaggggacccatcacctcattcaggaggagtttgcaaaccaaagctgatcagcaagtcaaacagcaggaaatctaagtctcctatacctgggcaaggctacttaggaacggaacggccctcttcagtctcctctgtacattcagaaggggattaccataggcagacgccagggtgggcctgggaagacaggccctcttcaacaggctcaactcagtttccttataaccctctgactatgcggatgctcagcagtactccaccaacaccgattgcatgtgctccctctgcggtgaaccaagcagctcctcaccaacagaacaggatctgggagcgagagcctgccccactgctctcagcacagtacgagaccctgtcggatagtgatgactgaactgcacaaagtgaggggaacagggtgcaggagagggatctctagtttttgtggtttaatttttagtagcaggtcaaaaacctgccctcctgtgacttattccctgagacttttcaggagagccagcccacagatgatgaagaaatgatggaagttcatttggagagtcaaatgggaaaaaaacaaacaaaaaactgcctttgatacaggcaattcagtggactataataatagtggagggttgagatgtagagtttttaaaaagtgaacagttgctgttcttacatctgtaaagaaaaccataatgtctttaaatcactcttctgtaaatagatgacctttttgcagtgtatatccccttgctgtagtatctggtgtacttatgttcaaatcagcgcatcaactttgggggtgatttttaaaaatctttttgtctatctatctttttaaccctagccttctaaacaacctcatacagcccagttacataatgttggctgtcacgggcattgtacttttatctgatattgtttcctctaaattcagctttccagtgatgtttaaaatcttgtgaaaatgtttagatttttaacacagaccctgtcataaaatctgtacattagggtcaaaaggtaaaagtaacaaattctgccatattgtaaatttccagtgcaggctttaatttttttttttcattagtagcactgaaaaaatattactgcatgggtatgttctagttcagtttataaagttttaaaggcttatttgaggcatacctcactgttacgcacactggtaatttaaccatgcccctaagtattccttttctcctgcatttgatgcagcccaacaaagcttttgttttgaaataaatttgactaccctgtccatagctacagtagattatttgtggtttaaggctcctggtgtctcaggttccaaaggaaaagcttacatatttttcccttagtttgaatatatgattggttgggttaaaagataatgatctgtgtagtatttagataagctttatgctgcatcctgaaaaactcatggtgaacacagtcctttttccccatcactatggaccagcatttactctcactttgctcccttgggacaagagtttactgttaaatgttttcatttcacagagtctcaaggtgcaaataatttaaaagactgaattctaaactaattatggtactagagggccagttttatctttcattaagaattgcttgctgaattttaaagtttttttcatacaatttatcatagcatttaagtatctttctataacatagatactaacagttttgggagaatgccactggtaactggaaaggggagaaacagatctctcaggatgataaaaattagcactttacagactttcaagtagacctaaacttttaaacaaaagtactcaaggcttttaaggaagcagctctgtgattagctactgaccaagaccctcctatcactggtgtctaatccctatgttacagatgaagacacaggtttagtactttgcccatatagttaaattagtgacagagataggccataagcccacatttgtcttcagtcaaagctttcactcctgtccctgttccactcctgtatacctgaggtccccaacataaactttagatcaggcttagtggtcagcattcctagtacttggaaagttggtattttttacaacagatatatgtaaacatataaaaatttcaaaatgaatgaaaaacagtgactaaatgttccacttcacagttttctgctgaatttttttttttcaggtactggtaatattttagagtttgttaataatttatattgccaacctaccataaaagagattatgatggtatttttctatgaccctgagggtcttaagctattctgagtcagaatacagttgacccttgaacaacacgggtttgaactgtgtgggtccacttatacatggattttcttccacctctgccacccaagatagcaagaccaaccccttctcatcctcagcctattcaacatgaagatgacaaggatgaagaccttcatgatgatccacttccacttaatgaatagtaaatatattttctcttccttataatcttaacaaacattttctcttctctagcttactttattgtaagaatacagtatataatacatatacaaaatatgtgtcaatcgactatgttatccgtaagacttctggtcagcagtaggccatgagtagttaagttttggaggagtcaaagttagatgtggatttttgactacttagggggtctatgcccctaactcctgcattatttgaaggtcaaccgtatagtttctgagaacatgtcagatcagagcctaacttcttactcttgcagttctacctgaggacccgaaggtgaggtgctgtgaaccactccctccatcctcatcataatgcatgtgcgtattactttatttaccatcacctggagaagaaatctcagaatgagagttaaaatccaataatagttcttgggttcaaaataaatgaaaggacagaattctcacatggtttacctatggaggttcaccttatcatgatttaagtggtaagcacagagcagcactgacaacttactgtggttcactgcaaaccaaaacatgatattctttgtagacttagatttcagtgttctgacactatatcccttacaccgtgatttttttagcacccagaactaaattaaggtcttcctaaatactcttcataaaagtattctgacagccagttttccactgcatgtttatgactgcaaatttcataatgcttttaattttggtacactgagtgattctattttaaaaatatttatgcccagaaaactccagtgaccattggacagttaaaaaattttaatgacacgattttaaccaattcacttttgaatttagaccaatcagtaaaggagatcagtcctccttttgcttcagtaccttattttacaacagtgtaaatgaactgtaatgaaaacacccacatgaagagactgtcctgaaaactcctagtgtttccaacaacgagaccatgagctgagtcactgtggatgatttaaaattaataaataaataaaacttggaatgaaaaacctttcagtaacccctgcagttgtgaaaaggtaaaaacattctcaatgcaaaaggtgagtggttgacattaatttttttaagaaatca

SEQ ID NO: 448616 - DNA, 4275 bp, Homo sapiens
tggattaagatggtctctgggctgggtgcggtggctcacgcctgtaatcccagcactttgggaggccaaggcgggcggatcacctgaggttcggaattcgagatcagcctgaccaatatggtgaaaccccatctcctaaaaatacaaaaaattagcctggtgtggtggtgggtgcctgtagtcccagctacttgggagactgaggtaggagaatcccttgaatctgggaggcggaggttgcagtgagccaagatcgcgccactgcactccagcctgggtgcgacagagagagactctgtctccaaaaaaaaaggtctctgtgtggtgggtcctggtattgttctaggtcacttgccaagtgctgtgtgtattcagtgggctgatggggcaatgcatgtttgtttcctgattggcctttcagaaataagtggaaatgtttttgattctctttcaggctcagttagctctagaggccattcttttgctgatcctgccagtaatcttgggctggaagacattatcaggaaggctctcatgggaagctttgatgacaaagttgaggatcatggagttgtcatgtcccagcctatgggagtagtgcctggtactgccaacacctcagttgtgaccagtggtgagacacgaagagaggaaggggacccatcacctcattcaggaggagtttgcaaaccaaagctgatcagcaagtcaaacagcaggaaatctaagtctcctatacctgggcaaggctacttaggaacggaacggccctcttcagtctcctctgtacattcagaaggggattaccataggcagacgccagggtgggcctgggaagacaggccctcttcaacaggctcaactcagtttccttataaccctctgactatgcggatgctcagcagtactccaccaacaccgattgcatgtgctccctctgcggtgaaccaagcagctcctcaccaacagaacaggatctgggagcgagagcctgccccactgctctcagcacagtacgagaccctgtcggatagtgatgactgaactgcacaaagtgaggggaacagggtgcaggagagggatctctagtttttgtggtttaatttttagtagcaggtcaaaaacctgccctcctgtgacttattccctgagacttttcaggagagccagcccacagatgatgaagaaatgatggaagttcatttggagagtcaaatgggaaaaaaacaaacaaaaaactgcctttgatacaggcaattcagtggactataataatagtggagggttgagatgtagagtttttaaaaagtgaacagttgctgttcttacatctgtaaagaaaaccataatgtctttaaatcactcttctgtaaatagatgacctttttgcagtgtatatccccttgctgtagtatctggtgtacttatgttcaaatcagcgcatcaactttgggggtgatttttaaaaatctttttgtctatctatctttttaaccctagccttctaaacaacctcatacagcccagttacataatgttggctgtcacgggcattgtacttttatctgatattgtttcctctaaattcagctttccagtgatgtttaaaatcttgtgaaaatgtttagatttttaacacagaccctgtcataaaatctgtacattagggtcaaaaggtaaaagtaacaaattctgccatattgtaaatttccagtgcaggctttaatttttttttttcattagtagcactgaaaaaatattactgcatgggtatgttctagttcagtttataaagttttaaaggcttatttgaggcatacctcactgttacgcacactggtaatttaaccatgcccctaagtattccttttctcctgcatttgatgcagcccaacaaagcttttgttttgaaataaatttgactaccctgtccatagctacagtagattatttgtggtttaaggctcctggtgtctcaggttccaaaggaaaagcttacatatttttcccttagtttgaatatatgattggttgggttaaaagataatgatctgtgtagtatttagataagctttatgctgcatcctgaaaaactcatggtgaacacagtcctttttccccatcactatggaccagcatttactctcactttgctcccttgggacaagagtttactgttaaatgttttcatttcacagagtctcaaggtgcaaataatttaaaagactgaattctaaactaattatggtactagagggccagttttatctttcattaagaattgcttgctgaattttaaagtttttttcatacaatttatcatagcatttaagtatctttctataacatagatactaacagttttgggagaatgccactggtaactggaaaggggagaaacagatctctcaggatgataaaaattagcactttacagactttcaagtagacctaaacttttaaacaaaagtactcaaggcttttaaggaagcagctctgtgattagctactgaccaagaccctcctatcactggtgtctaatccctatgttacagatgaagacacaggtttagtactttgcccatatagttaaattagtgacagagataggccataagcccacatttgtcttcagtcaaagctttcactcctgtccctgttccactcctgtatacctgaggtccccaacataaactttagatcaggcttagtggtcagcattcctagtacttggaaagttggtattttttacaacagatatatgtaaacatataaaaatttcaaaatgaatgaaaaacagtgactaaatgttccacttcacagttttctgctgaatttttttttttcaggtactggtaatattttagagtttgttaataatttatattgccaacctaccataaaagagattatgatggtatttttctatgaccctgagggtcttaagctattctgagtcagaatacagttgacccttgaacaacacgggtttgaactgtgtgggtccacttatacatggattttcttccacctctgccacccaagatagcaagaccaaccccttctcatcctcagcctattcaacatgaagatgacaaggatgaagaccttcatgatgatccacttccacttaatgaatagtaaatatattttctcttccttataatcttaacaaacattttctcttctctagcttactttattgtaagaatacagtatataatacatatacaaaatatgtgtcaatcgactatgttatccgtaagacttctggtcagcagtaggccatgagtagttaagttttggaggagtcaaagttagatgtggatttttgactacttagggggtctatgcccctaactcctgcattatttgaaggtcaaccgtatagtttctgagaacatgtcagatcagagcctaacttcttactcttgcagttctacctgaggacccgaaggtgaggtgctgtgaaccactccctccatcctcatcataatgcatgtgcgtattactttatttaccatcacctggagaagaaatctcagaatgagagttaaaatccaataatagttcttgggttcaaaataaatgaaaggacagaattctcacatggtttacctatggaggttcaccttatcatgatttaagtggtaagcacagagcagcactgacaacttactgtggttcactgcaaaccaaaacatgatattctttgtagacttagatttcagtgttctgacactatatcccttacaccgtgatttttttagcacccagaactaaattaaggtcttcctaaatactcttcataaaagtattctgacagccagttttccactgcatgtttatgactgcaaatttcataatgcttttaattttggtacactgagtgattctattttaaaaatatttatgcccagaaaactccagtgaccattggacagttaaaaaattttaatgacacgattttaaccaattcacttttgaatttagaccaatcagtaaaggagatcagtcctccttttgcttcagtaccttattttacaacagtgtaaatgaactgtaatgaaaacacccacatgaagagactgtcctgaaaactcctagtgtttccaacaacgagaccatgagctgagtcactgtggatgatttaaaattaataaataaataaaacttggaatgaaaaacctttcagtaacccctgcagttgtgaaaaggtaaaaacattctcaatgcaaaaggtgagtggttgacattaatttttttaagaaatca

SEQ ID NO: 448617 - DNA, 5425 bp, Homo sapiens
gggttgagtcaagatggcggccaaggtggcgaagcagcagccgcggcggcggcggcggctggagtgagcgtccgactcgccgcgccgaacgaggtcccggtgtagggccgcgcgccgtggccgcgtcccactcctcaggccggggcgcacgtcggctcccacgcttagccagctcccggtggtttcctagaaacatgattgtttattggcattgatctcacagtctggtgaggacttctttactgataatgtcaagttcaggttatcctcccaaccaaggagcattcagcacagaacaaagtcgttatcctcctcactctgtccagtatacatttcccaacacccgccaccagcaggagttcgcagtccctgattatcgttcctctcatcttgaagtgagtcaggcatcacagcttttgcagcaacagcagcagcaacagcttcgaaggcgaccttccttgctttcagaatttcacccaggttctgacaggcctcaagaaaggagaactagttatgaaccgtttcatccaggcccatccccagtggatcatgattcactggaatcgaagcgaccacgtctggaacaggtttctgattctcattttcagcgtgtcagtgctgcggttttgcctttagtgcacccgctgccagaagggctgagggcttctgcagatgctaagaaggatccagcattcggaggcaaacatgaagctccatcctctccaatttcggggcaaccatgtggagatgatcaaaatgcttcaccttcaaaactctcaaaggaagagttaatacagagtatggatcgtgtagatcgagaaattgcaaaagtagaacagcagatccttaaactgaaaaagaaacaacaacagcttgaagaagaggcagctaaacctcctgagcctgagaagcccgtgtcccctcctcctgtggagcagaaacaccgcagtattgtccaaattatttatgatgagaatcggaaaaaagcagaagaagctcataaaatttttgaaggtcttggcccaaaagttgaactgccactgtataaccagccatcagataccaaggtgtaccatgagaacatcaagacaaaccaggtgatgaggaaaaaactcattttattttttaaaagaagaaatcatgcaagaaaacaaagggaacaaaaaatctgccagcgttatgatcagctcatggaggcatgggagaaaaaagtggacagaatagaaaataatcctcggaggaaagctaaagaaagcaaaacaagggaatactatgaaaagcagtttccagaaattcgaaaacaaagagaacagcaagaaagatttcagcgagttgggcagaggggagctggtctttcagccaccattgctaggagtgagcatgagatttctgaaattattgatgggctctctgagcaggagaataatgagaaacaaatgcggcagctctctgtgattccacctatgatgtttgatgcagaacaaagacgagtcaagttcattaacatgaatgggcttatggaggaccctatgaaagtgtataaagataggcagtttatgaatgtttggactgaccatgaaaaggagatctttaaggacaagtttatccagcatccaaaaaactttggactaattgcatcatacttggagaggaagagtgttcctgattgtgttttgtattactatttaaccaagaaaaatgagaattataaagccctcgtcagaaggaattatgggaaacgcagaggcagaaaccagcaaattgctcgaccctcgcaagaagaaaaagtagaagaaaaagaagaggataaagcagaaaaaacagaaaaaaaagaagaagaaaagaaagatgaagaggaaaaagatgaaaaagaagactccaaagaaaataccaaggaaaaggacaagatagatggtacagcagaagaaactgaggaaagagagcaagccacaccccgggggcgaaagactgccaacagtcagggccgccgtaagggccggatcaccaggtccatgacaaacgaagctgcagctgccagtgctgcagccgcagcggctactgaagagcccccaccacctctgccaccgccaccagaacccatttctacagagcctgtggagacctctcgatggacagaagaagaaatggaagttgctaaaaaaggtctagtagaacatggtcgtaactgggcagcaattgctaaaatggtgggaacgaaaagtgaagctcaatgtaaaaacttctattttaactataaaaggcgacacaatcttgacaacctcttacagcagcataaacagaaaacttcacgaaaacctcgtgaagagcgagatgtgtctcaatgtgaaagtgtcgcttccactgtttctgctcaggaggatgaagatattgaagcctccaatgaagaagaaaatccagaagacagcgaaggtgcagaaaatagttctgatacagaaagtgctccttctccttcaccagttgaagctgtcaagcccagcgaggacagtcctgaaaatgctacttctcgaggaaacacagaacctgcggttgagcttgagcccaccacggaaactgcacccagtacatctccctccttagcagttccaagtacaaaaccagctgaagatgaaagtgtggagacccaggtgaatgacagcatcagtgctgagacagcagagcagatggatgtagatcagcaggagcacagtgctgaagagggttctgtttgtgatcccccacccgctaccaaagctgactctgtggacgttgaagtgagggtgccagaaaaccatgcatctaaagttgaaggtgataataccaaagaaagagacttggatagagccagtgagaaggtggaacctagagatgaagatttggtggtagctcagcaaataaatgcccaaaggcccgagccccagtcagacaatgattccagtgccacgtgcagcgctgatgaggatgtggatggagagccagagaggcagagaatgtttcctatggactcaaagccttcactgttaaaccccactggatctatactcgtctcatctccgttaaaaccaaatccactggatctgccacagcttcagcatcgagctgctgttatcccaccaatggtatcctgcaccccatgtaacataccaattggaaccccagtgagcggctatgctctctaccagcgacacattaaagcaatgcatgagtcagcactcctggaggagcagcggcagagacaagaacagatagatttggaatgtagaagttctacaagtccatgtggcacatccaagagtccaaacagagagtgggaagtccttcagcctgctccacatcaagtgataactaatctccctgaaggcgttcggcttccgacaactcgaccaaccaggccaccgccccctctcatcccgtcatccaaaaccacagtggcttcagaaaaaccatcttttataatgggaggctccatctcacagggaacaccaggcacttatttgacttctcataatcaggcttcctacactcaagaaacacccaagccgtcagtgggatctatctctcttggactgccacggcaacaggaatctgccaaatcagctactttgccctacatcaagcaggaagaattttctccccgaagccaaaactcacaacctgagggtctgttggtcagggcccaacatgaaggtgtagtcagaggtaccgcaggagccatacaagaaggaagtataactcggggaactccaaccagcaaaatttcagtggagagcattccatccctacggggctctatcactcagggcaccccggctctgccccagactggcataccaacagaggctttggtgaaggggtccatttcgagaatgcccattgaagacagcagtcctgagaaaggcagagaggaagctgcatccaaaggccatgttatttatgaaggcaaaagtggacatatcttgtcatatgataatattaagaatgcccgagaagggactaggagtccaagaacagctcatgaaatcagtttaaagagaagctatgaatcagtggaaggaaatataaagcaagggatgtcaatgagggagtctcctgtatcagcaccgttagaggggctgatatgccgagcattacccagggggagtcctcattctgacctcaaagaaaggactgtattgtctggctccataatgcaggggacaccaagagcaacaactgaaagctttgaagatggccttaaatatcccaaacaaattaaaagggaaagtcctcccatacgagcatttgaaggtgccattaccaaaggaaaaccatatgatggcatcaccaccatcaaagaaatggggcgttccattcatgagattccaaggcaagatattttaactcaggaaagtcggaaaactccagaagtggtccagagcacacggccgataattgagggttccatttcccagggcacaccaataaagtttgacaacaactcaggtcaatctgccatcaaacacaatgtcaaatccttaatcacggggcctagcaaactatcccgtggaatgcctccgctggaaattgtgccagagaacataaaagtggtagaacggggaaaatatgaggatgtgaaagcaggcgagaccgtgcgttcccggcacacgtcagtggtaagctctggcccctccgttcttaggtccacactgcatgaagctcccaaagcacaactgagccctgggatttatgatgacaccagtgcacggaggacccctgtgagttatcaaaacaccatgtccagaggctcacccatgatgaacagaacttctgatgttacaatttcttctaacaagtctaccaatcatgaaaggaaatcgacactgacccctacccagagggaaagtatcccagcgaagtctccagtgcctggggtggaccctgtcgtgagccacagtccgtttgatccccatcacagaggcagcactgcaggcgaggtttatcggagccacctgcccacgcacttggatccagccatgccttttcacagggctttggatcctggtaaacacaaaatatagtgataatttatggcaaataaatatgccaccagtatgacttttcagctttctgttgttgtacaatatagtacaattgcaaatatcattaatgtacagctcagtgaattttcacaaactaaattctcccatgttaccagcacccagatcaagaaataaaatcttatcagcacccggtaaagaactaaaaagaatagtatatgaaaagctctcttatctgatggcacttggtgaaactagttgaaaaagtggattaatgtgaataattattttaaaatgacagaggcatacctaaacatgttaacttacagcataaatagacgttcatttaccagaactctgatctaatgccaaggctttttcataaacaagtg

SEQ ID NO: 448618 - DNA, 4083 bp, Homo sapiens
gggttgagtcaagatggcggccaaggtggcgaagcagcagccgcggcggcggcggcggctggagtgagcgtccgactcgccgcgccgaacgaggtcccggtgtagggccgcgcgccgtggccgcgtcccactcctcaggccggggcgcacgtcggctcccacgcttagccagctcccggtggtttcctagaaacatgattgtttattggcattgatctcacagtctggtgaggacttctttactgataatgtcaagttcaggttatcctcccaaccaaggagcattcagcacagaacaaagtcgttatcctcctcactctgtccagtatacatttcccaacacccgccaccagcaggagttcgcagtccctgattatcgttcctctcatcttgaagtgagtcaggcatcacagcttttgcagcaacagcagcagcaacagcttcgaaggcgaccttccttgctttcagaatttcacccaggttctgacaggcctcaagaaaggagaactagttatgaaccgtttcatccaggcccatccccagtggatcatgattcactggaatcgaagcgaccacgtctggaacaggtttctgattctcattttcagcgtgtcagtgctgcggttttgcctttagtgcacccgctgccagaagggctgagggcttctgcagatgctaagaaggatccagcattcggaggcaaacatgaagctccatcctctccaatttcggggcaaccatgtggagatgatcaaaatgcttcaccttcaaaactctcaaaggaagagttaatacagagtatggatcgtgtagatcgagaaattgcaaaagtagaacagcagatccttaaactgaaaaagaaacaacaacagcttgaagaagaggcagctaaacctcctgagcctgagaagcccgtgtcccctcctcctgtggagcagaaacaccgcagtattgtccaaattatttatgatgagaatcggaaaaaagcagaagaagctcataaaatttttgaaggtcttggcccaaaagttgaactgccactgtataaccagccatcagataccaaggtgtaccatgagaacatcaagacaaaccaggtgatgaggaaaaaactcattttattttttaaaagaagaaatcatgcaagaaaacaaagggaacaaaaaatctgccagcgttatgatcagctcatggaggcatgggagaaaaaagtggacagaatagaaaataatcctcggaggaaagctaaagaaagcaaaacaagggaatactatgaaaagcagtttccagaaattcgaaaacaaagagaacagcaagaaagatttcagcgagttgggcagaggggagctggtctttcagccaccattgctaggagtgagcatgagatttctgaaattattgatgggctctctgagcaggagaataatgagaaacaaatgcggcagctctctgtgattccacctatgatgtttgatgcagaacaaagacgagtcaagttcattaacatgaatgggcttatggaggaccctatgaaagtgtataaagataggcagtttatgaatgtttggactgaccatgaaaaggagatctttaaggacaagtttatccagcatccaaaaaactttggactaattgcatcatacttggagaggaagagtgttcctgattgtgttttgtattactatttaaccaagaaaaatgagaattataaagccctcgtcagaaggaattatgggaaacgcagaggcagaaaccagcaaattgctcgaccctcgcaagaagaaaaagtagaagaaaaagaagaggataaagcagaaaaaacagaaaaaaaagaagaagaaaagaaagatgaagaggaaaaagatgaaaaagaagactccaaagaaaataccaaggaaaaggacaagatagatggtacagcagaagaaactgaggaaagagagcaagccacaccccgggggcgaaagactgccaacagtcagggccgccgtaagggccggatcaccaggtccatgacaaacgaagctgcagctgccagtgctgcagccgcagcggctactgaagagcccccaccacctctgccaccgccaccagaacccatttctacagagcctgtggagacctctcgatggacagaagaagaaatggaagttgctaaaaaaggtctagtagaacatggtcgtaactgggcagcaattgctaaaatggtgggaacgaaaagtgaagctcaatgtaaaaacttctattttaactataaaaggcgacacaatcttgacaacctcttacagcagcataaacagaaaacttcacgaaaacctcgtgaagagcgagatgtgtctcaatgtgaaagtgtcgcttccactgtttctgctcaggaggatgaagatattgaagcctccaatgaagaagaaaatccagaagacagcgaaggtgcagaaaatagttctgatacagaaagtgctccttctccttcaccagttgaagctgtcaagcccagcgaggacagtcctgaaaatgctacttctcgaggaaacacagaacctgcggttgagcttgagcccaccacggaaactgcacccagtacatctccctccttagcagttccaagtacaaaaccagctgaagatgaaagtgtggagacccaggtgaatgacagcatcagtgctgagacagcagagcagatggatgtagatcagcaggagcacagtgctgaagagggttctgtttgtgatcccccacccgctaccaaagctgactctgtggacgttgaagtgagggtgccagaaaaccatgcatctaaagttgaaggtgataataccaaagaaagagacttggatagagccagtgagaaggtggaacctagagatgaagatttggtggtagctcagcaaataaatgcccaaaggcccgagccccagtcagacaatgattccagtgccacgtgcagcgctgatgaggatgtggatggagagccagagaggcagagaatgtttcctatggactcaaagccttcactgttaaaccccactggatctatactcgtctcatctccgttaaaaccaaatccactggatctgccacagcttcagcatcgagctgctgttatcccaccaatggtatcctgcaccccatgtaacataccaattggaaccccagtgagcggctatgctctctaccagcgacacattaaagcaatgcatgagtcagcactcctggaggagcagcggcagagacaagaacagatagatttggaatgtagaagttctacaagtccatgtggcacatccaagagtccaaacagagagtgggaagtccttcagcctgctccacatcaagtgataactaatctccctgaaggcgttcggcttccgacaactcgaccaaccaggccaccgccccctctcatcccgtcatccaaaaccacagtggcttcagaaaaaccatcttttataatgggaggctccatctcacagggaacaccaggcacttatttgacttctcataatcaggcttcctacactcaagaaacacccaagccgtcagtgggatctatctctcttggactgccacggcaacaggaatctgccaaatcagctactttgccctacatcaagcaggaagaattttctccccgaagccaaaactcacaacctgagggtctgttggtcagggcccaacatgaaggtgtagtcagaggtaccgcaggagccatacaagaaggaagtataactcggggaactccaaccagcaaaatttcagtggagagcattccatccctacggggctctatcactcagggcaccccggctctgcccctgaccaacagaccctcaggtcgtgagttttggcttcggggagaaaattcttcctgcttggaaatctccaatagagattacaatagagatctccaacatgatttcatgcctttagaggagaaatatttcctggtctaagtggaatattgtgcggatatggcttctggaaaaccttcattctaaagcagcgttatagttgaacatttcatttagaactctggacgtaccttcttcagcttgctgtaatccacattcactgagtagaact

SEQ ID NO: 448619 - DNA, 3605 bp, Homo sapiens
gggttgagtcaagatggcggccaaggtggcgaagcagcagccgcggcggcggcggcggctggagtgagcgtccgactcgccgcgccgaacgaggtcccggtgtagggccgcgcgccgtggccgcgtcccactcctcaggccggggcgcacgtcggctcccacgcttagccagctcccggtggtttcctagaaacatgattgtttattggcattgatctcacagtctggtgaggacttctttactgataatgtcaagttcaggttatcctcccaaccaaggagcattcagcacagaacaaagtcgttatcctcctcactctgtccagtatacatttcccaacacccgccaccagcaggagttcgcagtccctgattatcgttcctctcatcttgaagtgagtcaggcatcacagcttttgcagcaacagcagcagcaacagcttcgaaggcgaccttccttgctttcagaatttcacccaggttctgacaggcctcaagaaaggagaactagttatgaaccgtttcatccaggcccatccccagtggatcatgattcactggaatcgaagcgaccacgtctggaacaggtttctgattctcattttcagcgtgtcagtgctgcggttttgcctttagtgcacccgctgccagaagggctgagggcttctgcagatgctaagaaggatccagcattcggaggcaaacatgaagctccatcctctccaatttcggggcaaccatgtggagatgatcaaaatgcttcaccttcaaaactctcaaaggaagagttaatacagagtatggatcgtgtagatcgagaaattgcaaaagtagaacagcagatccttaaactgaaaaagaaacaacaacagcttgaagaagaggcagctaaacctcctgagcctgagaagcccgtgtcccctcctcctgtggagcagaaacaccgcagtattgtccaaattatttatgatgagaatcggaaaaaagcagaagaagctcataaaatttttgaaggtcttggcccaaaagttgaactgccactgtataaccagccatcagataccaaggtgtaccatgagaacatcaagacaaaccaggtgatgaggaaaaaactcattttattttttaaaagaagaaatcatgcaagaaaacaaagggaacaaaaaatctgccagcgttatgatcagctcatggaggcatgggagaaaaaagtggacagaatagaaaataatcctcggaggaaagctaaagaaagcaaaacaagggaatactatgaaaagcagtttccagaaattcgaaaacaaagagaacagcaagaaagatttcagcgagttgggcagaggggagctggtctttcagccaccattgctaggagtgagcatgagatttctgaaattattgatgggctctctgagcaggagaataatgagaaacaaatgcggcagctctctgtgattccacctatgatgtttgatgcagaacaaagacgagtcaagttcattaacatgaatgggcttatggaggaccctatgaaagtgtataaagataggcagtttatgaatgtttggactgaccatgaaaaggagatctttaaggacaagtttatccagcatccaaaaaactttggactaattgcatcatacttggagaggaagagtgttcctgattgtgttttgtattactatttaaccaagaaaaatgagaattataaagccctcgtcagaaggaattatgggaaacgcagaggcagaaaccagcaaattgctcgaccctcgcaagaagaaaaagtagaagaaaaagaagaggataaagcagaaaaaacagaaaaaaaagaagaagaaaagaaagatgaagaggaaaaagatgaaaaagaagactccaaagaaaataccaaggaaaaggacaagatagatggtacagcagaagaaactgaggaaagagagcaagccacaccccgggggcgaaagactgccaacagtcagggccgccgtaagggccggatcaccaggtccatgacaaacgaagctgcagctgccagtgctgcagccgcagcggctactgaagagcccccaccacctctgccaccgccaccagaacccatttctacagagcctgtggagacctctcgatggacagaagaagaaatggaagttgctaaaaaaggtctagtagaacatggtcgtaactgggcagcaattgctaaaatggtgggaacgaaaagtgaagctcaatgtaaaaacttctattttaactataaaaggcgacacaatcttgacaacctcttacagcagcataaacagaaaacttcacgaaaacctcgtgaagagcgagatgtgtctcaatgtgaaagtgtcgcttccactgtttctgctcaggaggatgaagatattgaagcctccaatgaagaagaaaatccagaagacagcgaaggtgcagaaaatagttctgatacagaaagtgctccttctccttcaccagttgaagctgtcaagcccagcgaggacagtcctgaaaatgctacttctcgaggaaacacagaacctgcggttgagcttgagcccaccacggaaactgcacccagtacatctccctccttagcagttccaagtacaaaaccagctgaagatgaaagtgtggagacccaggtgaatgacagcatcagtgctgagacagcagagcagatggatgtagatcagcaggagcacagtgctgaagagggttctgtttgtgatcccccacccgctaccaaagctgactctgtggacgttgaagtgagggtgccagaaaaccatgcatctaaagttgaaggtgataataccaaagaaagagacttggatagagccagtgagaaggtggaacctagagatgaagatttggtggtagctcagcaaataaatgcccaaaggcccgagccccagtcagacaatgattccagtgccacgtgcagcgctgatgaggatgtggatggagagccagagaggcagagaatgtttcctatggactcaaagccttcactgttaaaccccactggatctatactcgtctcatctccgttaaaaccaaatccactggatctgccacagcttcagcatcgagctgctgttatcccaccaatggtatcctgcaccccatgtaacataccaattggaaccccagtgagcggctatgctctctaccagcgacacattaaagcaatgcatgagtcagcactcctggaggagcagcggcagagacaagaacagatagatttggaatgtagaagttctacaagtccatgtggcacatccaagagtccaaacagagagtgggaaggtaggtagatagagctatcaccaagagaacttttatgaagggaaataaagctaaacccaaaagcagtgtccattgtgctttgtaagttgtcagcctcccaactgattattatatttgtcctaacagacacagttccttaaattgaccttaaactatgaagaaatgttagtattattaactactaaaggatgccagtaacatttttaatagcattctagttaatgtgaattttctgatattcatctttgtgctggaagacattataaataaagttatgctttatgttccgttca

SEQ ID NO: 448620 - DNA, 2452 bp, Homo sapiens
gggttgagtcaagatggcggccaaggtggcgaagcagcagccgcggcggcggcggcggctggagtgagcgtccgactcgccgcgccgaacgaggtcccggtgtagggccgcgcgccgtggccgcgtcccactcctcaggccggggcgcacgtcggctcccacgcttagccagctcccggtggtttcctagaaacatgattgtttattggcattgatctcacagtctggtgaggacttctttactgataatgtcaagttcaggttatcctcccaaccaaggagcattcagcacagaacaaagtcgttatcctcctcactctgtccagtatacatttcccaacacccgccaccagcaggagttcgcagtccctgattatcgttcctctcatcttgaagtgagtcaggcatcacagcttttgcagcaacagcagcagcaacagcttcgaaggcgaccttccttgctttcagaatttcacccaggttctgacaggcctcaagaaaggagaactagttatgaaccgtttcatccaggcccatccccagtggatcatgattcactggaatcgaagcgaccacgtctggaacaggtttctgattctcattttcagcgtgtcagtgctgcggttttgcctttagtgcacccgctgccagaagggctgagggcttctgcagatgctaagaaggatccagcattcggaggcaaacatgaagctccatcctctccaatttcggggcaaccatgtggagatgatcaaaatgcttcaccttcaaaactctcaaaggaagagttaatacagagtatggatcgtgtagatcgagaaattgcaaaagtagaacagcagatccttaaactgaaaaagaaacaacaacagcttgaagaagaggcagctaaacctcctgagcctgagaagcccgtgtcccctcctcctgtggagcagaaacaccgcagtattgtccaaattatttatgatgagaatcggaaaaaagcagaagaagctcataaaatttttgaaggtcttggcccaaaagttgaactgccactgtataaccagccatcagataccaaggtgtaccatgagaacatcaagacaaaccaggtgatgaggaaaaaactcattttattttttaaaagaagaaatcatgcaagaaaacaaagggaacaaaaaatctgccagcgttatgatcagctcatggaggcatgggagaaaaaagtggacagaatagaaaataatcctcggaggaaagctaaagaaagcaaaacaagggaatactatgaaaagcagtttccagaaattcgaaaacaaagagaacagcaagaaagatttcagcgagttgggcagaggggagctggtctttcagccaccattgctaggagtgagcatgagatttctgaaattattgatgggctctctgagcaggagaataatgagaaacaaatgcggcagctctctgtgattccacctatgatgtttgatgcagaacaaagacgagtcaagttcattaacatgaatgggcttatggaggaccctatgaaagtgtataaagataggcagtttatgaatgtttggactgaccatgaaaaggagatctttaaggacaagtttatccagcatccaaaaaactttggactaattgcatcatacttggagaggaagagtgttcctgattgtgttttgtattactatttaaccaagaaaaatgagaattataaagccctcgtcagaaggaattatgggaaacgcagaggcagaaaccagcaaattgctcgaccctcgcaagaagaaaaagtagaagaaaaagaagaggataaagcagaaaaaacagaaaaaaaagaagaagaaaagaaagatgaagaggaaaaagatgaaaaagaagactccaaagaaaataccaaggaaaaggacaagatagatggtacagcagaagaaactgaggaaagagagcaagccacaccccgggggcgaaagactgccaacagtcagggccgccgtaagggccggatcaccaggtccatgacaaacgaagctgcagctgccagtgctgcagccgcagcggctactgaagagcccccaccacctctgccaccgccaccagaacccatttctacagagcctgtggagacctctcgatggacagaagaagaaatggaagttgctaaaaaaggtctagtagaacatggtcgtaactgggcagcaattgctaaaatggtgggaacgaaaagtgaagctcaatgtaaaaacttctattttaactataaaaggcgacacaatcttgacaacctcttacagcagcataaacagaaaacttcacgaaaacctcgtgaagagcgagatgtgtctcaatgtgaaagtgtcgcttccactgtttctgctcaggaggatgaagatattgaagcctccaatgaagaagaaaatccagaagacagcgaaggtatctcaaaattttaaattta

SEQ ID NO: 448621 - DNA, 886 bp, Homo sapiens
  misc_feature (783)..(783): n is a, c, g, or t
  misc_feature (796)..(796): n is a, c, g, or t
  misc_feature (812)..(812): n is a, c, g, or t
tggattaagatggtctctgggctgggtgcggtggctcacgcctgtaatcccagcactttgggaggccaaggcgggcggatcacctgaggttcggaattcgagatcagcctgaccaatatggtgaaaccccatctcctaaaaatacaaaaaattagcctggtgtggtggtgggtgcctgtagtcccagctacttgggagactgaggtaggagaatcccttgaatctgggaggcggaggttgcagtgagccaagatcgcgccactgcactccagcctgggtgcgacagagagagactctgtctccaaaaaaaaaggtctctgtgtggtgggtcctggtattgttctaggtcacttgccaagtgctgtgtgtattcagtgggctgatggggcaatgcatgtttgtttcctgattggcctttcagaaataagtggaaatgtttttgattctctttcaggctcagttagctctagaggccattcttttgctgatcctgccagtaatcttgggctggaagacattatcaggaaggctctcatgggaagctttgatgacaaagttgaggatcatggagttgtcatgtcccagcctatgggagtagtgcctggtactgccaacacctcagttgtgaccagtggtgagacacgaagagaggaaggggacccatcacctcattcaggtacagctttcattttagtgcttttctgctgcttttccccaaaaaagccagtttatttcccaaattctgatgcatcactaagacatttcatttatgtctttatgtgntcagagtcacctnttagggtttccgttanttaaaaaaggtttttgaaaacctacccagacattataatatgaacagaaataaaatggaagaaaatttttaccc

SEQ ID NO: 448622 - DNA, 2584 bp, Homo sapiens
cgccgcctgtcggcttccggaagctcatctcaaaatgctgaactgctctttggaagtcgccggtgctgttgtagttggagtctgttcacgggcctgagcttcgaggccaggctcccgggtgtcgttaatgttcggggccgccgggcgccaaccgatcggagctccagcagccgggaacagctggcatttcagtagaaccatggaggagctggttcatgaccttgtctcagcattggaagagagctcagagcaagctcgaggtggatttgctgaaacaggagaccattctcgaagtatatcttgccctctgaaacgccaggcaaggaaaaggagagggagaaaacggaggtcgtataatgtgcatcacccgtgggagactggtcactgcttaagtgaaggctctgattctagtttagaagaaccaagcaaggactatagagagaatcacaataataataaaaaagatcacagtgactctgatgaccaaatgttagtagcaaagcgcaggccgtcatcaaacttaaataataatgttcgagggaaaagacctctatggcatgagtctgattttgctgtggacaatgttgggaatagaactctgcgcaggaggagaaaggtaaaacgcatggcagtagatctcccacaggacatctctaacaaacggacaatgacccagccacctgagggttgtagagatcaggacatggacagtgatagagcctaccagtatcaagaatttaccaagaacaaagtcaaaaaaagaaagttgaaaataatcagacaaggaccaaaaatccaagatgaaggagtagttttagaaagtgaggaaacgaaccagaccaataaggacaaaatggaatgtgaagagcaaaaagtctcagatgagctcatgagtgaaagtgattccagcagtctcagcagcactgatgctggattgtttaccaatgatgagggaagacaaggtgatgatgaacagagtgactggttctacgaaaaggaatcaggtggagcatgtggtatcactggagttgtgccctggtgggaaaaggaagatcctactgagctagacaaaaatgtaccagatcctgtctttgaaagtatcttaactggttcttttccccttatgtcacacccaagcagaagaggtttccaagctagactcagtcgccttcatggaatgtcttcaaagaatattaaaaaatctggagggactccaacttcaatggtacccattcctggcccagtgggtaacaagagaatggttcatttttccccggattctcatcaccatgaccattggtttagccctggggctaggacagagcatgaccagcatcagcttctgagagataatcgagctgaaagaggacacaagaaaaattgttctgtgagaacagccagcaggcaaacaagcatgcatttaggatccttatgcacgggagatatcaaacggagaagaaaagctgcacctttgcctggacctactactgcaggatttgtaggtgaaaatgcccagccaatcctagaaaataatattggaaaccgaatgcttcagaatatgggctggacgcctgggtcaggccttggacgagatggcaaggggatctctgagccaattcaagccatgcagaggccaaagggattaggacttggatttcctctaccaaaaagtacttccgcaactactacccccaatgcaggaaaatccgcctaagaaaagcaaagaagaaatgttttacagactttattcactatgtcccattgttctaaaatgataacatgacttctgtttttgaagcaaaaatctacattgcctcaaacacatcactctagcttccttactgcatacagtcctgccatagtgagagaaatgggatttcatcacaattcatggtgctaaaatgaaaacctctgcactttaatttttttcagtaatttccagctatttctaggtataaagagcagctcgtttctcttatttattttagtctcatgtgtcaatactttccgatgctttgcttaattcatgtatgtgtgcagtgctgcaatgcccagacaaacgtgagcacacccaccagtttctaaaatggaatagacaggaaaagattgtgttttatatcatccctatctattgtaacccaaaagacctaccatcgcatcagtgaagtccgaacacatctttgtttgaaaggcttgtcaatttcatattccttgaattggcttcttggtgaggattttctgacagagtgatacccatcaattttctatccttagacaatgtagtgtgaagttcacagttgacaaacaacaattaatgtttcccttggatgttttgacaaaaataaacctcatcgttgttatcaccagagtgccctctaccttactttaatgcagattttataaattttacctcatttagaacataaaataattattgaaagaaaaatgtattttttaaattcaccgtgattgaactgtaaattctattaatccagatgtacttctacctctgttttcccaaagattgatattatttttaagatcaactcaagtgtagtaaacggatttaaaattttaatcattg

SEQ ID NO: 448623 - DNA, 3239 bp, Homo sapiens
cgccgcctgtcggcttccggaagctcatctcaaaatgctgaactgctctttggaagtcgccggtgctgttgtagttggagtctgttcacgggcctgagcttcgaggccaggctcccgggtgtcgttaatgttcggggccgccgggcgccaaccgatcggagctccagcagccgggaacagctggcatttcagtagaaccatggaggagctggttcatgaccttgtctcagcattggaagagagctcagagcaagctcgaggtggatttgctgaaacaggagaccattctcgaagtatatcttgccctctgaaacgccaggcaaggaaaaggagagggagaaaacggaggtcgtataatgtgcatcacccgtgggagactggtcactgcttaagtgaaggctctgattctagtttagaagaaccaagcaaggactatagagagaatcacaataataataaaaaagatcacagtgactctgatgaccaaatgttagtagcaaagcgcaggccgtcatcaaacttaaataataatgttcgagggaaaagacctctatggcatgagtctgattttgctgtggacaatgttgggaatagaactctgcgcaggaggagaaaggtaaaacgcatggcagtagatctcccacaggacatctctaacaaacggacaatgacccagccacctgagggttgtagagatcaggacatggacagtgatagagcctaccagtatcaagaatttaccaagaacaaagtcaaaaaaagaaagttgaaaataatcagacaaggaccaaaaatccaagatgaaggagtagttttagaaagtgaggaaacgaaccagaccaataaggacaaaatggaatgtgaagagcaaaaagtctcagatgagctcatgagtgaaagtgattccagcagtctcagcagcactgatgctggattgtttaccaatgatgagggaagacaaggtgatgatgaacagagtgactggttctacgaaaaggaatcaggtggagcatgtggtatcactggagttgtgccctggtgggaaaaggaagatcctactgagctagacaaaaatgtaccagatcctgtctttgaaagtatcttaactggttcttttccccttatgtcacacccaagcagaagaggtttccaagctagactcagtcgccttcatggaatgtcttcaaagaatattaaaaaatctggagggactccaacttcaatggctacaaactggaccagtgagattcccctataaaccaaatcttctaatgctaataaattagttacgttttgaacatctggggaatgacattcgagggaacctggctcctgtcctcttccctggaggaatatcattgaagtgagagcctctttgatgaaaagatggggctgtttttgctggaggactggtattcttccttttagtcagaagtgaacctgactggggaggctttctagggatttaggttggcccagggtggatagaaactactgtaaattatatatttttctcttttatggttttttttttacattgaatccatttatgtatacttgctttgccaaaatgctaacaaagctagaaaattttaaacttccagatcgacaagtattccttaatgtttatattgtgactgattaagaattaatttttacatatctgactgttgtaaataaaaatcatgatgcattgacatttatggttcatttttagagaagtcttatataaccagcattatttaaaatatttgcattttactcagggtattttaacaagggctaagatgagtagtaggtaaggttgataatctttgctggagtttgtattttgttcagcttcctttctacttgggtaatctgcttgtattgcaaactcattgtattttatagtatagctttcattgtactgcaaaaatcatcctcgttttaaattagccacagtgataactagtctgcactagtagaatcatttaccttttaaattatctgctttgtctgatacctgaaacacatcaaaattattattttggtttagagcttaatgaaacatgtgaaagctggtatttttaacaaatgctgtgtgattctgaatcatattgtcatgtttaaaagtgagagctgcttgtacatctttagaatggcagaccatatgtgtcactgtgagtgtcagaaatacttgcatgagctcattttcaccaactggggggaaaatgtaatgtttctattgatggtataatttagacactataataagttcagccatttgagttcttcaaaatggttatattaaaatgatatttttattaagcttcaataatgaaaaacaatgtgatttaatatgtgtatttttatattattgtatggattaattgttaattcagcatttaatggctaacttaaatatgattggaaaagaaacttcaagttgccattgcttttacctaaagtttttaaagtctgaaagatttcagcaaatgcattaaacaggaatgtgtgacatcttcttttagattgcttgtctaatttggagagattaaaaatggtaaaatgcaactttgagtctctttacctttgcatatttaaaggtacaatagtgtggtgttggtaattgtaagtaagcttttctgtgctatgtctttggagtgaaaattcatgtttttttttctgaattacataaatgcttttgttttattttgtataatgactgtcttttagatctgaataagtcactttaaaaccttggcctatgaactttgccttatcaatcatgaatctagatgaatgctatctagttcttggttcagttttacctatttttatttttggttcactgcttgcttgagcatagctgggatttgtagcccattttctaggcttattgcaatctcactgtggtattttatagaagctattacaactgataggctagcttcatggtattgatgatacatggcttaaccatactaaaagctgctttccctctctaaattgtaaaaaggtgatgaagtttcacttgatggagacatactatatatgtgtgtttatcatggaactagtgcattaggccataagctgtttttctggtctatgttttttgtatttaaaactttactgaagacaatggactccttcgggttttctttctttcaaccctgaattgtccttgtttgaatttttaagtactgtaatttttttttttcaataaaatctctgacttgggcaaaaaaaaaaaaaat

SEQ ID NO: 448624 - DNA, 2206 bp, Homo sapiens
cgccgcctgtcggcttccggaagctcatctcaaaatgctgaactgctctttggaagtcgccggtgctgttgtagttggagtctgttcacgggcctgagcttcgaggccaggctcccgggtgtcgttaatgttcggggccgccgggcgccaaccgatcggagctccagcagccgggaacagctggcatttcagtagaaccatggaggagctggttcatgaccttgtctcagcattggaagagagctcagagcaagctcgaggtggatttgctgaaacaggagaccattctcgaagtatatcttgccctctgaaacgccaggcaaggaaaaggagagggagaaaacggaggtcgtataatgtgcatcacccgtgggagactggtcactgcttaagtgaaggctctgattctagtttagaagaaccaagcaaggactatagagagaatcacaataataataaaaaagatcacagtgactctgatgaccaaatgttagtagcaaagcgcaggccgtcatcaaacttaaataataatgttcgagggaaaagacctctatggcatgagtctgattttgctgtggacaatgttgggaatagaactctgcgcaggaggagaaaggtaaaacgcatggcagtagatctcccacaggacatctctaacaaacggacaatgacccagccacctgagggttgtagagatcaggacatggacagtgatagagcctaccagtatcaagaatttaccaagaacaaagtcaaaaaaagaaagttgaaaataatcagacaaggaccaaaaatccaagatgaaggagtagttttagaaagtgaggaaacgaaccagaccaataaggacaaaatggaatgtgaagagcaaaaagtctcagatgagctcatgagtgaaagtgattccagcagtctcagcagcactgatgctggattgtttaccaatgatgagggaagacaaggtgatgatgaacagagtgactggttctacgaaaaggaatcaggtggagcatgtggtatcactggagttgtgccctggtgggaaaaggaagatcctactgagctagacaaaaatgtaccagatcctgtctttgaaagtatcttaactggttcttttccccttatgtcacacccaagcagaagaggtttccaagctagactcagtcgccttcatggaatgtcttcaaagaatattaaaaaatctggagggactccaacttcaatggtacccattcctggcccagtgggtaacaagagaatggttcatttttccccggattctcatcaccatgaccattggtttagccctggggctaggacagagcatgaccaggtcactaataaggggattgtatcttcgtttggcctaagtccagcaatctgaaagttggaaggtggagaccaaggcttagagaagttaagtactttgcctaaagttacacaggttgtaaatggtaaagctattattggaacctagtgactttttagttactggcccagctgggattagaacccagctctatcctgtattattatttccaagacttttatttttgttggggttaattgctaatattctgtacaacttcgttttagcccagtcttgcatataatcatattttctgcataaataagataagctagagtttgagtgagcacatagtgaagaatattgactatttgtttttttctttccaattagttagggtaaagcaagtgtaaagggaagtggatggtaaggcattttgaggaggcaatcaaatatgtttttttctaattatatatttccaagccaataatttctttgaagaagaatgttttaagcgtgtttctttaccatgttaggccagtaggtacagagaaaataatattagctctttatgtcagcataggtaacaaagccttaaaaaattcacagctgaatgcaacagtgaaggccgttgacaagagaggttgcattacttcaaccagggctactgcagtgaaccaaaaaaagaactgagttctaggcttccatctccaggctacatcttaactgactaagagggcagtttagctgtccaggaagaactcgattgctaactctcactgataattttgcaacagtgacaataaagaatgaattttaaaaagaaaaacttgtctccctgaactattgaactccagaaaaagtagtacttacagtctttgctttaagagaaaccag

SEQ ID NO: 448625 - DNA, 1516 bp, Homo sapiens
cgccgcctgtcggcttccggaagctcatctcaaaatgctgaactgctctttggaagtcgccggtgctgttgtagttggagtctgttcacgggcctgagcttcgaggccaggctcccgggtgtcgttaatgttcggggccgccgggcgccaaccgatcggagctccagcagccgggaacagctggcatttcagtagaaccatggaggagctggttcatgaccttgtctcagcattggaagagagctcagagcaagctcgaggtggatttgctgaaacaggagaccattctcgaagtatatcttgccctctgaaacgccaggcaaggaaaaggagagggagaaaacggaggtcgtataatgtgcatcacccgtgggagactggtcactgcttaagtgaaggctctgattctagtttagaagaaccaagcaaggactatagagagaatcacaataataataaaaaagatcacagtgactctgatgaccaaatgttagtagcaaagcgcaggccgtcatcaaacttaaataataatgttcgagggaaaagacctctatggcatgagtctgattttgctgtggacaatgttgggaatagaactctgcgcaggaggagaaaggtaaaacgcatggcagtagatctcccacaggacatctctaacaaacggacaatgacccagccacctgagggttgtagagatcaggacatggacagtgatagagcctaccagtatcaagaatttaccaagaacaaagtcaaaaaaagaaagttgaaaataatcagacaaggaccaaaaatccaagatgaaggagtagttttagaaagtgaggaaacgaaccagaccaataaggacaaaatggaatgtgaagagcaaaaagtctcagatgagctcatgagtgaaagtgattccagcagtctcagcagcactgatgctggattgtttaccaatgatgagggaagacaaggtgatgatgaacagagtgactggttctacgaaaaggaatcaggtggagcatgtggtatcactggagttgtgccctggtgggaaaaggaagatcctactgagctagacaaaaatgtaccagatcctgtctttgaaagtatcttaactggttcttttccccttatgtcacacccaagcagaagaggtttccaagctagactcagtcgccttcatggaatgtcttcaaagaatattaaaaaatctggagggactccaacttcaatggtacccattcctggcccagtgggtaacaagagaatggttcatttttccccggattctcatcaccatgaccattggtttagccctggggctaggacagagcatgaccaggtaaggaccattgtaatccaaaaggaagttactcagcctctttcaagtatttaactgtctcccttcaggagagtagatcagctttatgagaaaaaatacaaatccccgctcattttaaaaggtgttaattatgtcaacgattaaatacactgaccaaataaatgcgtgatccttaatcagcat

SEQ ID NO: 448626 - DNA, 423 bp, Homo sapiens
tggggaatgagaattctgctctttgcctttcctcttgggatgtgagacttttaataatcttgaaaaatgtcatgaatagccacagaaactcttagttccttttctttaaatgtaaaaaccattatccacaaggtatacttttcttcctggtttaattcagcagtttttccaattgtacctaggttttttacttacagattttaatgtaattcttatatgagttattttttaatatacatctgcaggtcactaataaggggattgtatcttcgtttggcctaagtccagcaatctgaaagttggaaggtaagaagcacttcgcaccatattcacaagttctgtttttgatcagagttgacattattgagtcagaatccagaaagcaacctcacttgtgacactgataggagtccaagggaacag

SEQ ID NO: 448627 - DNA, 938 bp, Homo sapiens
cgccgcctgtcggcttccggaagctcatctcaaaatgctgaactgctctttggaagtcgccggtgctgttgtagttggagtctgttcacgggcctgagcttcgaggccaggctcccgggtgtcgttaatgttcggggccgccgggcgccaaccgatcggagctccagcagccgggaacagctggcatttcagtagaaccatggaggagctggttcatgaccttgtctcagcattggaagagagctcagagcaagctcgaggtggatttgctgaaacaggagaccattctcgaagtatatcttgccctctgaaacgccaggcaaggaaaaggagagggagaaaacggaggtcgtataatgtgcatcacccgtgggagactggtcactgcttaagtgaaggctctgattctagtttagaagaacaaagtcaaaaaaagaaagttgaaaataatcagacaaggaccaaaaatccaagatgaaggagtagttttagaaagtgaggaaacgaaccagaccaataaggacaaaatggaatgtgaagagcaaaaagtctcagatgagctcatgagtgaaaggtgacttttatattctctaaatataaaaatatttatctccagtgtttgtggttgaatgttttatattttaattaattctattttaaaataattataaattgtaataatgatagtgatattactgtttagctatggttatatttccttatactttatgatgtttagcacaaagcaaaattgcttgtttgatttacacaaagtcttttgattgtattataatgactcaattttcagctacaaggaggaaaggaaatggattttcagtggaaaagaatgtgcttttgaataacagcacgtttgtaactcagaattggatatataattatatgtttaattatagacctttagcttttggtactttata

SEQ ID NO: 448628 - DNA, 2359 bp, Homo sapiens
cgccgcctgtcggcttccggaagctcatctcaaaatgctgaactgctctttggaagtcgccggtgctgttgtagttggagtctgttcacgggcctgagcttcgaggccaggctcccgggtgtcgttaatgttcggggccgccgggcgccaaccgatcggagctccagcagccgggaacagctggcatttcagtagaaccatggaggagctggttcatgaccttgtctcagcattggaagagagctcagagcaagctcgaggtggatttgctgaaacaggagaccattctcgaagtatatcttgccctctgaaacgccaggcaaggaaaaggagagggagaaaacggaggtcgtataatgtgcatcacccgtgggagactggtcactgcttaagtgaaggctctgattctagtttagaagaaccaagcaaggactatagagagaatcacaataataataaaaaagatcacagtgactctgatgaccaaatgttagtagcaaagcgcaggccgtcatcaaacttaaataataatgttcgagggaaaagacctctatggcatgagtctgattttgctgtggacaatgttgggaatagaactctgcgcaggaggagaaaggtaaaacgcatggcagtagatctcccacaggacatctctaacaaacggacaatgacccagccacctgagggttgtagagatcaggacatggacagtgatagagcctaccagtatcaagaatttaccaagaacaaagtcaaaaaaagaaagttgaaaataatcagacaaggaccaaaaatccaagatgaaggagtagttttagaaagtgaggaaacgaaccagaccaataaggacaaaatggaatgtgaagagcaaaaagtctcagatgagctcatgagtgaaagtgattccagcagtctcagcagcactgatgctggattgtttaccaatgatgagggaagacaaggtgatgatgaacagagtgactggttctacgaaaaggaatcaggtggagcatgtggtatcactggagttgtgccctggtgggaaaaggaagatcctactgagctagacaaaaatgtaccagatcctgtctttgaaagtatcttaactggttcttttccccttatgtcacacccaagcagaagaggtttccaagctagactcagtcgccttcatggaatgtcttcaaagaatattaaaaaatctggagggactccaacttcaatggtacccattcctggcccagtgggtaacaagagaatggttcatttttccccggattctcatcaccatgaccattggtttagccctggggctaggacagagcatgaccagcatcagcttctgagagataatcgagctgaaagaggacacaagaaaaattgttctgtgagaacagccagcaggcaaacaagcatgcatttaggatccttatgcacgggagatatcaaacggagaagaaaagctgcacctttgcctggacctactactgcaggatttgtaggtgaaaatgcccagccaatcctagaaaataatattggaaaccgaatgcttcagaatatgggctggacgcctgggtcaggccttggacgagatggcaaggggatctctgagccaattcaagccatgcagaggccaaagggattaggacttggatttcctctaccaaaaagtacttccgcaactactacccccaatgcaggaaaatccgcctaagaaaagcaaagaagaaatgttttacagactttattcactatgtcccattgttctaaaatgataacatgacttctgtttttgaagcaaaaatctacattgcctcaaacacatcactctagcttccttactgcatacagtcctgccatagtgagagaaatgggatttcatcacaattcatggtgctaaaatgaaaacctctgcactttaatttttttcagtaatttccagctatttctaggtataaagagcagctcgtttctcttatttattttagtctcatgtgtcaatactttccgatgctttgcttaattcatgtatgtgtgcagtgctgcaatgcccagacaaacgtgagcacacccaccagtttctaaaatggaatagacaggaaaagattgtgttttatatcatccctatctattgtaacccaaaagacctaccatcgcatcagtgaagtccgaacacatctttgtttgaaaggcttgtcaatttcatattccttgaattggcttcttggtgaggattttctgacagagtgatacccatcaattttctatccttagacaatgtagtgtgaagttcacagttgacaaacaacaattaatgtttcccttggatgttttgacaaaaataaacctcatcgttgtt

SEQ ID NO: 448629 - DNA, 2033 bp, Homo sapiens
cgccgcctgtcggcttccggaagctcatctcaaaatgctgaactgctctttggaagtcgccggtgctgttgtagttggagtctgttcacgggcctgagcttcgaggccaggctcccgggtgtcgttaatgttcggggccgccgggcgccaaccgatcggagctccagcagccgggaacagctggcatttcagtagaaccatggaggagctggttcatgaccttgtctcagcattggaagagagctcagagcaagctcgaggtggatttgctgaaacaggagaccattctcgaagtatatcttgccctctgaaacgccaggcaaggaaaaggagagggagaaaacggaggtcgtataatgtgcatcacccgtgggagactggtcactgcttaagtgaaggctctgattctagtttagaagaacaaagtcaaaaaaagaaagttgaaaataatcagacaaggaccaaaaatccaagatgaaggagtagttttagaaagtgaggaaacgaaccagaccaataaggacaaaatggaatgtgaagagcaaaaagtctcagatgagctcatgagtgaaagtgattccagcagtctcagcagcactgatgctggattgtttaccaatgatgagggaagacaaggtgatgatgaacagagtgactggttctacgaaaaggaatcaggtggagcatgtggtatcactggagttgtgccctggtgggaaaaggaagatcctactgagctagacaaaaatgtaccagatcctgtctttgaaagtatcttaactggttcttttccccttatgtcacacccaagcagaagaggtttccaagctagactcagtcgccttcatggaatgtcttcaaagaatattaaaaaatctggagggactccaacttcaatggtacccattcctggcccagtgggtaacaagagaatggttcatttttccccggattctcatcaccatgaccattggtttagccctggggctaggacagagcatgaccagcatcagcttctgagagataatcgagctgaaagaggacacaagaaaaattgttctgtgagaacagccagcaggcaaacaagcatgcatttaggatccttatgcacgggagatatcaaacggagaagaaaagctgcacctttgcctggacctactactgcaggatttgtaggtgaaaatgcccagccaatcctagaaaataatattggaaaccgaatgcttcagaatatgggctggacgcctgggtcaggccttggacgagatggcaaggggatctctgagccaattcaagccatgcagaggccaaagggattaggacttggatttcctctaccaaaaagtacttccgcaactactacccccaatgcaggaaaatccgcctaagaaaagcaaagaagaaatgttttacagactttattcactatgtcccattgttctaaaatgataacatgacttctgtttttgaagcaaaaatctacattgcctcaaacacatcactctagcttccttactgcatacagtcctgccatagtgagagaaatgggatttcatcacaattcatggtgctaaaatgaaaacctctgcactttaatttttttcagtaatttccagctatttctaggtataaagagcagctcgtttctcttatttattttagtctcatgtgtcaatactttccgatgctttgcttaattcatgtatgtgtgcagtgctgcaatgcccagacaaacgtgagcacacccaccagtttctaaaatggaatagacaggaaaagattgtgttttatatcatccctatctattgtaacccaaaagacctaccatcgcatcagtgaagtccgaacacatctttgtttgaaaggcttgtcaatttcatattccttgaattggcttcttggtgaggattttctgacagagtgatacccatcaattttctatccttagacaatgtagtgtgaagttcacagttgacaaacaacaattaatgtttcccttggatgttttgacaaaaataaacctcatcgttgtt

SEQ ID NO: 448630 - DNA, 1264 bp, Homo sapiens
cgccgcctgtcggcttccggaagctcatctcaaaatgctgaactgctctttggaagtcgccggtgctgttgtagttggagtctgttcacgggcctgagcttcgaggccaggctcccgggtgtcgttaatgttcggggccgccgggcgccaaccgatcggagctccagcagccgggaacagctggcatttcagtagaaccatggaggagctggttcatgaccttgtctcagcattggaagagagctcagagcaagctcgaggtggatttgctgaaacaggagaccattctcgaagtatatcttgccctctgaaacgccaggcaaggaaaaggagagggagaaaacggaggtcgtataatgtgcatcacccgtgggagactggtcactgcttaagtgaaggctctgattctagtttagaagaaccaagcaaggactatagagagaatcacaataataataaaaaagatcacagtgactctgatgaccaaatgttagtagcaaagcgcaggccgtcatcaaacttaaataataatgttcgagggaaaagacctctatggcatgagtctgattttgctgtggacaatgttgggaatagaactctgcgcaggaggagaaaggtaaaacgcatggcagtagatctcccacaggacatctctaacaaacggacaatgacccagccacctgagggttgtagagatcaggacatggacagtgatagagcctaccagtatcaagaatttaccaagaacaaagtcaaaaaaagaaagttgaaaataatcagacaaggaccaaaaatccaagatgaaggagtagttttagaaagtgaggaaacgaaccagaccaataaggacaaaatggaatgtgaagagcaaaaagtctcagatgagctcatgagtgaaaggtgacttttatattctctaaatataaaaatatttatctccagtgtttgtggttgaatgttttatattttaattaattctattttaaaataattataaattgtaataatgatagtgatattactgtttagctatggttatatttccttatactttatgatgtttagcacaaagcaaaattgcttgtttgatttacacaaagtcttttgattgtattataatgactcaattttcagctacaaggaggaaaggaaatggattttcagtggaaaagaatgtgcttttgaataacagcacgtttgtaactcagaattggatatataattatatgtttaattatagacctttagcttttggtactttata

SEQ ID NO: 448631 - DNA, 1439 bp, Homo sapiens
ggtccctccgggctgcagccggcagcccacgtccagggagggcggagggaggaggagaggcgcggagaggagggaggggagaggggagggaggaaggcgagagaaagggagctgcttccatcccggacttcccagagcctgcctggagcgcgtactcagcggctctcgggtcccagcgtcccagccgcggcccgcgctcctccgccccgctcctcctcctcctcttcctcctcctcctcctctctaggcacccccgtcccctccttccagcggctgcagcccccagccccaactctccgcgcttactcctgggacgcgcgtcctcgccccatcctttgcttccttccttccttccttcttccttcctcccctggctcccgccctccctctccaggtcgccctcccggggcccgattgtctcggtgccccgctcccggcccgcgccctgccccgtctctcccttgcacttcctgagtcgcccgccgccgccgtcgcagactcgccgcgggagccccagcccaacccgagcccgacagccactgccccggctccagctccagccccacagcccgcggcgcccgcccgagggagccccggcgcccggggaaggctccagtgggctagcgcgccctcgcccagccccgcgccccagccctgcccggcccggcgaggaaggaccgggaagatgaacaacggcggcaaagccgagaaggagaacaccccgagcgaggccaaccttcaggaggaggaggtccggaccctatttgtcagtggccttcctctggatatcaaacctcgggagctctatctgcttttcagaccatttaagggctatgagggttctcttataaagctcacatctaaacagcctgtaggttttgtcagttttgacagtcgctcagaagcagaggctgcaaagaatgctttgaatggcatccgcttcgatcctgaaattccgcaaacactacgactagagtttgctaaggcaaacacgaagatggccaagaacaaactcgtagggactccaaaccccagtactcctctgcccaacactgtacctcagttcattgccagagagccatatgagctcacagtgcctgcactttaccccagtagccctgaagtgtgggccccgtaccctctgtacccagcggagttagcgcctgctctacctcctcctgctttcacctatcccgcttcactgcatgcccagtgtttctctcctgaggcaaagcccaacacacctgtcttttgtccacttctccagcaaattagatttgtctctgggaatgtgtttgtaacataccaacctactgcagaccagcagagggagctcccatgttgaatttgtttgttagctattttcccccctttcacaaaaactatttcttgacgacctttgagagatttcaataaaaattttaatcagagcaaaaatg

SEQ ID NO: 448632 - DNA, 1509 bp, Homo sapiens
ggtccctccgggctgcagccggcagcccacgtccagggagggcggagggaggaggagaggcgcggagaggagggaggggagaggggagggaggaaggcgagagaaagggagctgcttccatcccggacttcccagagcctgcctggagcgcgtactcagcggctctcgggtcccagcgtcccagccgcggcccgcgctcctccgccccgctcctcctcctcctcttcctcctcctcctcctctctaggcacccccgtcccctccttccagcggctgcagcccccagccccaactctccgcgcttactcctgggacgcgcgtcctcgccccatcctttgcttccttccttccttccttcttccttcctcccctggctcccgccctccctctccaggtcgccctcccggggcccgattgtctcggtgccccgctcccggcccgcgccctgccccgtctctcccttgcacttcctgagtcgcccgccgccgccgtcgcagactcgccgcgggagccccagcccaacccgagcccgacagccactgccccggctccagctccagccccacagcccgcggcgcccgcccgagggagccccggcgcccggggaaggctccagtgggctagcgcgccctcgcccagccccgcgccccagccctgcccggcccggcgaggaaggaccgggaagatgaacaacggcggcaaagccgagaaggagaacaccccgagcgaggccaaccttcaggaggaggaggtccggaccctatttgtcagtggccttcctctggatatcaaacctcgggagctctatctgcttttcagaccatttaagggctatgagggttctcttataaagctcacatctaaacagcctgtaggttttgtcagttttgacagtcgctcagaagcagaggctgcaaagaatgctttgaatggcatccgcttcgatcctgaaattccgcaaacactacgactagagtttgctaaggcaaacacgaagatggccaagaacaaactcgtagggactccaaaccccagtactcctctgcccaacactgtacctcagttcattgccagagagccatatgagctcacagtgcctgcactttaccccagtagccctgaagtgtgggccccgtaccctctgtacccagcggagttagcgcctgctctacctcctcctgctttcacctatcccgcttcactgcatgcccagatgcgctggctccctccctccgaggctacttctcagggctggaagtcccgtcagttctgctgaatactatgtcccaggtgtgtgatggcggctgcaatctgtcttgtgggtattaatgcaatcttcagtggtggctactgttctctagctgttctacaaaactggagcatgctggcttgaaaaacccttgcccagttttgatcccttcaagactttgtcacagcctctatcacacatctgtttttctcgaagaaaaaaatataattaataaaaatgttttactcttttacactgta

SEQ ID NO: 448633 - DNA, 801 bp, Homo sapiens
gcggccgcacttctggttgcgcggcccacactggccgccattgtggtggaggtcggagcgagtctcctgggcccgaaccggctgttggaagtgcgagggcaccgagagccacggtccggaccctatttgtcagtggccttcctctggatatcaaacctcgggagctctatctgcttttcagaccatttaagggctatgagggttctcttataaagctcacatctaaacagcctgtaggttttgtcagttttgacagtcgctcagaagcagaggctgcaaagaatgctttgaatggcatccgcttcgatcctgaaattccgcaaacactacgactagagtttgctaaggcaaacacgaagatggccaagaacaaactcgtagggactccaaaccccagtactcctctgcccaacactgtacctcagttcattgccagagagccatatgagctcacagtgcctgcactttaccccagtagccctgaagtgtgggccccgtaccctctgtacccagcggagttagcgcctgctctacctcctcctgctttcacctatcccgcttcactgcatgcccagtgtttctctcctgaggcaaagcccaacacacctgtcttttgtccacttctccagcaaattagatttgtctctgggaatgtgtttgtaacataccaacctactgcagaccagcagagggagctcccatgttgaatttgtttgttagctattttcccccctttcacaaaaactatttcttgacgacctttgagagatttcaataaaaattttaatcagagcaaaaatg

SEQ ID NO: 448634 - DNA, 1595 bp, Homo sapiens
ggtccctccgggctgcagccggcagcccacgtccagggagggcggagggaggaggagaggcgcggagaggagggaggggagaggggagggaggaaggcgagagaaagggagctgcttccatcccggacttcccagagcctgcctggagcgcgtactcagcggctctcgggtcccagcgtcccagccgcggcccgcgctcctccgccccgctcctcctcctcctcttcctcctcctcctcctctctaggcacccccgtcccctccttccagcggctgcagcccccagccccaactctccgcgcttactcctgggacgcgcgtcctcgccccatcctttgcttccttccttccttccttcttccttcctcccctggctcccgccctccctctccaggtcgccctcccggggcccgattgtctcggtgccccgctcccggcccgcgccctgccccgtctctcccttgcacttcctgagtcgcccgccgccgccgtcgcagactcgccgcgggagccccagcccaacccgagcccgacagccactgccccggctccagctccagccccacagcccgcggcgcccgcccgagggagccccggcgcccggggaaggctccagtgggctagcgcgccctcgcccagccccgcgccccagccctgcccggcccggcgaggaaggaccgggaagatgaacaacggcggcaaagccgagaaggagaacaccccgagcgaggccaaccttcaggaggaggaggtccggaccctatttgtcagtggccttcctctggatatcaaacctcgggagctctatctgcttttcagaccatttaagggctatgagggttctcttataaagctcacatctaaacagcctgtaggttttgtcagttttgacagtcgctcagaagcagaggctgcaaagaatgctttgaatggcatccgcttcgatcctgaaattccgcaaacactacgactagagtttgctaaggcaaacacgaagatggccaagaacaaactcgtagggactccaaaccccagtactcctctgcccaacactgtacctcagttcattgccagagagccatatgagctcacagtgcctgcactttaccccagtagccctgaagtgtgggccccgtaccctctgtacccagcggagttagcgcctgctctacctcctcctgctttcacctatcccgcttcactgcatgcccagctctgtgaaggtcagactgtgaggagaagccaccccttgagcgctccgtctcctgatagtgccagcctggcctggtttcctgtttgatgcgctggctccctccctccgaggctacttctcagggctggaagtcccgtcagttctgctgaatactatgtcccaggtgtgtgatggcggctgcaatctgtcttgtgggtattaatgcaatcttcagtggtggctactgttctctagctgttctacaaaactggagcatgctggcttgaaaaacccttgcccagttttgatcccttcaagactttgtcacagcctctatcacacatctgtttttctcgaagaaaaaaatataattaataaaaatgttttactcttttacactgta

SEQ ID NO: 448635 - DNA, 1471 bp, Homo sapiens
ggtccctccgggctgcagccggcagcccacgtccagggagggcggagggaggaggagaggcgcggagaggagggaggggagaggggagggaggaaggcgagagaaagggagctgcttccatcccggacttcccagagcctgcctggagcgcgtactcagcggctctcgggtcccagcgtcccagccgcggcccgcgctcctccgccccgctcctcctcctcctcttcctcctcctcctcctctctaggcacccccgtcccctccttccagcggctgcagcccccagccccaactctccgcgcttactcctgggacgcgcgtcctcgccccatcctttgcttccttccttccttccttcttccttcctcccctggctcccgccctccctctccaggtcgccctcccggggcccgattgtctcggtgccccgctcccggcccgcgccctgccccgtctctcccttgcacttcctgagtcgcccgccgccgccgtcgcagactcgccgcgggagccccagcccaacccgagcccgacagccactgccccggctccagctccagccccacagcccgcggcgcccgcccgagggagccccggcgcccggggaaggctccagtgggctagcgcgccctcgcccagccccgcgccccagccctgcccggcccggcgaggaaggaccgggaagatgaacaacggcggcaaagccgagaaggagaacaccccgagcgaggccaaccttcaggaggaggaggtccggaccctatttgtcagtggccttcctctggatatcaaacctcgggagctctatctgcttttcagaccatttaagggctatgagggttctcttataaagctcacatctaaacagcctgtaggttttgtcagttttgacagtcgctcagaagcagaggctgcaaagaatgctttgaatggcatccgcttcgatcctgaaattccgcaaacactacgactagagtttgctaaggcaaacacgaagatggccaagaacaaactcgtagggactccaaaccccagtactcctctgcccaacactgtacctcagttcattgccagagagccatatgagctcacagtgcctgcactttaccccagtagccctgaagtgtgggccccgtaccctctgtacccagcggagttagcgcctgctctacctcatgcgctggctccctccctccgaggctacttctcagggctggaagtcccgtcagttctgctgaatactatgtcccaggtgtgtgatggcggctgcaatctgtcttgtgggtattaatgcaatcttcagtggtggctactgttctctagctgttctacaaaactggagcatgctggcttgaaaaacccttgcccagttttgatcccttcaagactttgtcacagcctctatcacacatctgtttttctcgaagaaaaaaatataattaataaaaatgttttactcttttacactgta

SEQ ID NO: 448636 - DNA, 501 bp, Homo sapiens
atctttcttctctaagtagatgggaagcctgtaagaagagacttggaggcaaagcaaagggaatcagcacttaaccctcacccaaagggcccaagagaatctttagtaactggaggcagagcagactggagcctctacggggcatctccccatattggagaattcagtctttgttttggaaatcttataatgtctttggagaggctttaaataattttgtttttcttagcaatgttatgctctattttgagacatggattttttttttcttctagtgtttctctcctgaggcaaagcccaacacacctgtcttttgtccacttctccagcaaattagatttgtctctgggaatgtgtttgtaacataccaacctactgcagaccagcagagggagctcccatgttgaatttgtttgttagctattttcccccctttcacaaaaactatttcttgacgacctttgagagatttcaataaaaattttaatcagagcaaaaatg

SEQ ID NO: 448637 - DNA, 1683 bp, Homo sapiens
ttgggagccaagtggggtgtagggggacgtcttctttcaggactcttgaaattttcctggccatggaccgggaccagagcccagaaattataagcacatgtagttacagcctccccagattggagaaggaaatgcaagagagaacgtgacggaatttggagctatttttcccttctcttctgttttgggtggaatggccttgcctgtctttggctgtgagcttgagtcatcctcagtagagtcccaggtgctggtgcccaggtggagcttagagcttaacaaggaggaaaggcactggggctccagaggcccagacagctgcggtggctcctgctgtcacgctggcctccccttagaagaaagccacctgtccatgtcatgctatcacactgcggtgcacccaccaaccagtatgaggctgtgaggtctgcacatcacacctaaggctactaacgccgtaactgtccgtcatacctaaggctaatacggtgagcagctgcagcgtcctggggaggagatgggtaataggtaatcaaatagacataatagtttgggtggtgatagtattcagggaataaataataaggccaggtaagcagctcagtgttgtggtacggccagcacttctggtgccttctgcttcaagttagcaaagcaggcagggtccgcctgagaaggtaacatctcagcaaagacctagaacttcaccagctttatacggggtttctttttcagaacacattccactttagtgaggcttggaaaatatttaactcctgtaatcttaaagtaaatggactggaagtgcagcaggcttggctcccacgcagcactaaggaatcactgggagagtgtgcagggccctcctcagagacctttctctgttttcccagtgaggagacgcaagcctggttctgcaattctttccagctctggagtctgttatggttcccatctgagctctaaaggtaggggtgggcctgaagaccctccacactgtcagtcctgtggacgtggtgggtgcccctctagccaccactgtcctccggactgtgccacatcacaagcacttaccgagctcctctacaaaccacgtgacaaccaaatgcagtgaaaactgcagccccccaacctgctcctgcccattgtgttttctgtggatctgtctggagtccttggagactcctgagcatgtgcactggcagagctgcctgactcttccctggaagaagttcaaagagggtagccacgtgttcagaccaggccatggggtctgggggctccgcgactcctgagagcaattcctggccggactctggctcatgttactgcccccacctccccccgcccaggtaaacccgggggtgcagacaactgttgttgaggtcccaggagcgggttgtcccctatgctcctggggacatggaggagagggagggtcccaggatcccagtacttgtatgagtcgcactgattagctgaagcccagaggcttcttaatcatcctagaaatacagcctcccgggaaatgtggcctggctctgcagctctgggtggctcgtgctctccctcctgtgtggaggggtcctggagaggttgggtgagctgattgataggtttcatgtgcaaagatgattattttcctgttctcaagtaacccaacttttgctaggaaactagaat

SEQ ID NO: 448638 - DNA, 1194 bp, Homo sapiens
ttgggagccaagtggggtgtagggggacgtcttctttcaggactcttgaaattttcctggccatggaccgggaccagagcccagaaattataagcacatgtagttacagcctccccagattggagaaggaaatgcaagagagaacgtgacggaatttggagctatttttcccttctcttctgttttgggtggaatggccttgcctgtctttggctgtgagcttgagtcatcctcagtagagtcccaggtgctggtgcccaggtggagcttagagcttaacaaggaggaaaggcactggggctccagaggcccagacagctgcggtggctcctgctgtcacgctggcctccccttagaagaaagccacctgtccatgtcatgctatcacactgcggtgcacccaccaaccagtatgaggctgtgaggtctgcacatcacacctaaggctactaacgccgtaactgtccgtcatacctaaggctaatacggtgagcagctgcagcgtcctggggaggagatgggtaataggtaatcaaatagacataatagtttgggtggtgatagtattcagggaataaataataaggccaggtaagcagctcagtgttgtggtacggccagcacttctggtgccttctgcttcaagttagcaaagcaggcagggtccgcctgagaaggtaacatctcagcaaagacctagaacttcaccagctttatacggggtttctttttcagaacacattccactttagtgaggcttggaaaatatttaactcctgtaatcttaaagtaaatggactggaagtgcagcaggcttggctcccacgcagcactaaggaatcactgggagagtgtgcagggccctcctcagagacctttctctgttttcccagtgaggagacgcaagcctggttctgcaattctttccagctctggagtctgttatggttcccatctgagctctaaaggtcccaggtgtgtgatggcggctgcaatctgtcttgtgggtattaatgcaatcttcagtggtggctactgttctctagctgttctacaaaactggagcatgctggcttgaaaaacccttgcccagttttgatcccttcaagactttgtcacagcctctatcacacatctgtttttctcgaagaaaaaaatataattaataaaaatgttttactcttttacactgta

SEQ ID NO: 448639 - DNA, 721 bp, Homo sapiens
gtcacaggtcagatacaaattggacagatttggtgtgaacatttacaagctcatcccgtacgctatgtttcagtggtcacctaaatattctcatttcaggactttttaaaacacattttcccaaatctaacttgggacaaaatctaacttgggacatttaaataggttatcaataattatctgtttatggcctctttcggcacacaaataagcatctccctgtacaaaattctagtgtatgctgagctgattgattgccttctgcatacaccttttctacaacttctcaaacgtgtgtgacatgctggtaagatggcaggaaaaggagtgactgaataatacaatatagctgagatgtgtttcaagaaaacctctgggccagggtaggggtttgtgagcgggagccaaggacttgccccatgtttctaatcaaggtgagaccactgacacatgtggtcagcaaatatgttctatacacacatccgcacactgtcatctaacccatccgttctcccatccacagcatctccaggacaaagccatcgcaactagggaggggttgacacctgctctcctaacatgttttctttctgtttcaggcttgaaaaacccttgcccagttttgatcccttcaagactttgtcacagcctctatcacacatctgtttttctcgaagaaaaaaatataattaataaaaatgttttactcttttacactgta

SEQ ID NO: 448640 - DNA, 524 bp, Homo sapiens
gcggccgcacttctggttgcgcggcccacactggccgccattgtggtggaggtcggagcgagtctcctgggcccgaaccggctgttggaagtgcgagggcaccgagagccacggtacctgtgagggatctctttaacttcctcagatgggatgggggaaagatcagagggtgacacttcgggtgaccgatgcctgaactggggcttccgggggaaggctatagaaagacttggcgataagctctccgaccgtgactcctaccattacttttatttacttatcatagctttttaaaaaactttgaaattaataataattcccctgaaatatccacctgtggcagtggagcaatgaaagcacgtgcttaagtattctcgtccacacagttggcagtggctcctccgtacggaaagcagttgtgatagagtcacctcaagccctgcagcttctccacaacccgaatctggaatatgttgcgtggatattgcctttttgtaaaatattggaatccgttggcccaaagt

SEQ ID NO: 448641 - DNA, 739 bp, Homo sapiens
tgattctttgctaggtctttgcaccttcgtatttcaaaattctcagaccctagggtacaagtagccagatatcttcacaaatgtgcatccttttagtttttgttttccaggagatgcttggagcaaagtttagtccttggtgcctgtgacagacagggatttcctatggccttgggctgaccaaagctgctcagctcctggaggtggctgtttctggatcttgctgtgtgggggcctcaggtcccatgcctttcctctgcagggcctttggacagtcctccgggtctaggccacagcccttgggatgcaaccacagggacgtgggtgtagagtcctgcttgctgggcctgcagcctcctaatgcgccctcagcgaagagttcacatgcttttcttggaatgtccttcctcgctggcccccagaagcctcctcttacttgctccgccaagtcctcagtgcgttttcctggctgagagcttttcatgtcgcatatccaaggccattctgcagcagcctctggtcctcagctcagcagcagaggcctttgatctctttcggcgttgcctctcttggctctctgccctcagaacaggccggtcttcaagaccgaggcagccccaggtggaggttactgtgcaccgttaacgggtgatctttctccatcccactctatcacacatctgtttttctcgaagaaaaaaatataattaataaaaatgttttactcttttacactgta

SEQ ID NO: 448642 - DNA, 425 bp, Homo sapiens
gtcggcacccattggtcgagagaattatgagctcacagtgcctgcactttaccccagtagccctgaagtgtgggccccgtaccctctgtacccagcggagttagcgcctgctctacctcctcctgctttcacctatcccgcttcactgcatgcccagtgtttctctcctgaggcaaagcccaacacacctgtcttttgtccacttctccagcaaattagatttgtctctgggaatgtgtttgtaacataccaacctactgcagaccagcagagggagctcccatgttgaatttgtttgttagctattttcccccctttcacaaaaactactcggaccaatgttggtcgccttgagggtggttgttgcttgctggaaacaggcaagagtcgtgttggaagcatttctaatttctctcggacctacg

SEQ ID NO: 448643 - DNA, 877 bp, Homo sapiens
ggtgcgggcggccggcggggcgcgggcccggggcgcggcggtggaagaaggttcaggcatggcccgtgccccggacgcagccccacagtgtggcccggggagggtggatctcgggagcgtgtgtttttgtgtccacgcgcgtctgcgggccccaaattgcgtaactccaaggacttttcggagacttttgtccggaccctatttgtcagtggccttcctctggatatcaaacctcgggagctctatctgcttttcagaccatttaagggctatgagggttctcttataaagctcacatctaaacagcctgtaggttttgtcagttttgacagtcgctcagaagcagaggctgcaaagaatgctttgaatggcatccgcttcgatcctgaaattccgcaaacactacgactagagtttgctaaggcaaacacgaagatggccaagaacaaactcgtagggactccaaaccccagtactcctctgcccaacactgtacctcagttcattgccagagagccatatgagctcacagtgcctgcactttaccccagtagccctgaagtgtgggccccgtaccctctgtacccagcggagttagcgcctgctctacctcctcctgctttcacctatcccgcttcactgcatgcccagtgtttctctcctgaggcaaagcccaacacacctgtcttttgtccacttctccagcaaattagatttgtctctgggaatgtgtttgtaacataccaacctactgcagaccagcagagggagctcccatgttgaatttgtttgttagctattttcccccctttcacaaaaactatttcttgacgacctttgagagatttcaataaaaattttaatcagagcaaaaatg

SEQ ID NO: 448644 - DNA, 744 bp, Homo sapiens
tgcagtacagttgctgcctcttacttgtcctgttatctgacagcgttccttttcaggtccggaccctatttgtcagtggccttcctctggatatcaaacctcgggagctctatctgcttttcagaccatttaagggctatgagggttctcttataaagctcacatctaaacagcctgtaggttttgtcagttttgacagtcgctcagaagcagaggctgcaaagaatgctttgaatggcatccgcttcgatcctgaaattccgcaaacactacgactagagtttgctaaggcaaacacgaagatggccaagaacaaactcgtagggactccaaaccccagtactcctctgcccaacactgtacctcagttcattgccagagagccatatgagctcacagtgcctgcactttaccccagtagccctgaagtgtgggccccgtaccctctgtacccagcggagttagcgcctgctctacctcctcctgctttcacctatcccgcttcactgcatgcccagtgtttctctcctgaggcaaagcccaacacacctgtcttttgtccacttctccagcaaattagatttgtctctgggaatgtgtttgtaacataccaacctactgcagaccagcagagggagctcccatgttgaatttgtttgttagctattttcccccctttcacaaaaactatttcttgacgacctttgagagatttcaataaaaattttaatcagagcaaaaatg

SEQ ID NO: 448645 - DNA, 708 bp, Homo sapiens
tcctaaatttatttttccaggtccggaccctatttgtcagtggccttcctctggatatcaaacctcgggagctctatctgcttttcagaccatttaagggctatgagggttctcttataaagctcacatctaaacagcctgtaggttttgtcagttttgacagtcgctcagaagcagaggctgcaaagaatgctttgaatggcatccgcttcgatcctgaaattccgcaaacactacgactagagtttgctaaggcaaacacgaagatggccaagaacaaactcgtagggactccaaaccccagtactcctctgcccaacactgtacctcagttcattgccagagagccatatgagctcacagtgcctgcactttaccccagtagccctgaagtgtgggccccgtaccctctgtacccagcggagttagcgcctgctctacctcctcctgctttcacctatcccgcttcactgcatgcccagtgtttctctcctgaggcaaagcccaacacacctgtcttttgtccacttctccagcaaattagatttgtctctgggaatgtgtttgtaacataccaacctactgcagaccagcagagggagctcccatgttgaatttgtttgttagctattttcccccctttcacaaaaactatttcttgacgacctttgagagatttcaataaaaattttaatcagagcaaaaatg

SEQ ID NO: 448646 - DNA, 1469 bp, Homo sapiens
ggtccctccgggctgcagccggcagcccacgtccagggagggcggagggaggaggagaggcgcggagaggagggaggggagaggggagggaggaaggcgagagaaagggagctgcttccatcccggacttcccagagcctgcctggagcgcgtactcagcggctctcgggtcccagcgtcccagccgcggcccgcgctcctccgccccgctcctcctcctcctcttcctcctcctcctcctctctaggcacccccgtcccctccttccagcggctgcagcccccagccccaactctccgcgcttactcctgggacgcgcgtcctcgccccatcctttgcttccttccttccttccttcttccttcctcccctggctcccgccctccctctccaggtcgccctcccggggcccgattgtctcggtgccccgctcccggcccgcgccctgccccgtctctcccttgcacttcctgagtcgcccgccgccgccgtcgcagactcgccgcgggagccccagcccaacccgagcccgacagccactgccccggctccagctccagccccacagcccgcggcgcccgcccgagggagccccggcgcccggggaaggctccagtgggctagcgcgccctcgcccagccccgcgccccagccctgcccggcccggcgaggaaggaccgggaagatgaacaacggcggcaaagccgagaaggagaacaccccgagcgaggccaaccttcaggaggaggaggtccggaccctatttgtcagtggccttcctctggatatcaaacctcgggagctctatctgcttttcagaccatttaagggctatgagggttctcttataaagctcacatctaaacagcctgtaggttttgtcagttttgacagtcgctcagaagcagaggctgcaaagaatgctttgaatggcatccgcttcgatcctgaaattccgcaaacactacgactagagtttgctaaggcaaacacgaagatggccaagaacaaactcgtagggactccaaaccccagtactcctctgcccaacactgtacctcagttcattgccagagagccatatgagctcacagtgcctgcactttaccccagtagccctgaagtgtgggccccgtaccctctgtacccagcggagttagcgcctgctctacctcctcctgctttcacctatcccgcttcactgcatgcccagtgtttctctcctgaggcaaagcccaacacacctgtcttttgtccacttctccagcaaattagatttgtctctgggaatgtgtttgtaacataccaacctactgcagaccagcagagggagctcccatgttgaatttgtttgttagctattttcccccctttcacaaaaactatttcttgacgacctttgagagatttcaataaaaattttaatcagagcaaaaatgaactcaagtagactgcagcgttttgttttc

SEQ ID NO: 448647 - DNA, 1481 bp, Homo sapiens
ggtccctccgggctgcagccggcagcccacgtccagggagggcggagggaggaggagaggcgcggagaggagggaggggagaggggagggaggaaggcgagagaaagggagctgcttccatcccggacttcccagagcctgcctggagcgcgtactcagcggctctcgggtcccagcgtcccagccgcggcccgcgctcctccgccccgctcctcctcctcctcttcctcctcctcctcctctctaggcacccccgtcccctccttccagcggctgcagcccccagccccaactctccgcgcttactcctgggacgcgcgtcctcgccccatcctttgcttccttccttccttccttcttccttcctcccctggctcccgccctccctctccaggtcgccctcccggggcccgattgtctcggtgccccgctcccggcccgcgccctgccccgtctctcccttgcacttcctgagtcgcccgccgccgccgtcgcagactcgccgcgggagccccagcccaacccgagcccgacagccactgccccggctccagctccagccccacagcccgcggcgcccgcccgagggagccccggcgcccggggaaggctccagtgggctagcgcgccctcgcccagccccgcgccccagccctgcccggcccggcgaggaaggaccgggaagatgaacaacggcggcaaagccgagaaggagaacaccccgagcgaggccaaccttcaggaggaggaggtccggaccctatttgtcagtggccttcctctggatatcaaacctcgggagctctatctgcttttcagaccatttaagggctatgagggttctcttataaagctcacatctaaacagcctgtaggttttgtcagttttgacagtcgctcagaagcagaggctgcaaagaatgctttgaatggcatccgcttcgatcctgaaattccgcaaacactacgactagagtttgctaaggcaaacacgaagatggccaagaacaaactcgtagggactccaaaccccagtactcctctgcccaacactgtacctcagttcattgccagagagccatatgagctcacagtgcctgcactttaccccagtagccctgaagtgtgggccccgtaccctctgtacccagcggagttagcgcctgctctacctcctcctgctttcacctatcccgcttcactgcatgcccagtgtttctctcctgaggcaaagcccaacacacctgtcttttgtccacttctccagcaaattagatttgtctctgggaatgtgtttgtaacataccaacctactgcagaccagcagagggagctcccatgttgaatttgtttgttagctattttcccccctttcacaaaaactactcggaccaatgttggtcgccttgagggtggttgttgcttgctggaaacaggcaagagtcgtgttggaagcatttctaatttctctcggacctacg

SEQ ID NO: 448648 - DNA, 2280 bp, Homo sapiens
ggtccctccgggctgcagccggcagcccacgtccagggagggcggagggaggaggagaggcgcggagaggagggaggggagaggggagggaggaaggcgagagaaagggagctgcttccatcccggacttcccagagcctgcctggagcgcgtactcagcggctctcgggtcccagcgtcccagccgcggcccgcgctcctccgccccgctcctcctcctcctcttcctcctcctcctcctctctaggcacccccgtcccctccttccagcggctgcagcccccagccccaactctccgcgcttactcctgggacgcgcgtcctcgccccatcctttgcttccttccttccttccttcttccttcctcccctggctcccgccctccctctccaggtcgccctcccggggcccgattgtctcggtgccccgctcccggcccgcgccctgccccgtctctcccttgcacttcctgagtcgcccgccgccgccgtcgcagactcgccgcgggagccccagcccaacccgagcccgacagccactgccccggctccagctccagccccacagcccgcggcgcccgcccgagggagccccggcgcccggggaaggctccagtgggctagcgcgccctcgcccagccccgcgccccagccctgcccggcccggcgaggaaggaccgggaagatgaacaacggcggcaaagccgagaaggagaacaccccgagcgaggccaaccttcaggaggaggaggtccggaccctatttgtcagtggccttcctctggatatcaaacctcgggagctctatctgcttttcagaccatttaagggctatgagggttctcttataaagctcacatctaaacagcctgtaggttttgtcagttttgacagtcgctcagaagcagaggctgcaaagaatgctttgaatggcatccgcttcgatcctgaaattccgcaaacactacgactagagtttgctaaggcaaacacgaagatggccaagaacaaactcgtagggactccaaaccccagtactcctctgcccaacactgtacctcagttcattgccagagagccatatgagctcacagtgcctgcactttaccccagtagccctgaagtgtgggccccgtaccctctgtacccagcggagttagcgcctgctctacctcctcctgctttcacctatcccgcttcactgcatgcccaggtaattgatacccatcggccaggacttcactcacttcaccaccagtcctttcaaacttggttcccgagagcacaccatacaactaacacctatccagctaacagatccaccctcaagagattaatgatcccctctaaatcaagctgacactccttcaggactgacgaggatcgtctgacagcaatgatatcacccactgcctgatgtttgccccaaatgacacctctctcttccttaatgatctcacctcatatcgcacatgagagaccggggcaggtttatccacctggctcccagctagctagagggcatcaccagagtgtatacgtgtgtgccttgtgtggaagggctgcagaggaaggtgtgtgctaggagaaggggatatgtgcgtctgtgcgtgtttctgtgtgttgagagttttccactctcgtgtacggtgagaagaatctctgaccaaagggaaagcttccaggggggaaggctgtactttcttaaatatgttacaggaaagattaagggttccttctctccattttcaggaaaccctgtagaaaaggagatacaagatagtgtctaagatggaattacaggtcaaggtagagatctctattctgaccagctttctttcttagttaaaaatagcctgatttttataaacaaacttcctgtttctccgcaaagattactgtctacatactaacacttcctctccccttggagaaaatatttctcttagcttcgcttttagtgcaagtggtagtaatcagtgtaaagattcacctctggagatcaccactcattctttggcctgcaaagattgatgaccagtaacaaatagaaatgtttctctcctgaggcaaagcccaacacacctgtcttttgtccacttctccagcaaattagatttgtctctgggaatgtgtttgtaacataccaacctactgcagaccagcagagggagctcccatgttgaatttgtttgttagctattttcccccctttcacaaaaactatttcttgacgacctttgagagatttcaataaaaattttaatcagagcaaaaatg

SEQ ID NO: 448649 - DNA, 2220 bp, Homo sapiens
ggtccctccgggctgcagccggcagcccacgtccagggagggcggagggaggaggagaggcgcggagaggagggaggggagaggggagggaggaaggcgagagaaagggagctgcttccatcccggacttcccagagcctgcctggagcgcgtactcagcggctctcgggtcccagcgtcccagccgcggcccgcgctcctccgccccgctcctcctcctcctcttcctcctcctcctcctctctaggcacccccgtcccctccttccagcggctgcagcccccagccccaactctccgcgcttactcctgggacgcgcgtcctcgccccatcctttgcttccttccttccttccttcttccttcctcccctggctcccgccctccctctccaggtcgccctcccggggcccgattgtctcggtgccccgctcccggcccgcgccctgccccgtctctcccttgcacttcctgagtcgcccgccgccgccgtcgcagactcgccgcgggagccccagcccaacccgagcccgacagccactgccccggctccagctccagccccacagcccgcggcgcccgcccgagggagccccggcgcccggggaaggctccagtgggctagcgcgccctcgcccagccccgcgccccagccctgcccggcccggcgaggaaggaccgggaagatgaacaacggcggcaaagccgagaaggagaacaccccgagcgaggccaaccttcaggaggaggaggtccggaccctatttgtcagtggccttcctctggatatcaaacctcgggagctctatctgcttttcagaccatttaagggctatgagggttctcttataaagctcacatctaaacagcctgtaggttttgtcagttttgacagtcgctcagaagcagaggctgcaaagaatgctttgaatggcatccgcttcgatcctgaaattccgcaaacactacgactagagtttgctaaggcaaacacgaagatggccaagaacaaactcgtagggactccaaaccccagtactcctctgcccaacactgtacctcagttcattgccagagagccatatgagctcacagtgcctgcactttaccccagtagccctgaagtgtgggccccgtaccctctgtacccagcggagttagcgcctgctctacctcctcctgctttcacctatcccgcttcactgcatgcccaggtaattgatacccatcggccaggacttcactcacttcaccaccagtcctttcaaacttggttcccgagagcacaccatacaactaacacctatccagctaacagatccaccctcaagagattaatgatcccctctaaatcaagctgacactccttcaggactgacgaggatcgtctgacagcaatgatatcacccactgcctgatgtttgccccaaatgacacctctctcttccttaatgatctcacctcatatcgcacatgagagaccggggcaggtttatccacctggctcccagctagctagagggcatcaccagagtgtatacgtgtgtgccttgtgtggaagggctgcagaggaaggtgtgtgctaggagaaggggatatgtgcgtctgtgcgtgtttctgtgtgttgagagttttccactctcgtgtacggtgagaagaatctctgaccaaagggaaagcttccaggggggaaggctgtactttcttaaatatgttacaggaaagattaagggttccttctctccattttcaggaaaccctgtagaaaaggagatacaagatagtgtctaagatggaattacaggtcaaggtagagatctctattctgaccagctttctttcttagttaaaaatagcctgatttttataaacaaacttcctgtttctccgcaaagattactgtctacatactaacacttcctctccccttggagaaaatatttctcttagcttcgcttttagtgcaagtggtagtaatcagtgtaaagattcacctctggagatcaccactcattctttggcctgcaaagattgatgaccagtaacaaatagaaagtacgtacgtaggtttcatttgtctttctgcatgtgtaattcagcctttaaattttaaatttttaaaaattattaggctggacaggcagagttttcgtttgcctgttttgctcagtgtttgtttacaaggctgggtgaaataaacagcttcccagaaaacctcctt

SEQ ID NO: 448650 - DNA, 1741 bp, Homo sapiens
ggtccctccgggctgcagccggcagcccacgtccagggagggcggagggaggaggagaggcgcggagaggagggaggggagaggggagggaggaaggcgagagaaagggagctgcttccatcccggacttcccagagcctgcctggagcgcgtactcagcggctctcgggtcccagcgtcccagccgcggcccgcgctcctccgccccgctcctcctcctcctcttcctcctcctcctcctctctaggcacccccgtcccctccttccagcggctgcagcccccagccccaactctccgcgcttactcctgggacgcgcgtcctcgccccatcctttgcttccttccttccttccttcttccttcctcccctggctcccgccctccctctccaggtcgccctcccggggcccgattgtctcggtgccccgctcccggcccgcgccctgccccgtctctcccttgcacttcctgagtcgcccgccgccgccgtcgcagactcgccgcgggagccccagcccaacccgagcccgacagccactgccccggctccagctccagccccacagcccgcggcgcccgcccgagggagccccggcgcccggggaaggctccagtgggctagcgcgccctcgcccagccccgcgccccagccctgcccggcccggcgaggaaggaccgggaagatgaacaacggcggcaaagccgagaaggagaacaccccgagcgaggccaaccttcaggaggaggaggtccggaccctatttgtcagtggccttcctctggatatcaaacctcgggagctctatctgcttttcagaccatttaagggctatgagggttctcttataaagctcacatctaaacagcctgtaggttttgtcagttttgacagtcgctcagaagcagaggctgcaaagaatgctttgaatggcatccgcttcgatcctgaaattccgcaaacactacgactagagtttgctaaggcaaacacgaagatggccaagaacaaactcgtagggactccaaaccccagtactcctctgcccaacactgtacctcagttcattgccagagagccatatgagctcacagtgcctgcactttaccccagtagccctgaagtgtgggccccgtaccctctgtacccagcggagttagcgcctgctctacctcctcctgctttcacctatcccgcttcactgcatgcccaggaaaccctgtagaaaaggagatacaagatagtgtctaagatggaattacaggtcaaggtagagatctctattctgaccagctttctttcttagttaaaaatagcctgatttttataaacaaacttcctgtttctccgcaaagattactgtctacatactaacacttcctctccccttggagaaaatatttctcttagcttcgcttttagtgcaagtggtagtaatcagtgtaaagattcacctctggagatcaccactcattctttggcctgcaaagattgatgaccagtaacaaatagaaatgtttctctcctgaggcaaagcccaacacacctgtcttttgtccacttctccagcaaattagatttgtctctgggaatgtgtttgtaacataccaacctactgcagaccagcagagggagctcccatgttgaatttgtttgttagctattttcccccctttcacaaaaactatttcttgacgacctttgagagatttcaataaaaattttaatcagagcaaaaatg

SEQ ID NO: 448651 - DNA, 1963 bp, Homo sapiens
  misc_feature (1809)..(1809): n is a, c, g, or t
ggtccctccgggctgcagccggcagcccacgtccagggagggcggagggaggaggagaggcgcggagaggagggaggggagaggggagggaggaaggcgagagaaagggagctgcttccatcccggacttcccagagcctgcctggagcgcgtactcagcggctctcgggtcccagcgtcccagccgcggcccgcgctcctccgccccgctcctcctcctcctcttcctcctcctcctcctctctaggcacccccgtcccctccttccagcggctgcagcccccagccccaactctccgcgcttactcctgggacgcgcgtcctcgccccatcctttgcttccttccttccttccttcttccttcctcccctggctcccgccctccctctccaggtcgccctcccggggcccgattgtctcggtgccccgctcccggcccgcgccctgccccgtctctcccttgcacttcctgagtcgcccgccgccgccgtcgcagactcgccgcgggagccccagcccaacccgagcccgacagccactgccccggctccagctccagccccacagcccgcggcgcccgcccgagggagccccggcgcccggggaaggctccagtgggctagcgcgccctcgcccagccccgcgccccagccctgcccggcccggcgaggaaggaccgggaagatgaacaacggcggcaaagccgagaaggagaacaccccgagcgaggccaaccttcaggaggaggaggtccggaccctatttgtcagtggccttcctctggatatcaaacctcgggagctctatctgcttttcagaccatttaagggctatgagggttctcttataaagctcacatctaaacagcctgtaggttttgtcagttttgacagtcgctcagaagcagaggctgcaaagaatgctttgaatggcatccgcttcgatcctgaaattccgcaaacactacgactagagtttgctaaggcaaacacgaagatggccaagaacaaactcgtagggactccaaaccccagtactcctctgcccaacactgtacctcagttcattgccagagagccattaggtggagctaatgaacatggagagaggcagtgaagtgcagaagtgaagggtctggactcatgatcttgattgattcacatcctggctctgtgagagtcgttgggctggatatttaacctcgctgtgtctcagctttctcataagatgagctcacagtgcctgcactttaccccagtagccctgaagtgtgggccccgtaccctctgtacccagcggagttagcgcctgctctacctcctcctgctttcacctatcccgcttcactgcatgcccagatgcgctggctccctccctccgaggctacttctcagggctggaagtcccgtcagttctgctgaatactatgtcccaggtgtgtgatggcggctgcaatctgtcttgtgggtattaatgcaatcttcagtggtggctactgttctctagctgttctacaaaactggagcatgctggcttgaaaaacccttgcccagttttgatcccttcaagactttgtcacagcctctatcacacatctgtttttctcgaagaaaaaaatataattaataaaaatgttttactcttttacactgtataattgtaagaaatagcgtattatttgtgaatgcatggtctgaaatttctgtacagtttggagatattttcaaacgaaacgtaagagaagtcaacaataaaaccaagaaaagtgagtatttttataccaaacattttaagtatgctgggatggncgatcttacactggttcggactcacagtcattgtccttgactttctgaactgcttgtcacttcaacacaatatctatttatattcctctgaagtaagttgcatgtatgaggcatgtctccaaactattactcaacatatccgaatcgtattgcc

SEQ ID NO: 448652 - DNA, 1292 bp, Homo sapiens
  misc_feature (1060)..(1060): n is a, c, g, or t
  misc_feature (1222)..(1222): n is a, c, g, or t
  misc_feature (1253)..(1253): n is a, c, g, or t
ggtccctccgggctgcagccggcagcccacgtccagggagggcggagggaggaggagaggcgcggagaggagggaggggagaggggagggaggaaggcgagagaaagggagctgcttccatcccggacttcccagagcctgcctggagcgcgtactcagcggctctcgggtcccagcgtcccagccgcggcccgcgctcctccgccccgctcctcctcctcctcttcctcctcctcctcctctctaggcacccccgtcccctccttccagcggctgcagcccccagccccaactctccgcgcttactcctgggacgcgcgtcctcgccccatcctttgcttccttccttccttccttcttccttcctcccctggctcccgccctccctctccaggtcgccctcccggggcccgattgtctcggtgccccgctcccggcccgcgccctgccccgtctctcccttgcacttcctgagtcgcccgccgccgccgtcgcagactcgccgcgggagccccagcccaacccgagcccgacagccactgccccggctccagctccagccccacagcccgcggcgcccgcccgagggagccccggcgcccggggaaggctccagtgggctagcgcgccctcgcccagccccgcgccccagccctgcccggcccggcgaggaaggaccgggaagatgaacaacggcggcaaagccgagaaggagaacaccccgagcgaggccaaccttcaggaggaggaggtccggaccctatttgtcagtggccttcctctggatatcaaacctcgggagctctatctgcttttcagaccatttaagggctatgagggttctcttataaagctcacatctaaacagcctgtaggttttgtcagttttgacagtcgctcagaagcagaggctgcaaagaatgctttgaatggcatccgcttcgatcctgaaattccgcaaacactacgactagagtttgctaaggcaaacacgaagatggccaagaacaaactcgtagggactccaaaccccagtactcctctgcccaacacgtttgcnaacgcagagaggaagagcatttttactttttcctccatgtttgttctgcagcatttccattgatgcatgctattgtagacttcttaggttgaccttggccttgacctccaccactagctcatgacccaaaactgaagatgtgcatcagaaagggacagattnggtctttctgctgtaaaagatattctgcctnagtgcctgctaaaatgttgtgcatagtcctctctgcgtt

SEQ ID NO: 448653 - DNA, 1455 bp, Homo sapiens
ggtccctccgggctgcagccggcagcccacgtccagggagggcggagggaggaggagaggcgcggagaggagggaggggagaggggagggaggaaggcgagagaaagggagctgcttccatcccggacttcccagagcctgcctggagcgcgtactcagcggctctcgggtcccagcgtcccagccgcggcccgcgctcctccgccccgctcctcctcctcctcttcctcctcctcctcctctctaggcacccccgtcccctccttccagcggctgcagcccccagccccaactctccgcgcttactcctgggacgcgcgtcctcgccccatcctttgcttccttccttccttccttcttccttcctcccctggctcccgccctccctctccaggtcgccctcccggggcccgattgtctcggtgccccgctcccggcccgcgccctgccccgtctctcccttgcacttcctgagtcgcccgccgccgccgtcgcagactcgccgcgggagccccagcccaacccgagcccgacagccactgccccggctccagctccagccccacagcccgcggcgcccgcccgagggagccccggcgcccggggaaggctccagtgggctagcgcgccctcgcccagccccgcgccccagccctgcccggcccggcgaggaaggaccgggaagatgaacaacggcggcaaagccgagaaggagaacaccccgagcgaggccaaccttcaggaggaggaggtccggaccctatttgtcagtggccttcctctggatatcaaacctcgggagctctatctgcttttcagaccatttaagggctatgagggttctcttataaagctcacatctaaacagcctgtaggttttgtcagttttgacagtcgctcagaagcagaggctgcaaagaatgctttgaatggcatccgcttcgatcctgaaattccgcaaacactacgactagagtttgctaaggcaaacacgaagatggccaagaacaaactcgtagggactccaaaccccagtactcctctgcccaacactggctctattgcctacgacgaagcttactattgcagtgtccgattagtcgccctgcatctcttacgcgacagatcaggccactgacacgtcgctggagcgcgggaccctcggcacccagtaggatctaggaacacgattcacctacatcgcgctagcatccgtatgcacgcctgtcacgagcagagccgcaggcgattctactcgatgagagcgaagcgcccagaacacactttcgtatagcaaactctacaggaaattagaagtgtatcgttgagccagtacatatgtcaacagaacctacggtcacatgacacggccagggacgacggtgaggctcaccacgtgaattccagcgtttagacggagaggtccacaaccagtactggacaggagtagcatgt

SEQ ID NO: 448654 - DNA, 1029 bp, Homo sapiens
  misc_feature (875)..(875): n is a, c, g, or t
gtcacaggtcagatacaaattggacagatttggtgtgaacatttacaagctcatcccgtacgctatgtttcagtggtcacctaaatattctcatttcaggactttttaaaacacattttcccaaatctaacttgggacaaaatctaacttgggacatttaaataggttatcaataattatctgtttatggcctctttcggcacacaaataagcatctccctgtacaaaattctagtgtatgctgagctgattgattgccttctgcatacaccttttctacaacttctcaaacgtgtgtgacatgctggtaagatggcaggaaaaggagtgactgaataatacaatatagctgagatgtgtttcaagaaaacctctgggccagggtaggggtttgtgagcgggagccaaggacttgccccatgtttctaatcaaggtgagaccactgacacatgtggtcagcaaatatgttctatacacacatccgcacactgtcatctaacccatccgttctcccatccacagcatctccaggacaaagccatcgcaactagggaggggttgacacctgctctcctaacatgttttctttctgtttcaggcttgaaaaacccttgcccagttttgatcccttcaagactttgtcacagcctctatcacacatctgtttttctcgaagaaaaaaatataattaataaaaatgttttactcttttacactgtataattgtaagaaatagcgtattatttgtgaatgcatggtctgaaatttctgtacagtttggagatattttcaaacgaaacgtaagagaagtcaacaataaaaccaagaaaagtgagtatttttataccaaacattttaagtatgctgggatggncgatcttacactggttcggactcacagtcattgtccttgactttctgaactgcttgtcacttcaacacaatatctatttatattcctctgaagtaagttgcatgtatgaggcatgtctccaaactattactcaacatatccgaatcgtattgcc

SEQ ID NO: 448655 - DNA, 1201 bp, Homo sapiens
  misc_feature (1047)..(1047): n is a, c, g, or t
tgattctttgctaggtctttgcaccttcgtatttcaaaattctcagaccctagggtacaagtagccagatatcttcacaaatgtgcatccttttagtttttgttttccaggagatgcttggagcaaagtttagtccttggtgcctgtgacagacagggatttcctatggccttgggctgaccaaagctgctcagctcctggaggtggctgtttctggatcttgctgtgtgggggcctcaggtcccatgcctttcctctgcagggcctttggacagtcctccgggtctaggccacagcccttgggatgcaaccacagggacgtgggtgtagagtcctgcttgctgggcctgcagcctcctaatgcgccctcagcgaagagttcacatgcttttcttggaatgtccttcctcgctggcccccagaagcctcctcttacttgctccgccaagtcctcagtgcgttttcctggctgagagcttttcatgtcgcatatccaaggccattctgcagcagcctctggtcctcagctcagcagcagaggcctttgatctctttcggcgttgcctctcttggctctctgccctcagaacaggccggtcttcaagaccgaggcagccccaggtggaggttactgtgcaccgttaacgggtgatctttctccatcccagtcccaggtgtgtgatggcggctgcaatctgtcttgtgggtattaatgcaatcttcagtggtggctactgttctctagctgttctacaaaactggagcatgctggcttgaaaaacccttgcccagttttgatcccttcaagactttgtcacagcctctatcacacatctgtttttctcgaagaaaaaaatataattaataaaaatgttttactcttttacactgtataattgtaagaaatagcgtattatttgtgaatgcatggtctgaaatttctgtacagtttggagatattttcaaacgaaacgtaagagaagtcaacaataaaaccaagaaaagtgagtatttttataccaaacattttaagtatgctgggatggncgatcttacactggttcggactcacagtcattgtccttgactttctgaactgcttgtcacttcaacacaatatctatttatattcctctgaagtaagttgcatgtatgaggcatgtctccaaactattactcaacatatccgaatcgtattgcc

SEQ ID NO: 448656 - DNA, 515 bp, Homo sapiens
tctgtggcctacataaattcttaaagagaagacatccattgtgaagcagttgcgtgggttccagtgacagagatcctgggtttcatttgtatctgctcacctaatttttttccaaatcatttctcacagacccttcagcaatggctactagaaggacgaacaattgccctcctttggaagtacggctaatagaagccctagatccgaataagatccgaataagaatatgtaatggaccaggcgcagtgcctcacgcctgtcatcccagcactttgggaggctgaggcaggcggatcacttgatgccagaagtttgagaccagcccagccaacatggtgaaaccccgtctctactaaaaatacaaaaattacccaagcatggtggtgggcgcctgtaatcccagctactagggaggctgaggcaggagaatcgcttgaacccgggaggcagaggttgcagtgagccaagatcatgccactgtattttggcctgggcgacagagcaagactgtcgaa

SEQ ID NO: 448657 - DNA, 576 bp, Homo sapiens
  misc_feature (422)..(422): n is a, c, g, or t
aaagtgacaccctttaaccaacacaaaaaaagttcgggcacagtcccaggtgtgtgatggcggctgcaatctgtcttgtgggtattaatgcaatcttcagtggtggctactgttctctagctgttctacaaaactggagcatgctggcttgaaaaacccttgcccagttttgatcccttcaagactttgtcacagcctctatcacacatctgtttttctcgaagaaaaaaatataattaataaaaatgttttactcttttacactgtataattgtaagaaatagcgtattatttgtgaatgcatggtctgaaatttctgtacagtttggagatattttcaaacgaaacgtaagagaagtcaacaataaaaccaagaaaagtgagtatttttataccaaacattttaagtatgctgggatggncgatcttacactggttcggactcacagtcattgtccttgactttctgaactgcttgtcacttcaacacaatatctatttatattcctctgaagtaagttgcatgtatgaggcatgtctccaaactattactcaacatatccgaatcgtattgcc

SEQ ID NO: 448658 - DNA, 394 bp, Homo sapiens
tttcatgaaaaaaaaatagaaggaagagaaacacagataaatccatagattgattttttttaaaggccccaagaatgcaaacaggtgtgtgtgtgtgtgcacatgcacatgcatgtgtgtaatttgctttcccagataacttaggagacatttgtaggaggagttaggtaatcaataaagaacttatttttacatgaacaagatggtattactacagttacttttggctaaacttggtttttctttattttcagggctatgagggttctcttataaagctcacatctaaacaggtaagaatttcaaagtggcatataaagatcacttttttactttcctcaggaatattgctggggcttgacattctttttttattcccattagaatttgaggg

SEQ ID NO: 448659 - DNA, 576 bp, Homo sapiens
gagcttgcctgtgtgttcataatggtgtgtggaacgcctctcaggacaccgctctgatgcttttcagccccttggggaagaggccctcacaggctagtgtgagtgggtaccatcttggaacagtagggaagtggtagccaagcaggaccctccgtgagaatggggatatgctggggagccctggctcacggccttctcccatgtcttttcagatatgcgctggctccctccctccgaggctacttctcagggctggaagtcccgtcagttctgctgaatactatgtaagtactcgctttcctttggaatgtgcgaagcccctagaacacatctgtacatggtgggtgcgccatgaacgcagctctcctcctttctctgcacccacaccttatgcacctcctttgtccatctttgttaaactcacttgaactacatagcagtgcatcttttccgagaggaaattttcacctaggtacgggtgctagtctatttgagtctaacttaggaaaccagtacctggcctccccacttaaaaataagcagtcagtgctaatttctgtagaacagctgtcagaa

SEQ ID NO: 448660 - DNA, 1715 bp, Homo sapiens
ggtccctccgggctgcagccggcagcccacgtccagggagggcggagggaggaggagaggcgcggagaggagggaggggagaggggagggaggaaggcgagagaaagggagctgcttccatcccggacttcccagagcctgcctggagcgcgtactcagcggctctcgggtcccagcgtcccagccgcggcccgcgctcctccgccccgctcctcctcctcctcttcctcctcctcctcctctctaggcacccccgtcccctccttccagcggctgcagcccccagccccaactctccgcgcttactcctgggacgcgcgtcctcgccccatcctttgcttccttccttccttccttcttccttcctcccctggctcccgccctccctctccaggtcgccctcccggggcccgattgtctcggtgccccgctcccggcccgcgccctgccccgtctctcccttgcacttcctgagtcgcccgccgccgccgtcgcagactcgccgcgggagccccagcccaacccgagcccgacagccactgccccggctccagctccagccccacagcccgcggcgcccgcccgagggagccccggcgcccggggaaggctccagtgggctagcgcgccctcgcccagccccgcgccccagccctgcccggcccggcgaggaaggaccgggaagatgaacaacggcggcaaagccgagaaggagaacaccccgagcgaggccaaccttcaggaggaggaggtccggaccctatttgtcagtggccttcctctggatatcaaacctcgggagctctatctgcttttcagaccatttaagggctatgagggttctcttataaagctcacatctaaacagcctgtaggttttgtcagttttgacagtcgctcagaagcagaggctgcaaagaatgctttgaatggcatccgcttcgatcctgaaattccgcaaacactacgactagagtttgctaaggcaaacacgaagatggccaagaacaaactcgtagggactccaaaccccagtactcctctgcccaacactgtacctcagttcattgccagagagccatatgagctcacagtgcctgcactttaccccagtagccctgaagtgtgggccccgtaccctctgtacccagcggagttagcgcctgctctacctcctcctgctttcacctatcccgcttcactgcatgcccagatgcgctggctccctccctccgaggctacttctcagggctggaagtcccgtcagttctgctgaatactatacccttcagcaatggctactagaaggacgaacaattgccctcctttggaagtacggctaatagaagccctagatccgaataagatccgaataagaatatgtaatggaccaggcgcagtgcctcacgcctgtcatcccagcactttgggaggctgaggcaggcggatcacttgatgccagaagtttgagaccagcccagccaacatggtcccaggtgtgtgatggcggctgcaatctgtcttgtgggtattaatgcaatcttcagtggtggctactgttctctagctgttctacaaaactggagcatgctggcttgaaaaacccttgcccagttttgatcccttcaagactttgtcacagcctctatcacacatctgtttttctcgaagaaaaaaatataattaataaaaatgttttactcttttacactgta

SEQ ID NO: 448661 - DNA, 807 bp, Homo sapiens
tcagaacccaagttgtccaagagagatgtcgtgtacaaaacagttaagaccgtgaagagaggggggtttataatgtcagaaattgaggaaaagaaactaaggtggcctgaatgatccaggtccggaccctatttgtcagtggccttcctctggatatcaaacctcgggagctctatctgcttttcagaccatttaagggctatgagggttctcttataaagctcacatctaaacagcctgtaggttttgtcagttttgacagtcgctcagaagcagaggctgcaaagaatgctttgaatggcatccgcttcgatcctgaaattccgcaaacactacgactagagtttgctaaggcaaacacgaagatggccaagaacaaactcgtagggactccaaaccccagtactcctctgcccaacactgtacctcagttcattgccagagagccatatgagctcacagtgcctgcactttaccccagtagccctgaagtgtgggccccgtaccctctgtacccagcggagttagcgcctgctctacctcctcctgctttcacctatcccgcttcactgcatgcccagtgtttctctcctgaggcaaagcccaacacacctgtcttttgtccacttctccagcaaattagatttgtctctgggaatgtgtttgtaacataccaacctactgcagaccagcagagggagctcccatgttgaatttgtttgttagctattttcccccctttcacaaaaactatttcttgacgacctttgagagatttcaataaaaattttaatcagagcaaaaatg

SEQ ID NO: 448662 - DNA, 538 bp, Homo sapiens
cgaggcccaagaattcgggacgaggaaaagggcatccgcttcgatcctgaaattccgcaaacactacgactagagtttgctaaggcaaacacgaagatggccaagaacaaactcgtagggactccaaaccccagtactcctctgcccaacactgtacctcagttcattgccagagagccatatgagctcacagtgcctgcactttaccccagtagccctgaagtgtgggccccgtaccctctgtacccagcggagttagcgcctgctctacctcctcctgctttcacctatcccgcttcactgcatgcccagtgtttctctcctgaggcaaagcccaacacacctgtcttttgtccacttctccagcaaattagatttgtctctgggaatgtgtttgtaacataccaacctactgcagaccagcagagggagctcccatgttgaatttgtttgttagctattttcccccctttcacaaaaactatttcttgacgacctttgagagatttcaataaaaattttaatcagagcaaaaatg

SEQ ID NO: 448663 - DNA, 811 bp, Homo sapiens
cgccttcatgtcactctggagtgcgcctcgaccaggctgacgagagcctgaagacgggctgcacgctcgtccccaaccctgcaggcacctgtgcgagtgagaacgtgagggctgtgtgcgagagctggtcagagaggctggggcagggcttccttctcgcagtcacctgcaccgaaagcagaaccatgccatccactgtgcagctctcctccccgggcagccctccccctcctgtgtctcctgtgaaacaccgtcacgtcttggcctcgtcggggctcagcgccccaacccacacccaggccgcaccagtcacaccactgcgctccacactgacccagtgcacacagacccatcaccctctactgtgtgtttaggtgtccagccccccacctgccatgggggctctgtgtccccgccccgtcctttcccacctgtctcaggaaggcagctccaactctgctctttgcttagtgagcaagtggattcagatgcaccaggccatgagccgtgggtagatgcgctggctccctccctccgaggctacttctcagggctggaagtcccgtcagttctgctgaatactatgtcccaggtgtgtgatggcggctgcaatctgtcttgtgggtattaatgcaatcttcagtggtggctactgttctctagctgttctacaaaactggagcatgctggcttgaaaaacccttgcccagttttgatcccttcaagactttgtcacagcctctatcacacatctgtttttctcgaagaaaaaaatataattaataaaaatgttttactcttttacactgta

SEQ ID NO: 448664 - DNA, 1146 bp, Homo sapiens
gcggccgcacttctggttgcgcggcccacactggccgccattgtggtggaggtcggagcgagtctcctgggcccgaaccggctgttggaagtgcgagggcaccgagagccacggtctgtttttcccatggtaaaagaacaagaaagacagaacaaagaaggcagagcagaaaagttccatgttcctcctcactccatcttgcctagccaaaacaattgaacagtttcagatatctatttcaaagatttcagataagttctaaaatgttttcttttgttgtgacttcagccttgacttgcctctactcttaagcacacgtctaagcctgatcaaaaggacaatgtgggaatgcatgaaagaataatgtgtgcttttcaaaagataagccagatactggaagcagaaactctgaaggacaaagttaaaatctaaaggtagctgtcatcttatgatctaaggtccggaccctatttgtcagtggccttcctctggatatcaaacctcgggagctctatctgcttttcagaccatttaagggctatgagggttctcttataaagctcacatctaaacagcctgtaggttttgtcagttttgacagtcgctcagaagcagaggctgcaaagaatgctttgaatggcatccgcttcgatcctgaaattccgcaaacactacgactagagtttgctaaggcaaacacgaagatggccaagaacaaactcgtagggactccaaaccccagtactcctctgcccaacactgtacctcagttcattgccagagagccatatgagctcacagtgcctgcactttaccccagtagccctgaagtgtgggccccgtaccctctgtacccagcggagttagcgcctgctctacctcctcctgctttcacctatcccgcttcactgcatgcccagtgtttctctcctgaggcaaagcccaacacacctgtcttttgtccacttctccagcaaattagatttgtctctgggaatgtgtttgtaacataccaacctactgcagaccagcagagggagctcccatgttgaatttgtttgttagctattttcccccctttcacaaaaactatttcttgacgacctttgagagatttcaataaaaattttaatcagagcaaaaatg

SEQ ID NO: 448665 - DNA, 1640 bp, Homo sapiens
ggtccctccgggctgcagccggcagcccacgtccagggagggcggagggaggaggagaggcgcggagaggagggaggggagaggggagggaggaaggcgagagaaagggagctgcttccatcccggacttcccagagcctgcctggagcgcgtactcagcggctctcgggtcccagcgtcccagccgcggcccgcgctcctccgccccgctcctcctcctcctcttcctcctcctcctcctctctaggcacccccgtcccctccttccagcggctgcagcccccagccccaactctccgcgcttactcctgggacgcgcgtcctcgccccatcctttgcttccttccttccttccttcttccttcctcccctggctcccgccctccctctccaggtcgccctcccggggcccgattgtctcggtgccccgctcccggcccgcgccctgccccgtctctcccttgcacttcctgagtcgcccgccgccgccgtcgcagactcgccgcgggagccccagcccaacccgagcccgacagccactgccccggctccagctccagccccacagcccgcggcgcccgcccgagggagccccggcgcccggggaaggctccagtgggctagcgcgccctcgcccagccccgcgccccagccctgcccggcccggcgaggaaggaccgggaagatgaacaacggcggcaaagccgagaaggagaacaccccgagcgaggccaaccttcaggaggaggaggtccggaccctatttgtcagtggccttcctctggatatcaaacctcgggagctctatctgcttttcagaccatttaagggctatgagggttctcttataaagctcacatctaaacagcctgtaggttttgtcagttttgacagtcgctcagaagcagaggctgcaaagaatgctttgaatggcatccgcttcgatcctgaaattccgcaaacactacgactagagtttgctaaggcaaacacgaagatggccaagaacaaactcgtagggactccaaaccccagtactcctctgcccaacactgtacctcagttcattgccagagagccatatgagctcacagtgcctgcactttaccccagtagccctgaagtgtgggccccgtaccctctgtacccagcggagttagcgcctgctctacctcctcctgctttcacctatcccgcttcactgcatgcccagtgtttctctcctgaggcaaagcccaacacacctgtcttttgtccacttctccagcaaattagatttgtctctgggaatgtgtttgtaacataccaacctactgcagaccagcagagggagctcccatgttgaatttgtttgttagctattttcccccctttcacaaaaactatttcttgacgacctttgagagatttcaataaaaattttaatcagagcaaaaatgaacaaaacagaacacaaaaacacttttgcggcgccctcggcgccccgaaaaaagtttataaaccatcgggtgggggccggggccccatggtagtggacacgtggcccaagcggtcccaagaaaacccgcggccggccgggggtggtcccccccatataaaaaccgcggcggaaccgcggctcgttcgaacaccccagaggg

SEQ ID NO: 448666 - DNA, 1745 bp, Homo sapiens
ggtccctccgggctgcagccggcagcccacgtccagggagggcggagggaggaggagaggcgcggagaggagggaggggagaggggagggaggaaggcgagagaaagggagctgcttccatcccggacttcccagagcctgcctggagcgcgtactcagcggctctcgggtcccagcgtcccagccgcggcccgcgctcctccgccccgctcctcctcctcctcttcctcctcctcctcctctctaggcacccccgtcccctccttccagcggctgcagcccccagccccaactctccgcgcttactcctgggacgcgcgtcctcgccccatcctttgcttccttccttccttccttcttccttcctcccctggctcccgccctccctctccaggtcgccctcccggggcccgattgtctcggtgccccgctcccggcccgcgccctgccccgtctctcccttgcacttcctgagtcgcccgccgccgccgtcgcagactcgccgcgggagccccagcccaacccgagcccgacagccactgccccggctccagctccagccccacagcccgcggcgcccgcccgagggagccccggcgcccggggaaggctccagtgggctagcgcgccctcgcccagccccgcgccccagccctgcccggcccggcgaggaaggaccgggaagatgaacaacggcggcaaagccgagaaggagaacaccccgagcgaggccaaccttcaggaggaggaggtccggaccctatttgtcagtggccttcctctggatatcaaacctcgggagctctatctgcttttcagaccatttaagggctatgagggttctcttataaagctcacatctaaacagcctgtaggttttgtcagttttgacagtcgctcagaagcagaggctgcaaagaatgctttgaatggcatccgcttcgatcctgaaattccgcaaacactacgactagagtttgctaaggcaaacacgaagatggccaagaacaaactcgtagggactccaaaccccagtactcctctgcccaacactgtacctcagttcattgccagagagccatatgagctcacagtgcctgcactttaccccagtagccctgaagtgtgggccccgtaccctctgtacccagcggagttagcgcctgctctacctcctcctgctttcacctatcccgcttcactgcatgcccagtgtttctctcctgaggcaaagcccaacacacctgtcttttgtccacttctccagcaaattagatttgtctctgggaatgtgtttgtaacataccaacctactgcagaccagcagagggagctcccatgttgaatttgtttgttagctattttcccccctttcacaaaaactagacgagcactccctagggagtgctcgtctttggggagtaagggaatgcttctcattggaggagacacttgagctgactctggggcaaactctagacaagtggcagtgggtcagggagggcgttcgtggctgaggggatggtttgcattaagccacgcagcatgacaaggcctttcacaatacctgggataaagtgttgggcaaacgggagcaggcagtgatatgtatggggaaagtgagagacgagacagaactgcagttctgaaggattttccttccacgaagaataaaggagttaggactttatcttgaaggcagtaggtatccctgaagtactgtaagcaaaagacgagcactccct

SEQ ID NO: 448667 - DNA, 1817 bp, Homo sapiens
  misc_feature (1663)..(1663): n is a, c, g, or t
ggtccctccgggctgcagccggcagcccacgtccagggagggcggagggaggaggagaggcgcggagaggagggaggggagaggggagggaggaaggcgagagaaagggagctgcttccatcccggacttcccagagcctgcctggagcgcgtactcagcggctctcgggtcccagcgtcccagccgcggcccgcgctcctccgccccgctcctcctcctcctcttcctcctcctcctcctctctaggcacccccgtcccctccttccagcggctgcagcccccagccccaactctccgcgcttactcctgggacgcgcgtcctcgccccatcctttgcttccttccttccttccttcttccttcctcccctggctcccgccctccctctccaggtcgccctcccggggcccgattgtctcggtgccccgctcccggcccgcgccctgccccgtctctcccttgcacttcctgagtcgcccgccgccgccgtcgcagactcgccgcgggagccccagcccaacccgagcccgacagccactgccccggctccagctccagccccacagcccgcggcgcccgcccgagggagccccggcgcccggggaaggctccagtgggctagcgcgccctcgcccagccccgcgccccagccctgcccggcccggcgaggaaggaccgggaagatgaacaacggcggcaaagccgagaaggagaacaccccgagcgaggccaaccttcaggaggaggaggtccggaccctatttgtcagtggccttcctctggatatcaaacctcgggagctctatctgcttttcagaccatttaagggctatgagggttctcttataaagctcacatctaaacagcctgtaggttttgtcagttttgacagtcgctcagaagcagaggctgcaaagaatgctttgaatggcatccgcttcgatcctgaaattccgcaaacactacgactagagtttgctaaggcaaacacgaagatggccaagaacaaactcgtagggactccaaaccccagtactcctctgcccaacactgtacctcagttcattgccagagagccatatgagctcacagtgcctgcactttaccccagtagccctgaagtgtgggccccgtaccctctgtacccagcggagttagcgcctgctctacctcctcctgctttcacctatcccgcttcactgcatgcccagatgcgctggctccctccctccgaggctacttctcagggctggaagtcccgtcagttctgctgaatactatgtcccaggtgtgtgatggcggctgcaatctgtcttgtgggtattaatgcaatcttcagtggtggctactgttctctagctgttctacaaaactggagcatgctggcttgaaaaacccttgcccagttttgatcccttcaagactttgtcacagcctctatcacacatctgtttttctcgaagaaaaaaatataattaataaaaatgttttactcttttacactgtataattgtaagaaatagcgtattatttgtgaatgcatggtctgaaatttctgtacagtttggagatattttcaaacgaaacgtaagagaagtcaacaataaaaccaagaaaagtgagtatttttataccaaacattttaagtatgctgggatggncgatcttacactggttcggactcacagtcattgtccttgactttctgaactgcttgtcacttcaacacaatatctatttatattcctctgaagtaagttgcatgtatgaggcatgtctccaaactattactcaacatatccgaatcgtattgcc

SEQ ID NO: 448668 - DNA, 1496 bp, Homo sapiens
ggtccctccgggctgcagccggcagcccacgtccagggagggcggagggaggaggagaggcgcggagaggagggaggggagaggggagggaggaaggcgagagaaagggagctgcttccatcccggacttcccagagcctgcctggagcgcgtactcagcggctctcgggtcccagcgtcccagccgcggcccgcgctcctccgccccgctcctcctcctcctcttcctcctcctcctcctctctaggcacccccgtcccctccttccagcggctgcagcccccagccccaactctccgcgcttactcctgggacgcgcgtcctcgccccatcctttgcttccttccttccttccttcttccttcctcccctggctcccgccctccctctccaggtcgccctcccggggcccgattgtctcggtgccccgctcccggcccgcgccctgccccgtctctcccttgcacttcctgagtcgcccgccgccgccgtcgcagactcgccgcgggagccccagcccaacccgagcccgacagccactgccccggctccagctccagccccacagcccgcggcgcccgcccgagggagccccggcgcccggggaaggctccagtgggctagcgcgccctcgcccagccccgcgccccagccctgcccggcccggcgaggaaggaccgggaagatgaacaacggcggcaaagccgagaaggagaacaccccgagcgaggccaaccttcaggaggaggaggtccggaccctatttgtcagtggccttcctctggatatcaaacctcgggagctctatctgcttttcagaccatttaagggctatgagggttctcttataaagctcacatctaaacagcctgtaggttttgtcagttttgacagtcgctcagaagcagaggctgcaaagaatgctttgaatggcatccgcttcgatcctgaaattccgcaaacactacgactagagtttgctaaggcaaacacgaagatggccaagaacaaactcgtagggactccaaaccccagtactcctctgcccaacactgtacctcagttcattgccagagagccatatgagctcacagtgcctgcactttaccccagtagccctgaagtgtgggccccgtaccctctgtacccagcggagttagcgcctgctctacctcctcctgctttcacctatcccgcttcactgcatgcccaggaaaccctgtagaaaaggagatacaagatagtgtctaagatggaattacaggtcaagtgtttctctcctgaggcaaagcccaacacacctgtcttttgtccacttctccagcaaattagatttgtctctgggaatgtgtttgtaacataccaacctactgcagaccagcagagggagctcccatgttgaatttgtttgttagctattttcccccctttcacaaaaactatttcttgacgacctttgagagatttcaataaaaattttaatcagagcaaaaatg

SEQ ID NO: 448669 - DNA, 1669 bp, Homo sapiens
ggtccctccgggctgcagccggcagcccacgtccagggagggcggagggaggaggagaggcgcggagaggagggaggggagaggggagggaggaaggcgagagaaagggagctgcttccatcccggacttcccagagcctgcctggagcgcgtactcagcggctctcgggtcccagcgtcccagccgcggcccgcgctcctccgccccgctcctcctcctcctcttcctcctcctcctcctctctaggcacccccgtcccctccttccagcggctgcagcccccagccccaactctccgcgcttactcctgggacgcgcgtcctcgccccatcctttgcttccttccttccttccttcttccttcctcccctggctcccgccctccctctccaggtcgccctcccggggcccgattgtctcggtgccccgctcccggcccgcgccctgccccgtctctcccttgcacttcctgagtcgcccgccgccgccgtcgcagactcgccgcgggagccccagcccaacccgagcccgacagccactgccccggctccagctccagccccacagcccgcggcgcccgcccgagggagccccggcgcccggggaaggctccagtgggctagcgcgccctcgcccagccccgcgccccagccctgcccggcccggcgaggaaggaccgggaagatgaacaacggcggcaaagccgagaaggagaacaccccgagcgaggccaaccttcaggaggaggaggtccggaccctatttgtcagtggccttcctctggatatcaaacctcgggagctctatctgcttttcagaccatttaagggctatgagggttctcttataaagctcacatctaaacagcctgtaggttttgtcagttttgacagtcgctcagaagcagaggctgcaaagaatgctttgaatggcatccgcttcgatcctgaaattccgcaaacactacgactagagtttgctaaggcaaacacgaagatggccaagaacaaactcgtagggactccaaaccccagtactcctctgcccaacactgtacctcagttcattgccagagagccatatgagctcacagtgcctgcactttaccccagtagccctgaagtgtgggccccgtaccctctgtacccagcggagttagcgcctgctctacctcctcctgctttcacctatcccgcttcactgcatgcccagatgcgctggctccctccctccgaggctacttctcagggctggaagtcccgtcagttctgctgaatactatacccttcagcaatggctactagaaggacgaacaattgccctcctttggaagtacggctaatagaagccctagatccgaataagatccgaataagaatatgtaatggaccaggcgcagtgcctcacgcctgtcatcccagcactttgggaggctgaggcaggcggatcacttgatgccagaagtttgagaccagcccagccaacatggtgaaaccccgtctctactaaaaatacaaaaattacccaagcatggtggtgggcgcctgtaatcccagctactagggaggctgaggcaggagaatcgcttgaacccgggaggcagaggttgcagtgagccaagatcatgccactgtattttggcctgggcgacagagcaagactgtcgaa

SEQ ID NO: 448670 - DNA, 1308 bp, Homo sapiens
ggtccctccgggctgcagccggcagcccacgtccagggagggcggagggaggaggagaggcgcggagaggagggaggggagaggggagggaggaaggcgagagaaagggagctgcttccatcccggacttcccagagcctgcctggagcgcgtactcagcggctctcgggtcccagcgtcccagccgcggcccgcgctcctccgccccgctcctcctcctcctcttcctcctcctcctcctctctaggcacccccgtcccctccttccagcggctgcagcccccagccccaactctccgcgcttactcctgggacgcgcgtcctcgccccatcctttgcttccttccttccttccttcttccttcctcccctggctcccgccctccctctccaggtcgccctcccggggcccgattgtctcggtgccccgctcccggcccgcgccctgccccgtctctcccttgcacttcctgagtcgcccgccgccgccgtcgcagactcgccgcgggagccccagcccaacccgagcccgacagccactgccccggctccagctccagccccacagcccgcggcgcccgcccgagggagccccggcgcccggggaaggctccagtgggctagcgcgccctcgcccagccccgcgccccagccctgcccggcccggcgaggaaggaccgggaagatgaacaacggcggcaaagccgagaaggagaacaccccgagcgaggccaaccttcaggaggaggaggtccggaccctatttgtcagtggccttcctctggatatcaaacctcgggagctctatctgcttttcagaccatttaagggctatgagggttctcttataaagctcacatctaaacagcctgtaggttttgtcagttttgacagtcgctcagaagcagaggctgcaaagaatgctttgaatggcatccgcttcgatcctgaaattccgcaaacactacgactagagtttgctaaggcaaacacgaagatggccaagaacaaactcgtagggactccaaaccccagtactcctctgcccaacactgtacctcagttcattgccagagagccattgtttctctcctgaggcaaagcccaacacacctgtcttttgtccacttctccagcaaattagatttgtctctgggaatgtgtttgtaacataccaacctactgcagaccagcagagggagctcccatgttgaatttgtttgttagctattttcccccctttcacaaaaactatttcttgacgacctttgagagatttcaataaaaattttaatcagagcaaaaatg

SEQ ID NO: 448671 - DNA, 1119 bp, Homo sapiens
  misc_feature (965)..(965): n is a, c, g, or t
cgccttcatgtcactctggagtgcgcctcgaccaggctgacgagagcctgaagacgggctgcacgctcgtccccaaccctgcaggcacctgtgcgagtgagaacgtgagggctgtgtgcgagagctggtcagagaggctggggcagggcttccttctcgcagtcacctgcaccgaaagcagaaccatgccatccactgtgcagctctcctccccgggcagccctccccctcctgtgtctcctgtgaaacaccgtcacgtcttggcctcgtcggggctcagcgccccaacccacacccaggccgcaccagtcacaccactgcgctccacactgacccagtgcacacagacccatcaccctctactgtgtgtttaggtgtccagccccccacctgccatgggggctctgtgtccccgccccgtcctttcccacctgtctcaggaaggcagctccaactctgctctttgcttagtgagcaagtggattcagatgcaccaggccatgagccgtgggtagatgcgctggctccctccctccgaggctacttctcagggctggaagtcccgtcagttctgctgaatactatgtcccaggtgtgtgatggcggctgcaatctgtcttgtgggtattaatgcaatcttcagtggtggctactgttctctagctgttctacaaaactggagcatgctggcttgaaaaacccttgcccagttttgatcccttcaagactttgtcacagcctctatcacacatctgtttttctcgaagaaaaaaatataattaataaaaatgttttactcttttacactgtataattgtaagaaatagcgtattatttgtgaatgcatggtctgaaatttctgtacagtttggagatattttcaaacgaaacgtaagagaagtcaacaataaaaccaagaaaagtgagtatttttataccaaacattttaagtatgctgggatggncgatcttacactggttcggactcacagtcattgtccttgactttctgaactgcttgtcacttcaacacaatatctatttatattcctctgaagtaagttgcatgtatgaggcatgtctccaaactattactcaacatatccgaatcgtattgcc

SEQ ID NO: 448672 - DNA, 4875 bp, Homo sapiens
cgacattttaactgaactgcgggataaagtgaaatctttccgtgcagctctacgagaggaggaaattgttcctcgtctgataagacaacagtggagaaaggacgcatgctgtttcttagggacacggctgacttccagatatgaccatgtatttgtggcttaaactcttggcatttggctttgcctttctggacacagaagtatttgtgacagggcaaagcccaacaccttcccccactgatgcctaccttaatgcctctgaaacaaccactctgagcccttctggaagcgctgtcatttcaaccacaacaatagctactactccatctaagccaacatgtgatgaaaaatatgcaaacatcactgtggattacttatataacaaggaaactaaattatttacagcaaagctaaatgttaatgagaatgtggaatgtggaaacaatacttgcacaaacaatgaggtgcataaccttacagaatgtaaaaatgcgtctgtttccatatctcataattcatgtactgctcctgataagacattaatattagatgtgccaccaggggttgaaaagtttcagttacatgattgtacacaagttgaaaaagcagatactactatttgtttaaaatggaaaaatattgaaacctttacttgtgatacacagaatattacctacagatttcagtgtggtaatatgatatttgataataaagaaattaaattagaaaaccttgaacccgaacatgagtataagtgtgactcagaaatactctataataaccacaagtttactaacgcaagtaaaattattaaaacagattttgggagtccaggagagcctcagattattttttgtagaagtgaagctgcacatcaaggagtaattacctggaatccccctcaaagatcatttcataattttaccctctgttatataaaagagacagaaaaagattgcctcaatctggataaaaacctgatcaaatatgatttgcaaaatttaaaaccttatacgaaatatgttttatcattacatgcctacatcattgcaaaagtgcaacgtaatggaagtgctgcaatgtgtcatttcacaactaaaagtgctcctccaagccaggtctggaacatgactgtctccatgacatcagataatagtatgcatgtcaagtgtaggcctcccagggaccgtaatggcccccatgaacgttaccatttggaagttgaagctggaaatactctggttagaaatgagtcgcataagaattgcgatttccgtgtaaaagatcttcaatattcaacagactacacttttaaggcctattttcacaatggagactatcctggagaaccctttattttacatcattcaacatcttataattctaaggcactgatagcatttctggcatttctgattattgtgacatcaatagccctgcttgttgttctctacaaaatctatgatctacataagaaaagatcctgcaatttagatgaacagcaggagcttgttgaaagggatgatgaaaaacaactgatgaatgtggagccaatccatgcagatattttgttggaaacttataagaggaagattgctgatgaaggaagactttttctggctgaatttcagagcatcccgcgggtgttcagcaagtttcctataaaggaagctcgaaagccctttaaccagaataaaaaccgttatgttgacattcttccttatgattataaccgtgttgaactctctgaaataaacggagatgcagggtcaaactacataaatgccagctatattgatggtttcaaagaacccaggaaatacattgctgcacaaggtcccagggatgaaactgttgatgatttctggaggatgatttgggaacagaaagccacagttattgtcatggtcactcgatgtgaagaaggaaacaggaacaagtgtgcagaatactggccgtcaatggaagagggcactcgggcttttggagatgttgttgtaaagatcaaccagcacaaaagatgtccagattacatcattcagaaattgaacattgtaaataaaaaagaaaaagcaactggaagagaggtgactcacattcagttcaccagctggccagaccacggggtgcctgaggatcctcacttgctcctcaaactgagaaggagagtgaatgccttcagcaatttcttcagtggtcccattgtggtgcactgcagtgctggtgttgggcgcacaggaacctatatcggaattgatgccatgctagaaggcctggaagccgagaacaaagtggatgtttatggttatgttgtcaagctaaggcgacagagatgcctgatggttcaagtagaggcccagtacatcttgatccatcaggctttggtggaatacaatcagtttggagaaacagaagtgaatttgtctgaattacatccatatctacataacatgaagaaaagggatccacccagtgagccgtctccactagaggctgaattccagagacttccttcatataggagctggaggacacagcacattggaaatcaagaagaaaataaaagtaaaaacaggaattctaatgtcatcccatatgactataacagagtgccacttaaacatgagctggaaatgagtaaagagagtgagcatgattcagatgaatcctctgatgatgacagtgattcagaggaaccaagcaaatacatcaatgcatcttttataatgagctactggaaacctgaagtgatgattgctgctcagggaccactgaaggagaccattggtgacttttggcagatgatcttccaaagaaaagtcaaagttattgttatgctgacagaactgaaacatggagaccaggaaatctgtgctcagtactggggagaaggaaagcaaacatatggagatattgaagttgacctgaaagacacagacaaatcttcaacttatacccttcgtgtctttgaactgagacattccaagaggaaagactctcgaactgtgtaccagtaccaatatacaaactggagtgtggagcagcttcctgcagaacccaaggaattaatctctatgattcaggtcgtcaaacaaaaacttccccagaagaattcctctgaagggaacaagcatcacaagagtacacctctactcattcactgcagggatggatctcagcaaacgggaatattttgtgctttgttaaatctcttagaaagtgcggaaacagaagaggtagtggatatttttcaagtggtaaaagctctacgcaaagctaggccaggcatggtttccacattcgagcaatatcaattcctatatgacgtcattgccagcacctaccctgctcagaatggacaagtaaagaaaaacaaccatcaagaagataaaattgaatttgataatgaagtggacaaagtaaagcaggatgctaattgtgttaatccacttggtgccccagaaaagctccctgaagcaaaggaacaggctgaaggttctgaacccacgagtggcactgaggggccagaacattctgtcaatggtcctgcaagtccagctttaaatcaaggttcataggaaaagacataaatgaggaaactccaaacctcctgttagctgttatttctatttttgtagaagtaggaagtgaaaataggtatacagtggattaattaaatgcagcgaaccaatatttgtagaagggttatattttactactgtggaaaaatatttaagatagttttgccagaacagtttgtacagacgtatgcttattttaaaattttatctcttattcagtaaaaaacaacttctttgtaatcgttatgtgtgtatatgtatgtgtgtatgggtgtgtgtttgtgtgagagacagagaaagagagagaattctttcaagtgaatctaaaagcttttgcttttcctttgtttttatgaagaaaaaatacattttatattagaagtgttaacttagcttgaaggatctgtttttaaaaatcataaactgtgtgcagactcaataaaatcatgtacatttctgaaatgacctcaagatgtcctccttgttctactcatatatatctatcttatatagtttactattttacttctagagatagtacataaaggtggtatgtgtgtgtatgctactacaaaaaagttgttaactaaattaacattgggaaatcttatattccatatattagcatttagtccaatgtctttttaagcttatttaattaaaaaatttccagtgagcttatcatgctgtctttacatggggttttcaattttgcatgctcgattattccctgtacaatatttaaaatttattgcttgatacttttgacaacaaattaggttttgtacaattgaacttaaataaatgtcattaaaataaataaatgcaatatgtattaatattcattgtataaaaatagaagaatacaaacatatttgttaaatatttacatatgaaatttaatatagctatttttatggaatttttcattgatatgaaaaatatgatattgcatatgcatagttcccatgttaaatcccattcataactttcattaaagcatttactttgaatttctccaatgcttagaatgtttttaccaggaatggatgtcgctaatcataataaaattcaaccattatttttttcttgtttataatacattgtgttatatgttcaaatatgaaatgtgtatgcacctattgaaatatgtttaatgcatttattaacatttgcaggacacttttacaggccccaattatccaatagtctaataattgtttaagatctagaaaaaaaaaatcaagaatagtggtatttttcatgaagtaataaaaactcgttttggtgaatt

SEQ ID NO: 448673 - DNA, 852 bp, Homo sapiens
ggacgcgtgggtcgcggacgcgtgggcaagatgtcctccttgttctactcatatatatctatcttatatagtttactattttacttctagagatagtacataaaggtggtatgtgtgtgtatgctactacaaaaaagttgttaactaaattaacattgggaaatcttatattccatatattagcatttagtccaatgtctttttaagcttatttaattaaaaaatttccagtgagcttatcatgctgtctttacatggggttttcaattttgcatgctcgattattccctgtacaatatttaaaatttattgcttgatacttttgacaacaaattaggttttgtacaattgaacttaaataaatgtcattaaaataaataaatgcaatatgtattaatattcattgtataaaaatagaagaatacaaacatatttgttaaatatttacatatgaaatttaatatagctatttttatggaatttttcattgatatgaaaaatatgatattgcatatgcatagttcccatgttaaatcccattcataactttcattaaagcatttactttgaatttctccaatgcttagaatgtttttaccaggaatggatgtcgctaatcataataaaattcaaccattatttttttcttgtttataatacattgtgttatatgttcaaatatgaaatgtgtatgcacctattgaaatatgtttaatgcatttattaacatttgcaggacacttttacaggccccaattatccaatagtctaataattgtttaagatctagaaaaaaaaaatcaagaatagtggtatttttcatgaagtaataaaaactcgttttggtgaatt

SEQ ID NO: 448674 - DNA, 1138 bp, Homo sapiens
ctgcaaccctcgaatcgtcgactataccgcctaaataggcgagccccctgtatactatgtacgcctcctctcctctcttctccagactcgctcgctctaccgagcatctaccagttctccagactccgcctccatacttcttgtcttagtccttctccccctccctgcgatcctcagaaagttcttcaacacgcccatgaaattatccccgtcgggtattccagtgctttatgtgccttacaggcccgagcccttcacctctccacgagaaacggattccagggcaaagcccaacaccttcccccactggtaagaattaatatttatatttttactaattttattttcttgttgcaaagtttatatatttaactacaattttctattattaacactgaaattatttttaaggataaattttataatcatgagtgattcttgacattcacttgttcttaaactttctgcttatacgttatagagtttaataactacctaaacatgttattaaatttgtatatatattttgtgtataaatagtaacttttcccaaacttgacagtaaatcacacaacaggtttctactctcttttaatattttaagactataaaaaaatgcatttaaattagataacaaaattttatagtctgaaagcaggttaacagctgtctatgtatgttatagatatgtagataacagatttgcatatgtctatatttctttaagagtatgttgcttttttcaatggtatgcaaaacctttgagactattgagatatttttaaataataattttcaaattctactgaacacttcaatagtccttataaatgtcttaatcatgagataaatttaaaacacagagatctgcaaataaattcatacatagtacatacaaaataagagaaaaaattaaattgcagatggttaaatatcacatcacttaactgatgttactgaaaatgtattttcctgcataatcatatggttgacagtatgcattaagaaggtaagtaaaacaatgaagacaattttgatttaatatggtaatgcacaattccaactaacgtacattcaacagatcatgaaattgggttattaaaatgaatatttttgtcattaaataaaaattccgtcc

SEQ ID NO: 448675 - DNA, 938 bp, Homo sapiens
cgttgcaccctggactattatctgctatctgccatctaggcgtctgctctctcggtccaacttgctgtcgcgtctaccgtcctttgcatcgtgctctatcggtgtgtgctgtgactcgaccaaaccaggtcgctcgagctatccacaaccctccttcctctccgtcccatgtacagccgcctctcttcgtgcccccctctcctcgctcaatcaccaactcactgttctcgctcaccggcccatttagccacgcgttccaagccctccaaaagctctttccgaacgccaatggtaatttcaacgggggaaatcccagggactttttcggcactgaaggcccgaactttctcgctttcacgaaaaagggatcccagggcaaagcccaacaccttcccccactgatgcctaccttaatgcctctgaaacaaccactctgagcccttctggaagcgctgtcatttcaaccacaacaatagctactactccatctaagccaacatgtgatgaaaaatatgcaaacatcactgtggattacttatataacaaggaaactaaattatttacagcaaagctaaatgttaatgagaatgtggaatgtggaaacaatacttgcacaaacaatgaggtgcataaccttacagaatgtaaaaatgcgtctgtttccatatctcataattcatgtactgctcctgataagacattaatattagatgtgccaccaggggttgaaaagtttcagttacatgattgtacacaagttgaaaaagcagatactactatttgtttaaaatggaaaaatattgaaacctttacttgtgatacacagaatattacctacagatttcagtgtggtaatatgatatttgataataaagaaagatccgccaggcacccgccctctctggtatctcttcacgccagcgcggttataataaaac

SEQ ID NO: 448676 - DNA, 1201 bp, Homo sapiens
tggtgttggttatgtggatgtatacatttgttaaaaatgcattaaactgtatctcaaatgggtacattttaatgtaaattttacttcagacattttatttaaacatttatcagtttttctcagtttcaaatgactagttactggaagcaatgacaagtgctactcaatgactgctaaatttattggtgctatgaatgccagatttttagcacagcaaaatctacaaattccaggatttttaggtagtatctgggcaagaatatatatgaataatgtatatgaaaggaagagggggttcttagatatcttcaagtcagtggaatgcttaggtttcacagtgccaatctggtgtgacatttactttgttaaaggaatttactctaaaacaaattaaatgagcccagatgcatttctttaaattttattttgaattcatcatttgtcaaaatatggttatcaataatgcatgcttataatatgaagaatgctttatccatgtcttatttttcatattacataacattcttattcttttaacaggtccaggagagcctcagattattttttgtagaagtgaagctgcacatcaaggagtaattacctggaatccccctcaaagatcatttcataattttaccctctgttatataaaagagacaggtaatttgtgtagaatttaatttcatcagaaaagagaaatcaagaatttgaaagtactagaaatttttattgagccagtgagtcacaaagctctctgcttagagactgcataggcatagtatactccctgatcttagaattgcttccactcattcaaagctttccagccccagaaatgactaaaatccagaacattctaaatatttgcttgtccttcttggtcttagtttaaatctttgtgctccaaagcctagagacagaaaacctctggatgacaacactcatttctgtcttgcaagtattatgtaagtgatttgactcactttgactcatctttgaactcatcattcagcctcctaaacaaaccaacaaacaagcaaaccccttgtaaaacttgtttcagctaataatacagacaaaatgttgggtgaataaaaatgaacatgggcccatgtagccgctggggccagtttggtgtaatcttgggagcatagttctaagtttagaattagacttctgcagaagtaatgcaattaaaaaa

SEQ ID NO: 448677 - DNA, 1366 bp, Homo sapiens
agggcacgccgatacgtccgtaggactaccatctctcatccctccgataaatgcgatgcctaccgcgaccatcgcaacgctcctcgccttaccactctacatacataatgatcaaatcttccccaatactgtcctcccatatccgcatctattctcgtgtcttttcttcgtccttactcggtaggggatgctctctatcatttcattcttgttctactattcctgttcgtctatcgcgccggctttgacaaacgaactgtcaacaaaaaagttttacgtgatatatactcgcgggcaagaaatgcatcgctcccgccgcaacaactcgatacatgcctaagcaccaatcatgggactcaagcgtgtatctacgatctcacgtcatctcaatgaggactgccgatcggcataggaaatgcagaatcgctcacctcggggtgagaaagtttctgtgcacagattgttcccaaggtaataacgggtgatcctagcatctgttgtgaatgggaatatatttaacccttttatttctgagacactgggatattgcgtacagggttaagtgtggtaatatgatatttgataataaagaaattaaattagaaaaccttgaacccgaacatgagtataagtgtgactcagaaatactctataataaccacaagtttactaacgcaagtaaaattattaaaacagattttgggagtccaggagagcctcagattattttttgtagaagtgaagctgcacatcaaggagtaattacctggaatccccctcaaagatcatttcataattttaccctctgttatataaaagagacaggtaatttgtgtagaatttaatttcatcagaaaagagaaatcaagaatttgaaagtactagaaatttttattgagccagtgagtcacaaagctctctgcttagagactgcataggcatagtatactccctgatcttagaattgcttccactcattcaaagctttccagccccagaaatgactaaaatccagaacattctaaatatttgcttgtccttcttggtcttagtttaaatctttgtgctccaaagcctagagacagaaaacctctggatgacaacactcatttctgtcttgcaagtattatgtaagtgatttgactcactttgactcatctttgaactcatcattcagcctcctaaacaaaccaacaaacaagcaaaccccttgtaaaacttgtttcagctaataatacagacaaaatgttgggtgaataaaaatgaacatgggcccatgtagccgctggggccagtttggtgtaatcttgggagcatagttctaagtttagaattagacttctgcagaagtaatgcaattaaaaaa

SEQ ID NO: 448678 - DNA, 875 bp, Homo sapiens
  misc_feature (65)..(65): n is a, c, g, or t
tgtcttctattgcacttccccttaccaacagaaagaaaagtttagaaacactcaacaccttttgnacggcttgaacagcacctaccctgctcagaatggacaagtaaagaaaaacaaccatcaagaagataaaattgaatttgataatgaagtggacaaagtaaagcaggatgctaattgtgttaatccacttggtgccccagaaaagctccctgaagcaaaggaacaggctgaaggttctgaacccacgagtggcactgaggggccagaacattctgtcaatggtcctgcaagtccagctttaaatcaaggttcataggaaaagacataaatgaggaaactccaaacctcctgttagctgttatttctatttttgtagaagtaggacacgaaagtccgtctccactggatcaagtaaacgcatcgaatcaatttctgctcaacggatatctcccacctactgcccaacatcatttgcagacgctctcccccccccccgtctcagtcgcacttttcccaatcccaacaccctatcacgcaaactcagctcacctccctccctctgcgtcagcaccacataatattccacccctcccatacattaatgcctctacttacggttcctatcctgtggtccgtaaaaccaatgactctatacactacaccacctctcatctaaactctcctaccacgcccctatacttctaccccatatacacgtatccccttacttcctctctcactaaatcctacgaaacactcacctcttctctaatgtgtcctccagcccccacgaccccactagcccactaatccaccacagcaatacatgtatagatacctatatataatatcatatatacttagatcaccat

SEQ ID NO: 448679 - DNA, 963 bp, Homo sapiens
  misc_feature (586)..(586): n is a, c, g, or t
  misc_feature (598)..(598): n is a, c, g, or t
cttgtctatgtgcgctatagtcgtcatacgacacaccatatgtacggtagttagcgtattcaaagtgtcgatttaacacgtgatgtcttctgaaaatcgatcactgggtcggtctcgctctcttcatccatttagtcaggactaaacaataacactacaggcgcgcattacgcggaactaaattatcctgtggactctttaagtgatggaattcatcaactcccactcaaaacactctatatacaagacgctaatactcggcatgacagcgaaatgtcgcggcgggtgcacaaaagcactggagtatttaaaaagtgtgccgtcgggaaaaatgatagggggggaacaaagtggttcgtgtttaaagtacaattaagcaaaaacacataacaacccacaaaaggggtccgtacgacgcaccgtcggaataaatcaactcgatggtaaatcacaggggttttttatgtcgatagaaggtcctggcctcttcaaattgtccaaacgaaaggagtcccaggtggaaagcccacaaccttccccctttgaatgcataccataatgcctgtaaaacaaccactatgagccnttctggaagcgntgtcatttcaaccgcaacaatagctactactccatctaagccaacatgtgatgaaaaatatgcaaacatcactgtggattacttatataacaaggaaactaaattatttacagcaaagctaaatgttaatgagaatgtggaatgtggaaacaatacttgcacaaacaatgaggtgcataaccttacagaatgtaaaaatgcgtctgtttccatatctcataattcatgtactgctcctgataagacattaatattagatgtgccaccaggggttgaaaagtttcagttacatgattgtacacaagttgaaaaagcaggcggccgttccctgatttctgcgccctaccgctgacgcgtgtacaaaa

SEQ ID NO: 448680 - DNA, 933 bp, Homo sapiens
  misc_feature (548)..(548): n is a, c, g, or t
  misc_feature (560)..(560): n is a, c, g, or t
  misc_feature (885)..(885): n is a, c, g, or t
cttctcacgccgcttacttccccaccacgcgaatcatctgtatgagccatcgcacaaacacccgccgtactcctggactctcaaccttccaacagctgctctcacgcaaacattcataatgaccacctatcccaatcactcgccgcacacgttacccgccccaccacctaataactagttcgctacacgagcttatgcatccatcaccacgatacaatagcggccacgcttcctcctcacaccatgtcggcgttccctcaccaccggacgactaaacatatatacccgcactaaaaacacatccgtagatcaaaagcgaacgtagcttcacaacagtcaccatcaaccccctcactctaactccccccaaaatattcttctataagccttatggaagaactcacacagcgggcactcccaatgggttttttagaccataaaggccggagcctgtcacctgtccaaagcagggtataccatggaaaagccccaacaccttgccccagagaagcacaccttaatgcctatgaaacaaccactatgagccnttctggaagcgntgtcatttcaaccgcaacaatagctactactccatctaagccaacatgtgatgaaaaatatgcaaacatcactgtggattacttatataacaaggaaactaaattatttacagcaaagctaaatgttaatgagaatgtggaatgtggaaacaatacttgcacaaacaatgaggtgcataaccttacagaatgtaaaaatgcgtctgtttccatatctcataattcatgtactgctcctgataagacattaatattagatgtgccaccaggggttgaaaagtttcagttacatgattgtacacaagttgaaaaagcagtacagcancgcgccacgcccctccttctcctgctctactcccccctccctcaacat

SEQ ID NO: 448681 - DNA, 904 bp, Homo sapiens
cgtcaccgaagtaaagcttccatacgcttactatactcggtcacatattcctatcaagcgcacgaaacagcgtcaacaaccttcacatcagccctatccatcattctaccagataggacaactcaataatcatttccatacacagacccgcagcattcttatcgtcctccctctatgattgttgtgaatgccgcccattcctctcactcgctttgtcgccttataaccattttaccgataccaggcctgcccctcccaacccaccgactaacgctaaccgtggatgttgtaacaatatccgtccctaatctaccaacctgtcctcttacaggcacattaaccccacccccctaatcctccctaatgttcttcacaagccatctgagcaaatccaacgcggtaatcccatcctttctaggccataaggcacccgcctgctgctgtccacaaagggatcccagggcaaagcccaacaccttcccccactgatgcctaccttaatgcctctgaaacaaccactctgagcccttctggaagcgctgtcatttcaaccacaacaatagctactactccatctaagccaacatgtgatgaaaaatatgcaaacatcactgtggattacttatataacaaggaaactaaattatttacagcaaagctaaatgttaatgagaatgtggaatgtggaaacaatacttgcacaaacaatgaggtgcataaccttacagaatgtaaaaatgcgtctgtttccatatctcataattcatgtactgctcctgataagacattaatattagatgtgccaccaggggttgaaaagtttcagttacatgattgtacacaagttgaaaaagcaggcggcagtttctctgtcccgtactacaacgattgcgtgcacaaaaac

SEQ ID NO: 448682 - DNA, 918 bp, Homo sapiens
ctggtaagatgttaagggggctaaccgcgacgatattcgttcactacatttatattgttgtgaaaaccggtggattgaacttgtccttggccgaactacgtattgaatatcaatgaaagcattaaacctaaataaatcatagtcatagcgccatagccactcgggcgcctccctcgcgcgtcttatcttactgttctctctcttactatactcgtatgttcgtattcctatccttgcgttgggcgcgaggctgctccaagcggctgcctatatttacatggatgtatgttataaacaggtgggttggggaaatgtgtatggcagtgctttgcaccaacccaacaaagagcgataacgtcgacagttgtttacagatacgtgcagactcccgcaatctccatcatctaaatgatggattcggatcaggatacgacatgtgcgatgcgccaccccggggttgaaaagtttcagttacatgattgtacacaagttgaaaaagcagatactactatttgtttaaaatggaaaaatattgaaacctttacttgtgatacacagaatattacctacagatttcagtgtggtaatatgatatttgataataaagaaattaaattagaaaaccttgaacccgaacatgagtataagtgtgactcagaaatactctataataaccacaagtttactaacgcaagtaaaattattaaaacagattttgggagtccaggagagcctcagattattttttgtagaagtgaagctgcacatcaaggagtaattacctggaatccccctcaaagatcatttcataattttaccctctgttatataaaagagacagaaaaagattgcctcaatctggataaaaacctgatgcggcaggtttcctttctagtatcatctgagggttatgataat

SEQ ID NO: 448683 - DNA, 513 bp, Homo sapiens
atctcaatccttgccaaattctatgtcattagcataatttcagtggctttaactgacatgttaggaatgaatgagggcttaggatacacattatgaaatactaatcaagtttatttctgtatcttcttgtcaggggttgaaaagtttcagttacatgattgtacacaagttgaaaaagcagatactactatttgtttaaaatggaaaaatattgaaacctttacttgtgatacacagaatattacctacagatttcagtgtggtaagaatataacattgaccagagaatttttttttgtggcacaatgttgttctagatattatttaatcttactctctgccctttctctcttcctccctgcctctcttgttctccctctgtttgtcttttttctttcttgtctttttcttggtctgtggtatatttagagtcaaataattaaattacctatacaattcaaacaaattcacaaaataaatgaatacttttcatgaaaaataaatatctaaaaa

SEQ ID NO: 448684 - DNA, 5358 bp, Homo sapiens
cgacattttaactgaactgcgggataaagtgaaatctttccgtgcagctctacgagaggaggaaattgttcctcgtctgataagacaacagtggagaaaggacgcatgctgtttcttagggacacggctgacttccagatatgaccatgtatttgtggcttaaactcttggcatttggctttgcctttctggacacagaagtatttgtgacagggcaaagcccaacaccttcccccactggattgactacagcaaagatgcccagtgttccactttcaagtgaccccttacctactcacaccactgcattctcacccgcaagcacctttgaaagagaaaatgacttctcagagaccacaacttctcttagtccagacaatacttccacccaagtatccccggactctttggataatgctagtgcttttaataccacaggtgtttcatcagtacagacgcctcaccttcccacgcacgcagactcgcagacgccctctgctggaactgacacgcagacattcagcggctccgccgccaatgcaaaactcaaccctaccccaggcagcaatgctatctcagatgtcccaggagagaggagtacagccagcacctttcctacagacccagtttccccattgacaaccaccctcagccttgcacaccacagctctgctgccttacctgcacgcacctccaacaccaccatcacagcgaacacctcagatgcctaccttaatgcctctgaaacaaccactctgagcccttctggaagcgctgtcatttcaaccacaacaatagctactactccatctaagccaacatgtgatgaaaaatatgcaaacatcactgtggattacttatataacaaggaaactaaattatttacagcaaagctaaatgttaatgagaatgtggaatgtggaaacaatacttgcacaaacaatgaggtgcataaccttacagaatgtaaaaatgcgtctgtttccatatctcataattcatgtactgctcctgataagacattaatattagatgtgccaccaggggttgaaaagtttcagttacatgattgtacacaagttgaaaaagcagatactactatttgtttaaaatggaaaaatattgaaacctttacttgtgatacacagaatattacctacagatttcagtgtggtaatatgatatttgataataaagaaattaaattagaaaaccttgaacccgaacatgagtataagtgtgactcagaaatactctataataaccacaagtttactaacgcaagtaaaattattaaaacagattttgggagtccaggagagcctcagattattttttgtagaagtgaagctgcacatcaaggagtaattacctggaatccccctcaaagatcatttcataattttaccctctgttatataaaagagacagaaaaagattgcctcaatctggataaaaacctgatcaaatatgatttgcaaaatttaaaaccttatacgaaatatgttttatcattacatgcctacatcattgcaaaagtgcaacgtaatggaagtgctgcaatgtgtcatttcacaactaaaagtgctcctccaagccaggtctggaacatgactgtctccatgacatcagataatagtatgcatgtcaagtgtaggcctcccagggaccgtaatggcccccatgaacgttaccatttggaagttgaagctggaaatactctggttagaaatgagtcgcataagaattgcgatttccgtgtaaaagatcttcaatattcaacagactacacttttaaggcctattttcacaatggagactatcctggagaaccctttattttacatcattcaacatcttataattctaaggcactgatagcatttctggcatttctgattattgtgacatcaatagccctgcttgttgttctctacaaaatctatgatctacataagaaaagatcctgcaatttagatgaacagcaggagcttgttgaaagggatgatgaaaaacaactgatgaatgtggagccaatccatgcagatattttgttggaaacttataagaggaagattgctgatgaaggaagactttttctggctgaatttcagagcatcccgcgggtgttcagcaagtttcctataaaggaagctcgaaagccctttaaccagaataaaaaccgttatgttgacattcttccttatgattataaccgtgttgaactctctgaaataaacggagatgcagggtcaaactacataaatgccagctatattgatggtttcaaagaacccaggaaatacattgctgcacaaggtcccagggatgaaactgttgatgatttctggaggatgatttgggaacagaaagccacagttattgtcatggtcactcgatgtgaagaaggaaacaggaacaagtgtgcagaatactggccgtcaatggaagagggcactcgggcttttggagatgttgttgtaaagatcaaccagcacaaaagatgtccagattacatcattcagaaattgaacattgtaaataaaaaagaaaaagcaactggaagagaggtgactcacattcagttcaccagctggccagaccacggggtgcctgaggatcctcacttgctcctcaaactgagaaggagagtgaatgccttcagcaatttcttcagtggtcccattgtggtgcactgcagtgctggtgttgggcgcacaggaacctatatcggaattgatgccatgctagaaggcctggaagccgagaacaaagtggatgtttatggttatgttgtcaagctaaggcgacagagatgcctgatggttcaagtagaggcccagtacatcttgatccatcaggctttggtggaatacaatcagtttggagaaacagaagtgaatttgtctgaattacatccatatctacataacatgaagaaaagggatccacccagtgagccgtctccactagaggctgaattccagagacttccttcatataggagctggaggacacagcacattggaaatcaagaagaaaataaaagtaaaaacaggaattctaatgtcatcccatatgactataacagagtgccacttaaacatgagctggaaatgagtaaagagagtgagcatgattcagatgaatcctctgatgatgacagtgattcagaggaaccaagcaaatacatcaatgcatcttttataatgagctactggaaacctgaagtgatgattgctgctcagggaccactgaaggagaccattggtgacttttggcagatgatcttccaaagaaaagtcaaagttattgttatgctgacagaactgaaacatggagaccaggaaatctgtgctcagtactggggagaaggaaagcaaacatatggagatattgaagttgacctgaaagacacagacaaatcttcaacttatacccttcgtgtctttgaactgagacattccaagaggaaagactctcgaactgtgtaccagtaccaatatacaaactggagtgtggagcagcttcctgcagaacccaaggaattaatctctatgattcaggtcgtcaaacaaaaacttccccagaagaattcctctgaagggaacaagcatcacaagagtacacctctactcattcactgcagggatggatctcagcaaacgggaatattttgtgctttgttaaatctcttagaaagtgcggaaacagaagaggtagtggatatttttcaagtggtaaaagctctacgcaaagctaggccaggcatggtttccacattcgagcaatatcaattcctatatgacgtcattgccagcacctaccctgctcagaatggacaagtaaagaaaaacaaccatcaagaagataaaattgaatttgataatgaagtggacaaagtaaagcaggatgctaattgtgttaatccacttggtgccccagaaaagctccctgaagcaaaggaacaggctgaaggttctgaacccacgagtggcactgaggggccagaacattctgtcaatggtcctgcaagtccagctttaaatcaaggttcataggaaaagacataaatgaggaaactccaaacctcctgttagctgttatttctatttttgtagaagtaggaagtgaaaataggtatacagtggattaattaaatgcagcgaaccaatatttgtagaagggttatattttactactgtggaaaaatatttaagatagttttgccagaacagtttgtacagacgtatgcttattttaaaattttatctcttattcagtaaaaaacaacttctttgtaatcgttatgtgtgtatatgtatgtgtgtatgggtgtgtgtttgtgtgagagacagagaaagagagagaattctttcaagtgaatctaaaagcttttgcttttcctttgtttttatgaagaaaaaatacattttatattagaagtgttaacttagcttgaaggatctgtttttaaaaatcataaactgtgtgcagactcaataaaatcatgtacatttctgaaatgacctcaagatgtcctccttgttctactcatatatatctatcttatatagtttactattttacttctagagatagtacataaaggtggtatgtgtgtgtatgctactacaaaaaagttgttaactaaattaacattgggaaatcttatattccatatattagcatttagtccaatgtctttttaagcttatttaattaaaaaatttccagtgagcttatcatgctgtctttacatggggttttcaattttgcatgctcgattattccctgtacaatatttaaaatttattgcttgatacttttgacaacaaattaggttttgtacaattgaacttaaataaatgtcattaaaataaataaatgcaatatgtattaatattcattgtataaaaatagaagaatacaaacatatttgttaaatatttacatatgaaatttaatatagctatttttatggaatttttcattgatatgaaaaatatgatattgcatatgcatagttcccatgttaaatcccattcataactttcattaaagcatttactttgaatttctccaatgcttagaatgtttttaccaggaatggatgtcgctaatcataataaaattcaaccattatttttttcttgtttataatacattgtgttatatgttcaaatatgaaatgtgtatgcacctattgaaatatgtttaatgcatttattaacatttgcaggacacttttacaggccccaattatccaatagtctaataattgtttaagatctagaaaaaaaaaatcaagaatagtggtatttttcatgaagtaataaaaactcgttttggtgaatt

SEQ ID NO: 448685 - DNA, 4495 bp, Homo sapiens
  misc_feature (4400)..(4400): n is a, c, g, or t
cgacattttaactgaactgcgggataaagtgaaatctttccgtgcagctctacgagaggaggaaattgttcctcgtctgataagacaacagtggagaaaggacgcatgctgtttcttagggacacggctgacttccagatatgaccatgtatttgtggcttaaactcttggcatttggctttgcctttctggacacagaagtatttgtgacagggcaaagcccaacaccttcccccactggattgactacagcaaagatgcccagtgttccactttcaagtgaccccttacctactcacaccactgcattctcacccgcaagcacctttgaaagagaaaatgacttctcagagaccacaacttctcttagtccagacaatacttccacccaagtatccccggactctttggataatgctagtgcttttaataccacaggtgtttcatcagtacagacgcctcaccttcccacgcacgcagactcgcagacgccctctgctggaactgacacgcagacattcagcggctccgccgccaatgcaaaactcaaccctaccccaggcagcaatgctatctcagatgtcccaggagagaggagtacagccagcacctttcctacagacccagtttccccattgacaaccaccctcagccttgcacaccacagctctgctgccttacctgcacgcacctccaacaccaccatcacagcgaacacctcagatgcctaccttaatgcctctgaaacaaccactctgagcccttctggaagcgctgtcatttcaaccacaacaatagctactactccatctaagccaacatgtgatgaaaaatatgcaaacatcactgtggattacttatataacaaggaaactaaattatttacagcaaagctaaatgttaatgagaatgtggaatgtggaaacaatacttgcacaaacaatgaggtgcataaccttacagaatgtaaaaatgcgtctgtttccatatctcataattcatgtactgctcctgataagacattaatattagatgtgccaccaggggttgaaaagtttcagttacatgattgtacacaagttgaaaaagcagatactactatttgtttaaaatggaaaaatattgaaacctttacttgtgatacacagaatattacctacagatttcagtgtggtaatatgatatttgataataaagaaattaaattagaaaaccttgaacccgaacatgagtataagtgtgactcagaaatactctataataaccacaagtttactaacgcaagtaaaattattaaaacagattttgggagtccaggagagcctcagattattttttgtagaagtgaagctgcacatcaaggagtaattacctggaatccccctcaaagatcatttcataattttaccctctgttatataaaagagacagaaaaagattgcctcaatctggataaaaacctgatcaaatatgatttgcaaaatttaaaaccttatacgaaatatgttttatcattacatgcctacatcattgcaaaagtgcaacgtaatggaagtgctgcaatgtgtcatttcacaactaaaagtgctcctccaagccaggtctggaacatgactgtctccatgacatcagataatagtatgcatgtcaagtgtaggcctcccagggaccgtaatggcccccatgaacgttaccatttggaagttgaagctggaaatactctggttagaaatgagtcgcataagaattgcgatttccgtgtaaaagatcttcaatattcaacagactacacttttaaggcctattttcacaatggagactatcctggagaaccctttattttacatcattcaacatcttataattctaaggcactgatagcatttctggcatttctgattattgtgacatcaatagccctgcttgttgttctctacaaaatctatgatctacataagaaaagatcctgcaatttagatgaacagcaggagcttgttgaaagggatgatgaaaaacaactgatgaatgtggagccaatccatgcagatattttgttggaaacttataagaggaagattgctgatgaaggaagactttttctggctgaatttcagagcatcccgcgggtgttcagcaagtttcctataaaggaagctcgaaagccctttaaccagaataaaaaccgttatgttgacattcttccttatgattataaccgtgttgaactctctgaaataaacggagatgcagggtcaaactacataaatgccagctatattgatggtttcaaagaacccaggaaatacattgctgcacaaggtcccagggatgaaactgttgatgatttctggaggatgatttgggaacagaaagccacagttattgtcatggtcactcgatgtgaagaaggaaacaggaacaagtgtgcagaatactggccgtcaatggaagagggcactcgggcttttggagatgttgttgtaaagatcaaccagcacaaaagatgtccagattacatcattcagaaattgaacattgtaaataaaaaagaaaaagcaactggaagagaggtgactcacattcagttcaccagctggccagaccacggggtgcctgaggatcctcacttgctcctcaaactgagaaggagagtgaatgccttcagcaatttcttcagtggtcccattgtggtgcactgcagtgctggtgttgggcgcacaggaacctatatcggaattgatgccatgctagaaggcctggaagccgagaacaaagtggatgtttatggttatgttgtcaagctaaggcgacagagatgcctgatggttcaagtagaggcccagtacatcttgatccatcaggctttggtggaatacaatcagtttggagaaacagaagtgaatttgtctgaattacatccatatctacataacatgaagaaaagggatccacccagtgagccgtctccactagaggctgaattccagagacttccttcatataggagctggaggacacagcacattggaaatcaagaagaaaataaaagtaaaaacaggaattctaatgtcatcccatatgactataacagagtgccacttaaacatgagctggaaatgagtaaagagagtgagcatgattcagatgaatcctctgatgatgacagtgattcagaggaaccaagcaaatacatcaatgcatcttttataatgagctactggaaacctgaagtgatgattgctgctcagggaccactgaaggagaccattggtgacttttggcagatgatcttccaaagaaaagtcaaagttattgttatgctgacagaactgaaacatggagaccaggaaatctgtgctcagtactggggagaaggaaagcaaacatatggagatattgaagttgacctgaaagacacagacaaatcttcaacttatacccttcgtgtctttgaactgagacattccaagaggaaagactctcgaactgtgtaccagtaccaatatacaaactggagtgtggagcagcttcctgcagaacccaaggaattaatctctatgattcaggtcgtcaaacaaaaacttccccagaagaattcctctgaagggaacaagcatcacaagagtacacctctactcattcactgcagggatggatctcagcaaacgggaatattttgtgctttgttaaatctcttagaaagtgcggaaacagaagaggtagtggatatttttcaagtggtaaaagctctacgcaaagctaggccaggcatggtttccacattcgagcaatatcaattcctatatgacgtcattgccagcacctaccctgctcagaatggacaagtaaagaaaaacaaccatcaagaagataaaattgaatttgataatgaagtggacaaagtaaagcaggatgctaattgtgttaatccacttggtgccccagaaaagctccctgaagcaaaggaacaggctgaaggttctgaacccacgagtggcactgaggggccagaacattctgtcaatggtcctgcaagtccagctttaaatcaaggttcataggaaaagacataaatgaggaaactccaaacctcctgttagctgttatttctatttttgtagaagtaggaagtgaaaataggtatacagtggattaattaaatgcagcgaaccaatatttgtagaagggttatattttactactgtggaaaaatatttaagatagttttgccagaacagtttgtacagacgtatgcttattttaaaattttatctcttattcagtaaaaaacaacttctttgtaatcgttatgtgtgtatatgtatgtgtgtatgggtgtgtgtttgtgtgagagacagagaaagagagagaattctttcaagtgaatctaaaaggctttngcttttcctttgtttttattgagaaaaaattccttttaatattcttgttaactttacctggagggacttgttttatctaacttggttcagacttt

SEQ ID NO: 448686 - DNA, 5214 bp, Homo sapiens
cgacattttaactgaactgcgggataaagtgaaatctttccgtgcagctctacgagaggaggaaattgttcctcgtctgataagacaacagtggagaaaggacgcatgctgtttcttagggacacggctgacttccagatatgaccatgtatttgtggcttaaactcttggcatttggctttgcctttctggacacagaagtatttgtgacagggcaaagcccaacaccttcccccactggattgactacagcaaagatgcccagtgttccactttcaagtgaccccttacctactcacaccactgcattctcacccgcaagcacctttgaaagagaaaatgacttctcagagaccacaacttctcttagtccagacaatacttccacccaagtatccccggactctttggataatgctagtgcttttaataccacaggtgtttcatcagtacagacgcctcaccttcccacgcacgcagactcgcagacgccctctgctggaactgacacgcagacattcagcggctccgccgccaatgcaaaactcaaccctaccccaggcagcaatgctatctcagatgcctaccttaatgcctctgaaacaaccactctgagcccttctggaagcgctgtcatttcaaccacaacaatagctactactccatctaagccaacatgtgatgaaaaatatgcaaacatcactgtggattacttatataacaaggaaactaaattatttacagcaaagctaaatgttaatgagaatgtggaatgtggaaacaatacttgcacaaacaatgaggtgcataaccttacagaatgtaaaaatgcgtctgtttccatatctcataattcatgtactgctcctgataagacattaatattagatgtgccaccaggggttgaaaagtttcagttacatgattgtacacaagttgaaaaagcagatactactatttgtttaaaatggaaaaatattgaaacctttacttgtgatacacagaatattacctacagatttcagtgtggtaatatgatatttgataataaagaaattaaattagaaaaccttgaacccgaacatgagtataagtgtgactcagaaatactctataataaccacaagtttactaacgcaagtaaaattattaaaacagattttgggagtccaggagagcctcagattattttttgtagaagtgaagctgcacatcaaggagtaattacctggaatccccctcaaagatcatttcataattttaccctctgttatataaaagagacagaaaaagattgcctcaatctggataaaaacctgatcaaatatgatttgcaaaatttaaaaccttatacgaaatatgttttatcattacatgcctacatcattgcaaaagtgcaacgtaatggaagtgctgcaatgtgtcatttcacaactaaaagtgctcctccaagccaggtctggaacatgactgtctccatgacatcagataatagtatgcatgtcaagtgtaggcctcccagggaccgtaatggcccccatgaacgttaccatttggaagttgaagctggaaatactctggttagaaatgagtcgcataagaattgcgatttccgtgtaaaagatcttcaatattcaacagactacacttttaaggcctattttcacaatggagactatcctggagaaccctttattttacatcattcaacatcttataattctaaggcactgatagcatttctggcatttctgattattgtgacatcaatagccctgcttgttgttctctacaaaatctatgatctacataagaaaagatcctgcaatttagatgaacagcaggagcttgttgaaagggatgatgaaaaacaactgatgaatgtggagccaatccatgcagatattttgttggaaacttataagaggaagattgctgatgaaggaagactttttctggctgaatttcagagcatcccgcgggtgttcagcaagtttcctataaaggaagctcgaaagccctttaaccagaataaaaaccgttatgttgacattcttccttatgattataaccgtgttgaactctctgaaataaacggagatgcagggtcaaactacataaatgccagctatattgatggtttcaaagaacccaggaaatacattgctgcacaaggtcccagggatgaaactgttgatgatttctggaggatgatttgggaacagaaagccacagttattgtcatggtcactcgatgtgaagaaggaaacaggaacaagtgtgcagaatactggccgtcaatggaagagggcactcgggcttttggagatgttgttgtaaagatcaaccagcacaaaagatgtccagattacatcattcagaaattgaacattgtaaataaaaaagaaaaagcaactggaagagaggtgactcacattcagttcaccagctggccagaccacggggtgcctgaggatcctcacttgctcctcaaactgagaaggagagtgaatgccttcagcaatttcttcagtggtcccattgtggtgcactgcagtgctggtgttgggcgcacaggaacctatatcggaattgatgccatgctagaaggcctggaagccgagaacaaagtggatgtttatggttatgttgtcaagctaaggcgacagagatgcctgatggttcaagtagaggcccagtacatcttgatccatcaggctttggtggaatacaatcagtttggagaaacagaagtgaatttgtctgaattacatccatatctacataacatgaagaaaagggatccacccagtgagccgtctccactagaggctgaattccagagacttccttcatataggagctggaggacacagcacattggaaatcaagaagaaaataaaagtaaaaacaggaattctaatgtcatcccatatgactataacagagtgccacttaaacatgagctggaaatgagtaaagagagtgagcatgattcagatgaatcctctgatgatgacagtgattcagaggaaccaagcaaatacatcaatgcatcttttataatgagctactggaaacctgaagtgatgattgctgctcagggaccactgaaggagaccattggtgacttttggcagatgatcttccaaagaaaagtcaaagttattgttatgctgacagaactgaaacatggagaccaggaaatctgtgctcagtactggggagaaggaaagcaaacatatggagatattgaagttgacctgaaagacacagacaaatcttcaacttatacccttcgtgtctttgaactgagacattccaagaggaaagactctcgaactgtgtaccagtaccaatatacaaactggagtgtggagcagcttcctgcagaacccaaggaattaatctctatgattcaggtcgtcaaacaaaaacttccccagaagaattcctctgaagggaacaagcatcacaagagtacacctctactcattcactgcagggatggatctcagcaaacgggaatattttgtgctttgttaaatctcttagaaagtgcggaaacagaagaggtagtggatatttttcaagtggtaaaagctctacgcaaagctaggccaggcatggtttccacattcgagcaatatcaattcctatatgacgtcattgccagcacctaccctgctcagaatggacaagtaaagaaaaacaaccatcaagaagataaaattgaatttgataatgaagtggacaaagtaaagcaggatgctaattgtgttaatccacttggtgccccagaaaagctccctgaagcaaaggaacaggctgaaggttctgaacccacgagtggcactgaggggccagaacattctgtcaatggtcctgcaagtccagctttaaatcaaggttcataggaaaagacataaatgaggaaactccaaacctcctgttagctgttatttctatttttgtagaagtaggaagtgaaaataggtatacagtggattaattaaatgcagcgaaccaatatttgtagaagggttatattttactactgtggaaaaatatttaagatagttttgccagaacagtttgtacagacgtatgcttattttaaaattttatctcttattcagtaaaaaacaacttctttgtaatcgttatgtgtgtatatgtatgtgtgtatgggtgtgtgtttgtgtgagagacagagaaagagagagaattctttcaagtgaatctaaaagcttttgcttttcctttgtttttatgaagaaaaaatacattttatattagaagtgttaacttagcttgaaggatctgtttttaaaaatcataaactgtgtgcagactcaataaaatcatgtacatttctgaaatgacctcaagatgtcctccttgttctactcatatatatctatcttatatagtttactattttacttctagagatagtacataaaggtggtatgtgtgtgtatgctactacaaaaaagttgttaactaaattaacattgggaaatcttatattccatatattagcatttagtccaatgtctttttaagcttatttaattaaaaaatttccagtgagcttatcatgctgtctttacatggggttttcaattttgcatgctcgattattccctgtacaatatttaaaatttattgcttgatacttttgacaacaaattaggttttgtacaattgaacttaaataaatgtcattaaaataaataaatgcaatatgtattaatattcattgtataaaaatagaagaatacaaacatatttgttaaatatttacatatgaaatttaatatagctatttttatggaatttttcattgatatgaaaaatatgatattgcatatgcatagttcccatgttaaatcccattcataactttcattaaagcatttactttgaatttctccaatgcttagaatgtttttaccaggaatggatgtcgctaatcataataaaattcaaccattatttttttcttgtttataatacattgtgttatatgttcaaatatgaaatgtgtatgcacctattgaaatatgtttaatgcatttattaacatttgcaggacacttttacaggccccaattatccaatagtctaataattgtttaagatctagaaaaaaaaaatcaagaatagtggtatttttcatgaagtaataaaaactcgttttggtgaatt

SEQ ID NO: 448687 - DNA, 5094 bp, Homo sapiens
  misc_feature (94)..(94): n is a, c, g, or t
ccgcgcctacctccgcgcaccacggccagccagtagcgccgcgaacgtcgaagtatcgaccggcacacagacatttacaccgcactccacggantacgccgctgcatagccacagtgctccgtcactgcgcgtcactcgctctactatgacacaaacccggcgctcgctcaatgcaccacgaacactatcctcccgcatatctgcctcttcatccatcctccgtgtcaacctagtgttgtcgtctcctgacctacgcccaaccaccaccactggtctggttcataggtccatttcgaccaccggtcatccatagccctcgaaaatgttttcttccgatggccattggcaaaaatcgcgcgtgggaatatccagggagttgttttggccataaaggccggagcctgtcacctgtccaaagaaagggatcccagggcaaagcccaacaccttcccccactgatgcctaccttaatgcctctgaaacaaccactctgagcccttctggaagcgctgtcatttcaaccacaacaatagctactactccatctaagccaacatgtgatgaaaaatatgcaaacatcactgtggattacttatataacaaggaaactaaattatttacagcaaagctaaatgttaatgagaatgtggaatgtggaaacaatacttgcacaaacaatgaggtgcataaccttacagaatgtaaaaatgcgtctgtttccatatctcataattcatgtactgctcctgataagacattaatattagatgtgccaccaggggttgaaaagtttcagttacatgattgtacacaagttgaaaaagcagatactactatttgtttaaaatggaaaaatattgaaacctttacttgtgatacacagaatattacctacagatttcagtgtggtaatatgatatttgataataaagaaattaaattagaaaaccttgaacccgaacatgagtataagtgtgactcagaaatactctataataaccacaagtttactaacgcaagtaaaattattaaaacagattttgggagtccaggagagcctcagattattttttgtagaagtgaagctgcacatcaaggagtaattacctggaatccccctcaaagatcatttcataattttaccctctgttatataaaagagacagaaaaagattgcctcaatctggataaaaacctgatcaaatatgatttgcaaaatttaaaaccttatacgaaatatgttttatcattacatgcctacatcattgcaaaagtgcaacgtaatggaagtgctgcaatgtgtcatttcacaactaaaagtgctcctccaagccaggtctggaacatgactgtctccatgacatcagataatagtatgcatgtcaagtgtaggcctcccagggaccgtaatggcccccatgaacgttaccatttggaagttgaagctggaaatactctggttagaaatgagtcgcataagaattgcgatttccgtgtaaaagatcttcaatattcaacagactacacttttaaggcctattttcacaatggagactatcctggagaaccctttattttacatcattcaacatcttataattctaaggcactgatagcatttctggcatttctgattattgtgacatcaatagccctgcttgttgttctctacaaaatctatgatctacataagaaaagatcctgcaatttagatgaacagcaggagcttgttgaaagggatgatgaaaaacaactgatgaatgtggagccaatccatgcagatattttgttggaaacttataagaggaagattgctgatgaaggaagactttttctggctgaatttcagagcatcccgcgggtgttcagcaagtttcctataaaggaagctcgaaagccctttaaccagaataaaaaccgttatgttgacattcttccttatgattataaccgtgttgaactctctgaaataaacggagatgcagggtcaaactacataaatgccagctatattgatggtttcaaagaacccaggaaatacattgctgcacaaggtcccagggatgaaactgttgatgatttctggaggatgatttgggaacagaaagccacagttattgtcatggtcactcgatgtgaagaaggaaacaggaacaagtgtgcagaatactggccgtcaatggaagagggcactcgggcttttggagatgttgttgtaaagatcaaccagcacaaaagatgtccagattacatcattcagaaattgaacattgtaaataaaaaagaaaaagcaactggaagagaggtgactcacattcagttcaccagctggccagaccacggggtgcctgaggatcctcacttgctcctcaaactgagaaggagagtgaatgccttcagcaatttcttcagtggtcccattgtggtgcactgcagtgctggtgttgggcgcacaggaacctatatcggaattgatgccatgctagaaggcctggaagccgagaacaaagtggatgtttatggttatgttgtcaagctaaggcgacagagatgcctgatggttcaagtagaggcccagtacatcttgatccatcaggctttggtggaatacaatcagtttggagaaacagaagtgaatttgtctgaattacatccatatctacataacatgaagaaaagggatccacccagtgagccgtctccactagaggctgaattccagagacttccttcatataggagctggaggacacagcacattggaaatcaagaagaaaataaaagtaaaaacaggaattctaatgtcatcccatatgactataacagagtgccacttaaacatgagctggaaatgagtaaagagagtgagcatgattcagatgaatcctctgatgatgacagtgattcagaggaaccaagcaaatacatcaatgcatcttttataatgagctactggaaacctgaagtgatgattgctgctcagggaccactgaaggagaccattggtgacttttggcagatgatcttccaaagaaaagtcaaagttattgttatgctgacagaactgaaacatggagaccaggaaatctgtgctcagtactggggagaaggaaagcaaacatatggagatattgaagttgacctgaaagacacagacaaatcttcaacttatacccttcgtgtctttgaactgagacattccaagaggaaagactctcgaactgtgtaccagtaccaatatacaaactggagtgtggagcagcttcctgcagaacccaaggaattaatctctatgattcaggtcgtcaaacaaaaacttccccagaagaattcctctgaagggaacaagcatcacaagagtacacctctactcattcactgcagggatggatctcagcaaacgggaatattttgtgctttgttaaatctcttagaaagtgcggaaacagaagaggtagtggatatttttcaagtggtaaaagctctacgcaaagctaggccaggcatggtttccacattcgagcaatatcaattcctatatgacgtcattgccagcacctaccctgctcagaatggacaagtaaagaaaaacaaccatcaagaagataaaattgaatttgataatgaagtggacaaagtaaagcaggatgctaattgtgttaatccacttggtgccccagaaaagctccctgaagcaaaggaacaggctgaaggttctgaacccacgagtggcactgaggggccagaacattctgtcaatggtcctgcaagtccagctttaaatcaaggttcataggaaaagacataaatgaggaaactccaaacctcctgttagctgttatttctatttttgtagaagtaggaagtgaaaataggtatacagtggattaattaaatgcagcgaaccaatatttgtagaagggttatattttactactgtggaaaaatatttaagatagttttgccagaacagtttgtacagacgtatgcttattttaaaattttatctcttattcagtaaaaaacaacttctttgtaatcgttatgtgtgtatatgtatgtgtgtatgggtgtgtgtttgtgtgagagacagagaaagagagagaattctttcaagtgaatctaaaagcttttgcttttcctttgtttttatgaagaaaaaatacattttatattagaagtgttaacttagcttgaaggatctgtttttaaaaatcataaactgtgtgcagactcaataaaatcatgtacatttctgaaatgacctcaagatgtcctccttgttctactcatatatatctatcttatatagtttactattttacttctagagatagtacataaaggtggtatgtgtgtgtatgctactacaaaaaagttgttaactaaattaacattgggaaatcttatattccatatattagcatttagtccaatgtctttttaagcttatttaattaaaaaatttccagtgagcttatcatgctgtctttacatggggttttcaattttgcatgctcgattattccctgtacaatatttaaaatttattgcttgatacttttgacaacaaattaggttttgtacaattgaacttaaataaatgtcattaaaataaataaatgcaatatgtattaatattcattgtataaaaatagaagaatacaaacatatttgttaaatatttacatatgaaatttaatatagctatttttatggaatttttcattgatatgaaaaatatgatattgcatatgcatagttcccatgttaaatcccattcataactttcattaaagcatttactttgaatttctccaatgcttagaatgtttttaccaggaatggatgtcgctaatcataataaaattcaaccattatttttttcttgtttataatacattgtgttatatgttcaaatatgaaatgtgtatgcacctattgaaatatgtttaatgcatttattaacatttgcaggacacttttacaggccccaattatccaatagtctaataattgtttaagatctagaaaaaaaaaatcaagaatagtggtatttttcatgaagtaataaaaactcgttttggtgaatt

SEQ ID NO: 448688 - DNA, 5379 bp, Homo sapiens
  misc_feature (94)..(94): n is a, c, g, or t
ccgcgcctacctccgcgcaccacggccagccagtagcgccgcgaacgtcgaagtatcgaccggcacacagacatttacaccgcactccacggantacgccgctgcatagccacagtgctccgtcactgcgcgtcactcgctctactatgacacaaacccggcgctcgctcaatgcaccacgaacactatcctcccgcatatctgcctcttcatccatcctccgtgtcaacctagtgttgtcgtctcctgacctacgcccaaccaccaccactggtctggttcataggtccatttcgaccaccggtcatccatagccctcgaaaatgttttcttccgatggccattggcaaaaatcgcgcgtgggaatatccagggagttgttttggccataaaggccggagcctgtcacctgtccaaagaaagggatcccagggcaaagcccaacaccttcccccactggtgtttcatcagtacagacgcctcaccttcccacgcacgcagactcgcagacgccctctgctggaactgacacgcagacattcagcggctccgccgccaatgcaaaactcaaccctaccccaggcagcaatgctatctcagatgtcccaggagagaggagtacagccagcacctttcctacagacccagtttccccattgacaaccaccctcagccttgcacaccacagctctgctgccttacctgcacgcacctccaacaccaccatcacagcgaacacctcagatgcctaccttaatgcctctgaaacaaccactctgagcccttctggaagcgctgtcatttcaaccacaacaatagctactactccatctaagccaacatgtgatgaaaaatatgcaaacatcactgtggattacttatataacaaggaaactaaattatttacagcaaagctaaatgttaatgagaatgtggaatgtggaaacaatacttgcacaaacaatgaggtgcataaccttacagaatgtaaaaatgcgtctgtttccatatctcataattcatgtactgctcctgataagacattaatattagatgtgccaccaggggttgaaaagtttcagttacatgattgtacacaagttgaaaaagcagatactactatttgtttaaaatggaaaaatattgaaacctttacttgtgatacacagaatattacctacagatttcagtgtggtaatatgatatttgataataaagaaattaaattagaaaaccttgaacccgaacatgagtataagtgtgactcagaaatactctataataaccacaagtttactaacgcaagtaaaattattaaaacagattttgggagtccaggagagcctcagattattttttgtagaagtgaagctgcacatcaaggagtaattacctggaatccccctcaaagatcatttcataattttaccctctgttatataaaagagacagaaaaagattgcctcaatctggataaaaacctgatcaaatatgatttgcaaaatttaaaaccttatacgaaatatgttttatcattacatgcctacatcattgcaaaagtgcaacgtaatggaagtgctgcaatgtgtcatttcacaactaaaagtgctcctccaagccaggtctggaacatgactgtctccatgacatcagataatagtatgcatgtcaagtgtaggcctcccagggaccgtaatggcccccatgaacgttaccatttggaagttgaagctggaaatactctggttagaaatgagtcgcataagaattgcgatttccgtgtaaaagatcttcaatattcaacagactacacttttaaggcctattttcacaatggagactatcctggagaaccctttattttacatcattcaacatcttataattctaaggcactgatagcatttctggcatttctgattattgtgacatcaatagccctgcttgttgttctctacaaaatctatgatctacataagaaaagatcctgcaatttagatgaacagcaggagcttgttgaaagggatgatgaaaaacaactgatgaatgtggagccaatccatgcagatattttgttggaaacttataagaggaagattgctgatgaaggaagactttttctggctgaatttcagagcatcccgcgggtgttcagcaagtttcctataaaggaagctcgaaagccctttaaccagaataaaaaccgttatgttgacattcttccttatgattataaccgtgttgaactctctgaaataaacggagatgcagggtcaaactacataaatgccagctatattgatggtttcaaagaacccaggaaatacattgctgcacaaggtcccagggatgaaactgttgatgatttctggaggatgatttgggaacagaaagccacagttattgtcatggtcactcgatgtgaagaaggaaacaggaacaagtgtgcagaatactggccgtcaatggaagagggcactcgggcttttggagatgttgttgtaaagatcaaccagcacaaaagatgtccagattacatcattcagaaattgaacattgtaaataaaaaagaaaaagcaactggaagagaggtgactcacattcagttcaccagctggccagaccacggggtgcctgaggatcctcacttgctcctcaaactgagaaggagagtgaatgccttcagcaatttcttcagtggtcccattgtggtgcactgcagtgctggtgttgggcgcacaggaacctatatcggaattgatgccatgctagaaggcctggaagccgagaacaaagtggatgtttatggttatgttgtcaagctaaggcgacagagatgcctgatggttcaagtagaggcccagtacatcttgatccatcaggctttggtggaatacaatcagtttggagaaacagaagtgaatttgtctgaattacatccatatctacataacatgaagaaaagggatccacccagtgagccgtctccactagaggctgaattccagagacttccttcatataggagctggaggacacagcacattggaaatcaagaagaaaataaaagtaaaaacaggaattctaatgtcatcccatatgactataacagagtgccacttaaacatgagctggaaatgagtaaagagagtgagcatgattcagatgaatcctctgatgatgacagtgattcagaggaaccaagcaaatacatcaatgcatcttttataatgagctactggaaacctgaagtgatgattgctgctcagggaccactgaaggagaccattggtgacttttggcagatgatcttccaaagaaaagtcaaagttattgttatgctgacagaactgaaacatggagaccaggaaatctgtgctcagtactggggagaaggaaagcaaacatatggagatattgaagttgacctgaaagacacagacaaatcttcaacttatacccttcgtgtctttgaactgagacattccaagaggaaagactctcgaactgtgtaccagtaccaatatacaaactggagtgtggagcagcttcctgcagaacccaaggaattaatctctatgattcaggtcgtcaaacaaaaacttccccagaagaattcctctgaagggaacaagcatcacaagagtacacctctactcattcactgcagggatggatctcagcaaacgggaatattttgtgctttgttaaatctcttagaaagtgcggaaacagaagaggtagtggatatttttcaagtggtaaaagctctacgcaaagctaggccaggcatggtttccacattcgagcaatatcaattcctatatgacgtcattgccagcacctaccctgctcagaatggacaagtaaagaaaaacaaccatcaagaagataaaattgaatttgataatgaagtggacaaagtaaagcaggatgctaattgtgttaatccacttggtgccccagaaaagctccctgaagcaaaggaacaggctgaaggttctgaacccacgagtggcactgaggggccagaacattctgtcaatggtcctgcaagtccagctttaaatcaaggttcataggaaaagacataaatgaggaaactccaaacctcctgttagctgttatttctatttttgtagaagtaggaagtgaaaataggtatacagtggattaattaaatgcagcgaaccaatatttgtagaagggttatattttactactgtggaaaaatatttaagatagttttgccagaacagtttgtacagacgtatgcttattttaaaattttatctcttattcagtaaaaaacaacttctttgtaatcgttatgtgtgtatatgtatgtgtgtatgggtgtgtgtttgtgtgagagacagagaaagagagagaattctttcaagtgaatctaaaagcttttgcttttcctttgtttttatgaagaaaaaatacattttatattagaagtgttaacttagcttgaaggatctgtttttaaaaatcataaactgtgtgcagactcaataaaatcatgtacatttctgaaatgacctcaagatgtcctccttgttctactcatatatatctatcttatatagtttactattttacttctagagatagtacataaaggtggtatgtgtgtgtatgctactacaaaaaagttgttaactaaattaacattgggaaatcttatattccatatattagcatttagtccaatgtctttttaagcttatttaattaaaaaatttccagtgagcttatcatgctgtctttacatggggttttcaattttgcatgctcgattattccctgtacaatatttaaaatttattgcttgatacttttgacaacaaattaggttttgtacaattgaacttaaataaatgtcattaaaataaataaatgcaatatgtattaatattcattgtataaaaatagaagaatacaaacatatttgttaaatatttacatatgaaatttaatatagctatttttatggaatttttcattgatatgaaaaatatgatattgcatatgcatagttcccatgttaaatcccattcataactttcattaaagcatttactttgaatttctccaatgcttagaatgtttttaccaggaatggatgtcgctaatcataataaaattcaaccattatttttttcttgtttataatacattgtgttatatgttcaaatatgaaatgtgtatgcacctattgaaatatgtttaatgcatttattaacatttgcaggacacttttacaggccccaattatccaatagtctaataattgtttaagatctagaaaaaaaaaatcaagaatagtggtatttttcatgaagtaataaaaactcgttttggtgaatt

SEQ ID NO: 448689 - DNA, 5049 bp, Homo sapiens
  misc_feature (454)..(454): n is a, c, g, or t
  misc_feature (466)..(466): n is a, c, g, or t
cggggcagtagcaaacgcggcgggaaaggcgcaccgtttgctcgctccgatcgttaaaaaagggtgaggtcacctgtctcgcccggttacacagaatccggcaacgaccttcaacatatatcatcgttacttcgctccttcaccttactcatcaacttccccacctcacctattctccatcactcagcggcccgcgaccgttatcgcgtctcataacatcgaattcacaggcggcacctctaacccatttcccgctaaggcagtgtcgtcagtacaataacccctccacaattaaaaagaaggagaaatagcaagaaaccgcttgtgctgcgacatgcaaccgctgacgttttacggggctccgcctctcaatgcagaattaacctcgtccccaggccaggaatggtatttcagagcccaactttaaggcgtctggggcacccactatgagccnttctggaagcgntgtcatttcaaccgcaacaatagctactactccatctaagccaacatgtgatgaaaaatatgcaaacatcactgtggattacttatataacaaggaaactaaattatttacagcaaagctaaatgttaatgagaatgtggaatgtggaaacaatacttgcacaaacaatgaggtgcataaccttacagaatgtaaaaatgcgtctgtttccatatctcataattcatgtactgctcctgataagacattaatattagatgtgccaccaggggttgaaaagtttcagttacatgattgtacacaagttgaaaaagcagatactactatttgtttaaaatggaaaaatattgaaacctttacttgtgatacacagaatattacctacagatttcagtgtggtaatatgatatttgataataaagaaattaaattagaaaaccttgaacccgaacatgagtataagtgtgactcagaaatactctataataaccacaagtttactaacgcaagtaaaattattaaaacagattttgggagtccaggagagcctcagattattttttgtagaagtgaagctgcacatcaaggagtaattacctggaatccccctcaaagatcatttcataattttaccctctgttatataaaagagacagaaaaagattgcctcaatctggataaaaacctgatcaaatatgatttgcaaaatttaaaaccttatacgaaatatgttttatcattacatgcctacatcattgcaaaagtgcaacgtaatggaagtgctgcaatgtgtcatttcacaactaaaagtgctcctccaagccaggtctggaacatgactgtctccatgacatcagataatagtatgcatgtcaagtgtaggcctcccagggaccgtaatggcccccatgaacgttaccatttggaagttgaagctggaaatactctggttagaaatgagtcgcataagaattgcgatttccgtgtaaaagatcttcaatattcaacagactacacttttaaggcctattttcacaatggagactatcctggagaaccctttattttacatcattcaacatcttataattctaaggcactgatagcatttctggcatttctgattattgtgacatcaatagccctgcttgttgttctctacaaaatctatgatctacataagaaaagatcctgcaatttagatgaacagcaggagcttgttgaaagggatgatgaaaaacaactgatgaatgtggagccaatccatgcagatattttgttggaaacttataagaggaagattgctgatgaaggaagactttttctggctgaatttcagagcatcccgcgggtgttcagcaagtttcctataaaggaagctcgaaagccctttaaccagaataaaaaccgttatgttgacattcttccttatgattataaccgtgttgaactctctgaaataaacggagatgcagggtcaaactacataaatgccagctatattgatggtttcaaagaacccaggaaatacattgctgcacaaggtcccagggatgaaactgttgatgatttctggaggatgatttgggaacagaaagccacagttattgtcatggtcactcgatgtgaagaaggaaacaggaacaagtgtgcagaatactggccgtcaatggaagagggcactcgggcttttggagatgttgttgtaaagatcaaccagcacaaaagatgtccagattacatcattcagaaattgaacattgtaaataaaaaagaaaaagcaactggaagagaggtgactcacattcagttcaccagctggccagaccacggggtgcctgaggatcctcacttgctcctcaaactgagaaggagagtgaatgccttcagcaatttcttcagtggtcccattgtggtgcactgcagtgctggtgttgggcgcacaggaacctatatcggaattgatgccatgctagaaggcctggaagccgagaacaaagtggatgtttatggttatgttgtcaagctaaggcgacagagatgcctgatggttcaagtagaggcccagtacatcttgatccatcaggctttggtggaatacaatcagtttggagaaacagaagtgaatttgtctgaattacatccatatctacataacatgaagaaaagggatccacccagtgagccgtctccactagaggctgaattccagagacttccttcatataggagctggaggacacagcacattggaaatcaagaagaaaataaaagtaaaaacaggaattctaatgtcatcccatatgactataacagagtgccacttaaacatgagctggaaatgagtaaagagagtgagcatgattcagatgaatcctctgatgatgacagtgattcagaggaaccaagcaaatacatcaatgcatcttttataatgagctactggaaacctgaagtgatgattgctgctcagggaccactgaaggagaccattggtgacttttggcagatgatcttccaaagaaaagtcaaagttattgttatgctgacagaactgaaacatggagaccaggaaatctgtgctcagtactggggagaaggaaagcaaacatatggagatattgaagttgacctgaaagacacagacaaatcttcaacttatacccttcgtgtctttgaactgagacattccaagaggaaagactctcgaactgtgtaccagtaccaatatacaaactggagtgtggagcagcttcctgcagaacccaaggaattaatctctatgattcaggtcgtcaaacaaaaacttccccagaagaattcctctgaagggaacaagcatcacaagagtacacctctactcattcactgcagggatggatctcagcaaacgggaatattttgtgctttgttaaatctcttagaaagtgcggaaacagaagaggtagtggatatttttcaagtggtaaaagctctacgcaaagctaggccaggcatggtttccacattcgagcaatatcaattcctatatgacgtcattgccagcacctaccctgctcagaatggacaagtaaagaaaaacaaccatcaagaagataaaattgaatttgataatgaagtggacaaagtaaagcaggatgctaattgtgttaatccacttggtgccccagaaaagctccctgaagcaaaggaacaggctgaaggttctgaacccacgagtggcactgaggggccagaacattctgtcaatggtcctgcaagtccagctttaaatcaaggttcataggaaaagacataaatgaggaaactccaaacctcctgttagctgttatttctatttttgtagaagtaggaagtgaaaataggtatacagtggattaattaaatgcagcgaaccaatatttgtagaagggttatattttactactgtggaaaaatatttaagatagttttgccagaacagtttgtacagacgtatgcttattttaaaattttatctcttattcagtaaaaaacaacttctttgtaatcgttatgtgtgtatatgtatgtgtgtatgggtgtgtgtttgtgtgagagacagagaaagagagagaattctttcaagtgaatctaaaagcttttgcttttcctttgtttttatgaagaaaaaatacattttatattagaagtgttaacttagcttgaaggatctgtttttaaaaatcataaactgtgtgcagactcaataaaatcatgtacatttctgaaatgacctcaagatgtcctccttgttctactcatatatatctatcttatatagtttactattttacttctagagatagtacataaaggtggtatgtgtgtgtatgctactacaaaaaagttgttaactaaattaacattgggaaatcttatattccatatattagcatttagtccaatgtctttttaagcttatttaattaaaaaatttccagtgagcttatcatgctgtctttacatggggttttcaattttgcatgctcgattattccctgtacaatatttaaaatttattgcttgatacttttgacaacaaattaggttttgtacaattgaacttaaataaatgtcattaaaataaataaatgcaatatgtattaatattcattgtataaaaatagaagaatacaaacatatttgttaaatatttacatatgaaatttaatatagctatttttatggaatttttcattgatatgaaaaatatgatattgcatatgcatagttcccatgttaaatcccattcataactttcattaaagcatttactttgaatttctccaatgcttagaatgtttttaccaggaatggatgtcgctaatcataataaaattcaaccattatttttttcttgtttataatacattgtgttatatgttcaaatatgaaatgtgtatgcacctattgaaatatgtttaatgcatttattaacatttgcaggacacttttacaggccccaattatccaatagtctaataattgtttaagatctagaaaaaaaaaatcaagaatagtggtatttttcatgaagtaataaaaactcgttttggtgaatt

SEQ ID NO: 448690 - DNA, 4745 bp, Homo sapiens
cggtcaaggatgttatcggcgatatcggtatcgttgtcgtacctacactctacaatcgacggtcataggagtcggctgataggcttaagagcggtctgtcaatagtcttattagtagctaacatgaaactctgagcacaccggtctgcgcctattagtagggcattcttactccggctaccaaacgggaccacccatctagactcaaggcgtaactggatctgttcaagctgctgggtgtagctttaacacatagaggctaaattttttctggcaaggtgaaagtttaatgcggagatgaatggggacccaaattgtgcaaaagcgattaagggcaataccgtaacagaaggtaaaaaggcgtaaggtttccatatattataaatcatgggcctgctcgtgtgaaaacattaagattacaggtgccaccaggggttgaaaagtttcagttacatgattgtacacaagttgaaaaagcagatactactatttgtttaaaatggaaaaatattgaaacctttacttgtgatacacagaatattacctacagatttcagtgtggtaatatgatatttgataataaagaaattaaattagaaaaccttgaacccgaacatgagtataagtgtgactcagaaatactctataataaccacaagtttactaacgcaagtaaaattattaaaacagattttgggagtccaggagagcctcagattattttttgtagaagtgaagctgcacatcaaggagtaattacctggaatccccctcaaagatcatttcataattttaccctctgttatataaaagagacagaaaaagattgcctcaatctggataaaaacctgatcaaatatgatttgcaaaatttaaaaccttatacgaaatatgttttatcattacatgcctacatcattgcaaaagtgcaacgtaatggaagtgctgcaatgtgtcatttcacaactaaaagtgctcctccaagccaggtctggaacatgactgtctccatgacatcagataatagtatgcatgtcaagtgtaggcctcccagggaccgtaatggcccccatgaacgttaccatttggaagttgaagctggaaatactctggttagaaatgagtcgcataagaattgcgatttccgtgtaaaagatcttcaatattcaacagactacacttttaaggcctattttcacaatggagactatcctggagaaccctttattttacatcattcaacatcttataattctaaggcactgatagcatttctggcatttctgattattgtgacatcaatagccctgcttgttgttctctacaaaatctatgatctacataagaaaagatcctgcaatttagatgaacagcaggagcttgttgaaagggatgatgaaaaacaactgatgaatgtggagccaatccatgcagatattttgttggaaacttataagaggaagattgctgatgaaggaagactttttctggctgaatttcagagcatcccgcgggtgttcagcaagtttcctataaaggaagctcgaaagccctttaaccagaataaaaaccgttatgttgacattcttccttatgattataaccgtgttgaactctctgaaataaacggagatgcagggtcaaactacataaatgccagctatattgatggtttcaaagaacccaggaaatacattgctgcacaaggtcccagggatgaaactgttgatgatttctggaggatgatttgggaacagaaagccacagttattgtcatggtcactcgatgtgaagaaggaaacaggaacaagtgtgcagaatactggccgtcaatggaagagggcactcgggcttttggagatgttgttgtaaagatcaaccagcacaaaagatgtccagattacatcattcagaaattgaacattgtaaataaaaaagaaaaagcaactggaagagaggtgactcacattcagttcaccagctggccagaccacggggtgcctgaggatcctcacttgctcctcaaactgagaaggagagtgaatgccttcagcaatttcttcagtggtcccattgtggtgcactgcagtgctggtgttgggcgcacaggaacctatatcggaattgatgccatgctagaaggcctggaagccgagaacaaagtggatgtttatggttatgttgtcaagctaaggcgacagagatgcctgatggttcaagtagaggcccagtacatcttgatccatcaggctttggtggaatacaatcagtttggagaaacagaagtgaatttgtctgaattacatccatatctacataacatgaagaaaagggatccacccagtgagccgtctccactagaggctgaattccagagacttccttcatataggagctggaggacacagcacattggaaatcaagaagaaaataaaagtaaaaacaggaattctaatgtcatcccatatgactataacagagtgccacttaaacatgagctggaaatgagtaaagagagtgagcatgattcagatgaatcctctgatgatgacagtgattcagaggaaccaagcaaatacatcaatgcatcttttataatgagctactggaaacctgaagtgatgattgctgctcagggaccactgaaggagaccattggtgacttttggcagatgatcttccaaagaaaagtcaaagttattgttatgctgacagaactgaaacatggagaccaggaaatctgtgctcagtactggggagaaggaaagcaaacatatggagatattgaagttgacctgaaagacacagacaaatcttcaacttatacccttcgtgtctttgaactgagacattccaagaggaaagactctcgaactgtgtaccagtaccaatatacaaactggagtgtggagcagcttcctgcagaacccaaggaattaatctctatgattcaggtcgtcaaacaaaaacttccccagaagaattcctctgaagggaacaagcatcacaagagtacacctctactcattcactgcagggatggatctcagcaaacgggaatattttgtgctttgttaaatctcttagaaagtgcggaaacagaagaggtagtggatatttttcaagtggtaaaagctctacgcaaagctaggccaggcatggtttccacattcgagcaatatcaattcctatatgacgtcattgccagcacctaccctgctcagaatggacaagtaaagaaaaacaaccatcaagaagataaaattgaatttgataatgaagtggacaaagtaaagcaggatgctaattgtgttaatccacttggtgccccagaaaagctccctgaagcaaaggaacaggctgaaggttctgaacccacgagtggcactgaggggccagaacattctgtcaatggtcctgcaagtccagctttaaatcaaggttcataggaaaagacataaatgaggaaactccaaacctcctgttagctgttatttctatttttgtagaagtaggaagtgaaaataggtatacagtggattaattaaatgcagcgaaccaatatttgtagaagggttatattttactactgtggaaaaatatttaagatagttttgccagaacagtttgtacagacgtatgcttattttaaaattttatctcttattcagtaaaaaacaacttctttgtaatcgttatgtgtgtatatgtatgtgtgtatgggtgtgtgtttgtgtgagagacagagaaagagagagaattctttcaagtgaatctaaaagcttttgcttttcctttgtttttatgaagaaaaaatacattttatattagaagtgttaacttagcttgaaggatctgtttttaaaaatcataaactgtgtgcagactcaataaaatcatgtacatttctgaaatgacctcaagatgtcctccttgttctactcatatatatctatcttatatagtttactattttacttctagagatagtacataaaggtggtatgtgtgtgtatgctactacaaaaaagttgttaactaaattaacattgggaaatcttatattccatatattagcatttagtccaatgtctttttaagcttatttaattaaaaaatttccagtgagcttatcatgctgtctttacatggggttttcaattttgcatgctcgattattccctgtacaatatttaaaatttattgcttgatacttttgacaacaaattaggttttgtacaattgaacttaaataaatgtcattaaaataaataaatgcaatatgtattaatattcattgtataaaaatagaagaatacaaacatatttgttaaatatttacatatgaaatttaatatagctatttttatggaatttttcattgatatgaaaaatatgatattgcatatgcatagttcccatgttaaatcccattcataactttcattaaagcatttactttgaatttctccaatgcttagaatgtttttaccaggaatggatgtcgctaatcataataaaattcaaccattatttttttcttgtttataatacattgtgttatatgttcaaatatgaaatgtgtatgcacctattgaaatatgtttaatgcatttattaacatttgcaggacacttttacaggccccaattatccaatagtctaataattgtttaagatctagaaaaaaaaaatcaagaatagtggtatttttcatgaagtaataaaaactcgttttggtgaatt

SEQ ID NO: 448691 - DNA, 4587 bp, Homo sapiens
tggtgttggttatgtggatgtatacatttgttaaaaatgcattaaactgtatctcaaatgggtacattttaatgtaaattttacttcagacattttatttaaacatttatcagtttttctcagtttcaaatgactagttactggaagcaatgacaagtgctactcaatgactgctaaatttattggtgctatgaatgccagatttttagcacagcaaaatctacaaattccaggatttttaggtagtatctgggcaagaatatatatgaataatgtatatgaaaggaagagggggttcttagatatcttcaagtcagtggaatgcttaggtttcacagtgccaatctggtgtgacatttactttgttaaaggaatttactctaaaacaaattaaatgagcccagatgcatttctttaaattttattttgaattcatcatttgtcaaaatatggttatcaataatgcatgcttataatatgaagaatgctttatccatgtcttatttttcatattacataacattcttattcttttaacaggtccaggagagcctcagattattttttgtagaagtgaagctgcacatcaaggagtaattacctggaatccccctcaaagatcatttcataattttaccctctgttatataaaagagacagaaaaagattgcctcaatctggataaaaacctgatcaaatatgatttgcaaaatttaaaaccttatacgaaatatgttttatcattacatgcctacatcattgcaaaagtgcaacgtaatggaagtgctgcaatgtgtcatttcacaactaaaagtgctcctccaagccaggtctggaacatgactgtctccatgacatcagataatagtatgcatgtcaagtgtaggcctcccagggaccgtaatggcccccatgaacgttaccatttggaagttgaagctggaaatactctggttagaaatgagtcgcataagaattgcgatttccgtgtaaaagatcttcaatattcaacagactacacttttaaggcctattttcacaatggagactatcctggagaaccctttattttacatcattcaacatcttataattctaaggcactgatagcatttctggcatttctgattattgtgacatcaatagccctgcttgttgttctctacaaaatctatgatctacataagaaaagatcctgcaatttagatgaacagcaggagcttgttgaaagggatgatgaaaaacaactgatgaatgtggagccaatccatgcagatattttgttggaaacttataagaggaagattgctgatgaaggaagactttttctggctgaatttcagagcatcccgcgggtgttcagcaagtttcctataaaggaagctcgaaagccctttaaccagaataaaaaccgttatgttgacattcttccttatgattataaccgtgttgaactctctgaaataaacggagatgcagggtcaaactacataaatgccagctatattgatggtttcaaagaacccaggaaatacattgctgcacaaggtcccagggatgaaactgttgatgatttctggaggatgatttgggaacagaaagccacagttattgtcatggtcactcgatgtgaagaaggaaacaggaacaagtgtgcagaatactggccgtcaatggaagagggcactcgggcttttggagatgttgttgtaaagatcaaccagcacaaaagatgtccagattacatcattcagaaattgaacattgtaaataaaaaagaaaaagcaactggaagagaggtgactcacattcagttcaccagctggccagaccacggggtgcctgaggatcctcacttgctcctcaaactgagaaggagagtgaatgccttcagcaatttcttcagtggtcccattgtggtgcactgcagtgctggtgttgggcgcacaggaacctatatcggaattgatgccatgctagaaggcctggaagccgagaacaaagtggatgtttatggttatgttgtcaagctaaggcgacagagatgcctgatggttcaagtagaggcccagtacatcttgatccatcaggctttggtggaatacaatcagtttggagaaacagaagtgaatttgtctgaattacatccatatctacataacatgaagaaaagggatccacccagtgagccgtctccactagaggctgaattccagagacttccttcatataggagctggaggacacagcacattggaaatcaagaagaaaataaaagtaaaaacaggaattctaatgtcatcccatatgactataacagagtgccacttaaacatgagctggaaatgagtaaagagagtgagcatgattcagatgaatcctctgatgatgacagtgattcagaggaaccaagcaaatacatcaatgcatcttttataatgagctactggaaacctgaagtgatgattgctgctcagggaccactgaaggagaccattggtgacttttggcagatgatcttccaaagaaaagtcaaagttattgttatgctgacagaactgaaacatggagaccaggaaatctgtgctcagtactggggagaaggaaagcaaacatatggagatattgaagttgacctgaaagacacagacaaatcttcaacttatacccttcgtgtctttgaactgagacattccaagaggaaagactctcgaactgtgtaccagtaccaatatacaaactggagtgtggagcagcttcctgcagaacccaaggaattaatctctatgattcaggtcgtcaaacaaaaacttccccagaagaattcctctgaagggaacaagcatcacaagagtacacctctactcattcactgcagggatggatctcagcaaacgggaatattttgtgctttgttaaatctcttagaaagtgcggaaacagaagaggtagtggatatttttcaagtggtaaaagctctacgcaaagctaggccaggcatggtttccacattcgagcaatatcaattcctatatgacgtcattgccagcacctaccctgctcagaatggacaagtaaagaaaaacaaccatcaagaagataaaattgaatttgataatgaagtggacaaagtaaagcaggatgctaattgtgttaatccacttggtgccccagaaaagctccctgaagcaaaggaacaggctgaaggttctgaacccacgagtggcactgaggggccagaacattctgtcaatggtcctgcaagtccagctttaaatcaaggttcataggaaaagacataaatgaggaaactccaaacctcctgttagctgttatttctatttttgtagaagtaggaagtgaaaataggtatacagtggattaattaaatgcagcgaaccaatatttgtagaagggttatattttactactgtggaaaaatatttaagatagttttgccagaacagtttgtacagacgtatgcttattttaaaattttatctcttattcagtaaaaaacaacttctttgtaatcgttatgtgtgtatatgtatgtgtgtatgggtgtgtgtttgtgtgagagacagagaaagagagagaattctttcaagtgaatctaaaagcttttgcttttcctttgtttttatgaagaaaaaatacattttatattagaagtgttaacttagcttgaaggatctgtttttaaaaatcataaactgtgtgcagactcaataaaatcatgtacatttctgaaatgacctcaagatgtcctccttgttctactcatatatatctatcttatatagtttactattttacttctagagatagtacataaaggtggtatgtgtgtgtatgctactacaaaaaagttgttaactaaattaacattgggaaatcttatattccatatattagcatttagtccaatgtctttttaagcttatttaattaaaaaatttccagtgagcttatcatgctgtctttacatggggttttcaattttgcatgctcgattattccctgtacaatatttaaaatttattgcttgatacttttgacaacaaattaggttttgtacaattgaacttaaataaatgtcattaaaataaataaatgcaatatgtattaatattcattgtataaaaatagaagaatacaaacatatttgttaaatatttacatatgaaatttaatatagctatttttatggaatttttcattgatatgaaaaatatgatattgcatatgcatagttcccatgttaaatcccattcataactttcattaaagcatttactttgaatttctccaatgcttagaatgtttttaccaggaatggatgtcgctaatcataataaaattcaaccattatttttttcttgtttataatacattgtgttatatgttcaaatatgaaatgtgtatgcacctattgaaatatgtttaatgcatttattaacatttgcaggacacttttacaggccccaattatccaatagtctaataattgtttaagatctagaaaaaaaaaatcaagaatagtggtatttttcatgaagtaataaaaactcgttttggtgaatt

SEQ ID NO: 448692 - DNA, 3953 bp, Homo sapiens
ctctcccccccctgcctaaacaaccacccccacaatgcctcatcgccaccccatcctcccatatccccgcccaattcgccctcccgccgcaatagttttttccacccactgcccccattctcccacaaggtgaaccgcaatggaagcgacgccaaatgtgtcatttccccaatcacaaagggttcctccaagccaggtctggaacatgactgtctccatgacatcagataatagtatgcatgtcaagtgtaggcctcccagggaccgtaatggcccccatgaacgttaccatttggaagttgaagctggaaatactctggttagaaatgagtcgcataagaattgcgatttccgtgtaaaagatcttcaatattcaacagactacacttttaaggcctattttcacaatggagactatcctggagaaccctttattttacatcattcaacatcttataattctaaggcactgatagcatttctggcatttctgattattgtgacatcaatagccctgcttgttgttctctacaaaatctatgatctacataagaaaagatcctgcaatttagatgaacagcaggagcttgttgaaagggatgatgaaaaacaactgatgaatgtggagccaatccatgcagatattttgttggaaacttataagaggaagattgctgatgaaggaagactttttctggctgaatttcagagcatcccgcgggtgttcagcaagtttcctataaaggaagctcgaaagccctttaaccagaataaaaaccgttatgttgacattcttccttatgattataaccgtgttgaactctctgaaataaacggagatgcagggtcaaactacataaatgccagctatattgatggtttcaaagaacccaggaaatacattgctgcacaaggtcccagggatgaaactgttgatgatttctggaggatgatttgggaacagaaagccacagttattgtcatggtcactcgatgtgaagaaggaaacaggaacaagtgtgcagaatactggccgtcaatggaagagggcactcgggcttttggagatgttgttgtaaagatcaaccagcacaaaagatgtccagattacatcattcagaaattgaacattgtaaataaaaaagaaaaagcaactggaagagaggtgactcacattcagttcaccagctggccagaccacggggtgcctgaggatcctcacttgctcctcaaactgagaaggagagtgaatgccttcagcaatttcttcagtggtcccattgtggtgcactgcagtgctggtgttgggcgcacaggaacctatatcggaattgatgccatgctagaaggcctggaagccgagaacaaagtggatgtttatggttatgttgtcaagctaaggcgacagagatgcctgatggttcaagtagaggcccagtacatcttgatccatcaggctttggtggaatacaatcagtttggagaaacagaagtgaatttgtctgaattacatccatatctacataacatgaagaaaagggatccacccagtgagccgtctccactagaggctgaattccagagacttccttcatataggagctggaggacacagcacattggaaatcaagaagaaaataaaagtaaaaacaggaattctaatgtcatcccatatgactataacagagtgccacttaaacatgagctggaaatgagtaaagagagtgagcatgattcagatgaatcctctgatgatgacagtgattcagaggaaccaagcaaatacatcaatgcatcttttataatgagctactggaaacctgaagtgatgattgctgctcagggaccactgaaggagaccattggtgacttttggcagatgatcttccaaagaaaagtcaaagttattgttatgctgacagaactgaaacatggagaccaggaaatctgtgctcagtactggggagaaggaaagcaaacatatggagatattgaagttgacctgaaagacacagacaaatcttcaacttatacccttcgtgtctttgaactgagacattccaagaggaaagactctcgaactgtgtaccagtaccaatatacaaactggagtgtggagcagcttcctgcagaacccaaggaattaatctctatgattcaggtcgtcaaacaaaaacttccccagaagaattcctctgaagggaacaagcatcacaagagtacacctctactcattcactgcagggatggatctcagcaaacgggaatattttgtgctttgttaaatctcttagaaagtgcggaaacagaagaggtagtggatatttttcaagtggtaaaagctctacgcaaagctaggccaggcatggtttccacattcgagcaatatcaattcctatatgacgtcattgccagcacctaccctgctcagaatggacaagtaaagaaaaacaaccatcaagaagataaaattgaatttgataatgaagtggacaaagtaaagcaggatgctaattgtgttaatccacttggtgccccagaaaagctccctgaagcaaaggaacaggctgaaggttctgaacccacgagtggcactgaggggccagaacattctgtcaatggtcctgcaagtccagctttaaatcaaggttcataggaaaagacataaatgaggaaactccaaacctcctgttagctgttatttctatttttgtagaagtaggaagtgaaaataggtatacagtggattaattaaatgcagcgaaccaatatttgtagaagggttatattttactactgtggaaaaatatttaagatagttttgccagaacagtttgtacagacgtatgcttattttaaaattttatctcttattcagtaaaaaacaacttctttgtaatcgttatgtgtgtatatgtatgtgtgtatgggtgtgtgtttgtgtgagagacagagaaagagagagaattctttcaagtgaatctaaaagcttttgcttttcctttgtttttatgaagaaaaaatacattttatattagaagtgttaacttagcttgaaggatctgtttttaaaaatcataaactgtgtgcagactcaataaaatcatgtacatttctgaaatgacctcaagatgtcctccttgttctactcatatatatctatcttatatagtttactattttacttctagagatagtacataaaggtggtatgtgtgtgtatgctactacaaaaaagttgttaactaaattaacattgggaaatcttatattccatatattagcatttagtccaatgtctttttaagcttatttaattaaaaaatttccagtgagcttatcatgctgtctttacatggggttttcaattttgcatgctcgattattccctgtacaatatttaaaatttattgcttgatacttttgacaacaaattaggttttgtacaattgaacttaaataaatgtcattaaaataaataaatgcaatatgtattaatattcattgtataaaaatagaagaatacaaacatatttgttaaatatttacatatgaaatttaatatagctatttttatggaatttttcattgatatgaaaaatatgatattgcatatgcatagttcccatgttaaatcccattcataactttcattaaagcatttactttgaatttctccaatgcttagaatgtttttaccaggaatggatgtcgctaatcataataaaattcaaccattatttttttcttgtttataatacattgtgttatatgttcaaatatgaaatgtgtatgcacctattgaaatatgtttaatgcatttattaacatttgcaggacacttttacaggccccaattatccaatagtctaataattgtttaagatctagaaaaaaaaaatcaagaatagtggtatttttcatgaagtaataaaaactcgttttggtgaatt

SEQ ID NO: 448693 - DNA, 3989 bp, Homo sapiens
ctaaggaggaatagcgagtgcccgccgggctcactaaaaaactcccccctctaaacacaaagaaaataacatctcctctcttcgtatgcagccggtatgaacatgctctggaaggtttgtagcattgccggaccaagctttgtgtccagagccgcccccttgcgaacaggacagcacagaaaaggccttcacttgggctttttcacctcaaaggggcccttacacgccggttcgggaaaacgaccgttccccaggcgatccggataatagtatgcatgtcaagtgtaggcctcccagggaccgtaatggcccccatgaacgttaccatttggaagttgaagctggaaatactctggttagaaatgagtcgcataagaattgcgatttccgtgtaaaagatcttcaatattcaacagactacacttttaaggcctattttcacaatggagactatcctggagaaccctttattttacatcattcaacatcttataattctaaggcactgatagcatttctggcatttctgattattgtgacatcaatagccctgcttgttgttctctacaaaatctatgatctacataagaaaagatcctgcaatttagatgaacagcaggagcttgttgaaagggatgatgaaaaacaactgatgaatgtggagccaatccatgcagatattttgttggaaacttataagaggaagattgctgatgaaggaagactttttctggctgaatttcagagcatcccgcgggtgttcagcaagtttcctataaaggaagctcgaaagccctttaaccagaataaaaaccgttatgttgacattcttccttatgattataaccgtgttgaactctctgaaataaacggagatgcagggtcaaactacataaatgccagctatattgatggtttcaaagaacccaggaaatacattgctgcacaaggtcccagggatgaaactgttgatgatttctggaggatgatttgggaacagaaagccacagttattgtcatggtcactcgatgtgaagaaggaaacaggaacaagtgtgcagaatactggccgtcaatggaagagggcactcgggcttttggagatgttgttgtaaagatcaaccagcacaaaagatgtccagattacatcattcagaaattgaacattgtaaataaaaaagaaaaagcaactggaagagaggtgactcacattcagttcaccagctggccagaccacggggtgcctgaggatcctcacttgctcctcaaactgagaaggagagtgaatgccttcagcaatttcttcagtggtcccattgtggtgcactgcagtgctggtgttgggcgcacaggaacctatatcggaattgatgccatgctagaaggcctggaagccgagaacaaagtggatgtttatggttatgttgtcaagctaaggcgacagagatgcctgatggttcaagtagaggcccagtacatcttgatccatcaggctttggtggaatacaatcagtttggagaaacagaagtgaatttgtctgaattacatccatatctacataacatgaagaaaagggatccacccagtgagccgtctccactagaggctgaattccagagacttccttcatataggagctggaggacacagcacattggaaatcaagaagaaaataaaagtaaaaacaggaattctaatgtcatcccatatgactataacagagtgccacttaaacatgagctggaaatgagtaaagagagtgagcatgattcagatgaatcctctgatgatgacagtgattcagaggaaccaagcaaatacatcaatgcatcttttataatgagctactggaaacctgaagtgatgattgctgctcagggaccactgaaggagaccattggtgacttttggcagatgatcttccaaagaaaagtcaaagttattgttatgctgacagaactgaaacatggagaccaggaaatctgtgctcagtactggggagaaggaaagcaaacatatggagatattgaagttgacctgaaagacacagacaaatcttcaacttatacccttcgtgtctttgaactgagacattccaagaggaaagactctcgaactgtgtaccagtaccaatatacaaactggagtgtggagcagcttcctgcagaacccaaggaattaatctctatgattcaggtcgtcaaacaaaaacttccccagaagaattcctctgaagggaacaagcatcacaagagtacacctctactcattcactgcagggatggatctcagcaaacgggaatattttgtgctttgttaaatctcttagaaagtgcggaaacagaagaggtagtggatatttttcaagtggtaaaagctctacgcaaagctaggccaggcatggtttccacattcgagcaatatcaattcctatatgacgtcattgccagcacctaccctgctcagaatggacaagtaaagaaaaacaaccatcaagaagataaaattgaatttgataatgaagtggacaaagtaaagcaggatgctaattgtgttaatccacttggtgccccagaaaagctccctgaagcaaaggaacaggctgaaggttctgaacccacgagtggcactgaggggccagaacattctgtcaatggtcctgcaagtccagctttaaatcaaggttcataggaaaagacataaatgaggaaactccaaacctcctgttagctgttatttctatttttgtagaagtaggaagtgaaaataggtatacagtggattaattaaatgcagcgaaccaatatttgtagaagggttatattttactactgtggaaaaatatttaagatagttttgccagaacagtttgtacagacgtatgcttattttaaaattttatctcttattcagtaaaaaacaacttctttgtaatcgttatgtgtgtatatgtatgtgtgtatgggtgtgtgtttgtgtgagagacagagaaagagagagaattctttcaagtgaatctaaaagcttttgcttttcctttgtttttatgaagaaaaaatacattttatattagaagtgttaacttagcttgaaggatctgtttttaaaaatcataaactgtgtgcagactcaataaaatcatgtacatttctgaaatgacctcaagatgtcctccttgttctactcatatatatctatcttatatagtttactattttacttctagagatagtacataaaggtggtatgtgtgtgtatgctactacaaaaaagttgttaactaaattaacattgggaaatcttatattccatatattagcatttagtccaatgtctttttaagcttatttaattaaaaaatttccagtgagcttatcatgctgtctttacatggggttttcaattttgcatgctcgattattccctgtacaatatttaaaatttattgcttgatacttttgacaacaaattaggttttgtacaattgaacttaaataaatgtcattaaaataaataaatgcaatatgtattaatattcattgtataaaaatagaagaatacaaacatatttgttaaatatttacatatgaaatttaatatagctatttttatggaatttttcattgatatgaaaaatatgatattgcatatgcatagttcccatgttaaatcccattcataactttcattaaagcatttactttgaatttctccaatgcttagaatgtttttaccaggaatggatgtcgctaatcataataaaattcaaccattatttttttcttgtttataatacattgtgttatatgttcaaatatgaaatgtgtatgcacctattgaaatatgtttaatgcatttattaacatttgcaggacacttttacaggccccaattatccaatagtctaataattgtttaagatctagaaaaaaaaaatcaagaatagtggtatttttcatgaagtaataaaaactcgttttggtgaatt

SEQ ID NO: 448694 - DNA, 3360 bp, Homo sapiens
gtgttgacaatgctaccatgtgaaggcctaaggaatacaatgttcatcaaataattaatcagactttgctcacatatgaattagttctgtttgctggcctatcaagcagaagtattttaaacagttgtgagaatgacctttaccaaatcattttaaacacaaatccaaaaagcttccacccatgcaccccacttttatggtgtatgtttattttgggttttttttgcttgacagcatgcaagttcctagaaattttggttatacttttaaagaaagtattaccttacttaccttactgttaagttattgcttacagggtagtacatgcaagtcctgcacaatatcttaactactagttattgattagaaaggaaaacacaaccatggttgagaaaatatataagacacctgaggaaactatgaactcttttgagtagtttatgtttacacgaggagactttgtactggtactcccttccacttatttatgtttcatagtttgctttaaaaaaatcatctcaaagaaaatattatctcttgactagaaaaaagaaaaagcaactggaagagaggtgactcacattcagttcaccagctggccagaccacggggtgcctgaggatcctcacttgctcctcaaactgagaaggagagtgaatgccttcagcaatttcttcagtggtcccattgtggtgcactgcagtgctggtgttgggcgcacaggaacctatatcggaattgatgccatgctagaaggcctggaagccgagaacaaagtggatgtttatggttatgttgtcaagctaaggcgacagagatgcctgatggttcaagtagaggcccagtacatcttgatccatcaggctttggtggaatacaatcagtttggagaaacagaagtgaatttgtctgaattacatccatatctacataacatgaagaaaagggatccacccagtgagccgtctccactagaggctgaattccagagacttccttcatataggagctggaggacacagcacattggaaatcaagaagaaaataaaagtaaaaacaggaattctaatgtcatcccatatgactataacagagtgccacttaaacatgagctggaaatgagtaaagagagtgagcatgattcagatgaatcctctgatgatgacagtgattcagaggaaccaagcaaatacatcaatgcatcttttataatgagctactggaaacctgaagtgatgattgctgctcagggaccactgaaggagaccattggtgacttttggcagatgatcttccaaagaaaagtcaaagttattgttatgctgacagaactgaaacatggagaccaggaaatctgtgctcagtactggggagaaggaaagcaaacatatggagatattgaagttgacctgaaagacacagacaaatcttcaacttatacccttcgtgtctttgaactgagacattccaagaggaaagactctcgaactgtgtaccagtaccaatatacaaactggagtgtggagcagcttcctgcagaacccaaggaattaatctctatgattcaggtcgtcaaacaaaaacttccccagaagaattcctctgaagggaacaagcatcacaagagtacacctctactcattcactgcagggatggatctcagcaaacgggaatattttgtgctttgttaaatctcttagaaagtgcggaaacagaagaggtagtggatatttttcaagtggtaaaagctctacgcaaagctaggccaggcatggtttccacattcgagcaatatcaattcctatatgacgtcattgccagcacctaccctgctcagaatggacaagtaaagaaaaacaaccatcaagaagataaaattgaatttgataatgaagtggacaaagtaaagcaggatgctaattgtgttaatccacttggtgccccagaaaagctccctgaagcaaaggaacaggctgaaggttctgaacccacgagtggcactgaggggccagaacattctgtcaatggtcctgcaagtccagctttaaatcaaggttcataggaaaagacataaatgaggaaactccaaacctcctgttagctgttatttctatttttgtagaagtaggaagtgaaaataggtatacagtggattaattaaatgcagcgaaccaatatttgtagaagggttatattttactactgtggaaaaatatttaagatagttttgccagaacagtttgtacagacgtatgcttattttaaaattttatctcttattcagtaaaaaacaacttctttgtaatcgttatgtgtgtatatgtatgtgtgtatgggtgtgtgtttgtgtgagagacagagaaagagagagaattctttcaagtgaatctaaaagcttttgcttttcctttgtttttatgaagaaaaaatacattttatattagaagtgttaacttagcttgaaggatctgtttttaaaaatcataaactgtgtgcagactcaataaaatcatgtacatttctgaaatgacctcaagatgtcctccttgttctactcatatatatctatcttatatagtttactattttacttctagagatagtacataaaggtggtatgtgtgtgtatgctactacaaaaaagttgttaactaaattaacattgggaaatcttatattccatatattagcatttagtccaatgtctttttaagcttatttaattaaaaaatttccagtgagcttatcatgctgtctttacatggggttttcaattttgcatgctcgattattccctgtacaatatttaaaatttattgcttgatacttttgacaacaaattaggttttgtacaattgaacttaaataaatgtcattaaaataaataaatgcaatatgtattaatattcattgtataaaaatagaagaatacaaacatatttgttaaatatttacatatgaaatttaatatagctatttttatggaatttttcattgatatgaaaaatatgatattgcatatgcatagttcccatgttaaatcccattcataactttcattaaagcatttactttgaatttctccaatgcttagaatgtttttaccaggaatggatgtcgctaatcataataaaattcaaccattatttttttcttgtttataatacattgtgttatatgttcaaatatgaaatgtgtatgcacctattgaaatatgtttaatgcatttattaacatttgcaggacacttttacaggccccaattatccaatagtctaataattgtttaagatctagaaaaaaaaaatcaagaatagtggtatttttcatgaagtaataaaaactcgttttggtgaatt

SEQ ID NO: 448695 - DNA, 2557 bp, Homo sapiens
  misc_feature (32)..(32): n is a, c, g, or t
cgcggccgcggaacggctgcgagaagacgacngaaggcccagtacatcttgatccatcaggctttggtggaatacaatcagtttggagaaacagaagtgaatttgtctgaattacatccatatctacataacatgaagaaaagggatccacccagtgagccgtctccactagaggctgaattccagagacttccttcatataggagctggaggacacagcacattggaaatcaagaagaaaataaaagtaaaaacaggaattctaatgtcatcccatatgactataacagagtgccacttaaacatgagctggaaatgagtaaagagagtgagcatgattcagatgaatcctctgatgatgacagtgattcagaggaaccaagcaaatacatcaatgcatcttttataatgagctactggaaacctgaagtgatgattgctgctcagggaccactgaaggagaccattggtgacttttggcagatgatcttccaaagaaaagtcaaagttattgttatgctgacagaactgaaacatggagaccaggaaatctgtgctcagtactggggagaaggaaagcaaacatatggagatattgaagttgacctgaaagacacagacaaatcttcaacttatacccttcgtgtctttgaactgagacattccaagaggaaagactctcgaactgtgtaccagtaccaatatacaaactggagtgtggagcagcttcctgcagaacccaaggaattaatctctatgattcaggtcgtcaaacaaaaacttccccagaagaattcctctgaagggaacaagcatcacaagagtacacctctactcattcactgcagggatggatctcagcaaacgggaatattttgtgctttgttaaatctcttagaaagtgcggaaacagaagaggtagtggatatttttcaagtggtaaaagctctacgcaaagctaggccaggcatggtttccacattcgagcaatatcaattcctatatgacgtcattgccagcacctaccctgctcagaatggacaagtaaagaaaaacaaccatcaagaagataaaattgaatttgataatgaagtggacaaagtaaagcaggatgctaattgtgttaatccacttggtgccccagaaaagctccctgaagcaaaggaacaggctgaaggttctgaacccacgagtggcactgaggggccagaacattctgtcaatggtcctgcaagtccagctttaaatcaaggttcataggaaaagacataaatgaggaaactccaaacctcctgttagctgttatttctatttttgtagaagtaggaagtgaaaataggtatacagtggattaattaaatgcagcgaaccaatatttgtagaagggttatattttactactgtggaaaaatatttaagatagttttgccagaacagtttgtacagacgtatgcttattttaaaattttatctcttattcagtaaaaaacaacttctttgtaatcgttatgtgtgtatatgtatgtgtgtatgggtgtgtgtttgtgtgagagacagagaaagagagagaattctttcaagtgaatctaaaagcttttgcttttcctttgtttttatgaagaaaaaatacattttatattagaagtgttaacttagcttgaaggatctgtttttaaaaatcataaactgtgtgcagactcaataaaatcatgtacatttctgaaatgacctcaagatgtcctccttgttctactcatatatatctatcttatatagtttactattttacttctagagatagtacataaaggtggtatgtgtgtgtatgctactacaaaaaagttgttaactaaattaacattgggaaatcttatattccatatattagcatttagtccaatgtctttttaagcttatttaattaaaaaatttccagtgagcttatcatgctgtctttacatggggttttcaattttgcatgctcgattattccctgtacaatatttaaaatttattgcttgatacttttgacaacaaattaggttttgtacaattgaacttaaataaatgtcattaaaataaataaatgcaatatgtattaatattcattgtataaaaatagaagaatacaaacatatttgttaaatatttacatatgaaatttaatatagctatttttatggaatttttcattgatatgaaaaatatgatattgcatatgcatagttcccatgttaaatcccattcataactttcattaaagcatttactttgaatttctccaatgcttagaatgtttttaccaggaatggatgtcgctaatcataataaaattcaaccattatttttttcttgtttataatacattgtgttatatgttcaaatatgaaatgtgtatgcacctattgaaatatgtttaatgcatttattaacatttgcaggacacttttacaggccccaattatccaatagtctaataattgtttaagatctagaaaaaaaaaatcaagaatagtggtatttttcatgaagtaataaaaactcgttttggtgaatt

SEQ ID NO: 448696 - DNA, 1804 bp, Homo sapiens
gcaaaaaatatattctctctcttcctgtttttattctaatatcaccctttttggtgagaagtaggattattttctatcttttctttcttttatagggatggatctcagcaaacgggaatattttgtgctttgttaaatctcttagaaagtgcggaaacagaagaggtagtggatatttttcaagtggtaaaagctctacgcaaagctaggccaggcatggtttccacattcgagcaatatcaattcctatatgacgtcattgccagcacctaccctgctcagaatggacaagtaaagaaaaacaaccatcaagaagataaaattgaatttgataatgaagtggacaaagtaaagcaggatgctaattgtgttaatccacttggtgccccagaaaagctccctgaagcaaaggaacaggctgaaggttctgaacccacgagtggcactgaggggccagaacattctgtcaatggtcctgcaagtccagctttaaatcaaggttcataggaaaagacataaatgaggaaactccaaacctcctgttagctgttatttctatttttgtagaagtaggaagtgaaaataggtatacagtggattaattaaatgcagcgaaccaatatttgtagaagggttatattttactactgtggaaaaatatttaagatagttttgccagaacagtttgtacagacgtatgcttattttaaaattttatctcttattcagtaaaaaacaacttctttgtaatcgttatgtgtgtatatgtatgtgtgtatgggtgtgtgtttgtgtgagagacagagaaagagagagaattctttcaagtgaatctaaaagcttttgcttttcctttgtttttatgaagaaaaaatacattttatattagaagtgttaacttagcttgaaggatctgtttttaaaaatcataaactgtgtgcagactcaataaaatcatgtacatttctgaaatgacctcaagatgtcctccttgttctactcatatatatctatcttatatagtttactattttacttctagagatagtacataaaggtggtatgtgtgtgtatgctactacaaaaaagttgttaactaaattaacattgggaaatcttatattccatatattagcatttagtccaatgtctttttaagcttatttaattaaaaaatttccagtgagcttatcatgctgtctttacatggggttttcaattttgcatgctcgattattccctgtacaatatttaaaatttattgcttgatacttttgacaacaaattaggttttgtacaattgaacttaaataaatgtcattaaaataaataaatgcaatatgtattaatattcattgtataaaaatagaagaatacaaacatatttgttaaatatttacatatgaaatttaatatagctatttttatggaatttttcattgatatgaaaaatatgatattgcatatgcatagttcccatgttaaatcccattcataactttcattaaagcatttactttgaatttctccaatgcttagaatgtttttaccaggaatggatgtcgctaatcataataaaattcaaccattatttttttcttgtttataatacattgtgttatatgttcaaatatgaaatgtgtatgcacctattgaaatatgtttaatgcatttattaacatttgcaggacacttttacaggccccaattatccaatagtctaataattgtttaagatctagaaaaaaaaaatcaagaatagtggtatttttcatgaagtaataaaaactcgttttggtgaatt

SEQ ID NO: 448697 - DNA, 1795 bp, Homo sapiens
ggttgctccaaggtaaagttcaaaaagtatcctgcagtcaaccctttagcaccataaagaaactaaattatttagatgtttttatgagaacatatcaaaaagtacttttctgtcatccaatacttccacaaataaatcattagttcttgctaatcttcatctggcataaaaataatgacatcaactttcttcatgtaatttcccacttaattcctttactaggagcaatatcaattcctatatgacgtcattgccagcacctaccctgctcagaatggacaagtaaagaaaaacaaccatcaagaagataaaattgaatttgataatgaagtggacaaagtaaagcaggatgctaattgtgttaatccacttggtgccccagaaaagctccctgaagcaaaggaacaggctgaaggttctgaacccacgagtggcactgaggggccagaacattctgtcaatggtcctgcaagtccagctttaaatcaaggttcataggaaaagacataaatgaggaaactccaaacctcctgttagctgttatttctatttttgtagaagtaggaagtgaaaataggtatacagtggattaattaaatgcagcgaaccaatatttgtagaagggttatattttactactgtggaaaaatatttaagatagttttgccagaacagtttgtacagacgtatgcttattttaaaattttatctcttattcagtaaaaaacaacttctttgtaatcgttatgtgtgtatatgtatgtgtgtatgggtgtgtgtttgtgtgagagacagagaaagagagagaattctttcaagtgaatctaaaagcttttgcttttcctttgtttttatgaagaaaaaatacattttatattagaagtgttaacttagcttgaaggatctgtttttaaaaatcataaactgtgtgcagactcaataaaatcatgtacatttctgaaatgacctcaagatgtcctccttgttctactcatatatatctatcttatatagtttactattttacttctagagatagtacataaaggtggtatgtgtgtgtatgctactacaaaaaagttgttaactaaattaacattgggaaatcttatattccatatattagcatttagtccaatgtctttttaagcttatttaattaaaaaatttccagtgagcttatcatgctgtctttacatggggttttcaattttgcatgctcgattattccctgtacaatatttaaaatttattgcttgatacttttgacaacaaattaggttttgtacaattgaacttaaataaatgtcattaaaataaataaatgcaatatgtattaatattcattgtataaaaatagaagaatacaaacatatttgttaaatatttacatatgaaatttaatatagctatttttatggaatttttcattgatatgaaaaatatgatattgcatatgcatagttcccatgttaaatcccattcataactttcattaaagcatttactttgaatttctccaatgcttagaatgtttttaccaggaatggatgtcgctaatcataataaaattcaaccattatttttttcttgtttataatacattgtgttatatgttcaaatatgaaatgtgtatgcacctattgaaatatgtttaatgcatttattaacatttgcaggacacttttacaggccccaattatccaatagtctaataattgtttaagatctagaaaaaaaaaatcaagaatagtggtatttttcatgaagtaataaaaactcgttttggtgaatt

SEQ ID NO: 448698 - DNA, 1069 bp, Homo sapiens
cgacattttaactgaactgcgggataaagtgaaatctttccgtgcagctctacgagaggaggaaattgttcctcgtctgataagacaacagtggagaaaggacgcatgctgtttcttagggacacggctgacttccagatatgaccatgtatttgtggcttaaactcttggcatttggctttgcctttctggacacagaagtatttgtgacagggcaaagcccaacaccttcccccactggtaagaattaatatttatatttttactaattttattttcttgttgcaaagtttatatatttaactacaattttctattattaacactgaaattatttttaaggataaattttataatcatgagtgattcttgacattcacttgttcttaaactttctgcttatacgttatagagtttaataactacctaaacatgttattaaatttgtatatatattttgtgtataaatagtaacttttcccaaacttgacagtaaatcacacaacaggtttctactctcttttaatattttaagactataaaaaaatgcatttaaattagataacaaaattttatagtctgaaagcaggttaacagctgtctatgtatgttatagatatgtagataacagatttgcatatgtctatatttctttaagagtatgttgcttttttcaatggtatgcaaaacctttgagactattgagatatttttaaataataattttcaaattctactgaacacttcaatagtccttataaatgtcttaatcatgagataaatttaaaacacagagatctgcaaataaattcatacatagtacatacaaaataagagaaaaaattaaattgcagatggttaaatatcacatcacttaactgatgttactgaaaatgtattttcctgcataatcatatggttgacagtatgcattaagaaggtaagtaaaacaatgaagacaattttgatttaatatggtaatgcacaattccaactaacgtacattcaacagatcatgaaattgggttattaaaatgaatatttttgtcattaaataaaaattccgtcc

SEQ ID NO: 448699 - DNA, 1254 bp, Homo sapiens
atatttattgggcatcttgttaaaaaaaaaaaggcaccgttcctggcacaagtgatttgatggacaagataagcaaggcccttgctcttatggagtttactgttaagtgggaagatggaaaaaagaaggacgcatgctgtttcttagggacacggctgacttccagatatgaccatgtatttgtggcttaaactcttggcatttggctttgcctttctggacacagaagtatttgtgacagggcaaagcccaacaccttcccccactggtgtttcatcagtacagacgcctcaccttcccacgcacgcagactcgcagacgccctctgctggaactgacacgcagacattcagcggctccgccgccaatgcaaaactcaaccctaccccaggcagcaatgctatctcagatgtcccaggagagaggagtacagccagcacctttcctacagacccagtttccccattgacaaccaccctcagccttgcacaccacagctctgctgccttacctgcacgcacctccaacaccaccatcacagcgaacacctcagatgcctaccttaatgcctctgaaacaaccactctgagcccttctggaagcgctgtcatttcaaccacaacaatagctactactccatctaagccaacatgtgatgaaaaatatgcaaacatcactgtggattacttatataacaaggaaactaaattatttacagcaaagctaaatgttaatgagaatgtggaatgtggaaacaatacttgcacaaacaatgaggtgcataaccttacagaatgtaaaaatgcgtctgtttccatatctcataattcatgtactgctcctgataagacattaatattagatgtgccaccaggggttgaaaagtttcagttacatgattgtacacaagttgaaaaagcagatactactatttgtttaaaatggaaaaatattgaaacctttacttgtgatacacagaatattacctacagatttcagtgtggtaagaatataacattgaccagagaatttttttttgtggcacaatgttgttctagatattatttaatcttactctctgccctttctctcttcctccctgcctctcttgttctccctctgtttgtcttttttctttcttgtctttttcttggtctgtggtatatttagagtcaaataattaaattacctatacaattcaaacaaattcacaaaataaatgaatacttttcatgaaaaataaatatctaaaaa

SEQ ID NO: 448700 - DNA, 917 bp, Homo sapiens
cgagaacgcgcacaagcacgaccgcggcaccattcgccgtgcctaccctctatacccccccactaaccggtcgacgttcccgctttagaccgagacgcactactcagcagccattttagtttttctcgtgccctcgcgcgaacctcgctggaactacagttcttttctccccaagagggccgcgccttcgctctctccaaaaacgcattcccgggctagtctcaccccttcccccaagggggtttagtagtacaaaaccctccaccttccacaactccaaaatgccaaaccccctttggggatactgctagcccaccttccacggtctccgcccgccaatgcaaaactaaaccctaccccggcgggcaatgttatgtcagatgcctaccttaatgcctctgaaacaaccactctgagcccttctggaagcgctgtcatttcaaccacaacaatagctactactccatctaagccaacatgtgatgaaaaatatgcaaacatcactgtggattacttatataacaaggaaactaaattatttacagcaaagctaaatgttaatgagaatgtggaatgtggaaacaatacttgcacaaacaatgaggtgcataaccttacagaatgtaaaaatgcgtctgtttccatatctcataattcatgtactgctcctgataagacattaatattagatgtgccaccaggggttgaaaagtttcagttacatgattgtacacaagttgaaaaagcagatactactatttgtttaaaatggaaaaatattgaaacctttacttgtgatacacagaatattacctacagatttcagtgtggtaatatgatatttgataataaagaaagatccgccaggcacccgccctctctggtatctcttcacgccagcgcggttataataaaac

SEQ ID NO: 448701 - DNA, 1049 bp, Homo sapiens
atatttattgggcatcttgttaaaaaaaaaaaggcaccgttcctggcacaagtgatttgatggacaagataagcaaggcccttgctcttatggagtttactgttaagtgggaagatggaaaaaagaaggacgcatgctgtttcttagggacacggctgacttccagatatgaccatgtatttgtggcttaaactcttggcatttggctttgcctttctggacacagaagtatttgtgacagggcaaagcccaacaccttcccccactggattgactacagcaaagatgcccagtgttccactttcaagtgaccccttacctactcacaccactgcattctcacccgcaagcacctttgaaagagaaaatgacttctcagagaccacaacttctcttagtccagacaatacttccacccaagtatccccggactctttggataatgctagtgcttttaataccacaggtgtttcatcagtacagacgcctcaccttcccacgcacgcagactcgcagacgccctctgctggaactgacacgcagacattcagcggctccgccgccaatgcaaaactcaaccctaccccaggcagcaatgctatctcaggtttgcgggtcctttagacttgtgcaaatatgaaaagtacatgacgactacctgtatttaagaatggtgtgaggaaatctaaccacttattcaatgtgcagctattgctagttgatgaatttggaatttcagtcactcttaggaatatgaaaccacagaacaaatgtccttttaacagagatgaaataatagtgagaattgtgagactacagcaaaaatctgctcaggaggaaagagttattcagaatagtctattttttatatatttcaggcaattaccattctacagggaaaactttttgttagaagtaagaaataatatgcataaatctttacttaaagactttgtaccaacaaacaaaagggtgaagagtgattcctattatcagtgaagggcagtgagaaattgtaaccacaatgaaactgttatttaaagaatgag

SEQ ID NO: 448702 - DNA, 777 bp, Homo sapiens
cgacattttaactgaactgcgggataaagtgaaatctttccgtgcagctctacgagaggaggaaattgttcctcgtctgataagacaacagtggagaaaggacgcatgctgtttcttagggacacggctgacttccagatatgaccatgtatttgtggcttaaactcttggcatttggctttgcctttctggacacagaagtatttgtgacagggcaaagcccaacaccttcccccactggccatctgcaagctgaggagcaaggaagccaatccaagtcaccaaacctcaaaagtagggaagctgacagttcagccttcagttggtggccaaaggcccgagagcccctcacaaaccactggagtaagtccaagagtccaaaagctgaggaacttggagtctgatgttcaagagcaggaagcagccagcacgagagaaagatgaagaccagaagactcagcaagctcacttctcctaccttcttgtgcctgctttttctagccgtgctggcagttgcttggatgatgcccactcatattgggtgggggtgggggggttggggagggtctgcctcccccagtccactgactcaaatgttaatctcccttggcaatacgctcacaggcacacccaggaacaatactttgcatccttcaatccaatcaagttgacactcaatattaaccatcaaatactattataaggagaatgttgcatgattttccttctagtctgtttgtaattcacatctaatgaaagagtgagagtggacgataa

SEQ ID NO: 448703 - DNA, 363 bp, Homo sapiens
cccggactctttggataatgctagtgcttttaataccacaggttggcacacaaaagttgttaacttaaatatcagggaatgtcatttagaaaattctacagttatcagtacaacttgtctttaaattatttgcacagtttctaagtatgtgattttattcaagtgcagaaattgcaggaaattagtatctgtgaaatatagatcgactgaagtaattaatgcatgttgttagggagtggagagagaaaagaagggaagcaagatctccaaggacaatcaggaggggaaatttgttctagtatcctctgatctatacacactcgccatgattctcccgcttggcttcccgccacctggacagat

SEQ ID NO: 448704 - DNA, 1142 bp, Homo sapiens
  misc_feature (241)..(241): n is a, c, g, or t
  misc_feature (243)..(243): n is a, c, g, or t
  misc_feature (247)..(248): n is a, c, g, or t
  misc_feature (264)..(264): n is a, c, g, or t
  misc_feature (274)..(274): n is a, c, g, or t
  misc_feature (280)..(280): n is a, c, g, or t
  misc_feature (282)..(282): n is a, c, g, or t
ctcgcacgccgcacacgcccccacccacgccgcggccccgccccgccccgtttatttcggcgctccctctgctccgcctcgccgtttctcgatcgcccgccagaccccccacaccatccgcactcctgccggccaccaggtcgcgttataggccacgacccaactgcctggaaccccccaaaaggtttttcccccatcccgttgggatattccccggtgcgaagatccagtatctttttgncnatannggcccgagcccgtcanctgtccaganaaaggntnccagggcaaagcccaacaccttcccccactggtaagaattaatatttatatttttactaattttattttcttgttgcaaagtttatatatttaactacaattttctattattaacactgaaattatttttaaggataaattttataatcatgagtgattcttgacattcacttgttcttaaactttctgcttatacgttatagagtttaataactacctaaacatgttattaaatttgtatatatattttgtgtataaatagtaacttttcccaaacttgacagtaaatcacacaacaggtttctactctcttttaatattttaagactataaaaaaatgcatttaaattagataacaaaattttatagtctgaaagcaggttaacagctgtctatgtatgttatagatatgtagataacagatttgcatatgtctatatttctttaagagtatgttgcttttttcaatggtatgcaaaacctttgagactattgagatatttttaaataataattttcaaattctactgaacacttcaatagtccttataaatgtcttaatcatgagataaatttaaaacacagagatctgcaaataaattcatacatagtacatacaaaataagagaaaaaattaaattgcagatggttaaatatcacatcacttaactgatgttactgaaaatgtattttcctgcataatcatatggttgacagtatgcattaagaaggtaagtaaaacaatgaagacaattttgatttaatatggtaatgcacaattccaactaacgtacattcaacagatcatgaaattgggttattaaaatgaatatttttgtcattaaataaaaattccgtcc

SEQ ID NO: 448705 - DNA, 1130 bp, Homo sapiens
  misc_feature (229)..(229): n is a, c, g, or t
  misc_feature (231)..(231): n is a, c, g, or t
  misc_feature (235)..(236): n is a, c, g, or t
  misc_feature (252)..(252): n is a, c, g, or t
  misc_feature (262)..(262): n is a, c, g, or t
  misc_feature (268)..(268): n is a, c, g, or t
  misc_feature (270)..(270): n is a, c, g, or t
gtacctacgttctgtctgtgtcccaatcgcgcactttgcacggcgccatggcttgtactccctgctccctcgtccggcaatttcaggccagcatgccgggttggtcgtcctgatccttttcgtagcatgcgctctcgtaatggcctatgacctaccgctccaaacctctcaaatgttctttcggacccccttcgcatttacacccgcggtagatccagtatctttttgncnatannggcccgagcccgtcanctgtccaganaaaggntnccagggcaaagcccaacaccttcccccactggtaagaattaatatttatatttttactaattttattttcttgttgcaaagtttatatatttaactacaattttctattattaacactgaaattatttttaaggataaattttataatcatgagtgattcttgacattcacttgttcttaaactttctgcttatacgttatagagtttaataactacctaaacatgttattaaatttgtatatatattttgtgtataaatagtaacttttcccaaacttgacagtaaatcacacaacaggtttctactctcttttaatattttaagactataaaaaaatgcatttaaattagataacaaaattttatagtctgaaagcaggttaacagctgtctatgtatgttatagatatgtagataacagatttgcatatgtctatatttctttaagagtatgttgcttttttcaatggtatgcaaaacctttgagactattgagatatttttaaataataattttcaaattctactgaacacttcaatagtccttataaatgtcttaatcatgagataaatttaaaacacagagatctgcaaataaattcatacatagtacatacaaaataagagaaaaaattaaattgcagatggttaaatatcacatcacttaactgatgttactgaaaatgtattttcctgcataatcatatggttgacagtatgcattaagaaggtaagtaaaacaatgaagacaattttgatttaatatggtaatgcacaattccaactaacgtacattcaacagatcatgaaattgggttattaaaatgaatatttttgtcattaaataaaaattccgtcc

SEQ ID NO: 448706 - DNA, 745 bp, Homo sapiens
  misc_feature (1)..(1): n is a, c, g, or t
  misc_feature (17)..(17): n is a, c, g, or t
  misc_feature (38)..(38): n is a, c, g, or t
  misc_feature (59)..(59): n is a, c, g, or t
  misc_feature (707)..(707): n is a, c, g, or t
  misc_feature (717)..(717): n is a, c, g, or t
  misc_feature (719)..(719): n is a, c, g, or t
  misc_feature (729)..(729): n is a, c, g, or t
  misc_feature (731)..(731): n is a, c, g, or t
nttgcaattaacctacnaaaagtttcttcagcccctcntgcaaaggcaggaatgaaggngcatggtctttcccactaaagggtcctccaagccaggtctggaacatgactgtctccatgacatcagataatagtatgcatgtcaagtgtaggcctcccagggaccgtaatggcccccatgaacgttaccatttggaagttgaagctggaaatactctggttagaaatgagtcgcataagaattgcgatttccgtgtaaaagatcttcaatattcaacagactacacttttaaggcctattttcacaatggagactatcctggagaaccctttattttacatcattcaacatcttataattctaaggcactgatagcatttctggcatttctgattattgtgacatcaatagccctgcttgttgttctctacaaaatctatgatctacataagaaaagatcctgcaatttagatgaacagcaggagcttgttgaaagggatgatgaaaaacaactgatgaatgtggagccaatccatgcagatattttgttggaaacttataagaggaagattgctgatgaaggaagactttttctggctgaatttcagagcatcccgcgggtgttcagcaagtttcctataaaggaagctcgaaagccctttaaccagaataaaaaccgttatgttgacattcttccttatgattanaaccgtgttncnaatctgaaangncggtcagagcgttc

SEQ ID NO: 448707 - DNA, 926 bp, Homo sapiens
  misc_feature (429)..(429): n is a, c, g, or t
  misc_feature (441)..(441): n is a, c, g, or t
cgaggactgaagtattgtcgcgctacgtgaatgtcgccgctctcacatatagattgctggcgtatccatgcacatccgggctcatccgggtggctccggttgcggtccttgtccgcgcagttaacagtatataccgttgcacattactgaataatctacttcctctttgttttggtctccctcagtatggaaatgtctttcatcaggctttagggtaatcgtacctaccgacacgcgcacctctcactggttttccaaagcaccgcggaactttatatctgcgtgggttaaacatgtatatgtccgaatcaatagaaaggatgagcctgtcccactgtccaaaaatgagtattcccgattgcatggcgctgacaccttcccccacgtgatgcagccattaatgcctgttaaggcggccactatgagccnttctggaagcgntgtcatttcaaccgcaacaatagctactactccatctaagccaacatgtgatgaaaaatatgcaaacatcactgtggattacttatataacaaggaaactaaattatttacagcaaagctaaatgttaatgagaatgtggaatgtggaaacaatacttgcacaaacaatgaggtgcataaccttacagaatgtaaaaatgcgtctgtttccatatctcataattcatgtactgctcctgataagacattaatattagatgtgccaccaggggttgaaaagtttcagttacatgattgtacacaagttgaaaaagcagatactactatttgtttaaaatggaaaaatattgaaacctttacttgtgatacacagaatattacctacagatttcagtgtggtaatatgatatttgataataaagaaagatccgccaggcacccgccctctctggtatctcttcacgccagcgcggttataataaaac

SEQ ID NO: 448708 - DNA, 947 bp, Homo sapiens
cctacaagttgcataaccgcgctaaacccggaacgatgcacttacaatcagttagaaaaggtgcgtctacaccgccgactcctagcgacgctcgactactgcctcgttcgcagagcattatataggtggagaaatataatcaattgtcatatactataaccgcgaacacgccttactgacctcgacggtccgaattatagtacaactcataatacgatatataaacaaaaccttgtcttaatcgtctcttgactatcgatatcctcctctggtctccaacacacccagcgctaaatataaaaggatgaatataatacagatatggcgtggaattaaaacccagtcttgataccgagccattacggcacatcagtacagacgaggtaaatagtgttccataccaggaaaagagtttattaatcgcaattgtaatgtaacaggtgttttttaatatttggatgcatgcagtcatcgtctgtccaataagaaagcggccacaagagaaaaccacacacctatccacattaaagcctgacataataagtgtaagacctaccactatgagcccatatgggagagcgatcattccatccgcgacaagagtgatgattccatctaacccaacatggaatgaaaaatatgcaaacatcactgtggattacttatataacaaggaaactaaattatttacagcaaagctaaatgttaatgagaatgtggaatgtggaaacaatacttgcacaaacaatgaggtgcataaccttacagaatgtaaaaatgcgtctgtttccatatctcataattcatgtactgctcctgataagacattaatattagatgtgccaccaggggttgaaaagtttcagttacatgattgtacacaagttgaaaaagcaggcgccaagtcccggggtgtcccgtatcccaggcccaatactgaaaaaaat

SEQ ID NO: 448709 - DNA, 905 bp, Homo sapiens
cagtaacgatcgaatcgagagcaaagcgtacgtcggtaagtagttcggcatttctgcgcgtcgtcttgtacacgatgaggtgctagctatagtgatataatagtgatcattagctatatacaagtagtataatatgctttcgataatccgtttaagatggtcggcagccttaatggtttaacgtgaagatccataaccctgtgttatcggcgaattaaggtgtggagttctcggcttcaaaagttgattcccaattgcatggggatataacaaacggggtagtagaaaatgatggtggggaaataatgggcgtagctttttcagtttccggcaaaatgggattttagaataacgcccttcacacgtccacctgagatatcaactataagcatgtgaatgggaccactgagaggctttgtggaagggtggtcacgtattcttcaacaataggggatactccatctaagccgacaatgtgatgaaaaatatgcaaacatcactgtggattacttatataacaaggaaactaaattatttacagcaaagctaaatgttaatgagaatgtggaatgtggaaacaatacttgcacaaacaatgaggtgcataaccttacagaatgtaaaaatgcgtctgtttccatatctcataattcatgtactgctcctgataagacattaatattagatgtgccaccaggggttgaaaagtttcagttacatgattgtacacaagttgaaaaagcagatactactatttgtttaaaatggaaaaatattgaaacctttacttgtgatacacagaatattacctacagatttcagtgtggtaatatgatatttgataataaagtcagatgcgggcagtgattgggcttttgtttgttagtaggatgcctggtgaaaaa

SEQ ID NO: 448710 - DNA, 4536 bp, Homo sapiens
cgacattttaactgaactgcgggataaagtgaaatctttccgtgcagctctacgagaggaggaaattgttcctcgtctgataagacaacagtggagaaaggacgcatgctgtttcttagggacacggctgacttccagatatgaccatgtatttgtggcttaaactcttggcatttggctttgcctttctggacacagaagtatttgtgacagggcaaagcccaacaccttcccccactggattgactacagcaaagatgcccagtgttccactttcaagtgaccccttacctactcacaccactgcattctcacccgcaagcacctttgaaagagaaaatgacttctcagagaccacaacttctcttagtccagacaatacttccacccaagtatccccggactctttggataatgctagtgcttttaataccacaggtgtttcatcagtacagacgcctcaccttcccacgcacgcagactcgcagacgccctctgctggaactgacacgcagacattcagcggctccgccgccaatgcaaaactcaaccctaccccaggcagcaatgctatctcagatgtcccaggagagaggagtacagccagcacctttcctacagacccagtttccccattgacaaccaccctcagccttgcacaccacagctctgctgccttacctgcacgcacctccaacaccaccatcacagcgaacacctcagatgcctaccttaatgcctctgaaacaaccactctgagcccttctggaagcgctgtcatttcaaccacaacaatagctactactccatctaagccaacatgtgatgaaaaatatgcaaacatcactgtggattacttatataacaaggaaactaaattatttacagcaaagctaaatgttaatgagaatgtggaatgtggaaacaatacttgcacaaacaatgaggtgcataaccttacagaatgtaaaaatgcgtctgtttccatatctcataattcatgtactgctcctgataagacattaatattagatgtgccaccaggggttgaaaagtttcagttacatgattgtacacaagttgaaaaagcagatactactatttgtttaaaatggaaaaatattgaaacctttacttgtgatacacagaatattacctacagatttcagtgtggtaatatgatatttgataataaagaaattaaattagaaaaccttgaacccgaacatgagtataagtgtgactcagaaatactctataataaccacaagtttactaacgcaagtaaaattattaaaacagattttgggagtccaggagagcctcagattattttttgtagaagtgaagctgcacatcaaggagtaattacctggaatccccctcaaagatcatttcataattttaccctctgttatataaaagagacagaaaaagattgcctcaatctggataaaaacctgatcaaatatgatttgcaaaatttaaaaccttatacgaaatatgttttatcattacatgcctacatcattgcaaaagtgcaacgtaatggaagtgctgcaatgtgtcatttcacaactaaaagtgctcctccaagccaggtctggaacatgactgtctccatgacatcagataatagtatgcatgtcaagtgtaggcctcccagggaccgtaatggcccccatgaacgttaccatttggaagttgaagctggaaatactctggttagaaatgagtcgcataagaattgcgatttccgtgtaaaagatcttcaatattcaacagactacacttttaaggcctattttcacaatggagactatcctggagaaccctttattttacatcattcaacatcttataattctaaggcactgatagcatttctggcatttctgattattgtgacatcaatagccctgcttgttgttctctacaaaatctatgatctacataagaaaagatcctgcaatttagatgaacagcaggagcttgttgaaagggatgatgaaaaacaactgatgaatgtggagccaatccatgcagatattttgttggaaacttataagaggaagattgctgatgaaggaagactttttctggctgaatttcagagcatcccgcgggtgttcagcaagtttcctataaaggaagctcgaaagccctttaaccagaataaaaaccgttatgttgacattcttccttatgattataaccgtgttgaactctctgaaataaacggagatgcagggtcaaactacataaatgccagctatattgatggtttcaaagaacccaggaaatacattgctgcacaaggtcccagggatgaaactgttgatgatttctggaggatgatttgggaacagaaagccacagttattgtcatggtcactcgatgtgaagaaggaaacaggaacaagtgtgcagaatactggccgtcaatggaagagggcactcgggcttttggagatgttgttgtaaagatcaaccagcacaaaagatgtccagattacatcattcagaaattgaacattgtaaataaaaaagaaaaagcaactggaagagaggtgactcacattcagttcaccagctggccagaccacggggtgcctgaggatcctcacttgctcctcaaactgagaaggagagtgaatgccttcagcaatttcttcagtggtcccattgtggtgcactgcagtgctggtgttgggcgcacaggaacctatatcggaattgatgccatgctagaaggcctggaagccgagaacaaagtggatgtttatggttatgttgtcaagctaaggcgacagagatgcctgatggttcaagtagaggcccagtacatcttgatccatcaggctttggtggaatacaatcagtttggagaaacagaagtgaatttgtctgaattacatccatatctacataacatgaagaaaagggatccacccagtgagccgtctccactagaggctgaattccagagacttccttcatataggagctggaggacacagcacattggaaatcaagaagaaaataaaagtaaaaacaggaattctaatgtcatcccatatgactataacagagtgccacttaaacatgagctggaaatgagtaaagagagtgagcatgattcagatgaatcctctgatgatgacagtgattcagaggaaccaagcaaatacatcaatgcatcttttataatgagctactggaaacctgaagtgatgattgctgctcagggaccactgaaggagaccattggtgacttttggcagatgatcttccaaagaaaagtcaaagttattgttatgctgacagaactgaaacatggagaccaggaaatctgtgctcagtactggggagaaggaaagcaaacatatggagatattgaagttgacctgaaagacacagacaaatcttcaacttatacccttcgtgtctttgaactgagacattccaagaggaaagactctcgaactgtgtaccagtaccaatatacaaactggagtgtggagcagcttcctgcagaacccaaggaattaatctctatgattcaggtcgtcaaacaaaaacttccccagaagaattcctctgaagggaacaagcatcacaagagtacacctctactcattcactgcagggatggatctcagcaaacgggaatattttgtgctttgttaaatctcttagaaagtgcggaaacagaagaggtagtggatatttttcaagtggtaaaagctctacgcaaagctaggccaggcatggtttccacattcgagcaatatcaattcctatatgacgtcattgccagcacctaccctgctcagaatggacaagtaaagaaaaacaaccatcaagaagataaaattgaatttgataatgaagtggacaaagtaaagcaggatgctaattgtgttaatccacttggtgccccagaaaagctccctgaagcaaaggaacaggctgaaggttctgaacccacgagtggcactgaggggccagaacattctgtcaatggtcctgcaagtccagctttaaatcaaggttcataggaaaagacataaatgaggaaactccaaacctcctgttagctgttatttctatttttgtagaagtaggaagtgaaaataggtatacagtggattaattaaatgcagcgaaccaatatttgtagaagggttatattttactactgtggaaaaatatttaagatagttttgccagaacagtttgtacagacgtatgcttattttaaaattttatctcttattcagtaaaaaacaacttctttgtaatcgttatgtgtgtatatgtatgtgtgtatgggtgtgtgtttgtgtgagagacagagaaagagagagaattctttcaagtgaatctaaaagcttttgcttttcctttgtttttatgaagaaaaaatacattttatattagaagtgttaacttagcttgaaggatctgtttttaaaaatcataaactgtgtgcagactcaataaaatcatgtacatttctgaaatgacctcaag

SEQ ID NO: 448711 - DNA, 4905 bp, Homo sapiens
  misc_feature (4840)..(4841): n is a, c, g, or t
cgacattttaactgaactgcgggataaagtgaaatctttccgtgcagctctacgagaggaggaaattgttcctcgtctgataagacaacagtggagaaaggacgcatgctgtttcttagggacacggctgacttccagatatgaccatgtatttgtggcttaaactcttggcatttggctttgcctttctggacacagaagtatttgtgacagggcaaagcccaacaccttcccccactggattgactacagcaaagatgcccagtgttccactttcaagtgaccccttacctactcacaccactgcattctcacccgcaagcacctttgaaagagaaaatgacttctcagagaccacaacttctcttagtccagacaatacttccacccaagtatccccggactctttggataatgctagtgcttttaataccacaggtgtttcatcagtacagacgcctcaccttcccacgcacgcagactcgcagacgccctctgctggaactgacacgcagacattcagcggctccgccgccaatgcaaaactcaaccctaccccaggcagcaatgctatctcagatgtcccaggagagaggagtacagccagcacctttcctacagacccagtttccccattgacaaccaccctcagccttgcacaccacagctctgctgccttacctgcacgcacctccaacaccaccatcacagcgaacacctcagatgcctaccttaatgcctctgaaacaaccactctgagcccttctggaagcgctgtcatttcaaccacaacaatagctactactccatctaagccaacatgtgatgaaaaatatgcaaacatcactgtggattacttatataacaaggaaactaaattatttacagcaaagctaaatgttaatgagaatgtggaatgtggaaacaatacttgcacaaacaatgaggtgcataaccttacagaatgtaaaaatgcgtctgtttccatatctcataattcatgtactgctcctgataagacattaatattagatgtgccaccaggggttgaaaagtttcagttacatgattgtacacaagttgaaaaagcagatactactatttgtttaaaatggaaaaatattgaaacctttacttgtgatacacagaatattacctacagatttcagtgtggtaatatgatatttgataataaagaaattaaattagaaaaccttgaacccgaacatgagtataagtgtgactcagaaatactctataataaccacaagtttactaacgcaagtaaaattattaaaacagattttgggagtccaggagagcctcagattattttttgtagaagtgaagctgcacatcaaggagtaattacctggaatccccctcaaagatcatttcataattttaccctctgttatataaaagagacagaaaaagattgcctcaatctggataaaaacctgatcaaatatgatttgcaaaatttaaaaccttatacgaaatatgttttatcattacatgcctacatcattgcaaaagtgcaacgtaatggaagtgctgcaatgtgtcatttcacaactaaaagtgctcctccaagccaggtctggaacatgactgtctccatgacatcagataatagtatgcatgtcaagtgtaggcctcccagggaccgtaatggcccccatgaacgttaccatttggaagttgaagctggaaatactctggttagaaatgagtcgcataagaattgcgatttccgtgtaaaagatcttcaatattcaacagactacacttttaaggcctattttcacaatggagactatcctggagaaccctttattttacatcattcaacatcttataattctaaggcactgatagcatttctggcatttctgattattgtgacatcaatagccctgcttgttgttctctacaaaatctatgatctacataagaaaagatcctgcaatttagatgaacagcaggagcttgttgaaagggatgatgaaaaacaactgatgaatgtggagccaatccatgcagatattttgttggaaacttataagaggaagattgctgatgaaggaagactttttctggctgaatttcagagcatcccgcgggtgttcagcaagtttcctataaaggaagctcgaaagccctttaaccagaataaaaaccgttatgttgacattcttccttatgattataaccgtgttgaactctctgaaataaacggagatgcagggtcaaactacataaatgccagctatattgatggtttcaaagaacccaggaaatacattgctgcacaaggtcccagggatgaaactgttgatgatttctggaggatgatttgggaacagaaagccacagttattgtcatggtcactcgatgtgaagaaggaaacaggaacaagtgtgcagaatactggccgtcaatggaagagggcactcgggcttttggagatgttgttgtaaagatcaaccagcacaaaagatgtccagattacatcattcagaaattgaacattgtaaataaaaaagaaaaagcaactggaagagaggtgactcacattcagttcaccagctggccagaccacggggtgcctgaggatcctcacttgctcctcaaactgagaaggagagtgaatgccttcagcaatttcttcagtggtcccattgtggtgcactgcagtgctggtgttgggcgcacaggaacctatatcggaattgatgccatgctagaaggcctggaagccgagaacaaagtggatgtttatggttatgttgtcaagctaaggcgacagagatgcctgatggttcaagtagaggcccagtacatcttgatccatcaggctttggtggaatacaatcagtttggagaaacagaagtgaatttgtctgaattacatccatatctacataacatgaagaaaagggatccacccagtgagccgtctccactagaggctgaattccagagacttccttcatataggagctggaggacacagcacattggaaatcaagaagaaaataaaagtaaaaacaggaattctaatgtcatcccatatgactataacagagtgccacttaaacatgagctggaaatgagtaaagagagtgagcatgattcagatgaatcctctgatgatgacagtgattcagaggaaccaagcaaatacatcaatgcatcttttataatgagctactggaaacctgaagtgatgattgctgctcagggaccactgaaggagaccattggtgacttttggcagatgatcttccaaagaaaagtcaaagttattgttatgctgacagaactgaaacatggagaccaggaaatctgtgctcagtactggggagaaggaaagcaaacatatggagatattgaagttgacctgaaagacacagacaaatcttcaacttatacccttcgtgtctttgaactgagacattccaagaggaaagactctcgaactgtgtaccagtaccaatatacaaactggagtgtggagcagcttcctgcagaacccaaggaattaatctctatgattcaggtcgtcaaacaaaaacttccccagaagaattcctctgaagggaacaagcatcacaagagtacacctctactcattcactgcagggatggatctcagcaaacgggaatattttgtgctttgttaaatctcttagaaagtgcggaaacagaagaggtagtggatatttttcaagtggtaaaagctctacgcaaagctaggccaggcatggtttccacattcgagcaatatcaattcctatatgacgtcattgccagcacctaccctgctcagaatggacaagtaaagaaaaacaaccatcaagaagataaaattgaatttgataatgaagtggacaaagtaaagcaggatgctaattgtgttaatccacttggtgccccagaaaagctccctgaagcaaaggaacaggctgaaggttctgaacccacgagtggcactgaggggccagaacattctgtcaatggtcctgcaagtccagctttaaatcaaggttcataggaaaagacataaatgaggaaactccaaacctcctgttagctgttatttctatttttgtagaagtaggaagtgaaaataggtatacagtggattaattaaatgcagcgaaccaatatttgtagaagggttatattttactactgtggaaaaatatttaagatagttttgccagaacagtttgtacagacgtatgcttattttaaaattttatctcttattcagtaaaaaacaacttctttgtaatcgttatgtgtgtatatgtatgtgtgtatgggtgtgtgtttgtgtgagagacagagaaagagagagaattctttcaagtgaatctaaaagcttttgcttttcctttgtttttatgaagaaaaaatacattttatattagaagtgttaacttagcttgaaggatctgtttttaaaaatcataaactgtgtgcagactcaataaaatcatgtacatttctgaaatgacctcaagatgtcctccttgttctactcatatatatctatcttatatagtttactattttacttctagagatagtacataaaggtggtatgtgtgtgtatgctactacaaaaaagttgttaactaaattaacattgggaaatcttatattccatatattagcatttagtccaatgtctttttaagcttatttaattaaaaaatttccagtgagcttatcatgctgtctttacatggggttttcaattttgcatgctcgattattccctgtacaatatttaaataatggcattaagataatccattcaaaccnnaaagctcttttaaagctacctgtcggcccgcctggccaaaggaccttggactcgagcagcttaa

SEQ ID NO: 448712 - DNA, 5188 bp, Homo sapiens
atatttattgggcatcttgttaaaaaaaaaaaggcaccgttcctggcacaagtgatttgatggacaagataagcaaggcccttgctcttatggagtttactgttaagtgggaagatggaaaaaagaaggacgcatgctgtttcttagggacacggctgacttccagatatgaccatgtatttgtggcttaaactcttggcatttggctttgcctttctggacacagaagtatttgtgacagggcaaagcccaacaccttcccccactggtgtttcatcagtacagacgcctcaccttcccacgcacgcagactcgcagacgccctctgctggaactgacacgcagacattcagcggctccgccgccaatgcaaaactcaaccctaccccaggcagcaatgctatctcagatgtcccaggagagaggagtacagccagcacctttcctacagacccagtttccccattgacaaccaccctcagccttgcacaccacagctctgctgccttacctgcacgcacctccaacaccaccatcacagcgaacacctcagatgcctaccttaatgcctctgaaacaaccactctgagcccttctggaagcgctgtcatttcaaccacaacaatagctactactccatctaagccaacatgtgatgaaaaatatgcaaacatcactgtggattacttatataacaaggaaactaaattatttacagcaaagctaaatgttaatgagaatgtggaatgtggaaacaatacttgcacaaacaatgaggtgcataaccttacagaatgtaaaaatgcgtctgtttccatatctcataattcatgtactgctcctgataagacattaatattagatgtgccaccaggggttgaaaagtttcagttacatgattgtacacaagttgaaaaagcagatactactatttgtttaaaatggaaaaatattgaaacctttacttgtgatacacagaatattacctacagatttcagtgtggtaatatgatatttgataataaagaaattaaattagaaaaccttgaacccgaacatgagtataagtgtgactcagaaatactctataataaccacaagtttactaacgcaagtaaaattattaaaacagattttgggagtccaggagagcctcagattattttttgtagaagtgaagctgcacatcaaggagtaattacctggaatccccctcaaagatcatttcataattttaccctctgttatataaaagagacagaaaaagattgcctcaatctggataaaaacctgatcaaatatgatttgcaaaatttaaaaccttatacgaaatatgttttatcattacatgcctacatcattgcaaaagtgcaacgtaatggaagtgctgcaatgtgtcatttcacaactaaaagtgctcctccaagccaggtctggaacatgactgtctccatgacatcagataatagtatgcatgtcaagtgtaggcctcccagggaccgtaatggcccccatgaacgttaccatttggaagttgaagctggaaatactctggttagaaatgagtcgcataagaattgcgatttccgtgtaaaagatcttcaatattcaacagactacacttttaaggcctattttcacaatggagactatcctggagaaccctttattttacatcattcaacatcttataattctaaggcactgatagcatttctggcatttctgattattgtgacatcaatagccctgcttgttgttctctacaaaatctatgatctacataagaaaagatcctgcaatttagatgaacagcaggagcttgttgaaagggatgatgaaaaacaactgatgaatgtggagccaatccatgcagatattttgttggaaacttataagaggaagattgctgatgaaggaagactttttctggctgaatttcagagcatcccgcgggtgttcagcaagtttcctataaaggaagctcgaaagccctttaaccagaataaaaaccgttatgttgacattcttccttatgattataaccgtgttgaactctctgaaataaacggagatgcagggtcaaactacataaatgccagctatattgatggtttcaaagaacccaggaaatacattgctgcacaaggtcccagggatgaaactgttgatgatttctggaggatgatttgggaacagaaagccacagttattgtcatggtcactcgatgtgaagaaggaaacaggaacaagtgtgcagaatactggccgtcaatggaagagggcactcgggcttttggagatgttgttgtaaagatcaaccagcacaaaagatgtccagattacatcattcagaaattgaacattgtaaataaaaaagaaaaagcaactggaagagaggtgactcacattcagttcaccagctggccagaccacggggtgcctgaggatcctcacttgctcctcaaactgagaaggagagtgaatgccttcagcaatttcttcagtggtcccattgtggtgcactgcagtgctggtgttgggcgcacaggaacctatatcggaattgatgccatgctagaaggcctggaagccgagaacaaagtggatgtttatggttatgttgtcaagctaaggcgacagagatgcctgatggttcaagtagaggcccagtacatcttgatccatcaggctttggtggaatacaatcagtttggagaaacagaagtgaatttgtctgaattacatccatatctacataacatgaagaaaagggatccacccagtgagccgtctccactagaggctgaattccagagacttccttcatataggagctggaggacacagcacattggaaatcaagaagaaaataaaagtaaaaacaggaattctaatgtcatcccatatgactataacagagtgccacttaaacatgagctggaaatgagtaaagagagtgagcatgattcagatgaatcctctgatgatgacagtgattcagaggaaccaagcaaatacatcaatgcatcttttataatgagctactggaaacctgaagtgatgattgctgctcagggaccactgaaggagaccattggtgacttttggcagatgatcttccaaagaaaagtcaaagttattgttatgctgacagaactgaaacatggagaccaggaaatctgtgctcagtactggggagaaggaaagcaaacatatggagatattgaagttgacctgaaagacacagacaaatcttcaacttatacccttcgtgtctttgaactgagacattccaagaggaaagactctcgaactgtgtaccagtaccaatatacaaactggagtgtggagcagcttcctgcagaacccaaggaattaatctctatgattcaggtcgtcaaacaaaaacttccccagaagaattcctctgaagggaacaagcatcacaagagtacacctctactcattcactgcagggatggatctcagcaaacgggaatattttgtgctttgttaaatctcttagaaagtgcggaaacagaagaggtagtggatatttttcaagtggtaaaagctctacgcaaagctaggccaggcatggtttccacattcgagcaatatcaattcctatatgacgtcattgccagcacctaccctgctcagaatggacaagtaaagaaaaacaaccatcaagaagataaaattgaatttgataatgaagtggacaaagtaaagcaggatgctaattgtgttaatccacttggtgccccagaaaagctccctgaagcaaaggaacaggctgaaggttctgaacccacgagtggcactgaggggccagaacattctgtcaatggtcctgcaagtccagctttaaatcaaggttcataggaaaagacataaatgaggaaactccaaacctcctgttagctgttatttctatttttgtagaagtaggaagtgaaaataggtatacagtggattaattaaatgcagcgaaccaatatttgtagaagggttatattttactactgtggaaaaatatttaagatagttttgccagaacagtttgtacagacgtatgcttattttaaaattttatctcttattcagtaaaaaacaacttctttgtaatcgttatgtgtgtatatgtatgtgtgtatgggtgtgtgtttgtgtgagagacagagaaagagagagaattctttcaagtgaatctaaaagcttttgcttttcctttgtttttatgaagaaaaaatacattttatattagaagtgttaacttagcttgaaggatctgtttttaaaaatcataaactgtgtgcagactcaataaaatcatgtacatttctgaaatgacctcaagatgtcctccttgttctactcatatatatctatcttatatagtttactattttacttctagagatagtacataaaggtggtatgtgtgtgtatgctactacaaaaaagttgttaactaaattaacattgggaaatcttatattccatatattagcatttagtccaatgtctttttaagcttatttaattaaaaaatttccagtgagcttatcatgctgtctttacatggggttttcaattttgcatgctcgattattccctgtacaatatttaaaatttattgcttgatacttttgacaacaaattaggttttgtacaattgaacttaaataaatgtcattaaaataaataaatgcaatatgtattaatattcattgtataaaaatagaagaatacaaacatatttgttaaatatttacatatgaaatttaatatagctatttttatggaatttttcattgatatgaaaaatatgatattgcatatgcatagttcccatgttaaatcccattcataactttcattaaagcatttactttgaatttctccaatgcttagaatgtttttaccaggaatggatgtcgctaatcataataaaattcaaccattatttttttcttgtttataatacattgtgttatatgttcaaatatgaaatgtgtatgcacctattgaaatatgtttaatgcatttattaacatttgcaggacacttttacaggccccaattatccaatagtctaataattgtttaagatctagaaaaaaaaaatcaagaatagtggtatttttcatgaagtaataaaaactcgttttggtgaatt

SEQ ID NO: 448713 - DNA, 4940 bp, Homo sapiens
ttggtacagttctgtagaatgcatgtgtcgtggtatagcagaagtgcttgaagatttgtttctctgccttatctttagtaattgtgtttatgttggctatctggctattgcccttgcgtgacagacacaagtgacagtgctgatggcccttctgattgcagatgtcccaggagagaggagtacagccagcacctttcctacagacccagtttccccattgacaaccaccctcagccttgcacaccacagctctgctgccttacctgcacgcacctccaacaccaccatcacagcgaacacctcagatgcctaccttaatgcctctgaaacaaccactctgagcccttctggaagcgctgtcatttcaaccacaacaatagctactactccatctaagccaacatgtgatgaaaaatatgcaaacatcactgtggattacttatataacaaggaaactaaattatttacagcaaagctaaatgttaatgagaatgtggaatgtggaaacaatacttgcacaaacaatgaggtgcataaccttacagaatgtaaaaatgcgtctgtttccatatctcataattcatgtactgctcctgataagacattaatattagatgtgccaccaggggttgaaaagtttcagttacatgattgtacacaagttgaaaaagcagatactactatttgtttaaaatggaaaaatattgaaacctttacttgtgatacacagaatattacctacagatttcagtgtggtaatatgatatttgataataaagaaattaaattagaaaaccttgaacccgaacatgagtataagtgtgactcagaaatactctataataaccacaagtttactaacgcaagtaaaattattaaaacagattttgggagtccaggagagcctcagattattttttgtagaagtgaagctgcacatcaaggagtaattacctggaatccccctcaaagatcatttcataattttaccctctgttatataaaagagacagaaaaagattgcctcaatctggataaaaacctgatcaaatatgatttgcaaaatttaaaaccttatacgaaatatgttttatcattacatgcctacatcattgcaaaagtgcaacgtaatggaagtgctgcaatgtgtcatttcacaactaaaagtgctcctccaagccaggtctggaacatgactgtctccatgacatcagataatagtatgcatgtcaagtgtaggcctcccagggaccgtaatggcccccatgaacgttaccatttggaagttgaagctggaaatactctggttagaaatgagtcgcataagaattgcgatttccgtgtaaaagatcttcaatattcaacagactacacttttaaggcctattttcacaatggagactatcctggagaaccctttattttacatcattcaacatcttataattctaaggcactgatagcatttctggcatttctgattattgtgacatcaatagccctgcttgttgttctctacaaaatctatgatctacataagaaaagatcctgcaatttagatgaacagcaggagcttgttgaaagggatgatgaaaaacaactgatgaatgtggagccaatccatgcagatattttgttggaaacttataagaggaagattgctgatgaaggaagactttttctggctgaatttcagagcatcccgcgggtgttcagcaagtttcctataaaggaagctcgaaagccctttaaccagaataaaaaccgttatgttgacattcttccttatgattataaccgtgttgaactctctgaaataaacggagatgcagggtcaaactacataaatgccagctatattgatggtttcaaagaacccaggaaatacattgctgcacaaggtcccagggatgaaactgttgatgatttctggaggatgatttgggaacagaaagccacagttattgtcatggtcactcgatgtgaagaaggaaacaggaacaagtgtgcagaatactggccgtcaatggaagagggcactcgggcttttggagatgttgttgtaaagatcaaccagcacaaaagatgtccagattacatcattcagaaattgaacattgtaaataaaaaagaaaaagcaactggaagagaggtgactcacattcagttcaccagctggccagaccacggggtgcctgaggatcctcacttgctcctcaaactgagaaggagagtgaatgccttcagcaatttcttcagtggtcccattgtggtgcactgcagtgctggtgttgggcgcacaggaacctatatcggaattgatgccatgctagaaggcctggaagccgagaacaaagtggatgtttatggttatgttgtcaagctaaggcgacagagatgcctgatggttcaagtagaggcccagtacatcttgatccatcaggctttggtggaatacaatcagtttggagaaacagaagtgaatttgtctgaattacatccatatctacataacatgaagaaaagggatccacccagtgagccgtctccactagaggctgaattccagagacttccttcatataggagctggaggacacagcacattggaaatcaagaagaaaataaaagtaaaaacaggaattctaatgtcatcccatatgactataacagagtgccacttaaacatgagctggaaatgagtaaagagagtgagcatgattcagatgaatcctctgatgatgacagtgattcagaggaaccaagcaaatacatcaatgcatcttttataatgagctactggaaacctgaagtgatgattgctgctcagggaccactgaaggagaccattggtgacttttggcagatgatcttccaaagaaaagtcaaagttattgttatgctgacagaactgaaacatggagaccaggaaatctgtgctcagtactggggagaaggaaagcaaacatatggagatattgaagttgacctgaaagacacagacaaatcttcaacttatacccttcgtgtctttgaactgagacattccaagaggaaagactctcgaactgtgtaccagtaccaatatacaaactggagtgtggagcagcttcctgcagaacccaaggaattaatctctatgattcaggtcgtcaaacaaaaacttccccagaagaattcctctgaagggaacaagcatcacaagagtacacctctactcattcactgcagggatggatctcagcaaacgggaatattttgtgctttgttaaatctcttagaaagtgcggaaacagaagaggtagtggatatttttcaagtggtaaaagctctacgcaaagctaggccaggcatggtttccacattcgagcaatatcaattcctatatgacgtcattgccagcacctaccctgctcagaatggacaagtaaagaaaaacaaccatcaagaagataaaattgaatttgataatgaagtggacaaagtaaagcaggatgctaattgtgttaatccacttggtgccccagaaaagctccctgaagcaaaggaacaggctgaaggttctgaacccacgagtggcactgaggggccagaacattctgtcaatggtcctgcaagtccagctttaaatcaaggttcataggaaaagacataaatgaggaaactccaaacctcctgttagctgttatttctatttttgtagaagtaggaagtgaaaataggtatacagtggattaattaaatgcagcgaaccaatatttgtagaagggttatattttactactgtggaaaaatatttaagatagttttgccagaacagtttgtacagacgtatgcttattttaaaattttatctcttattcagtaaaaaacaacttctttgtaatcgttatgtgtgtatatgtatgtgtgtatgggtgtgtgtttgtgtgagagacagagaaagagagagaattctttcaagtgaatctaaaagcttttgcttttcctttgtttttatgaagaaaaaatacattttatattagaagtgttaacttagcttgaaggatctgtttttaaaaatcataaactgtgtgcagactcaataaaatcatgtacatttctgaaatgacctcaagatgtcctccttgttctactcatatatatctatcttatatagtttactattttacttctagagatagtacataaaggtggtatgtgtgtgtatgctactacaaaaaagttgttaactaaattaacattgggaaatcttatattccatatattagcatttagtccaatgtctttttaagcttatttaattaaaaaatttccagtgagcttatcatgctgtctttacatggggttttcaattttgcatgctcgattattccctgtacaatatttaaaatttattgcttgatacttttgacaacaaattaggttttgtacaattgaacttaaataaatgtcattaaaataaataaatgcaatatgtattaatattcattgtataaaaatagaagaatacaaacatatttgttaaatatttacatatgaaatttaatatagctatttttatggaatttttcattgatatgaaaaatatgatattgcatatgcatagttcccatgttaaatcccattcataactttcattaaagcatttactttgaatttctccaatgcttagaatgtttttaccaggaatggatgtcgctaatcataataaaattcaaccattatttttttcttgtttataatacattgtgttatatgttcaaatatgaaatgtgtatgcacctattgaaatatgtttaatgcatttattaacatttgcaggacacttttacaggccccaattatccaatagtctaataattgtttaagatctagaaaaaaaaaatcaagaatagtggtatttttcatgaagtaataaaaactcgttttggtgaatt

SEQ ID NO: 448714 - DNA, 4945 bp, Homo sapiens
  misc_feature (350)..(350): n is a, c, g, or t
  misc_feature (362)..(362): n is a, c, g, or t
ctcgcctcgccgcaaccgcacgcaaccggaactcacgacgctgcgttcgcatcacaagcgcgaagctcccccgccaaactcgcccccgcactcccgattctcctgctaacaatggtcccctctcatctttatatgatgtatatccgtgcgaaccccccccctcccccactggtgtgttcctcgccatgagccaccaccctcctccgtacccagatcccaaaaccccttttttggctctggcgcgcggacatacaacggcttcgcgaccaatatacgatcatctcctcccccggccggccatatttttcaagggcctccccttaagcgtttgagatacccactatgagccnttctggaagcgntgtcatttcaaccgcaacaatagctactactccatctaagccaacatgtgatgaaaaatatgcaaacatcactgtggattacttatataacaaggaaactaaattatttacagcaaagctaaatgttaatgagaatgtggaatgtggaaacaatacttgcacaaacaatgaggtgcataaccttacagaatgtaaaaatgcgtctgtttccatatctcataattcatgtactgctcctgataagacattaatattagatgtgccaccaggggttgaaaagtttcagttacatgattgtacacaagttgaaaaagcagatactactatttgtttaaaatggaaaaatattgaaacctttacttgtgatacacagaatattacctacagatttcagtgtggtaatatgatatttgataataaagaaattaaattagaaaaccttgaacccgaacatgagtataagtgtgactcagaaatactctataataaccacaagtttactaacgcaagtaaaattattaaaacagattttgggagtccaggagagcctcagattattttttgtagaagtgaagctgcacatcaaggagtaattacctggaatccccctcaaagatcatttcataattttaccctctgttatataaaagagacagaaaaagattgcctcaatctggataaaaacctgatcaaatatgatttgcaaaatttaaaaccttatacgaaatatgttttatcattacatgcctacatcattgcaaaagtgcaacgtaatggaagtgctgcaatgtgtcatttcacaactaaaagtgctcctccaagccaggtctggaacatgactgtctccatgacatcagataatagtatgcatgtcaagtgtaggcctcccagggaccgtaatggcccccatgaacgttaccatttggaagttgaagctggaaatactctggttagaaatgagtcgcataagaattgcgatttccgtgtaaaagatcttcaatattcaacagactacacttttaaggcctattttcacaatggagactatcctggagaaccctttattttacatcattcaacatcttataattctaaggcactgatagcatttctggcatttctgattattgtgacatcaatagccctgcttgttgttctctacaaaatctatgatctacataagaaaagatcctgcaatttagatgaacagcaggagcttgttgaaagggatgatgaaaaacaactgatgaatgtggagccaatccatgcagatattttgttggaaacttataagaggaagattgctgatgaaggaagactttttctggctgaatttcagagcatcccgcgggtgttcagcaagtttcctataaaggaagctcgaaagccctttaaccagaataaaaaccgttatgttgacattcttccttatgattataaccgtgttgaactctctgaaataaacggagatgcagggtcaaactacataaatgccagctatattgatggtttcaaagaacccaggaaatacattgctgcacaaggtcccagggatgaaactgttgatgatttctggaggatgatttgggaacagaaagccacagttattgtcatggtcactcgatgtgaagaaggaaacaggaacaagtgtgcagaatactggccgtcaatggaagagggcactcgggcttttggagatgttgttgtaaagatcaaccagcacaaaagatgtccagattacatcattcagaaattgaacattgtaaataaaaaagaaaaagcaactggaagagaggtgactcacattcagttcaccagctggccagaccacggggtgcctgaggatcctcacttgctcctcaaactgagaaggagagtgaatgccttcagcaatttcttcagtggtcccattgtggtgcactgcagtgctggtgttgggcgcacaggaacctatatcggaattgatgccatgctagaaggcctggaagccgagaacaaagtggatgtttatggttatgttgtcaagctaaggcgacagagatgcctgatggttcaagtagaggcccagtacatcttgatccatcaggctttggtggaatacaatcagtttggagaaacagaagtgaatttgtctgaattacatccatatctacataacatgaagaaaagggatccacccagtgagccgtctccactagaggctgaattccagagacttccttcatataggagctggaggacacagcacattggaaatcaagaagaaaataaaagtaaaaacaggaattctaatgtcatcccatatgactataacagagtgccacttaaacatgagctggaaatgagtaaagagagtgagcatgattcagatgaatcctctgatgatgacagtgattcagaggaaccaagcaaatacatcaatgcatcttttataatgagctactggaaacctgaagtgatgattgctgctcagggaccactgaaggagaccattggtgacttttggcagatgatcttccaaagaaaagtcaaagttattgttatgctgacagaactgaaacatggagaccaggaaatctgtgctcagtactggggagaaggaaagcaaacatatggagatattgaagttgacctgaaagacacagacaaatcttcaacttatacccttcgtgtctttgaactgagacattccaagaggaaagactctcgaactgtgtaccagtaccaatatacaaactggagtgtggagcagcttcctgcagaacccaaggaattaatctctatgattcaggtcgtcaaacaaaaacttccccagaagaattcctctgaagggaacaagcatcacaagagtacacctctactcattcactgcagggatggatctcagcaaacgggaatattttgtgctttgttaaatctcttagaaagtgcggaaacagaagaggtagtggatatttttcaagtggtaaaagctctacgcaaagctaggccaggcatggtttccacattcgagcaatatcaattcctatatgacgtcattgccagcacctaccctgctcagaatggacaagtaaagaaaaacaaccatcaagaagataaaattgaatttgataatgaagtggacaaagtaaagcaggatgctaattgtgttaatccacttggtgccccagaaaagctccctgaagcaaaggaacaggctgaaggttctgaacccacgagtggcactgaggggccagaacattctgtcaatggtcctgcaagtccagctttaaatcaaggttcataggaaaagacataaatgaggaaactccaaacctcctgttagctgttatttctatttttgtagaagtaggaagtgaaaataggtatacagtggattaattaaatgcagcgaaccaatatttgtagaagggttatattttactactgtggaaaaatatttaagatagttttgccagaacagtttgtacagacgtatgcttattttaaaattttatctcttattcagtaaaaaacaacttctttgtaatcgttatgtgtgtatatgtatgtgtgtatgggtgtgtgtttgtgtgagagacagagaaagagagagaattctttcaagtgaatctaaaagcttttgcttttcctttgtttttatgaagaaaaaatacattttatattagaagtgttaacttagcttgaaggatctgtttttaaaaatcataaactgtgtgcagactcaataaaatcatgtacatttctgaaatgacctcaagatgtcctccttgttctactcatatatatctatcttatatagtttactattttacttctagagatagtacataaaggtggtatgtgtgtgtatgctactacaaaaaagttgttaactaaattaacattgggaaatcttatattccatatattagcatttagtccaatgtctttttaagcttatttaattaaaaaatttccagtgagcttatcatgctgtctttacatggggttttcaattttgcatgctcgattattccctgtacaatatttaaaatttattgcttgatacttttgacaacaaattaggttttgtacaattgaacttaaataaatgtcattaaaataaataaatgcaatatgtattaatattcattgtataaaaatagaagaatacaaacatatttgttaaatatttacatatgaaatttaatatagctatttttatggaatttttcattgatatgaaaaatatgatattgcatatgcatagttcccatgttaaatcccattcataactttcattaaagcatttactttgaatttctccaatgcttagaatgtttttaccaggaatggatgtcgctaatcataataaaattcaaccattatttttttcttgtttataatacattgtgttatatgttcaaatatgaaatgtgtatgcacctattgaaatatgtttaatgcatttattaacatttgcaggacacttttacaggccccaattatccaatagtctaataattgtttaagatctagaaaaaaaaaatcaagaatagtggtatttttcatgaagtaataaaaactcgttttggtgaatt

SEQ ID NO: 448715 - DNA, 3981 bp, Homo sapiens
ttgtaagggaggcccccaagggaatcctggatcccccaagccatttaaatttccctgtgtaaaaaaaaacaggaaagatgccccattgggataagccggataaatatgtttgcaaatttaacccttatcgaatatgtttatcattcaacgcttcacattgcaaaagtccaccgtaatgaagggttcaatgggctatttccaacttaaaagtgtctccaagccaggtctggaacatgactgtctccatgacatcagataatagtatgcatgtcaagtgtaggcctcccagggaccgtaatggcccccatgaacgttaccatttggaagttgaagctggaaatactctggttagaaatgagtcgcataagaattgcgatttccgtgtaaaagatcttcaatattcaacagactacacttttaaggcctattttcacaatggagactatcctggagaaccctttattttacatcattcaacatcttataattctaaggcactgatagcatttctggcatttctgattattgtgacatcaatagccctgcttgttgttctctacaaaatctatgatctacataagaaaagatcctgcaatttagatgaacagcaggagcttgttgaaagggatgatgaaaaacaactgatgaatgtggagccaatccatgcagatattttgttggaaacttataagaggaagattgctgatgaaggaagactttttctggctgaatttcagagcatcccgcgggtgttcagcaagtttcctataaaggaagctcgaaagccctttaaccagaataaaaaccgttatgttgacattcttccttatgattataaccgtgttgaactctctgaaataaacggagatgcagggtcaaactacataaatgccagctatattgatggtttcaaagaacccaggaaatacattgctgcacaaggtcccagggatgaaactgttgatgatttctggaggatgatttgggaacagaaagccacagttattgtcatggtcactcgatgtgaagaaggaaacaggaacaagtgtgcagaatactggccgtcaatggaagagggcactcgggcttttggagatgttgttgtaaagatcaaccagcacaaaagatgtccagattacatcattcagaaattgaacattgtaaataaaaaagaaaaagcaactggaagagaggtgactcacattcagttcaccagctggccagaccacggggtgcctgaggatcctcacttgctcctcaaactgagaaggagagtgaatgccttcagcaatttcttcagtggtcccattgtggtgcactgcagtgctggtgttgggcgcacaggaacctatatcggaattgatgccatgctagaaggcctggaagccgagaacaaagtggatgtttatggttatgttgtcaagctaaggcgacagagatgcctgatggttcaagtagaggcccagtacatcttgatccatcaggctttggtggaatacaatcagtttggagaaacagaagtgaatttgtctgaattacatccatatctacataacatgaagaaaagggatccacccagtgagccgtctccactagaggctgaattccagagacttccttcatataggagctggaggacacagcacattggaaatcaagaagaaaataaaagtaaaaacaggaattctaatgtcatcccatatgactataacagagtgccacttaaacatgagctggaaatgagtaaagagagtgagcatgattcagatgaatcctctgatgatgacagtgattcagaggaaccaagcaaatacatcaatgcatcttttataatgagctactggaaacctgaagtgatgattgctgctcagggaccactgaaggagaccattggtgacttttggcagatgatcttccaaagaaaagtcaaagttattgttatgctgacagaactgaaacatggagaccaggaaatctgtgctcagtactggggagaaggaaagcaaacatatggagatattgaagttgacctgaaagacacagacaaatcttcaacttatacccttcgtgtctttgaactgagacattccaagaggaaagactctcgaactgtgtaccagtaccaatatacaaactggagtgtggagcagcttcctgcagaacccaaggaattaatctctatgattcaggtcgtcaaacaaaaacttccccagaagaattcctctgaagggaacaagcatcacaagagtacacctctactcattcactgcagggatggatctcagcaaacgggaatattttgtgctttgttaaatctcttagaaagtgcggaaacagaagaggtagtggatatttttcaagtggtaaaagctctacgcaaagctaggccaggcatggtttccacattcgagcaatatcaattcctatatgacgtcattgccagcacctaccctgctcagaatggacaagtaaagaaaaacaaccatcaagaagataaaattgaatttgataatgaagtggacaaagtaaagcaggatgctaattgtgttaatccacttggtgccccagaaaagctccctgaagcaaaggaacaggctgaaggttctgaacccacgagtggcactgaggggccagaacattctgtcaatggtcctgcaagtccagctttaaatcaaggttcataggaaaagacataaatgaggaaactccaaacctcctgttagctgttatttctatttttgtagaagtaggaagtgaaaataggtatacagtggattaattaaatgcagcgaaccaatatttgtagaagggttatattttactactgtggaaaaatatttaagatagttttgccagaacagtttgtacagacgtatgcttattttaaaattttatctcttattcagtaaaaaacaacttctttgtaatcgttatgtgtgtatatgtatgtgtgtatgggtgtgtgtttgtgtgagagacagagaaagagagagaattctttcaagtgaatctaaaagcttttgcttttcctttgtttttatgaagaaaaaatacattttatattagaagtgttaacttagcttgaaggatctgtttttaaaaatcataaactgtgtgcagactcaataaaatcatgtacatttctgaaatgacctcaagatgtcctccttgttctactcatatatatctatcttatatagtttactattttacttctagagatagtacataaaggtggtatgtgtgtgtatgctactacaaaaaagttgttaactaaattaacattgggaaatcttatattccatatattagcatttagtccaatgtctttttaagcttatttaattaaaaaatttccagtgagcttatcatgctgtctttacatggggttttcaattttgcatgctcgattattccctgtacaatatttaaaatttattgcttgatacttttgacaacaaattaggttttgtacaattgaacttaaataaatgtcattaaaataaataaatgcaatatgtattaatattcattgtataaaaatagaagaatacaaacatatttgttaaatatttacatatgaaatttaatatagctatttttatggaatttttcattgatatgaaaaatatgatattgcatatgcatagttcccatgttaaatcccattcataactttcattaaagcatttactttgaatttctccaatgcttagaatgtttttaccaggaatggatgtcgctaatcataataaaattcaaccattatttttttcttgtttataatacattgtgttatatgttcaaatatgaaatgtgtatgcacctattgaaatatgtttaatgcatttattaacatttgcaggacacttttacaggccccaattatccaatagtctaataattgtttaagatctagaaaaaaaaaatcaagaatagtggtatttttcatgaagtaataaaaactcgttttggtgaatt

SEQ ID NO: 448716 - DNA, 3852 bp, Homo sapiens
  misc_feature (1)..(1): n is a, c, g, or t
  misc_feature (17)..(17): n is a, c, g, or t
  misc_feature (38)..(38): n is a, c, g, or t
  misc_feature (59)..(59): n is a, c, g, or t
nttgcaattaacctacnaaaagtttcttcagcccctcntgcaaaggcaggaatgaaggngcatggtctttcccactaaagggtcctccaagccaggtctggaacatgactgtctccatgacatcagataatagtatgcatgtcaagtgtaggcctcccagggaccgtaatggcccccatgaacgttaccatttggaagttgaagctggaaatactctggttagaaatgagtcgcataagaattgcgatttccgtgtaaaagatcttcaatattcaacagactacacttttaaggcctattttcacaatggagactatcctggagaaccctttattttacatcattcaacatcttataattctaaggcactgatagcatttctggcatttctgattattgtgacatcaatagccctgcttgttgttctctacaaaatctatgatctacataagaaaagatcctgcaatttagatgaacagcaggagcttgttgaaagggatgatgaaaaacaactgatgaatgtggagccaatccatgcagatattttgttggaaacttataagaggaagattgctgatgaaggaagactttttctggctgaatttcagagcatcccgcgggtgttcagcaagtttcctataaaggaagctcgaaagccctttaaccagaataaaaaccgttatgttgacattcttccttatgattataaccgtgttgaactctctgaaataaacggagatgcagggtcaaactacataaatgccagctatattgatggtttcaaagaacccaggaaatacattgctgcacaaggtcccagggatgaaactgttgatgatttctggaggatgatttgggaacagaaagccacagttattgtcatggtcactcgatgtgaagaaggaaacaggaacaagtgtgcagaatactggccgtcaatggaagagggcactcgggcttttggagatgttgttgtaaagatcaaccagcacaaaagatgtccagattacatcattcagaaattgaacattgtaaataaaaaagaaaaagcaactggaagagaggtgactcacattcagttcaccagctggccagaccacggggtgcctgaggatcctcacttgctcctcaaactgagaaggagagtgaatgccttcagcaatttcttcagtggtcccattgtggtgcactgcagtgctggtgttgggcgcacaggaacctatatcggaattgatgccatgctagaaggcctggaagccgagaacaaagtggatgtttatggttatgttgtcaagctaaggcgacagagatgcctgatggttcaagtagaggcccagtacatcttgatccatcaggctttggtggaatacaatcagtttggagaaacagaagtgaatttgtctgaattacatccatatctacataacatgaagaaaagggatccacccagtgagccgtctccactagaggctgaattccagagacttccttcatataggagctggaggacacagcacattggaaatcaagaagaaaataaaagtaaaaacaggaattctaatgtcatcccatatgactataacagagtgccacttaaacatgagctggaaatgagtaaagagagtgagcatgattcagatgaatcctctgatgatgacagtgattcagaggaaccaagcaaatacatcaatgcatcttttataatgagctactggaaacctgaagtgatgattgctgctcagggaccactgaaggagaccattggtgacttttggcagatgatcttccaaagaaaagtcaaagttattgttatgctgacagaactgaaacatggagaccaggaaatctgtgctcagtactggggagaaggaaagcaaacatatggagatattgaagttgacctgaaagacacagacaaatcttcaacttatacccttcgtgtctttgaactgagacattccaagaggaaagactctcgaactgtgtaccagtaccaatatacaaactggagtgtggagcagcttcctgcagaacccaaggaattaatctctatgattcaggtcgtcaaacaaaaacttccccagaagaattcctctgaagggaacaagcatcacaagagtacacctctactcattcactgcagggatggatctcagcaaacgggaatattttgtgctttgttaaatctcttagaaagtgcggaaacagaagaggtagtggatatttttcaagtggtaaaagctctacgcaaagctaggccaggcatggtttccacattcgagcaatatcaattcctatatgacgtcattgccagcacctaccctgctcagaatggacaagtaaagaaaaacaaccatcaagaagataaaattgaatttgataatgaagtggacaaagtaaagcaggatgctaattgtgttaatccacttggtgccccagaaaagctccctgaagcaaaggaacaggctgaaggttctgaacccacgagtggcactgaggggccagaacattctgtcaatggtcctgcaagtccagctttaaatcaaggttcataggaaaagacataaatgaggaaactccaaacctcctgttagctgttatttctatttttgtagaagtaggaagtgaaaataggtatacagtggattaattaaatgcagcgaaccaatatttgtagaagggttatattttactactgtggaaaaatatttaagatagttttgccagaacagtttgtacagacgtatgcttattttaaaattttatctcttattcagtaaaaaacaacttctttgtaatcgttatgtgtgtatatgtatgtgtgtatgggtgtgtgtttgtgtgagagacagagaaagagagagaattctttcaagtgaatctaaaagcttttgcttttcctttgtttttatgaagaaaaaatacattttatattagaagtgttaacttagcttgaaggatctgtttttaaaaatcataaactgtgtgcagactcaataaaatcatgtacatttctgaaatgacctcaagatgtcctccttgttctactcatatatatctatcttatatagtttactattttacttctagagatagtacataaaggtggtatgtgtgtgtatgctactacaaaaaagttgttaactaaattaacattgggaaatcttatattccatatattagcatttagtccaatgtctttttaagcttatttaattaaaaaatttccagtgagcttatcatgctgtctttacatggggttttcaattttgcatgctcgattattccctgtacaatatttaaaatttattgcttgatacttttgacaacaaattaggttttgtacaattgaacttaaataaatgtcattaaaataaataaatgcaatatgtattaatattcattgtataaaaatagaagaatacaaacatatttgttaaatatttacatatgaaatttaatatagctatttttatggaatttttcattgatatgaaaaatatgatattgcatatgcatagttcccatgttaaatcccattcataactttcattaaagcatttactttgaatttctccaatgcttagaatgtttttaccaggaatggatgtcgctaatcataataaaattcaaccattatttttttcttgtttataatacattgtgttatatgttcaaatatgaaatgtgtatgcacctattgaaatatgtttaatgcatttattaacatttgcaggacacttttacaggccccaattatccaatagtctaataattgtttaagatctagaaaaaaaaaatcaagaatagtggtatttttcatgaagtaataaaaactcgttttggtgaatt

SEQ ID NO: 448717 - DNA, 3964 bp, Homo sapiens
cctggaggtggtgaacgaacaccgcacgtaaaaaaaaagcgggggaagggctgcccccatatgtataacgcacggtcgattgctttggaaaatgacaaccgaataggcaatcgttttttctgccggcgcctcattcgtgcaaaggtgacttataatataggtcccaaatgggccattcccaactaaaatgctcctcccaagccaggtggtgacacatggtgttctctagtgcaacaggttcgtggtaaggaggcaaagtgaaggcctctcagggcctgttagggccccccagggcgtaccaatttggagagttgaaactgaaaatactagggttaagaatagtctgcatcagaattgcaaattcgttgaaaaagatcttaaatttcgacagactccacttttaaggcctattttcacaatggagactatcctggagaaccctttattttacatcattcaacatcttataattctaaggcactgatagcatttctggcatttctgattattgtgacatcaatagccctgcttgttgttctctacaaaatctatgatctacataagaaaagatcctgcaatttagatgaacagcaggagcttgttgaaagggatgatgaaaaacaactgatgaatgtggagccaatccatgcagatattttgttggaaacttataagaggaagattgctgatgaaggaagactttttctggctgaatttcagagcatcccgcgggtgttcagcaagtttcctataaaggaagctcgaaagccctttaaccagaataaaaaccgttatgttgacattcttccttatgattataaccgtgttgaactctctgaaataaacggagatgcagggtcaaactacataaatgccagctatattgatggtttcaaagaacccaggaaatacattgctgcacaaggtcccagggatgaaactgttgatgatttctggaggatgatttgggaacagaaagccacagttattgtcatggtcactcgatgtgaagaaggaaacaggaacaagtgtgcagaatactggccgtcaatggaagagggcactcgggcttttggagatgttgttgtaaagatcaaccagcacaaaagatgtccagattacatcattcagaaattgaacattgtaaataaaaaagaaaaagcaactggaagagaggtgactcacattcagttcaccagctggccagaccacggggtgcctgaggatcctcacttgctcctcaaactgagaaggagagtgaatgccttcagcaatttcttcagtggtcccattgtggtgcactgcagtgctggtgttgggcgcacaggaacctatatcggaattgatgccatgctagaaggcctggaagccgagaacaaagtggatgtttatggttatgttgtcaagctaaggcgacagagatgcctgatggttcaagtagaggcccagtacatcttgatccatcaggctttggtggaatacaatcagtttggagaaacagaagtgaatttgtctgaattacatccatatctacataacatgaagaaaagggatccacccagtgagccgtctccactagaggctgaattccagagacttccttcatataggagctggaggacacagcacattggaaatcaagaagaaaataaaagtaaaaacaggaattctaatgtcatcccatatgactataacagagtgccacttaaacatgagctggaaatgagtaaagagagtgagcatgattcagatgaatcctctgatgatgacagtgattcagaggaaccaagcaaatacatcaatgcatcttttataatgagctactggaaacctgaagtgatgattgctgctcagggaccactgaaggagaccattggtgacttttggcagatgatcttccaaagaaaagtcaaagttattgttatgctgacagaactgaaacatggagaccaggaaatctgtgctcagtactggggagaaggaaagcaaacatatggagatattgaagttgacctgaaagacacagacaaatcttcaacttatacccttcgtgtctttgaactgagacattccaagaggaaagactctcgaactgtgtaccagtaccaatatacaaactggagtgtggagcagcttcctgcagaacccaaggaattaatctctatgattcaggtcgtcaaacaaaaacttccccagaagaattcctctgaagggaacaagcatcacaagagtacacctctactcattcactgcagggatggatctcagcaaacgggaatattttgtgctttgttaaatctcttagaaagtgcggaaacagaagaggtagtggatatttttcaagtggtaaaagctctacgcaaagctaggccaggcatggtttccacattcgagcaatatcaattcctatatgacgtcattgccagcacctaccctgctcagaatggacaagtaaagaaaaacaaccatcaagaagataaaattgaatttgataatgaagtggacaaagtaaagcaggatgctaattgtgttaatccacttggtgccccagaaaagctccctgaagcaaaggaacaggctgaaggttctgaacccacgagtggcactgaggggccagaacattctgtcaatggtcctgcaagtccagctttaaatcaaggttcataggaaaagacataaatgaggaaactccaaacctcctgttagctgttatttctatttttgtagaagtaggaagtgaaaataggtatacagtggattaattaaatgcagcgaaccaatatttgtagaagggttatattttactactgtggaaaaatatttaagatagttttgccagaacagtttgtacagacgtatgcttattttaaaattttatctcttattcagtaaaaaacaacttctttgtaatcgttatgtgtgtatatgtatgtgtgtatgggtgtgtgtttgtgtgagagacagagaaagagagagaattctttcaagtgaatctaaaagcttttgcttttcctttgtttttatgaagaaaaaatacattttatattagaagtgttaacttagcttgaaggatctgtttttaaaaatcataaactgtgtgcagactcaataaaatcatgtacatttctgaaatgacctcaagatgtcctccttgttctactcatatatatctatcttatatagtttactattttacttctagagatagtacataaaggtggtatgtgtgtgtatgctactacaaaaaagttgttaactaaattaacattgggaaatcttatattccatatattagcatttagtccaatgtctttttaagcttatttaattaaaaaatttccagtgagcttatcatgctgtctttacatggggttttcaattttgcatgctcgattattccctgtacaatatttaaaatttattgcttgatacttttgacaacaaattaggttttgtacaattgaacttaaataaatgtcattaaaataaataaatgcaatatgtattaatattcattgtataaaaatagaagaatacaaacatatttgttaaatatttacatatgaaatttaatatagctatttttatggaatttttcattgatatgaaaaatatgatattgcatatgcatagttcccatgttaaatcccattcataactttcattaaagcatttactttgaatttctccaatgcttagaatgtttttaccaggaatggatgtcgctaatcataataaaattcaaccattatttttttcttgtttataatacattgtgttatatgttcaaatatgaaatgtgtatgcacctattgaaatatgtttaatgcatttattaacatttgcaggacacttttacaggccccaattatccaatagtctaataattgtttaagatctagaaaaaaaaaatcaagaatagtggtatttttcatgaagtaataaaaactcgttttggtgaatt

SEQ ID NO: 448718 - DNA, 1708 bp, Homo sapiens
  misc_feature (94)..(94): n is a, c, g, or t
ccgcgcctacctccgcgcaccacggccagccagtagcgccgcgaacgtcgaagtatcgaccggcacacagacatttacaccgcactccacggantacgccgctgcatagccacagtgctccgtcactgcgcgtcactcgctctactatgacacaaacccggcgctcgctcaatgcaccacgaacactatcctcccgcatatctgcctcttcatccatcctccgtgtcaacctagtgttgtcgtctcctgacctacgcccaaccaccaccactggtctggttcataggtccatttcgaccaccggtcatccatagccctcgaaaatgttttcttccgatggccattggcaaaaatcgcgcgtgggaatatccagggagttgttttggccataaaggccggagcctgtcacctgtccaaagaaagggatcccagggcaaagcccaacaccttcccccactgatgcctaccttaatgcctctgaaacaaccactctgagcccttctggaagcgctgtcatttcaaccacaacaatagctactactccatctaagccaacatgtgatgaaaaatatgcaaacatcactgtggattacttatataacaaggaaactaaattatttacagcaaagctaaatgttaatgagaatgtggaatgtggaaacaatacttgcacaaacaatgaggtgcataaccttacagaatgtaaaaatgcgtctgtttccatatctcataattcatgtactgctcctgataagacattaatattagatgtgccaccaggggttgaaaagtttcagttacatgattgtacacaagttgaaaaagcagatactactatttgtttaaaatggaaaaatattgaaacctttacttgtgatacacagaatattacctacagatttcagtgtggtaatatgatatttgataataaagaaattaaattagaaaaccttgaacccgaacatgagtataagtgtgactcagaaatactctataataaccacaagtttactaacgcaagtaaaattattaaaacagattttgggagtccaggagagcctcagattattttttgtagaagtgaagctgcacatcaaggagtaattacctggaatccccctcaaagatcatttcataattttaccctctgttatataaaagagacaggtaatttgtgtagaatttaatttcatcagaaaagagaaatcaagaatttgaaagtactagaaatttttattgagccagtgagtcacaaagctctctgcttagagactgcataggcatagtatactccctgatcttagaattgcttccactcattcaaagctttccagccccagaaatgactaaaatccagaacattctaaatatttgcttgtccttcttggtcttagtttaaatctttgtgctccaaagcctagagacagaaaacctctggatgacaacactcatttctgtcttgcaagtattatgtaagtgatttgactcactttgactcatctttgaactcatcattcagcctcctaaacaaaccaacaaacaagcaaaccccttgtaaaacttgtttcagctaataatacagacaaaatgttgggtgaataaaaatgaacatgggcccatgtagccgctggggccagtttggtgtaatcttgggagcatagttctaagtttagaattagacttctgcagaagtaatgcaattaaaaaa

SEQ ID NO: 448719 - DNA, 920 bp, Homo sapiens
atatttattgggcatcttgttaaaaaaaaaaaggcaccgttcctggcacaagtgatttgatggacaagataagcaaggcccttgctcttatggagtttactgttaagtgggaagatggaaaaaagaaggacgcatgctgtttcttagggacacggctgacttccagatatgaccatgtatttgtggcttaaactcttggcatttggctttgcctttctggacacagaagtatttgtgacagggcaaagcccaacaccttcccccactggtgtttcatcagtacagacgcctcaccttcccacgcacgcagactcgcagacgccctctgctggaactgacacgcagacattcagcggctccgccgccaatgcaaaactcaaccctaccccaggcagcaatgctatctcagatgtcccaggagagaggagtacagccagcacctttcctacagacccagtttccccattgacaaccaccctcagccttgcacaccacagctctgctgccttacctgcacgcacctccaacaccaccatcacagcgaacacctcagatgcctaccttaatgcctctgaaacaaccactctgagcccttctggaagcgctgtcatttcaaccacaacaatagctactactccatctaagccaacatgtgatgaaaaatatgcaaacatcactgtggattacttatataacaaggaaactaaattatttacagcaaagctaaatgttaatgagaatgtggaatgtggaaacaatacttgcacaaacaatgaggtgcataaccttacagaatgtaaaaatgcgtctgtttccatatctcataattcatgtactgctcctgataagacattaatattagatgtgccaccaggtaaatatcaatttatttcttttaataaatttataaaaacagtaca

SEQ ID NO: 448720 - DNA, 1186 bp, Homo sapiens
  misc_feature (94)..(94): n is a, c, g, or t
ccgcgcctacctccgcgcaccacggccagccagtagcgccgcgaacgtcgaagtatcgaccggcacacagacatttacaccgcactccacggantacgccgctgcatagccacagtgctccgtcactgcgcgtcactcgctctactatgacacaaacccggcgctcgctcaatgcaccacgaacactatcctcccgcatatctgcctcttcatccatcctccgtgtcaacctagtgttgtcgtctcctgacctacgcccaaccaccaccactggtctggttcataggtccatttcgaccaccggtcatccatagccctcgaaaatgttttcttccgatggccattggcaaaaatcgcgcgtgggaatatccagggagttgttttggccataaaggccggagcctgtcacctgtccaaagaaagggatcccagggcaaagcccaacaccttcccccactggtgtttcatcagtacagacgcctcaccttcccacgcacgcagactcgcagacgccctctgctggaactgacacgcagacattcagcggctccgccgccaatgcaaaactcaaccctaccccaggcagcaatgctatctcagatgcctaccttaatgcctctgaaacaaccactctgagcccttctggaagcgctgtcatttcaaccacaacaataggtgatattaccctcagtcaggcagccacaccatccccatgtgcctggtgatgtgctctcacaagggccttccacccactctacctcgggctcctttctttaagttgcattaagtgtttgaatcctgagggtgatggaacagcaggaagatatttctctgcttagcagtgcaacagctgatgagatcaggatgtaattgttactgtcataattcatcagaaagcatgtgtgagaaacaaccacatctactagaactttttctcacaggggtttaggtcttagtaaggaaaagaacaagcccatcaaaggggctgtccattgcaagtggtgagcatcagacggctgatggcagagttcccgttaagcagtgagagggcgtggagataaaggaaagagaaactgaggaatggctgcagcaatggtggtatctgtgaatcagcaagtaagctgatcagagcttgcaagcccacaattctcctcaaattcttccaacccaaaaccaagatgagcag

SEQ ID NO: 448721 - DNA, 1792 bp, Homo sapiens
gggcacgagggggggctcgggctgggggcgcggcctgtgccggccgccccaccctccttgcataaaagccggagcccgcggggccggcgctctcagcccgtcggttcccgagcgccttcccggtgaccccgcagtgggtgtgtgaggggaggacggacagacccagacgccgccggaccaggaggacgctgacgaggcaccatgcgtgagatcgtgcacatccaggcgggccagtgcggcaaccagatcggcgccaagttttgggaggtcatcagtgatgagcatgggattgaccccactggcagttaccatggagacagtgatttgcagctggagagaatcaatgtttactacaatgaagccactggtaacaaatatgttcctcgggccatcctcgtggatctggagccaggcacgatggattcggttaggtctggaccattcggccagatcttcagaccagacaatttcgtgtttggccagagtggagccgggaataactgggccaagggccactacacagagggagccgagctggtcgactcggtcctggatgtggtgaggaaggagtcagagagctgtgactgtctccagggcttccagctgacccactctctggggggcggcacggggtccgggatgggcaccctgctcatcagcaagatccgggaagagtacccagaccgcatcatgaacaccttcagcgtcatgccctcacccaaggtgtcagacacggtggtggagccctacaacgccaccctctcggtccaccagctggtggaaaacacagatgaaacctactgcattgacaacgaggccctgtatgacatctgcttccgcaccctgaagctgaccacccccacctacggggacctcaaccacctggtgtcggccaccatgagcggggtcaccacctgcctgcgcttcccgggccagctgaacgcagacctgcgcaagctggcggtgaacatggtgcccttccctcgcctgcacttcttcatgcccggcttcgcgcccctgaccagccggggcagccagcagtaccgggcgctcacggtgcccgagctcacccagcagatgttcgactccaagaacatgatggccgcctgcgacccgcgccacggccgctacctgacggtggctgccatcttccggggccgcatgtccatgaaggaggtggacgagcagatgctcaacgtgcagaacaagaacagcagctacttcgtggagtggatccccaacaacgtgaagacggccgtgtgcgacatcccgccccgcggcctgaagatgtcggccaccttcatcggcaacagcacggccatccaggagctgttcaagcgcatctccgagcagttcacggccatgttccggcgcaaggccttcctgcactggtacacgggcgagggcatggacgagatggagttcaccgaggccgagagcaacatgaacgacctggtgtccgagtaccagcagtaccaggacgccacggccgacgaacaaggggagttcgaggaggaggagggcgaggacgaggcgtagatgcccccgcgagacgggttagggaaagcggaggaggaaagcgagggggtggggggcttcccgggacgataacctggcagtggaaggaaagaagcatggtctactttaggtgtgcgctgggtctctggtgctcttcactgttgcctgtcacttttttttccttttttgtaatattgatgacatcaatgtaacatttgagatatttctgaattactgttgtaatggctaaaatcacataaacgtttgtgtcgga

SEQ ID NO: 448722 - DNA, 326 bp, Homo sapiens
gagagagagagagagagagagagagagagagagagagagagagagagagagagagagagagagagaggcgtagatgcccccgcgagacgggttagggaaagcggaggaggaaagcgagggggtggggggcttcccgggacgataacctggcagtggaaggaaagaagcatggtctactttaggtgtgcgctgggtctctggtgctcttcactgttgcctgtcacttttttttccttttttgtaatattgatgacatcaatgtaacatttgagatatttctgaattactgttgtaatggctaaaatcacataaacgtttgtgtcgga

SEQ ID NO: 448723 - DNA, 2027 bp, Homo sapiens
gggcacgagggggggctcgggctgggggcgcggcctgtgccggccgccccaccctccttgcataaaagccggagcccgcggggccggcgctctcagcccgtcggttcccgagcgccttcccggtgaccccgcagtgggtgtgtgaggggaggacggacagacccagacgccgccggaccaggaggacgctgacgaggcaccatgcgtgagatcgtgcacatccaggcgggccagtgcggcaaccagatcggcgccaagttttgggaggtcatcagtgatgagcatgggattgaccccactggcagttaccatggagacagtgatttgcagctggagagaatcaatgtttactacaatgaagccactggtaacaaatatgttcctcgggccatcctcgtggatctggagccaggcacgatggattcggttaggtctggaccattcggccagatcttcagaccagacaatttcgtgtttggccagagtggagccgggaataactgggccaagggccactacacagagggagccgagctggtcgactcggtcctggatgtggtgaggaaggagtcagagagctgtgactgtctccagggcttccagctgacccactctctggggggcggcacggggtccgggatgggcaccctgctcatcagcaagatccgggaagagtacccagaccgcatcatgaacaccttcagcgtcatgccctcacccaaggtgtcagacacggtggtggagccctacaacgccaccctctcggtccaccagctggtggaaaacacagatgaaacctactgcattgacaacgaggccctgtatgacatctgcttccgcaccctgaagctgaccacccccacctacggggacctcaaccacctggtgtcggccaccatgagcggggtcaccacctgcctgcgcttcccgggccagctgaacgcagacctgcgcaagctggcggtgaacatggtgcccttccctcgcctgcacttcttcatgcccggcttcgcgcccctgaccagccggggcagccagcagtaccgggcgctcacggtgcccgagctcacccagcagatgttcgactccaagaacatgatggccgcctgcgacccgcgccacggccgctacctgacggtggctgccatcttccggggccgcatgtccatgaaggaggtggacgagcagatgctcaacgtgcagaacaagaacagcagctacttcgtggagtggatccccaacaacgtgaagacggccgtgtgcgacatcccgccccgcggcctgaagatgtcggccaccttcatcggcaacagcacggccatccaggagctgttcaagcgcatctccgagcagttcacggccatgttccggcgcaaggccttcctgcactggtacacgggcgagggcatggacgagatggagttcaccgaggccgagagcaacatgaacgacctggtgtccgagtaccagcagtaccaggacgccacggccgacgaacaaggggagttcgaggaggaggagggcgaggacgaggcgtagatgcccccgcgagacgggttagggaaagcggaggaggaaagcgagggggtggggggcttcccgggacgataacctggcagtggaaggaaagaagcatggtctactttaggtgtgcgctgggtctctggtgctcttcactgttgcctgtcacttttttttccttttttgtaatattgatgacatcaatgtaacatttgagatatttctgaattactgttgtaatggctaaaatcacataaacgtttgtgtcggaatggtgtcctctctttctcttcctttttctctttattaacgatttaaatgtaactttctgaacacattgcattgaattcttcctttaacaaaaagcaaaggcgtaggtaaaagctcaaatgaatttattctttcggtatggtaaaattgaaccaatcacagttaagatgagagatcaacctgagttttaaaatacctttaataaatattagtgaaaaaatgtctacttgaagcac

SEQ ID NO: 448724 - DNA, 1727 bp, Homo sapiens
gggcacgagggggggctcgggctgggggcgcggcctgtgccggccgccccaccctccttgcataaaagccggagcccgcggggccggcgctctcagcccgtcggttcccgagcgccttcccggtgaccccgcagtgggtgtgtgaggggaggacggacagacccagacgccgccggaccaggaggacgctgacgaggcaccatgcgtgagatcgtgcacatccaggcgggccagtgcggcaaccagatcggcgccaagttttgggaggtcatcagtgatgagcatgggattgaccccactggcagttaccatggagacagtgatttgcagctggagagaatcaatgtttactacaatgaagccactggtaacaaatatgttcctcgggccatcctcgtggatctggagccaggcacgatggattcggttaggtctggaccattcggccagatcttcagaccagacaatttcgtgtttggccagagtggagccgggaataactgggccaagggccactacacagagggagccgagctggtcgactcggtcctggatgtggtgaggaaggagtcagagagctgtgactgtctccagggcttccagctgacccactctctggggggcggcacggggtccgggatgggcaccctgctcatcagcaagatccgggaagagtacccagaccgcatcatgaacaccttcagcgtcatgccctcacccaaggtgtcagacacggtggtggagccctacaacgccaccctctcggtccaccagctggtggaaaacacagatgaaacctactgcattgacaacgaggccctgtatgacatctgcttccgcaccctgaagctgaccacccccacctacggggacctcaaccacctggtgtcggccaccatgagcggggtcaccacctgcctgcgcttcccgggccagctgaacgcagacctgcgcaagctggcggtgaacatggtgcccttccctcgcctgcacttcttcatgcccggcttcgcgcccctgaccagccggggcagccagcagtaccgggcgctcacggtgcccgagctcacccagcagatgttcgactccaagaacatgatggccgcctgcgacccgcgccacggccgctacctgacggtggctgccatcttccggggccgcatgtccatgaaggaggtggacgagcagatgctcaacgtgcagaacaagaacagcagctacttcgtggagtggatccccaacaacgtgaagacggccgtgtgcgacatcccgccccgcggcctgaagatgtcggccaccttcatcggcaacagcacggccatccaggagctgttcaagcgcatctccgagcagttcacggccatgttccggcgcaaggccttcctgcactggtacacgggcgagggcatggacgagatggagttcaccgaggccgagagcaacatgaacgacctggtgtccgagtaccagcagtaccaggacgccacggccgacgaacaaggggagttcgaggaggaggagggcgaggacgattaaaaacttctcagatcaatcgtgcatccttagtgaacttctgttgtcctcaagcatggtctttctacttgtaaactatggtgctcagttttgcctctgttagaaattcacactgttgatgtaatgatgtggaactcctctaaaaattacagtattgtctgtgaaggtatctatactaataaaaaagcatgtgt

SEQ ID NO: 448725 - DNA, 1766 bp, Homo sapiens
gggcacgagggggggctcgggctgggggcgcggcctgtgccggccgccccaccctccttgcataaaagccggagcccgcggggccggcgctctcagcccgtcggttcccgagcgccttcccggtgaccccgcagtgggtgtgtgaggggaggacggacagacccagacgccgccggaccaggaggacgctgacgaggcaccatgcgtgagatcgtgcacatccaggcgggccagtgcggcaaccagatcggcgccaagttttgggaggtcatcagtgatgagcatgggattgaccccactggcagttaccatggagacagtgatttgcagctggagagaatcaatgtttactacaatgaagccactggtaacaaatatgttcctcgggccatcctcgtggatctggagccaggcacgatggattcggttaggtctggaccattcggccagatcttcagaccagacaatttcgtgtttggccagagtggagccgggaataactgggccaagggccactacacagagggagccgagctggtcgactcggtcctggatgtggtgaggaaggagtcagagagctgtgactgtctccagggcttccagctgacccactctctggggggcggcacggggtccgggatgggcaccctgctcatcagcaagatccgggaagagtacccagaccgcatcatgaacaccttcagcgtcatgccctcacccaaggtgtcagacacggtggtggagccctacaacgccaccctctcggtccaccagctggtggaaaacacagatgaaacctactgcattgacaacgaggccctgtatgacatctgcttccgcaccctgaagctgaccacccccacctacggggacctcaaccacctggtgtcggccaccatgagcggggtcaccacctgcctgcgcttcccgggccagctgaacgcagacctgcgcaagctggcggtgaacatggtgcccttccctcgcctgcacttcttcatgcccggcttcgcgcccctgaccagccggggcagccagcagtaccgggcgctcacggtgcccgagctcacccagcagatgttcgactccaagaacatgatggccgcctgcgacccgcgccacggccgctacctgacggtggctgccatcttccggggccgcatgtccatgaaggaggtggacgagcagatgctcaacgtgcagaacaagaacagcagctacttcgtggagtggatccccaacaacgtgaagacggccgtgtgcgacatcccgccccgcggcctgaagatgtcggccaccttcatcggcaacagcacggccatccaggagctgttcaagcgcatctccgagcagttcacggccatgttccggcgcaaggccttcctgcactggtacacgggcgagggcatggacgagatggagttcaccgaggccgagagcaacatgaacgacctggtgtccgagtaccagcagtaccaggacgccacggccgacgaacaaggggagttcgaggaggaggagggcgaggacgattaaaaacttctcagatcaatcgtgcatccttagtgaacttctgttgtcctcaagcatggtctttctacttgtaaactatggtgctcagttttgcctctgttagaaattcacactgttgatgtaatgatgtggaactcctctaaaaattacagtattgtctgtgaaggtatctatactaataaaaaagcatgtgtcgagcaacgcacggacccaccaagaacagaaacaaaaaa

SEQ ID NO: 448726 - DNA, 1708 bp, Homo sapiens
ggaaatggcgccctagaaaagccaggatgctactccctccgccgatttgtaggacaaagcaggcaaagctctttcgtggaagctcggctctctcagtcccgaccgaggccattataactcaaattcacaacctccggggatgcgaaaacacccggccttactgaggaacaaaggttttgggaggtcatcagtgatgagcatgggattgaccccactggcagttaccatggagacagtgatttgcagctggagagaatcaatgtttactacaatgaagccactggtaacaaatatgttcctcgggccatcctcgtggatctggagccaggcacgatggattcggttaggtctggaccattcggccagatcttcagaccagacaatttcgtgtttggccagagtggagccgggaataactgggccaagggccactacacagagggagccgagctggtcgactcggtcctggatgtggtgaggaaggagtcagagagctgtgactgtctccagggcttccagctgacccactctctggggggcggcacggggtccgggatgggcaccctgctcatcagcaagatccgggaagagtacccagaccgcatcatgaacaccttcagcgtcatgccctcacccaaggtgtcagacacggtggtggagccctacaacgccaccctctcggtccaccagctggtggaaaacacagatgaaacctactgcattgacaacgaggccctgtatgacatctgcttccgcaccctgaagctgaccacccccacctacggggacctcaaccacctggtgtcggccaccatgagcggggtcaccacctgcctgcgcttcccgggccagctgaacgcagacctgcgcaagctggcggtgaacatggtgcccttccctcgcctgcacttcttcatgcccggcttcgcgcccctgaccagccggggcagccagcagtaccgggcgctcacggtgcccgagctcacccagcagatgttcgactccaagaacatgatggccgcctgcgacccgcgccacggccgctacctgacggtggctgccatcttccggggccgcatgtccatgaaggaggtggacgagcagatgctcaacgtgcagaacaagaacagcagctacttcgtggagtggatccccaacaacgtgaagacggccgtgtgcgacatcccgccccgcggcctgaagatgtcggccaccttcatcggcaacagcacggccatccaggagctgttcaagcgcatctccgagcagttcacggccatgttccggcgcaaggccttcctgcactggtacacgggcgagggcatggacgagatggagttcaccgaggccgagagcaacatgaacgacctggtgtccgagtaccagcagtaccaggacgccacggccgacgaacaaggggagttcgaggaggaggagggcgaggacgaggcgtagatgcccccgcgagacgggttagggaaagcggaggaggaaagcgagggggtggggggcttcccgggacgataacctggcagtggaaggaaagaagcatggtctactttaggtgtgcgctgggtctctggtgctcttcactgttgcctgtcacttttttttccttttttgtaatattgatgacatcaatgtaacatttgagatatttctgaattactgttgtaatggctaaaatcacataaacgtttgtgtcgga

SEQ ID NO: 448727 - DNA, 1982 bp, Homo sapiens
gggcacgagggggggctcgggctgggggcgcggcctgtgccggccgccccaccctccttgcataaaagccggagcccgcggggccggcgctctcagcccgtcggttcccgagcgccttcccggtgaccccgcagtgggtgtgtgaggggaggacggacagacccagacgccgccggaccaggaggacgctgacgaggcaccatgcgtgagatcgtgcacatccaggcgggccagtgcggcaaccagatcggcgccaagttttgggaggtcatcagtgatgagcatgggattgaccccactggcagttaccatggagacagtgatttgcagctggagagaatcaatgtttactacaatgaagccactggtaacaaatatgttcctcgggccatcctcgtggatctggagccaggcacgatggattcggttaggtctggaccattcggccagatcttcagaccagacaatttcgtgtttggccagagtggagccgggaataactgggccaagggccactacacagagggagccgagctggtcgactcggtcctggatgtggtgaggaaggagtcagagagctgtgactgtctccagggcttccagctgacccactctctggggggcggcacggggtccgggatgggcaccctgctcatcagcaagatccgggaagagtacccagaccgcatcatgaacaccttcagcgtcatgcccctctcggtccaccagctggtggaaaacacagatgaaacctactgcattgacaacgaggccctgtatgacatctgcttccgcaccctgaagctgaccacccccacctacggggacctcaaccacctggtgtcggccaccatgagcggggtcaccacctgcctgcgcttcccgggccagctgaacgcagacctgcgcaagctggcggtgaacatggtgcccttccctcgcctgcacttcttcatgcccggcttcgcgcccctgaccagccggggcagccagcagtaccgggcgctcacggtgcccgagctcacccagcagatgttcgactccaagaacatgatggccgcctgcgacccgcgccacggccgctacctgacggtggctgccatcttccggggccgcatgtccatgaaggaggtggacgagcagatgctcaacgtgcagaacaagaacagcagctacttcgtggagtggatccccaacaacgtgaagacggccgtgtgcgacatcccgccccgcggcctgaagatgtcggccaccttcatcggcaacagcacggccatccaggagctgttcaagcgcatctccgagcagttcacggccatgttccggcgcaaggccttcctgcactggtacacgggcgagggcatggacgagatggagttcaccgaggccgagagcaacatgaacgacctggtgtccgagtaccagcagtaccaggacgccacggccgacgaacaaggggagttcgaggaggaggagggcgaggacgaggcgtagatgcccccgcgagacgggttagggaaagcggaggaggaaagcgagggggtggggggcttcccgggacgataacctggcagtggaaggaaagaagcatggtctactttaggtgtgcgctgggtctctggtgctcttcactgttgcctgtcacttttttttccttttttgtaatattgatgacatcaatgtaacatttgagatatttctgaattactgttgtaatggctaaaatcacataaacgtttgtgtcggaatggtgtcctctctttctcttcctttttctctttattaacgatttaaatgtaactttctgaacacattgcattgaattcttcctttaacaaaaagcaaaggcgtaggtaaaagctcaaatgaatttattctttcggtatggtaaaattgaaccaatcacagttaagatgagagatcaacctgagttttaaaatacctttaataaatattagtgaaaaaatgtctacttgaagcac

SEQ ID NO: 448728 - DNA, 561 bp, Homo sapiens
gagagagagagagagagagagagagagagagagagagagagagagagagagagagagagagagagaggcgtagatgcccccgcgagacgggttagggaaagcggaggaggaaagcgagggggtggggggcttcccgggacgataacctggcagtggaaggaaagaagcatggtctactttaggtgtgcgctgggtctctggtgctcttcactgttgcctgtcacttttttttccttttttgtaatattgatgacatcaatgtaacatttgagatatttctgaattactgttgtaatggctaaaatcacataaacgtttgtgtcggaatggtgtcctctctttctcttcctttttctctttattaacgatttaaatgtaactttctgaacacattgcattgaattcttcctttaacaaaaagcaaaggcgtaggtaaaagctcaaatgaatttattctttcggtatggtaaaattgaaccaatcacagttaagatgagagatcaacctgagttttaaaatacctttaataaatattagtgaaaaaatgtctacttgaagcac

SEQ ID NO: 448729 - DNA, 400 bp, Homo sapiens
  misc_feature (16)..(16): n is a, c, g, or t
ttgtaaaaaaagaggntggtacggtccggaattcccgggatggttcccgagcgccttcccggtgaccccgcagtgggtgtgtgaggggaggacggacagacccagacgccgccggaccaggaggacgctgacgaggcaccatgcgtgagatcgtgcacatccaggcgggccagtgcggcaaccagatcggcgccaagttttgggaggtcatcagtgatgagcatgggtggaaggaaagaagcatggtctactttaggtgtgcgctgggtctctggtgctcttcactgttgcctgtcacttttttttccttttttgtaatattgatgacatcaatgtaacatttgagatatttctgaattactgttgtaatggctaaaatcacataaacgtttgtgtcgga

SEQ ID NO: 448730 - DNA, 868 bp, Homo sapiens
gctcacttgacacctagcagcgcctcatcctggactgaccttcgtgggaggagcctccatgcacattcgtggcgcacggacgaggtgtcagtgagggctgcggtatctgcaccatcgtctgctgcctcaaaattggagctggaagaagccctccgaaccatcctgcttatattgcttgtacgcgacggtcccagggaatggtgacgagctgaggacatacatgtggcgtgtccaaatatgagaggcgcctacaagtgatggaatccacagaagctctgagcaacatgaacgacctggtgtccgagtaccagcagtaccaggacgccacggccgacgaacaaggggagttcgaggaggaggagggcgaggacgaggcgtagatgcccccgcgagacgggttagggaaagcggaggaggaaagcgagggggtggggggcttcccgggacgataacctggcagtggaaggaaagaagcatggtctactttaggtgtgcgctgggtctctggtgctcttcactgttgcctgtcacttttttttccttttttgtaatattgatgacatcaatgtaacatttgagatatttctgaattactgttgtaatggctaaaatcacataaacgtttgtgtcggaatggtgtcctctctttctcttcctttttctctttattaacgatttaaatgtaactttctgaacacattgcattgaattcttcctttaacaaaaagcaaaggcgtaggtaaaagctcaaatgaatttattctttcggtatggtaaaattgaaccaatcacagttaagatgagagatcaacctgagttttaaaatacctttaataaatattagtgaaaaaatgtctacttgaagcac

SEQ ID NO: 448731 - DNA, 1731 bp, Homo sapiens
  misc_feature (16)..(16): n is a, c, g, or t
ttgtaaaaaaagaggntggtacggtccggaattcccgggatggttcccgagcgccttcccggtgaccccgcagtgggtgtgtgaggggaggacggacagacccagacgccgccggaccaggaggacgctgacgaggcaccatgcgtgagatcgtgcacatccaggcgggccagtgcggcaaccagatcggcgccaagttttgggaggtcatcagtgatgagcatgggattgaccccactggcagttaccatggagacagtgatttgcagctggagagaatcaatgtttactacaatgaagccactggtaacaaatatgttcctcgggccatcctcgtggatctggagccaggcacgatggattcggttaggtctggaccattcggccagatcttcagaccagacaatttcgtgtttggccagagtggagccgggaataactgggccaagggccactacacagagggagccgagctggtcgactcggtcctggatgtggtgaggaaggagtcagagagctgtgactgtctccagggcttccagctgacccactctctggggggcggcacggggtccgggatgggcaccctgctcatcagcaagatccgggaagagtacccagaccgcatcatgaacaccttcagcgtcatgccctcacccaaggtgtcagacacggtggtggagccctacaacgccaccctctcggtccaccagctggtggaaaacacagatgaaacctactgcattgacaacgaggccctgtatgacatctgcttccgcaccctgaagctgaccacccccacctacggggacctcaaccacctggtgtcggccaccatgagcggggtcaccacctgcctgcgcttcccgggccagctgaacgcagacctgcgcaagctggcggtgaacatggtgcccttccctcgcctgcacttcttcatgcccggcttcgcgcccctgaccagccggggcagccagcagtaccgggcgctcacggtgcccgagctcacccagcagatgttcgactccaagaacatgatggccgcctgcgacccgcgccacggccgctacctgacggtggctgccatcttccggggccgcatgtccatgaaggaggtggacgagcagatgctcaacgtgcagaacaagaacagcagctacttcgtggagtggatccccaacaacgtgaagacggccgtgtgcgacatcccgccccgcggcctgaagatgtcggccaccttcatcggcaacagcacggccatccaggagctgttcaagcgcatctccgagcagttcacggccatgttccggcgcaaggccttcctgcactggtacacgggcgagggcatggacgagatggagttcaccgaggccgagagcaacatgaacgacctggtgtccgagtaccagcagtaccaggacgccacggccgacgaacaaggggagttcgaggaggaggagggcgaggacgaggcgtagatgcccccgcgagacgggttagggaaagcggaggaggaaagcgagggggtggggggcttcccgggacgataacctggcagtggaaggaaagaagcatggtctactttaggtgtgcgctgggtctctggtgctcttcactgttgcctgtcacttttttttccttttttgtaatattgatgacatcaatgtaacatttgagatatttctgaattactgttgtaatggctaaaatcacataaacgtttgtgtcgga

SEQ ID NO: 448732 - DNA, 1340 bp, Homo sapiens
gggcacgagggggggctcgggctgggggcgcggcctgtgccggccgccccaccctccttgcataaaagccggagcccgcggggccggcgctctcagcccgtcggttcccgagcgccttcccggtgaccccgcagtgggtgtgtgaggggaggacggacagacccagacgccgccggaccaggaggacgctgacgaggcaccatgcgtgagatcgtgcacatccaggcgggccagtgcggcaaccagatcggcgccaagttttgggaggtcatcagtgatgagcatgggattgaccccactggcagttaccatggagacagtgatttgcagctggagagaatcaatgtttactacaatgaagccactggtaacaaatatgttcctcgggccatcctcgtggatctggagccaggcacgatggattcggttaggtctggaccattcggccagatcttcagaccagacaatttcgtgtttggccagagtggagccgggaataactgggccaagggccactacacagagggagccgagctggtcgactcggtcctggatgtggtgaggaaggagtcagagagctgtgactgtctccagggcttccagctgacccactctctggggggcggcacggggtccgggatgggcaccctgctcatcagcaagatccgggaagagtacccagaccgcatcatgaacaccttcagcgtcatgccctcacccaaggtgtcagacacggtggtggagccctacaacgccaccctctcggtccaccagctggtggaaaacacagatgaaacctactgcattgacaacgaggccctgtatgacatctgcttccgcaccctgaagctgaccacccccacctacggggacctcaaccacctggtgtcggccaccatgagcggggtcaccacctgcctgcgcttcccgggccagctgaacgcagacctgcgcaagctggcggtgaacatggtgcccttccctcgcctgcacttcttcatgcccggcttcgcgcccctgaccagccggggcagccagcagtaccgggcgctcacggtgcccgagctcacccagcagatgttcgactccaagaacatgatggccgcctgcgaccggccaggcgtactgaggggtggcatcttcgggcgctgtcatgagggggggcacgatgtcaggggggaacaaacgggtatttgggagggtcccaaaacggaaaagcgggggattgccccggcgaaattggcctctcgaaagcgacaggggaggctcgaagaggatcgcgggcatgacggggggaaagacggaaaaacggtacaagcgcaagaaaagtcacaatgggg

SEQ ID NO: 448733 - DNA, 1552 bp, Homo sapiens
gccctttgagaacctgatggtgggtctccctttgtttggggcaacatctgcatgatggcagcaggcgccaagcccttctctgcagaggtccttgcctgagggtctaagtcactgttgttccttgcaggtaacaaatatgttcctcgggccatcctcgtggatctggagccaggcacgatggattcggttaggtctggaccattcggccagatcttcagaccagacaatttcgtgtttggccagagtggagccgggaataactgggccaagggccactacacagagggagccgagctggtcgactcggtcctggatgtggtgaggaaggagtcagagagctgtgactgtctccagggcttccagctgacccactctctggggggcggcacggggtccgggatgggcaccctgctcatcagcaagatccgggaagagtacccagaccgcatcatgaacaccttcagcgtcatgccctcacccaaggtgtcagacacggtggtggagccctacaacgccaccctctcggtccaccagctggtggaaaacacagatgaaacctactgcattgacaacgaggccctgtatgacatctgcttccgcaccctgaagctgaccacccccacctacggggacctcaaccacctggtgtcggccaccatgagcggggtcaccacctgcctgcgcttcccgggccagctgaacgcagacctgcgcaagctggcggtgaacatggtgcccttccctcgcctgcacttcttcatgcccggcttcgcgcccctgaccagccggggcagccagcagtaccgggcgctcacggtgcccgagctcacccagcagatgttcgactccaagaacatgatggccgcctgcgacccgcgccacggccgctacctgacggtggctgccatcttccggggccgcatgtccatgaaggaggtggacgagcagatgctcaacgtgcagaacaagaacagcagctacttcgtggagtggatccccaacaacgtgaagacggccgtgtgcgacatcccgccccgcggcctgaagatgtcggccaccttcatcggcaacagcacggccatccaggagctgttcaagcgcatctccgagcagttcacggccatgttccggcgcaaggccttcctgcactggtacacgggcgagggcatggacgagatggagttcaccgaggccgagagcaacatgaacgacctggtgtccgagtaccagcagtaccaggacgccacggccgacgaacaaggggagttcgaggaggaggagggcgaggacgaggcgtagatgcccccgcgagacgggttagggaaagcggaggaggaaagcgagggggtggggggcttcccgggacgataacctggcagtggaaggaaagaagcatggtctactttaggtgtgcgctgggtctctggtgctcttcactgttgcctgtcacttttttttccttttttgtaatattgatgacatcaatgtaacatttgagatatttctgaattactgttgtaatggctaaaatcacataaacgtttgtgtcgga

SEQ ID NO: 448734 - DNA, 1964 bp, Homo sapiens
gggcacgagggggggctcgggctgggggcgcggcctgtgccggccgccccaccctccttgcataaaagccggagcccgcggggccggcgctctcagcccgtcggttcccgagcgccttcccggtgaccccgcagtgggtgtgtgaggggaggacggacagacccagacgccgccggaccaggaggacgctgacgaggcaccatgcgtgagatcgtgcacatccaggcgggccagtgcggcaaccagatcggcgccaagttttgggaggtcatcagtgatgagcatgggattgaccccactggcagttaccatggagacagtgatttgcagctggagagaatcaatgtttactacaatgaagccactggtaacaaatatgttcctcgggccatcctcgtggatctggagccaggcacgatggattcggttaggtctggaccattcggccagatcttcagaccagacaatttcgtgtttggccagagtggagccgggaataactgggccaagggccactacacagagggagccgagctggtcgactcggtcctggatgtggtgaggaaggagtcagagagctgtgactgtctccagggcttccagctgacccactctctggggggcggcacggggtccgggatgggcaccctgctcatcagcaagatccgggaagagtacccagaccgcatcatgaacaccttcagcgtcatgccctcacccaaggtgtcagacacggtggtggagccctacaacgccaccctctcggtccaccagctggtggaaaacacagatgaaacctactgcattgacctcaaccacctggtgtcggccaccatgagcggggtcaccacctgcctgcgcttcccgggccagctgaacgcagacctgcgcaagctggcggtgaacatggtgcccttccctcgcctgcacttcttcatgcccggcttcgcgcccctgaccagccggggcagccagcagtaccgggcgctcacggtgcccgagctcacccagcagatgttcgactccaagaacatgatggccgcctgcgacccgcgccacggccgctacctgacggtggctgccatcttccggggccgcatgtccatgaaggaggtggacgagcagatgctcaacgtgcagaacaagaacagcagctacttcgtggagtggatccccaacaacgtgaagacggccgtgtgcgacatcccgccccgcggcctgaagatgtcggccaccttcatcggcaacagcacggccatccaggagctgttcaagcgcatctccgagcagttcacggccatgttccggcgcaaggccttcctgcactggtacacgggcgagggcatggacgagatggagttcaccgaggccgagagcaacatgaacgacctggtgtccgagtaccagcagtaccaggacgccacggccgacgaacaaggggagttcgaggaggaggagggcgaggacgaggcgtagatgcccccgcgagacgggttagggaaagcggaggaggaaagcgagggggtggggggcttcccgggacgataacctggcagtggaaggaaagaagcatggtctactttaggtgtgcgctgggtctctggtgctcttcactgttgcctgtcacttttttttccttttttgtaatattgatgacatcaatgtaacatttgagatatttctgaattactgttgtaatggctaaaatcacataaacgtttgtgtcggaatggtgtcctctctttctcttcctttttctctttattaacgatttaaatgtaactttctgaacacattgcattgaattcttcctttaacaaaaagcaaaggcgtaggtaaaagctcaaatgaatttattctttcggtatggtaaaattgaaccaatcacagttaagatgagagatcaacctgagttttaaaatacctttaataaatattagtgaaaaaatgtctacttgaagcac

SEQ ID NO: 448735 - DNA, 381 bp, Homo sapiens
ctcaggtgatctgcccaccttgggcaatcccaaaatgttgggattacaggcatgagccaccacgcctggggaaggggcctcttttggtgaaaaggcaagggcactactcctattcattagtgttctacgcttacgacctaatcacctcccagaggacccacctcctcattccattgtattgggaattagtcttcaaaatatgaattttagggagacacaaacattcagaccctagcagggaccctggaaaggattctcattgtgcagagtatggataaacagtgatgctagggcagtttttccagggttgtcagaaagggctgaactagaagtttccccactgtgcctggagtgccctgggttggttgagtgtagggtttc

SEQ ID NO: 448736 - DNA, 1614 bp, Homo sapiens
cccccccccccccccacccccacccgccgcaccacaccggccagcaagaccccgcaaacttaggctaggtacgaggcctggtgttagcggtgcgacgaaggagtaggtggtgggatctcaccgtgggtccgattagccttttctctgccttgcttgcttgagcttcagcggaattcgaaatggctggcggtaaggctggaaaggactccggaaaggccaagacaaaggcggtttcccgctcgcagagagccggcttgcagttcccagtgggccgtattcatcgacacctaaaatctaggacgaccagtcatggacgtgtgggcgcgactgccgctgtgtacagcgcagccatcctggagtacctcaccgcagaggtacttgaactggcaggaaatgcatcaaaagacttaaaggtaaagcgtattacccctcgtcacttgcaacttgctattcgtggagatgaagaattggattctctcatcaaggctacaattgctggtggtggtgtcattccacacatccacaaatctctgattgggaagaaaggacaacagaagactgtctaaaggatgcctggattccttgttatctcaggactctaaatactctaacagctgtccagtgttggtgattccagtggactgtatctctgtgaaaaacacaattttgcctttttgtaattctatttgagcaagttggaagtttaattagctttccaaccaaccaaatttctgcattcgagtcttaaccatatttaagtgttactgtggcttcaaagaagctattgattctgaagtagtgggttttgattgagttgactgtttttaaaaaactgtttggattttaattgtgatgcagaagttatagtaacaaacatttggttttgtacagacattatttccactctggtggataagttcaataaaggtcatatcccaaaaaaaaaaaaaaaacagaaacaaaaaaaacacaaacaaagcaaaaaagaaaggaatactacatcatgcagaagcacgacgggagagaggccgggacggtcggccggaggcgcggccgcgcgcgagggccgcagcctgcgcgagcacatagatgatagccgatggaggtgagagtgcgcatcgcttaccttacacagcgagacgacgcaggcaggaatcgcaaggtgacactcacccgggtgtgggatgagagcagtgagcagctgaaggtggtggtgggtagcagacatagagggcgagcggtgaacactactattgggagtagacgggttcgagcgccgtcttctcggcgagcgtcatggaacatgccgtagtcctcgcatggtattcggtgtgcgatcgagtgagacttaagataggtgggcagagatagaagtgtgatctgggatcagagccgggctcacctggatgacgacgagcgaggagaacgaagacaaagacacggagaggaggaaaaactacgcagatcacgacgagcggtggagaccgagagccggaatgcggtggcagcgagcaagagggaacagagagatgcgcgcaacgacgagggagacgggaaccagtgcggtcaccatgactgccggggcgaatgaagcagcaggagacgaagcgaggc

SEQ ID NO: 448737 - DNA, 977 bp, Homo sapiens
agccattggtgggatgagcaatccgagttcccggatgagggaacattctgcagtataaagggagcagggaaggcgggagacagcgcagtttgaatcgcggtgcgacgaaggagtaggtggtgggatctcaccgtgggtccgattagccttttctctgccttgcttgcttgagcttcagcggaattcgaaatggctggcggtaaggctggaaaggactccggaaaggccaagacaaaggcggtttcccgctcgcagagagccggcttgcagttcccagtgggccgtattcatcgacacctaaaatctaggacgaccagtcatggacgtgtgggcgcgactgccgctgtgtacagcgcagccatcctggagtacctcaccgcagaggtacttgaactggcaggaaatgcatcaaaagacttaaaggtaaagcgtattacccctcgtcacttgcaacttgctattcgtggagatgaagaattggattctctcatcaaggctacaattgctggtggtggtgtcattccacacatccacaaatctctgattgggaagaaaggacaacagaagactgtctaaaggatgcctggattccttgttatctcaggactctaaatactctaacagctgtccagtgttggtgattccagtggactgtatctctgtgaaaaacacaattttgcctttttgtaattctatttgagcaagttggaagtttaattagctttccaaccaaccaaatttctgcattcgagtcttaaccatatttaagtgttactgtggcttcaaagaagctattgattctgaagtagtgggttttgattgagttgactgtttttaaaaaactgtttggattttaattgtgatgcagaagttatagtaacaaacatttggttttgtacagacattatttccactctggtggataagttcaataaaggtcatatcccaaaactagttgtgtattaaatttgcttggt

SEQ ID NO: 448738 - DNA, 879 bp, Homo sapiens
  misc_feature (843)..(843): n is a, c, g, or t
  misc_feature (845)..(845): n is a, c, g, or t
agccattggtgggatgagcaatccgagttcccggatgagggaacattctgcagtataaagggagcagggaaggcgggagacagcgcagtttgaatcgcggtgcgacgaaggagtaggtggtgggatctcaccgtgggtccgattagccttttctctgccttgcttgcttgagcttcagcggaattcgaaatggctggcggtaaggctggaaaggactccggaaaggccaagacaaaggcggtttcccgctcgcagagagccggcttgcagttcccagtgggccgtattcatcgacacctaaaatctaggacgaccagtcatggacgtgtgggcgcgactgccgctgtgtacagcgcagccatcctggagtacctcaccgcagaggtacttgaactggcaggaaatgcatcaaaagacttaaaggtaaagcgtattacccctcgtcacttgcaacttgctattcgtggagatgaagaattggattctctcatcaaggctacaattgctggtggtggtgtcattccacacatccacaaatctctgattgggaagaaaggacaacagaagactgtctaaaggatgcctggattccttgttatctcaggactctaaatactctaacagctgtccagtgttggtgattccagtggactgtatctctgtgaaaaacacaattttgcctttttgtaattctatttgagcaagttggaagtttaattagctttccaaccaaccaaatttctgcattcgagtcttaaccatatttaagtgttactgtggcttcaaagaagctattgattctgaagtagtgggttttgattgagttgactgtttttactgttngnttttattgggggccgttagaaccttggttttgtc

SEQ ID NO: 448739 - DNA, 498 bp, Homo sapiens
  misc_feature (415)..(415): n is a, c, g, or t
  misc_feature (419)..(419): n is a, c, g, or t
agccattggtgggatgagcaatccgagttcccggatgagggaacattctgcagtataaagggagcagggaaggcgggagacagcgcagtttgaatcgcggtgcgacgaaggagtaggtggtgggatctcaccgtgggtccgattagccttttctctgccttgcttgcttgagcttcagcggaattcgaaatggctggcggtaaggctggaaaggactccggaaaggccaagacaaaggcggtttcccgctcgcagagagccggcttgcagttcccagtgggccgtattcatcgacacctaaaatctaggacgaccagtcatggacgtgtgggcgcgactgccgctgtgtacagcgcagccatcctggagtacctcaccgcagagcttgaactggcaggaaatgcatcaaaaaggnaccntttttttttaaaaaaaactaaagggggggggggctcttttttaaaaaaaaaaaatgaagaattgcattctctgatcacg

SEQ ID NO: 448740 - DNA, 1647 bp, Homo sapiens
  misc_feature (957)..(957): n is a, c, g, or t
  misc_feature (959)..(959): n is a, c, g, or t
cccccccccccccccacccccacccgccgcaccacaccggccagcaagaccccgcaaacttaggctaggtacgaggcctggtgttagcggtgcgacgaaggagtaggtggtgggatctcaccgtgggtccgattagccttttctctgccttgcttgcttgagcttcagcggaattcgaaatggctggcggtaaggctggaaaggactccggaaaggccaagacaaaggcggtttcccgctcgcagagagccggcttgcagttcccagtgggccgtattcatcgacacctaaaatctaggacgaccagtcatggacgtgtgggcgcgactgccgctgtgtacagcgcagccatcctggagtacctcaccgcagaggtacttgaactggcaggaaatgcatcaaaagacttaaaggtaaagcgtattacccctcgtcacttgcaacttgctattcgtggagatgaagaattggattctctcatcaaggctacaattgctggtggtggtgtcattccacacatccacaaatctctgattgggaagaaaggacaacagaagactgtctaaaggatgcctggattccttgttatctcaggactctaaatactctaacagctgtccagtgttggtgattccagtggactgtatctctgtgaaaaacacaattttgcctttttgtaattctatttgagcaagttggaagtttaattagctttccaaccaaccaaatttctgcattcgagtcttaaccatatttaagtgttactgtggcttcaaagaagctattgattctgaagtagtgggttttgattgagttgactgtttttaaaaaactgtttggattttaattgtgatgcagaagttatagtaacaaacatttggttttgtacagacattatttccactctggtggataagttcaataaaggtcatatcccaaaaaaaaaaaaaaaaaaananaaaaaaaaaaaaagaaaaaaaaaaaaacagaaacaaaaaaaacacaaacaaagcaaaaaagaaaggaatactacatcatgcagaagcacgacgggagagaggccgggacggtcggccggaggcgcggccgcgcgcgagggccgcagcctgcgcgagcacatagatgatagccgatggaggtgagagtgcgcatcgcttaccttacacagcgagacgacgcaggcaggaatcgcaaggtgacactcacccgggtgtgggatgagagcagtgagcagctgaaggtggtggtgggtagcagacatagagggcgagcggtgaacactactattgggagtagacgggttcgagcgccgtcttctcggcgagcgtcatggaacatgccgtagtcctcgcatggtattcggtgtgcgatcgagtgagacttaagataggtgggcagagatagaagtgtgatctgggatcagagccgggctcacctggatgacgacgagcgaggagaacgaagacaaagacacggagaggaggaaaaactacgcagatcacgacgagcggtggagaccgagagccggaatgcggtggcagcgagcaagagggaacagagagatgcgcgcaacgacgagggagacgggaaccagtgcggtcaccatgactgccggggcgaatgaagcagcaggagacgaagcgaggc

SEQ ID NO: 448741 - DNA, 1009 bp, Homo sapiens
cccccccccccccccacccccacccgccgcaccacaccggccagcaagaccccgcaaacttaggctaggtacgaggcctggtgttagcggtgcgacgaaggagtaggtggtgggatctcaccgtgggtccgattagccttttctctgccttgcttgcttgagcttcagcggaattcgaaatggctggcggtaaggctggaaaggactccggaaaggccaagacaaaggcggtttcccgctcgcagagagccggcttgcagttcccagtgggccgtattcatcgacacctaaaatctaggacgaccagtcatggacgtgtgggcgcgactgccgctgtgtacagcgcagccatcctggagtacctcaccgcagaggtacttgaactggcaggaaatgcatcaaaagacttaaaggtaaagcgtattacccctcgtcacttgcaacttgctattcgtggagatgaagaattggattctctcatcaaggctacaattgctggtggtggtgtcattccacacatccacaaatctctgattgggaagaaaggacaacagaagactgtctaaaggatgcctggattccttgttatctcaggactctaaatactctaacagctgtccagtgttggtgattccagtggactgtatctctgtgaaaaacacaattttgcctttttgtaattctatttgagcaagttggaagtttaattagctttccaaccaaccaaatttctgcattcgagtcttaaccatatttaagtgttactgtggcttcaaagaagctattgattctgaagtagtgggttttgattgagttgactgtttttaaaaaactgtttggattttaattgtgatgcagaagttatagtaacaaacatttggttttgtacagacattatttccactctggtggataagttcaataaaggtcatatcccaaacaaaaaaaaaataagtagagatataggtgtgatgaatgtactagtagaagtagagcaagaaaaaaaagg

SEQ ID NO: 448742 - DNA, 984 bp, Homo sapiens
cccccccccccccccacccccacccgccgcaccacaccggccagcaagaccccgcaaacttaggctaggtacgaggcctggtgttagcggtgcgacgaaggagtaggtggtgggatctcaccgtgggtccgattagccttttctctgccttgcttgcttgagcttcagcggaattcgaaatggctggcggtaaggctggaaaggactccggaaaggccaagacaaaggcggtttcccgctcgcagagagccggcttgcagttcccagtgggccgtattcatcgacacctaaaatctaggacgaccagtcatggacgtgtgggcgcgactgccgctgtgtacagcgcagccatcctggagtacctcaccgcagaggtacttgaactggcaggaaatgcatcaaaagacttaaaggtaaagcgtattacccctcgtcacttgcaacttgctattcgtggagatgaagaattggattctctcatcaaggctacaattgctggtggtggtgtcattccacacatccacaaatctctgattgggaagaaaggacaacagaagactgtctaaaggatgcctggattccttgttatctcaggactctaaatactctaacagctgtccagtgttggtgattccagtggactgtatctctgtgaaaaacacaattttgcctttttgtaattctatttgagcaagttggaagtttaattagctttccaaccaaccaaatttctgcattcgagtcttaaccatatttaagtgttactgtggcttcaaagaagctattgattctgaagtagtgggttttgattgagttgactgtttttaaaaaactgtttggattttaattgtgatgcagaagttatagtaacaaacatttggttttgtacagacattatttccactctggtggataagtctaaggtctttccaaaaaaaaaaaccggggttattggggggaaaagtttaagggctggtggtttgc

SEQ ID NO: 448743 - DNA, 1051 bp, Homo sapiens
cccccccccccccccacccccacccgccgcaccacaccggccagcaagaccccgcaaacttaggctaggtacgaggcctggtgttagcggtgcgacgaaggagtaggtggtgggatctcaccgtgggtccgattagccttttctctgccttgcttgcttgagcttcagcggaattcgaaatggctggcggtaaggctggaaaggactccggaaaggccaagacaaaggcggtttcccgctcgcagagagccggcttgcagttcccagtgggccgtattcatcgacacctaaaatctaggacgaccagtcatggacgtgtgggcgcgactgccgctgtgtacagcgcagccatcctggagtacctcaccgcagaggtacttgaactggcaggaaatgcatcaaaagacttaaaggtaaagcgtattacccctcgtcacttgcaacttgctattcgtggagatgaagaattggattctctcatcaaggctacaattgctggtggtggtgtcattccacacatccacaaatctctgattgggaagaaaggacaacagaagactgtctaaaggatgcctggattccttgttatctcaggactctaaatactctaacagctgtccagtgttggtgattccagtggactgtatctctgtgaaaaacacaattttgcctttttgtaattctatttgagcaagttggaagtttaattagctttccaaccaaccaaatttctgcattcgagtcttaaccatatttaagtgttactgtggcttcaaagaagctattgattctgaagtagtgggttttgattgagttgactgtttttaaaaaactgtttggattttaattgtgatgcagaagttattacacccttggttggtcgactattccactctgggtaagttcatacggtcaatcccacttgaaaacaaaggggggccataacacccaggccaatttcctccaccttttccacggccctaggagttattacgccgcggtaacagtcgaacacaaccccccactctgttctgccccaaccaaccattac

SEQ ID NO: 448744 - DNA, 872 bp, Homo sapiens
cccccccccccccccacccccacccgccgcaccacaccggccagcaagaccccgcaaacttaggctaggtacgaggcctggtgttagcggtgcgacgaaggagtaggtggtgggatctcaccgtgggtccgattagccttttctctgccttgcttgcttgagcttcagcggaattcgaaatggctggcggtaaggctggaaaggactccggaaaggccaagacaaaggcggtttcccgctcgcagagagccggcttgcagttcccagtgggccgtattcatcgacacctaaaatctaggacgaccagtcatggacgtgtgggcgcgactgccgctgtgtacagcgcagccatcctggagtacctcaccgcagaggtacttgaactggcaggaaatgcatcaaaagacttaaaggtaaagcgtattacccctcgtcacttgcaacttgctattcgtggagatgaagaattggattctctcatcaaggctacaattgctggtggtggtgtcattccacacatccacaaatctctgattgggaagaaaggacaacagaagactgtctaaaggatgcctggattccttgttatctcaggactctaaatactctaacagctgtccagtgttggtgattccagtggactgtatctctgtgaaaaacacaattttgcctttttgtaattctatttgagcaagttggaagtttaattagctttccaaccaaccaaatttctgcattcgagtcttaaccatatttaagtgttactgtggcttcaaagaagctattgattctgaagtagtgggttttgattgagttgactgttttttttgtacagacattatttccactctgtgggataagttctggtcatt

SEQ ID NO: 448745 - DNA, 1511 bp, Homo sapiens
  misc_feature (821)..(821): n is a, c, g, or t
  misc_feature (823)..(823): n is a, c, g, or t
gcagttggtggggtggtatagagtggtatagggtggtatagggtggtatagagtggtatagggtggtatagcctataccgccaagacaaaggcggtttcccgctcgcagagagccggcttgcagttcccagtgggccgtattcatcgacacctaaaatctaggacgaccagtcatggacgtgtgggcgcgactgccgctgtgtacagcgcagccatcctggagtacctcaccgcagaggtacttgaactggcaggaaatgcatcaaaagacttaaaggtaaagcgtattacccctcgtcacttgcaacttgctattcgtggagatgaagaattggattctctcatcaaggctacaattgctggtggtggtgtcattccacacatccacaaatctctgattgggaagaaaggacaacagaagactgtctaaaggatgcctggattccttgttatctcaggactctaaatactctaacagctgtccagtgttggtgattccagtggactgtatctctgtgaaaaacacaattttgcctttttgtaattctatttgagcaagttggaagtttaattagctttccaaccaaccaaatttctgcattcgagtcttaaccatatttaagtgttactgtggcttcaaagaagctattgattctgaagtagtgggttttgattgagttgactgtttttaaaaaactgtttggattttaattgtgatgcagaagttatagtaacaaacatttggttttgtacagacattatttccactctggtggataagttcaataaaggtcatatcccaaaaaaaaaaaaaaaaaaananaaaaaaaaaaaaagaaaaaaaaaaaaacagaaacaaaaaaaacacaaacaaagcaaaaaagaaaggaatactacatcatgcagaagcacgacgggagagaggccgggacggtcggccggaggcgcggccgcgcgcgagggccgcagcctgcgcgagcacatagatgatagccgatggaggtgagagtgcgcatcgcttaccttacacagcgagacgacgcaggcaggaatcgcaaggtgacactcacccgggtgtgggatgagagcagtgagcagctgaaggtggtggtgggtagcagacatagagggcgagcggtgaacactactattgggagtagacgggttcgagcgccgtcttctcggcgagcgtcatggaacatgccgtagtcctcgcatggtattcggtgtgcgatcgagtgagacttaagataggtgggcagagatagaagtgtgatctgggatcagagccgggctcacctggatgacgacgagcgaggagaacgaagacaaagacacggagaggaggaaaaactacgcagatcacgacgagcggtggagaccgagagccggaatgcggtggcagcgagcaagagggaacagagagatgcgcgcaacgacgagggagacgggaaccagtgcggtcaccatgactgccggggcgaatgaagcagcaggagacgaagcgaggc

SEQ ID NO: 448746 - DNA, 1614 bp, Homo sapiens
  misc_feature (924)..(924): n is a, c, g, or t
  misc_feature (926)..(926): n is a, c, g, or t
agccattggtgggatgagcaatccgagttcccggatgagggaacattctgcagtataaagggagcagggaaggcgggagacagcgcagtttgaatcgcggtgcgacgaaggagtaggtggtgggatctcaccgtgggtccgattagccttttctctgccttgcttgcttgagcttcagcggaattcgaaatggctggcggtaaggctggaaaggactccggaaaggccaagacaaaggcggtttcccgctcgcagagagccggcttgcagttcccagtgggccgtattcatcgactgccgctgtgtacagcgcagccatcctggagtacctcaccgcagaggtacttgaactggcaggaaatgcatcaaaagacttaaaggtaaagcgtattacccctcgtcacttgcaacttgctattcgtggagatgaagaattggattctctcatcaaggctacaattgctggtggtggtgtcattccacacatccacaaatctctgattgggaagaaaggacaacagaagactgtctaaaggatgcctggattccttgttatctcaggactctaaatactctaacagctgtccagtgttggtgattccagtggactgtatctctgtgaaaaacacaattttgcctttttgtaattctatttgagcaagttggaagtttaattagctttccaaccaaccaaatttctgcattcgagtcttaaccatatttaagtgttactgtggcttcaaagaagctattgattctgaagtagtgggttttgattgagttgactgtttttaaaaaactgtttggattttaattgtgatgcagaagttatagtaacaaacatttggttttgtacagacattatttccactctggtggataagttcaataaaggtcatatcccaaaaaaaaaaaaaaaaaaananaaaaaaaaaaaaagaaaaaaaaaaaaacagaaacaaaaaaaacacaaacaaagcaaaaaagaaaggaatactacatcatgcagaagcacgacgggagagaggccgggacggtcggccggaggcgcggccgcgcgcgagggccgcagcctgcgcgagcacatagatgatagccgatggaggtgagagtgcgcatcgcttaccttacacagcgagacgacgcaggcaggaatcgcaaggtgacactcacccgggtgtgggatgagagcagtgagcagctgaaggtggtggtgggtagcagacatagagggcgagcggtgaacactactattgggagtagacgggttcgagcgccgtcttctcggcgagcgtcatggaacatgccgtagtcctcgcatggtattcggtgtgcgatcgagtgagacttaagataggtgggcagagatagaagtgtgatctgggatcagagccgggctcacctggatgacgacgagcgaggagaacgaagacaaagacacggagaggaggaaaaactacgcagatcacgacgagcggtggagaccgagagccggaatgcggtggcagcgagcaagagggaacagagagatgcgcgcaacgacgagggagacgggaaccagtgcggtcaccatgactgccggggcgaatgaagcagcaggagacgaagcgaggc

SEQ ID NO: 448747 - DNA, 1603 bp, Homo sapiens
  misc_feature (913)..(913): n is a, c, g, or t
  misc_feature (915)..(915): n is a, c, g, or t
agccattggtgggatgagcaatccgagttcccggatgagggaacattctgcagtataaagggagcagggaaggcgggagacagcgcagtttgaatcgcggtgcgacgaaggagtaggtggtgggatctcaccgtgggtccgattagccttttctctgccttgcttgcttgagcttcagcggaattcgaaatggctggcggtaaggctggaaaggactccggaaaggccaagacaaaggcggtttcccgctcgcagagagccggcttgcagttcccagtgggccgtattcatcgacacctaaaatctaggacgaccagtcatggacgtgtgggcgcgactgccgctgtgtacagcgcagccatcctggagtacctcaccgcagaggtacttgaactggcaggaaatgcatcaaaagacttaaaggtaaagcgtattacccctcgtcacttgcaacttgctattcgtggagatgaagaattggattctctcatcaaggctacaattgctggtggtggtgtcattccacacatccacaaatctctgattgggaagaaaggacaacagaagactgtctaaaggatgcctggattccttgttatctcaggactctaaatactctaacagctgtccagtgttggtgattccagtggactgtatctctgtgaaactttccaaccaaccaaatttctgcattcgagtcttaaccatatttaagtgttactgtggcttcaaagaagctattgattctgaagtagtgggttttgattgagttgactgtttttaaaaaactgtttggattttaattgtgatgcagaagttatagtaacaaacatttggttttgtacagacattatttccactctggtggataagttcaataaaggtcatatcccaaaaaaaaaaaaaaaaaaananaaaaaaaaaaaaagaaaaaaaaaaaaacagaaacaaaaaaaacacaaacaaagcaaaaaagaaaggaatactacatcatgcagaagcacgacgggagagaggccgggacggtcggccggaggcgcggccgcgcgcgagggccgcagcctgcgcgagcacatagatgatagccgatggaggtgagagtgcgcatcgcttaccttacacagcgagacgacgcaggcaggaatcgcaaggtgacactcacccgggtgtgggatgagagcagtgagcagctgaaggtggtggtgggtagcagacatagagggcgagcggtgaacactactattgggagtagacgggttcgagcgccgtcttctcggcgagcgtcatggaacatgccgtagtcctcgcatggtattcggtgtgcgatcgagtgagacttaagataggtgggcagagatagaagtgtgatctgggatcagagccgggctcacctggatgacgacgagcgaggagaacgaagacaaagacacggagaggaggaaaaactacgcagatcacgacgagcggtggagaccgagagccggaatgcggtggcagcgagcaagagggaacagagagatgcgcgcaacgacgagggagacgggaaccagtgcggtcaccatgactgccggggcgaatgaagcagcaggagacgaagcgaggc

SEQ ID NO: 448748 - DNA, 2265 bp, Homo sapiens
  misc_feature (1575)..(1575): n is a, c, g, or t
  misc_feature (1577)..(1577): n is a, c, g, or t
agccattggtgggatgagcaatccgagttcccggatgagggaacattctgcagtataaagggagcagggaaggcgggagacagcgcagtttgaatcgcggtgcgacgaaggagtaggtggtgggatctcaccgtgggtccgattagccttttctctgccttgcttgcttgagcttcagcggaattcgaaatggctggcggtaaggctggaaaggactccggaaaggccaagacaaaggcggtttcccgctcgcagagagccggcttgcaggtcagtagttgttcgtgcagtctgggagtcatgatgtttttctttgcatttccttttttgttattcatcgctctcgatgggcgttttgtgtatgcgtgggtgatgcggtgtcgcgacttgggctgcccatacgataaatatgggggggaggaatcacgtgtttcgatgtcgggacgcgttgctgcgcccgtgccccttgctttggcgcgcatataatttccccatctctagttctcatttttgtgcatttatgtttgtgtatgcttaaaatttaagttcccagtgggccgtattcatcgacacctaaaatctaggacgaccagtcatggacgtgtgggcgcgactgccgctgtgtacagcgcagccatcctggagtacctcaccgcagaggtaaatgggtgaacgcctataatccggagaaggtttggggggcggggaggcggcaagagggaaggaggaaagtgatgcaagaaaactcccaggccctgaacgcggcgagaggcctaagagaacgctagagggagctggtgttcaacaaggatcctactgagcttgagttctctgctcttggaattaaaattgcgtgccccctgtatatcttgccagtcagatagtgaggaacgattccagttggtagatctgcgtttgtgagggttttattctgttctctgaatcttggccaaaggaaagttggaaggcaactgacagattctgccttttaggtacttgaactggcaggaaatgcatcaaaagacttaaaggtaaagcgtattacccctcgtcacttgcaacttgctattcgtggagatgaagaattggattctctcatcaaggctacaattgctggtggtggtgtcattccacacatccacaaatctctgattgggaagaaaggacaacagaagactgtctaaaggatgcctggattccttgttatctcaggactctaaatactctaacagctgtccagtgttggtgattccagtggactgtatctctgtgaaaaacacaattttgcctttttgtaattctatttgagcaagttggaagtttaattagctttccaaccaaccaaatttctgcattcgagtcttaaccatatttaagtgttactgtggcttcaaagaagctattgattctgaagtagtgggttttgattgagttgactgtttttaaaaaactgtttggattttaattgtgatgcagaagttatagtaacaaacatttggttttgtacagacattatttccactctggtggataagttcaataaaggtcatatcccaaaaaaaaaaaaaaaaaaananaaaaaaaaaaaaagaaaaaaaaaaaaacagaaacaaaaaaaacacaaacaaagcaaaaaagaaaggaatactacatcatgcagaagcacgacgggagagaggccgggacggtcggccggaggcgcggccgcgcgcgagggccgcagcctgcgcgagcacatagatgatagccgatggaggtgagagtgcgcatcgcttaccttacacagcgagacgacgcaggcaggaatcgcaaggtgacactcacccgggtgtgggatgagagcagtgagcagctgaaggtggtggtgggtagcagacatagagggcgagcggtgaacactactattgggagtagacgggttcgagcgccgtcttctcggcgagcgtcatggaacatgccgtagtcctcgcatggtattcggtgtgcgatcgagtgagacttaagataggtgggcagagatagaagtgtgatctgggatcagagccgggctcacctggatgacgacgagcgaggagaacgaagacaaagacacggagaggaggaaaaactacgcagatcacgacgagcggtggagaccgagagccggaatgcggtggcagcgagcaagagggaacagagagatgcgcgcaacgacgagggagacgggaaccagtgcggtcaccatgactgccggggcgaatgaagcagcaggagacgaagcgaggc

SEQ ID NO: 448749 - DNA, 1498 bp, Homo sapiens
  misc_feature (808)..(808): n is a, c, g, or t
  misc_feature (810)..(810): n is a, c, g, or t
agccattggtgggatgagcaatccgagttcccggatgagggaacattctgcagtataaagggagcagggaaggcgggagacagcgcagtttgaatcgcggtgcgacgaaggagtaggtggtgggatctcaccgtgggtccgattagccttttctctgccttgcttgcttgagcttcagcggaattcgaaatggctggcggtaaggctggaaaggactccggaaaggccaagacaaaggcggtttcccgctcgcagagagccggcttgcagttcccagtgggccgtattcatcgacacctaaaatctaggacgaccagtcatggacgtgtgggcgcgactgccgctgtgtacagcgcagccatcctggagtacctcaccgcagaggtacttgaactggcaggaaatgcatcaaaagacttaaaggtaaagcgtattacccctcgtcacttgcaacttgctattcgtggagatgaagaattggattccagtggactgtatctctgtgaaaaacacaattttgcctttttgtaattctatttgagcaagttggaagtttaattagctttccaaccaaccaaatttctgcattcgagtcttaaccatatttaagtgttactgtggcttcaaagaagctattgattctgaagtagtgggttttgattgagttgactgtttttaaaaaactgtttggattttaattgtgatgcagaagttatagtaacaaacatttggttttgtacagacattatttccactctggtggataagttcaataaaggtcatatcccaaaaaaaaaaaaaaaaaaananaaaaaaaaaaaaagaaaaaaaaaaaaacagaaacaaaaaaaacacaaacaaagcaaaaaagaaaggaatactacatcatgcagaagcacgacgggagagaggccgggacggtcggccggaggcgcggccgcgcgcgagggccgcagcctgcgcgagcacatagatgatagccgatggaggtgagagtgcgcatcgcttaccttacacagcgagacgacgcaggcaggaatcgcaaggtgacactcacccgggtgtgggatgagagcagtgagcagctgaaggtggtggtgggtagcagacatagagggcgagcggtgaacactactattgggagtagacgggttcgagcgccgtcttctcggcgagcgtcatggaacatgccgtagtcctcgcatggtattcggtgtgcgatcgagtgagacttaagataggtgggcagagatagaagtgtgatctgggatcagagccgggctcacctggatgacgacgagcgaggagaacgaagacaaagacacggagaggaggaaaaactacgcagatcacgacgagcggtggagaccgagagccggaatgcggtggcagcgagcaagagggaacagagagatgcgcgcaacgacgagggagacgggaaccagtgcggtcaccatgactgccggggcgaatgaagcagcaggagacgaagcgaggc

SEQ ID NO: 448750 - DNA, 754 bp, Homo sapiens
  misc_feature (546)..(546): n is a, c, g, or t
agccattggtgggatgagcaatccgagttcccggatgagggaacattctgcagtataaagggagcagggaaggcgggagacagcgcagtttgaatcgcggtgcgacgaaggagtaggtggtgggatctcaccgtgggtccgattagccttttctctgccttgcttgcttgagcttcagcggaattcgaaatggctggcggtaaggctggaaaggactccggaaaggccaagacaaaggcggtttcccgctcgcagagagccggcttgcaggctcccagggggccgtctttaaagacacctaaaaactaggacaaccagtcatggacatctgaccgctactgccaacttttacaatacagtcatccaaggagaccaaaccggacaaagactttaacccccggcgcatgcaaaaaaagatttaaactgtcagagactcatccaaagtaagttatcaattccgatccccccccgataaagattccccctcttaaaaaccagactacaaccactaagtgggagagaagaaaaaaacctccctcccacagngccacaaacaccgcccaaacgagaaaaaacagagagtattaaaaagaatcgcaaataaaatagaccgttctcaaataaaataaaaagctcgaacaaacatcccaacctgagataatgtcaactaaaaccccaccctccacaaatcacccggtacaactctctctattctaataaatcacacctaatcaaaaacattaagcagggatac

SEQ ID NO: 448751 - DNA, 914 bp, Homo sapiens
  misc_feature (224)..(224): n is a, c, g, or t
  misc_feature (226)..(226): n is a, c, g, or t
acctttgttcacttgtttatctgctgaccttccctccactattgtcctatgaccctgctgaagtagtgggttttgattgagttgactgtttttaaaaaactgtttggattttaattgtgatgcagaagttatagtaacaaacatttggttttgtacagacattatttccactctggtggataagttcaataaaggtcatatcccaaaaaaaaaaaaaaaaaaananaaaaaaaaaaaaagaaaaaaaaaaaaacagaaacaaaaaaaacacaaacaaagcaaaaaagaaaggaatactacatcatgcagaagcacgacgggagagaggccgggacggtcggccggaggcgcggccgcgcgcgagggccgcagcctgcgcgagcacatagatgatagccgatggaggtgagagtgcgcatcgcttaccttacacagcgagacgacgcaggcaggaatcgcaaggtgacactcacccgggtgtgggatgagagcagtgagcagctgaaggtggtggtgggtagcagacatagagggcgagcggtgaacactactattgggagtagacgggttcgagcgccgtcttctcggcgagcgtcatggaacatgccgtagtcctcgcatggtattcggtgtgcgatcgagtgagacttaagataggtgggcagagatagaagtgtgatctgggatcagagccgggctcacctggatgacgacgagcgaggagaacgaagacaaagacacggagaggaggaaaaactacgcagatcacgacgagcggtggagaccgagagccggaatgcggtggcagcgagcaagagggaacagagagatgcgcgcaacgacgagggagacgggaaccagtgcggtcaccatgactgccggggcgaatgaagcagcaggagacgaagcgaggc

SEQ ID NO: 448752 - DNA, 421 bp, Homo sapiens
gaaagttggaaggcaactgacagattctgccttttaggtacttgaactggcaggaaatgcatcaaaagacttaaaggtaaagcgtattacccctcgtcacttgcaacttgctattcgtggagatgaagaattggattctctcatcaaggctacaattgctggtggtggtatgttaacttctaacattttaaaaaatttcttcagaggaaggaattttttgctgcttttaattagtttttccaggagaggaaatttaagtatattttcaatgatggaagtatggttgtatcatgaaatttgatttatatgtataactcaatgaatttttacttcatacttgagctgcatgtttttaaagatacctttcaagttgaacagtatacactttcttggtttcaaatactgtgattttttaaaaaat

SEQ ID NO: 448753 - DNA, 329 bp, Homo sapiens
ggtgcgacgaaggagtaggtggtgggatctcaccgtgggtccgattagccttttctctgccttgcttgcttgagcttcagcggaattcgaaatggtaaacttcgcagagacgctcgatgactccgcgggtttttgccggcgagagaaaaacccgttacacagagggatgggggtgaagtggcgacggttgggaacgcgcggagacaggatttagaagagtggggggaggtgttttgtcggctgctagcggagcagcctcggatctcgcggcgggcggcgacggttgggtggcgcgcgcagcgccgctgggggccggcgggcggaggcgc

SEQ ID NO: 448754 - DNA, 1074 bp, Homo sapiens
cccccccccccccccacccccacccgccgcaccacaccggccagcaagaccccgcaaacttaggctaggtacgaggcctggtgttagcggtgcgacgaaggagtaggtggtgggatctcaccgtgggtccgattagccttttctctgccttgcttgcttgagcttcagcggaattcgaaatggctggcggtaaggctggaaaggactccggaaaggccaagacaaaggcggtttcccgctcgcagagagccggcttgcagttcccagtgggccgtattcatcgacacctaaaatctaggacgaccagtcatggacgtgtgggcgcgactgccgctgtgtacagcgcagccatcctggagtacctcaccgcagaggtacttgaactggcaggaaatgcatcaaaagacttaaaggtaaagcgtattacccctcgtcacttgcaacttgctattcgtggagatgaagaattggattctctcatcaaggctacaattgctggtggtggtgtcattccacacatccacaaatctctgattgggaagaaaggacaacagaagactgtctaaaggatgcctggattccttgttatctcaggactctaaatactctaacagctgtccagtgttggtgattccagtggactgtatctctgtgaaaaacacaattttgcctttttgtaattctatttgagcaagttggaagtttaattagctttccaaccaaccaaatttctgcattcgagtcttaaccatatttaagtgttactgtggcttcaaagaagctattgattctgaagtagtgggttttgattgagttgactgtttttaaaaaactgtttggattttaattgtgatgcagaagttatagtaacaaacatttggttttgtacagacattatttccactctggtggataagttcaataaaggtcatatcccaaaacaaaaaaggggggcgcaaattcccacgggccattaccagcctcttgtaagggccaagggcgaataacagacgggggctacagcacggaagcatcgactggaccactgcgagacgacccacgccgaaattctgc

SEQ ID NO: 448755 - DNA, 1657 bp, Homo sapiens
  misc_feature (967)..(967): n is a, c, g, or t
  misc_feature (969)..(969): n is a, c, g, or t
agccattggtgggatgagcaatccgagttcccggatgagggaacattctgcagtataaagggagcagggaaggcgggagacagcgcagtttgaatcgcggtgcgacgaaggagtaggtggtgggatctcaccgtgggtccgattagccttttctctgccttgcttgcttgagcttcagcggaattcgaaatggctggcggtaaggctggaaaggactccggaaaggccaagacaaaggcggtttcccgctcgcagagagccggcttgcagttcccagtgggccgtattcatcgacacctaaaatctaggacgaccagtcatggacgtgtgggcgcgactgccgctgtgtacagcgcagccatcctggagtacctcaccgcagaggtacttgaactggcaggaaatgcatcaaaagacttaaaggtaaagcgtattacccctcgtcacttgcaacttgctattcgtggagatgaagaattggattctctcatcaaggctacaattgctggtggtggtgtcattccacacatccacaaatctctgattgggaagaaaggacaacagaagactgtctaaaggatgcctggattccttgttatctcaggactctaaatactctaacagctgtccagtgttggtgattccagtggactgtatctctgtgaaaaacacaattttgcctttttgtaattctatttgagcaagttggaagtttaattagctttccaaccaaccaaatttctgcattcgagtcttaaccatatttaagtgttactgtggcttcaaagaagctattgattctgaagtagtgggttttgattgagttgactgtttttaaaaaactgtttggattttaattgtgatgcagaagttatagtaacaaacatttggttttgtacagacattatttccactctggtggataagttcaataaaggtcatatcccaaaaaaaaaaaaaaaaaaananaaaaaaaaaaaaagaaaaaaaaaaaaacagaaacaaaaaaaacacaaacaaagcaaaaaagaaaggaatactacatcatgcagaagcacgacgggagagaggccgggacggtcggccggaggcgcggccgcgcgcgagggccgcagcctgcgcgagcacatagatgatagccgatggaggtgagagtgcgcatcgcttaccttacacagcgagacgacgcaggcaggaatcgcaaggtgacactcacccgggtgtgggatgagagcagtgagcagctgaaggtggtggtgggtagcagacatagagggcgagcggtgaacactactattgggagtagacgggttcgagcgccgtcttctcggcgagcgtcatggaacatgccgtagtcctcgcatggtattcggtgtgcgatcgagtgagacttaagataggtgggcagagatagaagtgtgatctgggatcagagccgggctcacctggatgacgacgagcgaggagaacgaagacaaagacacggagaggaggaaaaactacgcagatcacgacgagcggtggagaccgagagccggaatgcggtggcagcgagcaagagggaacagagagatgcgcgcaacgacgagggagacgggaaccagtgcggtcaccatgactgccggggcgaatgaagcagcaggagacgaagcgaggc

SEQ ID NO: 448756 - DNA, 955 bp, Homo sapiens
cccccccccccccccacccccacccgccgcaccacaccggccagcaagaccccgcaaacttaggctaggtacgaggcctggtgttagcggtgcgacgaaggagtaggtggtgggatctcaccgtgggtccgattagccttttctctgccttgcttgcttgagcttcagcggaattcgaaatggctggcggtaaggctggaaaggactccggaaaggccaagacaaaggcggtttcccgctcgcagagagccggcttgcagttcccagtgggccgtattcatcgacacctaaaatctaggacgaccagtcatggacgtgtgggcgcgactgccgctgtgtacagcgcagccatcctggagtacctcaccgcagaggtacttgaactggcaggaaatgcatcaaaagacttaaaggtaaagcgtattacccctcgtcacttgcaacttgctattcgtggagatgaagaattggattctctcatcaaggctacaattgctggtggtggtgtcattccacacatccacaaatctctgattgggaagaaaggacaacagaagactgtctaaaggatgcctggattccttgttatctcaggactctaaatactctaacagctgtccagtgttggtgattccagtggactgtatctctgtgaaaaacacaattttgcctttttgtaattctatttgagcaagttggaagtttaattagctttccaaccaaccaaatttctgcattcgagtcttaaccatatttaagtgttactgtggcttcaaagaagctattgattctgaagtagtgggttttgattgagttgactgtttttaaaaaactgtttggattttaattgtgatgcagaagttatagtaacaaacatttggttttgtacagacggatatgacctttattgaacttatccactatagtggaaataatgtctgtacaataccaagtc

SEQ ID NO: 448757 - DNA, 1642 bp, Homo sapiens
  misc_feature (952)..(952): n is a, c, g, or t
  misc_feature (954)..(954): n is a, c, g, or t
gcgcggcggggggcgaacgggcggggtcgcccctgcggcgcgccgcgggccggagaccccggcagggtgcggggacgcgctcgcggcgggacgcgccgcggtgggggatgggcgcgccgccttggtaattctatattctccgttcctcctccgctcgcgggcgtgtgcgcgccgcaggctggcggtaaggctggaaaggactccggaaaggccaagacaaaggcggtttcccgctcgcagagagccggcttgcagttcccagtgggccgtattcatcgacacctaaaatctaggacgaccagtcatggacgtgtgggcgcgactgccgctgtgtacagcgcagccatcctggagtacctcaccgcagaggtacttgaactggcaggaaatgcatcaaaagacttaaaggtaaagcgtattacccctcgtcacttgcaacttgctattcgtggagatgaagaattggattctctcatcaaggctacaattgctggtggtggtgtcattccacacatccacaaatctctgattgggaagaaaggacaacagaagactgtctaaaggatgcctggattccttgttatctcaggactctaaatactctaacagctgtccagtgttggtgattccagtggactgtatctctgtgaaaaacacaattttgcctttttgtaattctatttgagcaagttggaagtttaattagctttccaaccaaccaaatttctgcattcgagtcttaaccatatttaagtgttactgtggcttcaaagaagctattgattctgaagtagtgggttttgattgagttgactgtttttaaaaaactgtttggattttaattgtgatgcagaagttatagtaacaaacatttggttttgtacagacattatttccactctggtggataagttcaataaaggtcatatcccaaaaaaaaaaaaaaaaaaananaaaaaaaaaaaaagaaaaaaaaaaaaacagaaacaaaaaaaacacaaacaaagcaaaaaagaaaggaatactacatcatgcagaagcacgacgggagagaggccgggacggtcggccggaggcgcggccgcgcgcgagggccgcagcctgcgcgagcacatagatgatagccgatggaggtgagagtgcgcatcgcttaccttacacagcgagacgacgcaggcaggaatcgcaaggtgacactcacccgggtgtgggatgagagcagtgagcagctgaaggtggtggtgggtagcagacatagagggcgagcggtgaacactactattgggagtagacgggttcgagcgccgtcttctcggcgagcgtcatggaacatgccgtagtcctcgcatggtattcggtgtgcgatcgagtgagacttaagataggtgggcagagatagaagtgtgatctgggatcagagccgggctcacctggatgacgacgagcgaggagaacgaagacaaagacacggagaggaggaaaaactacgcagatcacgacgagcggtggagaccgagagccggaatgcggtggcagcgagcaagagggaacagagagatgcgcgcaacgacgagggagacgggaaccagtgcggtcaccatgactgccggggcgaatgaagcagcaggagacgaagcgaggc

SEQ ID NO: 448758 - DNA, 1933 bp, Homo sapiens
  misc_feature (1243)..(1243): n is a, c, g, or t
  misc_feature (1245)..(1245): n is a, c, g, or t
agccattggtgggatgagcaatccgagttcccggatgagggaacattctgcagtataaagggagcagggaaggcgggagacagcgcagtttgaatcgcggtgcgacgaaggagtaggtggtgggatctcaccgtgggtccgattagccttttctctgccttgcttgcttgagcttcagcggaattcgaaatggctggcggtaaggctggaaaggactccggaaaggccaagacaaaggcggtttcccgctcgcagagagccggcttgcaggtcagtagttgttcgtgcagtctgggagtcatgatgtttttctttgcatttccttttttgttattcatcgctctcgatgggcgttttgtgtatgcgtgggtgatgcggtgtcgcgacttgggctgcccatacgataaatatgggggggaggaatcacgtgtttcgatgtcgggacgcgttgctgcgcccgtgccccttgctttggcgcgcatataatttccccatctctagttctcatttttgtgcatttatgtttgtgtatgcttaaaatttaagttcccagtgggccgtattcatcgacacctaaaatctaggacgaccagtcatggacgtgtgggcgcgactgccgctgtgtacagcgcagccatcctggagtacctcaccgcagaggtacttgaactggcaggaaatgcatcaaaagacttaaaggtaaagcgtattacccctcgtcacttgcaacttgctattcgtggagatgaagaattggattctctcatcaaggctacaattgctggtggtggtgtcattccacacatccacaaatctctgattgggaagaaaggacaacagaagactgtctaaaggatgcctggattccttgttatctcaggactctaaatactctaacagctgtccagtgttggtgattccagtggactgtatctctgtgaaaaacacaattttgcctttttgtaattctatttgagcaagttggaagtttaattagctttccaaccaaccaaatttctgcattcgagtcttaaccatatttaagtgttactgtggcttcaaagaagctattgattctgaagtagtgggttttgattgagttgactgtttttaaaaaactgtttggattttaattgtgatgcagaagttatagtaacaaacatttggttttgtacagacattatttccactctggtggataagttcaataaaggtcatatcccaaaaaaaaaaaaaaaaaaananaaaaaaaaaaaaagaaaaaaaaaaaaacagaaacaaaaaaaacacaaacaaagcaaaaaagaaaggaatactacatcatgcagaagcacgacgggagagaggccgggacggtcggccggaggcgcggccgcgcgcgagggccgcagcctgcgcgagcacatagatgatagccgatggaggtgagagtgcgcatcgcttaccttacacagcgagacgacgcaggcaggaatcgcaaggtgacactcacccgggtgtgggatgagagcagtgagcagctgaaggtggtggtgggtagcagacatagagggcgagcggtgaacactactattgggagtagacgggttcgagcgccgtcttctcggcgagcgtcatggaacatgccgtagtcctcgcatggtattcggtgtgcgatcgagtgagacttaagataggtgggcagagatagaagtgtgatctgggatcagagccgggctcacctggatgacgacgagcgaggagaacgaagacaaagacacggagaggaggaaaaactacgcagatcacgacgagcggtggagaccgagagccggaatgcggtggcagcgagcaagagggaacagagagatgcgcgcaacgacgagggagacgggaaccagtgcggtcaccatgactgccggggcgaatgaagcagcaggagacgaagcgaggc

SEQ ID NO: 448759 - DNA, 1989 bp, Homo sapiens
  misc_feature (1299)..(1299): n is a, c, g, or t
  misc_feature (1301)..(1301): n is a, c, g, or t
agccattggtgggatgagcaatccgagttcccggatgagggaacattctgcagtataaagggagcagggaaggcgggagacagcgcagtttgaatcgcggtgcgacgaaggagtaggtggtgggatctcaccgtgggtccgattagccttttctctgccttgcttgcttgagcttcagcggaattcgaaatggctggcggtaaggctggaaaggactccggaaaggccaagacaaaggcggtttcccgctcgcagagagccggcttgcagttcccagtgggccgtattcatcgacacctaaaatctaggacgaccagtcatggacgtgtgggcgcgactgccgctgtgtacagcgcagccatcctggagtacctcaccgcagaggtaaatgggtgaacgcctataatccggagaaggtttggggggcggggaggcggcaagagggaaggaggaaagtgatgcaagaaaactcccaggccctgaacgcggcgagaggcctaagagaacgctagagggagctggtgttcaacaaggatcctactgagcttgagttctctgctcttggaattaaaattgcgtgccccctgtatatcttgccagtcagatagtgaggaacgattccagttggtagatctgcgtttgtgagggttttattctgttctctgaatcttggccaaaggaaagttggaaggcaactgacagattctgccttttaggtacttgaactggcaggaaatgcatcaaaagacttaaaggtaaagcgtattacccctcgtcacttgcaacttgctattcgtggagatgaagaattggattctctcatcaaggctacaattgctggtggtggtgtcattccacacatccacaaatctctgattgggaagaaaggacaacagaagactgtctaaaggatgcctggattccttgttatctcaggactctaaatactctaacagctgtccagtgttggtgattccagtggactgtatctctgtgaaaaacacaattttgcctttttgtaattctatttgagcaagttggaagtttaattagctttccaaccaaccaaatttctgcattcgagtcttaaccatatttaagtgttactgtggcttcaaagaagctattgattctgaagtagtgggttttgattgagttgactgtttttaaaaaactgtttggattttaattgtgatgcagaagttatagtaacaaacatttggttttgtacagacattatttccactctggtggataagttcaataaaggtcatatcccaaaaaaaaaaaaaaaaaaananaaaaaaaaaaaaagaaaaaaaaaaaaacagaaacaaaaaaaacacaaacaaagcaaaaaagaaaggaatactacatcatgcagaagcacgacgggagagaggccgggacggtcggccggaggcgcggccgcgcgcgagggccgcagcctgcgcgagcacatagatgatagccgatggaggtgagagtgcgcatcgcttaccttacacagcgagacgacgcaggcaggaatcgcaaggtgacactcacccgggtgtgggatgagagcagtgagcagctgaaggtggtggtgggtagcagacatagagggcgagcggtgaacactactattgggagtagacgggttcgagcgccgtcttctcggcgagcgtcatggaacatgccgtagtcctcgcatggtattcggtgtgcgatcgagtgagacttaagataggtgggcagagatagaagtgtgatctgggatcagagccgggctcacctggatgacgacgagcgaggagaacgaagacaaagacacggagaggaggaaaaactacgcagatcacgacgagcggtggagaccgagagccggaatgcggtggcagcgagcaagagggaacagagagatgcgcgcaacgacgagggagacgggaaccagtgcggtcaccatgactgccggggcgaatgaagcagcaggagacgaagcgaggc

SEQ ID NO: 448760 - DNA, 1596 bp, Homo sapiens
  misc_feature (906)..(906): n is a, c, g, or t
  misc_feature (908)..(908): n is a, c, g, or t
agccattggtgggatgagcaatccgagttcccggatgagggaacattctgcagtataaagggagcagggaaggcgggagacagcgcagtttgaatcgcggtgcgacgaaggagtaggtggtgggatctcaccgtgggtccgattagccttttctctgccttgcttgcttgagcttcagcggaattcgaaatggctggcggtaaggctggaaaggactccggaaaggccaagacaaaggcggtttcccgctcgcagagagccggcttgcagttcccagtgggccgtattcatcgacacctaaaatctaggacgaccagtcatggacgtgtgggcgcgactgccgctgtgtacagcgcagccatcctggagtacctcaccgcagagacttgcaacttgctattcgtggagatgaagaattggattctctcatcaaggctacaattgctggtggtggtgtcattccacacatccacaaatctctgattgggaagaaaggacaacagaagactgtctaaaggatgcctggattccttgttatctcaggactctaaatactctaacagctgtccagtgttggtgattccagtggactgtatctctgtgaaaaacacaattttgcctttttgtaattctatttgagcaagttggaagtttaattagctttccaaccaaccaaatttctgcattcgagtcttaaccatatttaagtgttactgtggcttcaaagaagctattgattctgaagtagtgggttttgattgagttgactgtttttaaaaaactgtttggattttaattgtgatgcagaagttatagtaacaaacatttggttttgtacagacattatttccactctggtggataagttcaataaaggtcatatcccaaaaaaaaaaaaaaaaaaananaaaaaaaaaaaaagaaaaaaaaaaaaacagaaacaaaaaaaacacaaacaaagcaaaaaagaaaggaatactacatcatgcagaagcacgacgggagagaggccgggacggtcggccggaggcgcggccgcgcgcgagggccgcagcctgcgcgagcacatagatgatagccgatggaggtgagagtgcgcatcgcttaccttacacagcgagacgacgcaggcaggaatcgcaaggtgacactcacccgggtgtgggatgagagcagtgagcagctgaaggtggtggtgggtagcagacatagagggcgagcggtgaacactactattgggagtagacgggttcgagcgccgtcttctcggcgagcgtcatggaacatgccgtagtcctcgcatggtattcggtgtgcgatcgagtgagacttaagataggtgggcagagatagaagtgtgatctgggatcagagccgggctcacctggatgacgacgagcgaggagaacgaagacaaagacacggagaggaggaaaaactacgcagatcacgacgagcggtggagaccgagagccggaatgcggtggcagcgagcaagagggaacagagagatgcgcgcaacgacgagggagacgggaaccagtgcggtcaccatgactgccggggcgaatgaagcagcaggagacgaagcgaggc

SEQ ID NO: 448761 - DNA, 596 bp, Homo sapiens
  misc_feature (531)..(531): n is a, c, g, or t
  misc_feature (536)..(536): n is a, c, g, or t
  misc_feature (571)..(571): n is a, c, g, or t
agccattggtgggatgagcaatccgagttcccggatgagggaacattctgcagtataaagggagcagggaaggcgggagacagcgcagtttgaatcgcggtgcgacgaaggagtaggtggtgggatctcaccgtgggtccgattagccttttctctgccttgcttgcttgagcttcagcggaattcgaaatggctggcggtaaggctggaaaggactccggaaaggccaagacaaaggcggtttcccgctcgcagagagccggcttgcagttcccagtgggccgtattcatcgacacctaaaatctaggacgaccagtcatggacgtgtgggcgcgactgccgctgtgtacagcgcagccatcctggagtacctcaccgcagaggtacttgaactggcaggaaatgcatcaaaagacttaaaggtaaagcgtattacccctcgtcacttgcaacttgctattcgtggagatgaagaattggattctctcatcaaggctacaattgctggtggtggtgtcattccacacatncacanatctctgattgggaaatactctacagctgtccatngtgtgagtccagtgaccgatctctg

SEQ ID NO: 448762 - DNA, 1119 bp, Homo sapiens
  misc_feature (429)..(429): n is a, c, g, or t
  misc_feature (431)..(431): n is a, c, g, or t
cgagctcgctacccaaatctctcattgcgcacccaactatctataaacctagccatggccatccccttatgagcgggcgcagtgattataggctttcgctctaagattaaaaatgccctagcccacttctcaccacaaggcacacctacacccctttatccccaatgagagatttaaatctctcattgcgaaatctctcttgcaaatctctcattgcgaaccatatttaagtgttactgtggcttcaaagaagctattgattctgaagtagtgggttttgattgagttgactgtttttaaaaaactgtttggattttaattgtgatgcagaagttatagtaacaaacatttggttttgtacagacattatttccactctggtggataagttcaataaaggtcatatcccaaaaaaaaaaaaaaaaaaananaaaaaaaaaaaaagaaaaaaaaaaaaacagaaacaaaaaaaacacaaacaaagcaaaaaagaaaggaatactacatcatgcagaagcacgacgggagagaggccgggacggtcggccggaggcgcggccgcgcgcgagggccgcagcctgcgcgagcacatagatgatagccgatggaggtgagagtgcgcatcgcttaccttacacagcgagacgacgcaggcaggaatcgcaaggtgacactcacccgggtgtgggatgagagcagtgagcagctgaaggtggtggtgggtagcagacatagagggcgagcggtgaacactactattgggagtagacgggttcgagcgccgtcttctcggcgagcgtcatggaacatgccgtagtcctcgcatggtattcggtgtgcgatcgagtgagacttaagataggtgggcagagatagaagtgtgatctgggatcagagccgggctcacctggatgacgacgagcgaggagaacgaagacaaagacacggagaggaggaaaaactacgcagatcacgacgagcggtggagaccgagagccggaatgcggtggcagcgagcaagagggaacagagagatgcgcgcaacgacgagggagacgggaaccagtgcggtcaccatgactgccggggcgaatgaagcagcaggagacgaagcgaggc

SEQ ID NO: 448763 - DNA, 3927 bp, Homo sapiens
gcgtcttcagtatttaatgtctctgtgttccacccgcctgggctagcacgtgggggagctgcggaagcgcggcgctgcgggccgggccgcggggcacagccgggggccggcggcggcgcgcggactccgcatcccgcaccccgatggtagccgaggagctggtgtaattacttcaagcctccaggatggcaatccagttccgttcgctcttccccttggcattgcctgggatgctggcgctcctcggctggtggtggtttttctctcgtaaaaaaggccatgtcagcagccatgatgagcagcaggtggaggctggtgctgtgcagctgagggctgaccctgccatcaaggaacctctccccgtggaagacgtctgtcccaaagtagtgtccacaccccccagtgtcacagagcctccagaaaaggaactgtccaccgtgagcaagctgcctgcagagcccccagcattgctccagacacacccaccttgccgaagatcagagtcctcgggcattcttcctaacaccacagacatgagattgcgaccaggaacacgcagagatgacagtacaaagctggagctagccctgacaggtggtgaagccaaatcgattcctctagagtgccccctttcatccccaaagggtgtactattctccagcaaatcagctgaggtgtgtaagcaagattcccccttcagcagggtgccaaggaaggtccagccaggctaccccgtagtccccgcagagaagcgtagctctggggagagggcaagagagacaggtggggccgaagggactggtgatgccgtgttgggggaaaaggtgcttgaagaagctctgttgtctcgggagcatgtcttggaattggagaacagcaagggccccagcctggcctctttagagggggaagaagataaggggaagagcagctcatcccaggtggtggggccagtgcaggaggaagagtatgtagcagagaagttgccaagtaggttcatcgagtcggctcacacagagctggcaaaggacgatgcggcgccagcacccccagtcgcagacgccaaagcccaggacagaggtgtcgagggagaactgggcaatgaggagagcttggatagaaatgaggagggcttggatagaaatgaggagggcttggatagaaatgaggagagcttggatagaaatgaggagggcttggatagaaatgaggagattaagcgggctgccttccagataatctcccaagtgatctcagaagcaaccgaacaggtgctggccaccacggttggcaaggttgcaggtcgtgtgtgtcaggccagtcagctccaagggcagaaggaagagagctgtgtcccagttcaccagaaaactgtcttgggcccagacactgcggagcctgccacagcagaggcagctgttgccccgccggatgctggcctccccttgccaggcctaccagcagagggctcaccaccaccaaagacctacgtgagctgcctgaagagccttctgtccagccccaccaaggacagtaagccaaatatctctgcacaccacatctccctggcctcctgcctggcactgaccacccccagtgaagagttgccggaccgggcaggcatcctggtggaagatgccacctgtgtcacctgcatgtcagacagcagccaaagtgtccctttggtggcttctccaggacactgctcagattctttcagcacttcagggcttgaagactcttgcacagagaccagctcgagccccagggacaaggccatcaccccgccactgccagaaagtactgtgcccttcagcaatggggtgctgaagggggagttgtcagacttgggggctgaggatggatggaccatggatgcggaagcagatcattcaggaggttctgacaggaacagcatggattccgtggatagctgttgcagtctcaagaagactgagagcttccaaaatgcccaggcaggctccaaccctaagaaggtcgacctcatcatctgggagatcgaggtgccaaagcacttagtcggtcggctaattggcaagcaggggcgctatgtgagttttctgaagcaaacatctggtgccaagatctacatttcaaccctgccttacacccagagcgtccagatctgccacatagaaggctctcaacatcatgtagacaaagcgctgaacttgattgggaagaagttcaaagagctgaacctcaccaatatctacgctcccccattgccttcactggcactgccttctctgccgatgacatcctggctcatgctgcctgatggcatcaccgtggaggtcattgtggtcaaccaggtcaatgccgggcacctgttcgtgcagcagcacacacaccctaccttccacgcgctgcgcagcctcgaccagcagatgtacctctgttactctcagcctggaatccccaccttgcccaccccagtggaaataacggtcatctgtgccgcccctggtgcggacggggcctggtggcgagcccaagtggttgcctcctacgaggagaccaacgaagtggagattcgatacgtggactacggcggatataagagggtgaaagtagacgtgctccggcaaatcaggtctgactttgtcaccctgccgtttcagggagcagaagtccttctggacagtgtgatgcccctgtcagacgatgaccagttttcaccggaagcagatgccgccatgagcgagatgacggggaatacagcactgcttgctcaggtgacaagttacagtccaactggtcttcctctgattcagctgtggagtgtggttggagatgaagtggtgttgataaaccggtccctggtggagcgaggccttgcccagtgggtagacagctactacacaagcctttgacccccatgctgcttcctgagagtctttttttgcactgttgaaattgggcttggcactcaagtcaaagatgaacatcggaataacaaacattgtcctctccagaaagtcctttctttctccatactgtagtcctattgagaagacatttcgtctctgagaaaaaaggatggaactatgggttctcttcgcaaagccaaaggatagtgtttaacaagccagctggcttatcctggttctcagctgtttaaaaaaaaaaaaaaaaaggaatagaaacagtttcaaccagattgtcctattccccctgttccattcccctcttcttccttctatctccttccccggcaaaaaccaaacaaactggcagacaggccagggatgtatgttgcttgcttgagagggtttcttttacttcaaaatctttcttcagggagcaagacatgaactgactaattggtatccactacttgtacagcttacataaatgagttgatgatatttaaccagtttttataaacttcatttaggtctctaaacacagactttttaaattgcaactgtaaatatgaaatggtcatcacatctgaccttggtcagtggggaggggaactggtatcctgccaagcctggttgtaatttgtaaccattttctatttgtgcaaactctgtaaatatgtgtttaaacaaatgtaatattttgtacaagatacactggagaacaaagggaactcaagattcttccagccacatgtcacctgtaggtagaagtaaactctgcagtgcagcttctgctcttggcccctctggccagggcccctgtggcttcctgcacactggacaggtgactgtatggtagagactgtgatctgggaactttttgctgtacaaatctgtttaaaaaaaaaaaaagtaactcattgaattaacttgcagtggtgtgtttgattcttttttagactggcttcagcattgtgcagtttaaaaataagtaagtaacttacataaatcttcaattgtatgaactgcaaaaaaa

SEQ ID NO: 448764 - DNA, 4058 bp, Homo sapiens
actgtgacttacacaggcccctgaggatgaaggtaacagtcctgtgagcactgaggctgggctgggaccaacacctgagccatggctccagcactctgattcctggcccagccatgctgctgagggtgcacagcccaggcctaccatcgcccccacccttggtggcagaaccgagcactacccagcaaggtgtaattacttcaagcctccaggatggcaatccagttccgttcgctcttccccttggcattgcctgggatgctggcgctcctcggctggtggtggtttttctctcgtaaaaaaggccatgtcagcagccatgatgagcagcaggtggaggctggtgctgtgcagctgagggctgaccctgccatcaaggaacctctccccgtggaagacgtctgtcccaaagtagtgtccacaccccccagtgtcacagagcctccagaaaaggaactgtccaccgtgagcaagctgcctgcagagcccccagcattgctccagacacacccaccttgccgaagatcagagtcctcgggcattcttcctaacaccacagacatgagattgcgaccaggaacacgcagagatgacagtacaaagctggagctagccctgacaggtggtgaagccaaatcgattcctctagagtgccccctttcatccccaaagggtgtactattctccagcaaatcagctgaggtgtgtaagcaagattcccccttcagcagggtgccaaggaaggtccagccaggctaccccgtagtccccgcagagaagcgtagctctggggagagggcaagagagacaggtggggccgaagggactggtgatgccgtgttgggggaaaaggtgcttgaagaagctctgttgtctcgggagcatgtcttggaattggagaacagcaagggccccagcctggcctctttagagggggaagaagataaggggaagagcagctcatcccaggtggtggggccagtgcaggaggaagagtatgtagcagagaagttgccaagtaggttcatcgagtcggctcacacagagctggcaaaggacgatgcggcgccagcacccccagtcgcagacgccaaagcccaggacagaggtgtcgagggagaactgggcaatgaggagagcttggatagaaatgaggagggcttggatagaaatgaggagggcttggatagaaatgaggagagcttggatagaaatgaggagggcttggatagaaatgaggagattaagcgggctgccttccagataatctcccaagtgatctcagaagcaaccgaacaggtgctggccaccacggttggcaaggttgcaggtcgtgtgtgtcaggccagtcagctccaagggcagaaggaagagagctgtgtcccagttcaccagaaaactgtcttgggcccagacactgcggagcctgccacagcagaggcagctgttgccccgccggatgctggcctccccttgccaggcctaccagcagagggctcaccaccaccaaagacctacgtgagctgcctgaagagccttctgtccagccccaccaaggacagtaagccaaatatctctgcacaccacatctccctggcctcctgcctggcactgaccacccccagtgaagagttgccggaccgggcaggcatcctggtggaagatgccacctgtgtcacctgcatgtcagacagcagccaaagtgtccctttggtggcttctccaggacactgctcagattctttcagcacttcagggcttgaagactcttgcacagagaccagctcgagccccagggacaaggccatcaccccgccactgccagaaagtactgtgcccttcagcaatggggtgctgaagggggagttgtcagacttgggggctgaggatggatggaccatggatgcggaagcagatcattcaggagttgcagctccacccccgggaaagcggggcactttgataacgaggtgtcctgggtttttcgagtgctgaccccagcgtagacagttcagaccgctaacttacaggttctgacaggaacagcatggattccgtggatagctgttgcagtctcaagaagactgagagcttccaaaatgcccaggcaggctccaaccctaagaaggtcgacctcatcatctgggagatcgaggtgccaaagcacttagtcggtcggctaattggcaagcaggggcgctatgtgagttttctgaagcaaacatctggtgccaagatctacatttcaaccctgccttacacccagagcgtccagatctgccacatagaaggctctcaacatcatgtagacaaagcgctgaacttgattgggaagaagttcaaagagctgaacctcaccaatatctacgctcccccattgccttcactggcactgccttctctgccgatgacatcctggctcatgctgcctgatggcatcaccgtggaggtcattgtggtcaaccaggtcaatgccgggcacctgttcgtgcagcagcacacacaccctaccttccacgcgctgcgcagcctcgaccagcagatgtacctctgttactctcagcctggaatccccaccttgcccaccccagtggaaataacggtcatctgtgccgcccctggtgcggacggggcctggtggcgagcccaagtggttgcctcctacgaggagaccaacgaagtggagattcgatacgtggactacggcggatataagagggtgaaagtagacgtgctccggcaaatcaggtctgactttgtcaccctgccgtttcagggagcagaagtccttctggacagtgtgatgcccctgtcagacgatgaccagttttcaccggaagcagatgccgccatgagcgagatgacggggaatacagcactgcttgctcaggtgacaagttacagtccaactggtcttcctctgattcagctgtggagtgtggttggagatgaagtggtgttgataaaccggtccctggtggagcgaggccttgcccagtgggtagacagctactacacaagcctttgacccccatgctgcttcctgagagtctttttttgcactgttgaaattgggcttggcactcaagtcaaagatgaacatcggaataacaaacattgtcctctccagaaagtcctttctttctccatactgtagtcctattgagaagacatttcgtctctgagaaaaaaggatggaactatgggttctcttcgcaaagccaaaggatagtgtttaacaagccagctggcttatcctggttctcagctgtttaaaaaaaaaaaaaaaaaggaatagaaacagtttcaaccagattgtcctattccccctgttccattcccctcttcttccttctatctccttccccggcaaaaaccaaacaaactggcagacaggccagggatgtatgttgcttgcttgagagggtttcttttacttcaaaatctttcttcagggagcaagacatgaactgactaattggtatccactacttgtacagcttacataaatgagttgatgatatttaaccagtttttataaacttcatttaggtctctaaacacagactttttaaattgcaactgtaaatatgaaatggtcatcacatctgaccttggtcagtggggaggggaactggtatcctgccaagcctggttgtaatttgtaaccattttctatttgtgcaaactctgtaaatatgtgtttaaacaaatgtaatattttgtacaagatacactggagaacaaagggaactcaagattcttccagccacatgtcacctgtaggtagaagtaaactctgcagtgcagcttctgctcttggcccctctggccagggcccctgtggcttcctgcacactggacaggtgactgtatggtagagactgtgatctgggaactttttgctgtacaaatctgtttaaaaaaaaaaaaagtaactcattgaattaacttgcagtggtgtgtttgattcttttttagactggcttcagcattgtgcagtttaaaaataagtaagtaacttacataaatcttcaattgtatgaactgcaaaaaaa

SEQ ID NO: 448765 - DNA, 3787 bp, Homo sapiens
gcgtcttcagtatttaatgtctctgtgttccacccgcctgggctagcacgtgggggagctgcggaagcgcggcgctgcgggccgggccgcggggcacagccgggggccggcggcggcgcgcggactccgcatcccgcaccccgatggtagccgaggagctggtgtaattacttcaagcctccaggatggcaatccagttccgttcgctcttccccttggcattgcctgggatgctggcgctcctcggctggtggtggtttttctctcgtaaaaaaggccatgtcagcagccatgatgagcagcaggtggaggctggtgctgtgcagctgagggctgaccctgccatcaaggaacctctccccgtggaagacgtctgtcccaaagtagtgtccacaccccccagtgtcacagagcctccagaaaaggaactgtccaccgtgagcaagctgcctgcagagcccccagcattgctccagacacacccaccttgccgaagatcagagtcctcgggcattcttcctaacaccacagacatgagattgcgaccaggaacacgcagagatgacagtacaaagctggagctagccctgacaggtggtgaagccaaatcgattcctctagagtgccccctttcatccccaaagggtgtactattctccagcaaatcagctgaggtgtgtaagcaagattcccccttcagcagggtgccaaggaaggtccagccaggctaccccgtagtccccgcagagaagcgtagctctggggagagggcaagagagacaggtggggccgaagggactggtgatgccgtgttgggggaaaaggtgcttgaagaagctctgttgtctcgggagcatgtcttggaattggagaacagcaagggccccagcctggcctctttagagggggaagaagataaggggaagagcagctcatcccaggtggtggggccagtgcaggaggaagagtatgtagcagagaagttgccaagtaggttcatcgagtcggctcacacagagctggcaaaggacgatgcggcgccagcacccccagtcgcagacgccaaagcccaggacagaggtgtcgagggagaactgggcaatgaggagagcttggatagaaatgaggagggcttggatagaaatgaggagggcttggatagaaatgaggagagcttggatagaaatgaggagggcttggatagaaatgaggagattaagcgggctgccttccagataatctcccaagtgatctcagaagcaaccgaacaggtgctggccaccacggttggcaaggttgcaggtcgtgtgtgtcaggccagtcagctccaagggcagaaggaagagagctgtgtcccagttcaccagaaaactgtcttgggcccagacactgcggagcctgccacagcagaggcagctgttgccccgccggatgctggcctccccttgccaggcctaccagcagagggctcaccaccaccaaagacctacgtgagctgcctgaagagccttctgtccagccccaccaaggacagtaagccaaatatctctgcacaccacatctccctggcctcctgcctggcactgaccacccccagtgaagagttgccggaccgggcaggcatcctggtggaagatgccacctgtgtcacctgcatgtcagacagcagccaaagtgtccctttggtggcttctccaggacactgctcagattctttcagcacttcagggcttgaagactcttgcacagagaccagctcgagccccagggacaaggccatcaccccgccactgccagaaagtactgtgcccttcagcaatggggtgctgaagggggagttgtcagacttgggggctgaggatggatggaccatggatgcggaagcagatcattcaggaggttctgacaggaacagcatggattccgtggatagctgttgcagtctcaagaagactgagagcttccaaaatgcccaggcaggctccaaccctaagaaggtcgacctcatcatctgggagatcgaggtgccaaagcacttagtcggtcggctaattggcaagcaggggcgctatgtgagttttctgaagcaaacatctggtgccaagatctacatttcaaccctgccttacacccagagcgtccagatctgccacatagaaggctctcaacatcatgtagacaaagcgctgaacttgattgggaagaagttcaaagagctgaacctcaccaatatctacgctcccccattgccttcactggcactgccttctctgccgatgacatcctggctcatgctgcctgatggcatcaccgtggaggtcattgtggtcaaccaggtcaatgccgggcacctgttcgtgcagcagcacacacaccctaccttccacgcgctgcgcagcctcgaccagcagatgtacctctgttactctcagcctggaatccccaccttgcccaccccagtggaaataacggtcatctgtgccgcccctggtgcggacggggcctggtggcgagcccaagtggttgcctcctacgaggagaccaacgaagtggagattcgatacgtggactacggcggatataagagggtgaaagtagacgtgctccggcaaatcaggtctgactttgtcaccctgccgtttcagggagcagaagtccttctggacagtgtgatgcccctgtcagacgatgaccagttttcaccggaagcagatgccgccatgagcgagatgacggggaatacagcactgcttgctcaggtgacaagttacagtccaactggtcttcctctgattcagctgtggagtgtggttggagatgaagtggtgttgataaaccggtccctggtggagcgaggccttgcccagtgggtagacagctactacacaagcctttgacccccatgctgcttcctgagagtctttttttgcactgttgaaattgggcttggcactcaagtcaaagatgaacatcggaataacaaacattgtcctctccagaaagtcctttctttctccatactgtagtcctattgagaagacatttcgtctctgagaaaaaaggatggaactatgggttctcttcgcaaagccaaaggatagtgtttaacaagccagctggcttatcctggttctcagctgtttaaaaaaaaaaaaaaaaaggaatagaaacagtttcaaccagattgtcctattccccctgttccattcccctcttcttccttctatctccttccccggcaaaaaccaaacaaactggcagacaggccagggatgtatgttgcttgcttgagagggtttcttttacttcaaaatctttcttcagggagcaagacatgaactgactaattggtatccactacttgtacagcttacataaatgagttgatgatatttaaccattttctatttgtgcaaactctgtaaatatgtgtttaaacaaatgtaatattttgtacaagatacactggagaacaaagggaactcaagattcttccagccacatgtcacctgtaggtagaagtaaactctgcagtgcagcttctgctcttggcccctctggccagggcccctgtggcttcctgcacactggacaggtgactgtatggtagagactgtgatctgggaactttttgctgtacaaatctgtttaaaaaaaaaaaaagtaactcattgaattaacttgcagtggtgtgtttgattcttttttagactggcttcagcattgtgcagtttaaaaataagtaagtaacttacataaatcttcaattgtatgaactgcaaaaaaa

SEQ ID NO: 448766 - DNA, 4809 bp, Homo sapiens
actgtgacttacacaggcccctgaggatgaaggtaacagtcctgtgagcactgaggctgggctgggaccaacacctgagccatggctccagcactctgattcctggcccagccatgctgctgagggtgcacagcccaggcctaccatcgcccccacccttggtggcagaaccgagcactacccagcaaggtgtaattacttcaagcctccaggatggcaatccagttccgttcgctcttccccttggcattgcctgggatgctggcgctcctcggctggtggtggtttttctctcgtaaaaaaggccatgtcagcagccatgatgagcagcaggtggaggctggtgctgtgcagctgagggctgaccctgccatcaaggaacctctccccgtggaagacgtctgtcccaaagtagtgtccacaccccccagtgtcacagagcctccagaaaaggaactgtccaccgtgagcaagctgcctgcagagcccccagcattgctccagacacacccaccttgccgaagatcagagtcctcgggcattcttcctaacaccacagacatgagattgcgaccaggaacacgcagagatgacagtacaaagctggagctagccctgacaggtggtgaagccaaatcgattcctctagagtgccccctttcatccccaaagggtgtactattctccagcaaatcagctgaggtgtgtaagcaagattcccccttcagcagggtgccaaggaaggtccagccaggctaccccgtagtccccgcagagaagcgtagctctggggagagggcaagagagacaggtggggccgaagggactggtgatgccgtgttgggggaaaaggtgcttgaagaagctctgttgtctcgggagcatgtcttggaattggagaacagcaagggccccagcctggcctctttagagggggaagaagataaggggaagagcagctcatcccaggtggtggggccagtgcaggaggaagagtatgtagcagagaagttgccaagtaggttcatcgagtcggctcacacagagctggcaaaggacgatgcggcgccagcacccccagtcgcagacgccaaagcccaggacagaggtgtcgagggagaactgggcaatgaggagagcttggatagaaatgaggagggcttggatagaaatgaggagggcttggatagaaatgaggagagcttggatagaaatgaggagggcttggatagaaatgaggagattaagcgggctgccttccagataatctcccaagtgatctcagaagcaaccgaacaggtgctggccaccacggttggcaaggttgcaggtcgtgtgtgtcaggccagtcagctccaagggcagaaggaagagagctgtgtcccagttcaccagaaaactgtcttgggcccagacactgcggagcctgccacagcagaggcagctgttgccccgccggatgctggcctccccttgccaggcctaccagcagagggctcaccaccaccaaagacctacgtgagctgcctgaagagccttctgtccagccccaccaaggacagtaagccaaatatctctgcacaccacatctccctggcctcctgcctggcactgaccacccccagtgaagagttgccggaccgggcaggcatcctggtggaagatgccacctgtgtcacctgcatgtcagacagcagccaaagtgtccctttggtggcttctccaggacactgctcagattctttcagcacttcagggcttgaagactcttgcacagagaccagctcgagccccagggacaaggccatcaccccgccactgccagaaagtactgtgcccttcagcaatggggtgctgaagggggagttgtcagacttgggggctgaggatggatggaccatggatgcggaagcagatcattcaggagttgcagctccacccccgggaaagcggggcactttgataacgaggtgtcctgggtttttcgagtgctgaccccagcgtagacagttcagaccgctaacttacaggttctgacaggaacagcatggattccgtggatagctgttgcagtctcaagaagactgagagcttccaaaatgcccaggcaggctccaaccctaagaaggtcgacctcatcatctgggagatcgaggtgccaaagcacttagtcggtcggctaattggcaagcaggggcgctatgtgagttttctgaagcaaacatctggtgccaagatctacatttcaaccctgccttacacccagagcgtccagatctgccacatagaaggctctcaacatcatgtagacaaagcgctgaacttgattgggaagaagttcaaagagctgaacctcaccaatatctacgctcccccattgccttcactggcactgccttctctgccgatgacatcctggctcatgctgcctgatggcatcaccgtggaggtcattgtggtcaaccaggtcaatgccgggcacctgttcgtgcagcagcacacacaccctaccttccacgcgctgcgcagcctcgaccagcagatgtacctctgttactctcagcctggaatccccaccttgcccaccccagtggaaataacggtcatctgtgccgcccctggtgcggacggggcctggtggcgagcccaagtggttgcctcctacgaggagaccaacgaagtggagattcgatacgtggactacggcggatataagagggtgaaagtagacgtgctccggcaaatcaggtctgactttgtcaccctgccgtttcagggagcagaagtccttctggacagtgtgatgcccctgtcagacgatgaccagttttcaccggaagcagatgccgccatgagcgagatgacggggaatacagcactgcttgctcaggtgacaagttacagtccaactggtcttcctctgattcagctgtggagtgtggttggagatgaagtggtgttgataaaccggtccctggtggagcgaggccttgcccagtgggtagacagctactacacaagcctttgacccccatgctgcttcctgagagtctttttttgcactgttgaaattgggcttggcactcaagtcaaagatgaacatcggaataacaaacattgtcctcctttttctgttccaggatcaaatcccagctaccacactgcatttagtcatcaaatcaccctagttttctctggtctctgatatttcctcagtcttttcttgtttttttgtttgtttgattgtttgttttttgtttttttttttttcatgaccctgacagttttgaagagtctggtcaggtaccctataaaaattttcccagtctgaggtttatctgatgttttcccctcataattaggctcaaattaggggtgttttgaaagactaccctagaggtgatgtgtccttcttatcatatcatatcaggggtttttgataggtagccacatgccattactggagatgttaaccttcatcacttagttccggtagtgcttgcttaatttctcccctataaagttactatttttccttcttcatattttatgctttagaagcagagcactaagtctacccaaccttcaaggagaagggggaaagggaactcagccgcatctcccggaaaggggaacagccacatttattatttgaaattctcctgtatggaagatttgcccattattcctcacttatctctttattcaaacatttatttatttatatcagtacaaactcatggataattatatcatactttgtgtaataatccaaatactacgttatttattttattgttcaatttgttccagctttggctggtgggagctctttcaggttggctcctatattcctttgatatacccgtatcctttttttgagcactatcttactctctgccactacaagatgctgtacgctcaccttgtatttttccttccccagtgctagaatcagccatttctccaaggactctggctcctcttgttggagaatgatattagaaaccaagatttgtgccctgagtgttctaattgctagcaaggtgtcattgactctaggccctctcagttaacatagctaagaaatgcatgatttgtgtgaactaaccaatatatatacacatatctataaatatttatatatctatccatctgtatctacattaaactaaacatgagtttgtactaatacactgccacagggctcactgagtcacatttttaaaagatcgctccaaaaatattttataaaacaacagcaacaaaaagggataactaactgttccaagagtggaggcagtgagaccagtttaggctgttgtcatctaggcaagagatgatataggtttgaattaggatggtaacaaacaacaaggaggagatggagctgattccagacagactttgaagatacagctggtaggatttgatggtagtttggatatgaagtaggggtaggagaatgaggggaaatagaaggatgaaggacaactcatggattggaggtctgaaggaaatgtgtgcactgtgatgccatttgctgaggtggggaatactagggaaggcgcagctttggaggggaggatacagacatcaaaagttctgtttttatcttgctaagtttgagaagctctttagacaaggtgacaagtcaaatgagcgggcacacctaggagtgtggagctcctgcgaggagtctggactagagatataaattatagtgttatcagcatacagatggtaattgaagccagggggctagatgtgataacccagggagaaggcaagagtgatgacaaaaaaaaa

SEQ ID NO: 448767 - DNA, 3284 bp, Homo sapiens
actgtgacttacacaggcccctgaggatgaaggtaacagtcctgtgagcactgaggctgggctgggaccaacacctgagccatggctccagcactctgattcctggcccagccatgctgctgagggtgcacagcccaggcctaccatcgcccccacccttggtggcagaaccgagcactacccagcaaggtgtaattacttcaagcctccaggatggcaatccagttccgttcgctcttccccttggcattgcctgggatgctggcgctcctcggctggtggtggtttttctctcgtaaaaaaggccatgtcagcagccatgatgagcagcaggtggaggctggtgctgtgcagctgagggctgaccctgccatcaaggaacctctccccgtggaagacgtctgtcccaaagtagtgtccacaccccccagtgtcacagagcctccagaaaaggaactgtccaccgtgagcaagctgcctgcagagcccccagcattgctccagacacacccaccttgccgaagatcagagtcctcgggcattcttcctaacaccacagacatgagattgcgaccaggaacacgcagagatgacagtacaaagctggagctagccctgacaggtggtgaagccaaatcgattcctctagagtgccccctttcatccccaaagggtgtactattctccagcaaatcagctgaggtgtgtaagcaagattcccccttcagcagggtgccaaggaaggtccagccaggctaccccgtagtccccgcagagaagcgtagctctggggagagggcaagagagacaggtggggccgaagggactggtgatgccgtgttgggggaaaaggtgcttgaagaagctctgttgtctcgggagcatgtcttggaattggagaacagcaagggccccagcctggcctctttagagggggaagaagataaggggaagagcagctcatcccaggtggtggggccagtgcaggaggaagagtatgtagcagagaagttgccaagtaggttcatcgagtcggctcacacagagctggcaaaggacgatgcggcgccagcacccccagtcgcagacgccaaagcccaggacagaggtgtcgagggagaactgggcaatgaggagagcttggatagaaatgaggagggcttggatagaaatgaggagggcttggatagaaatgaggagagcttggatagaaatgaggagggcttggatagaaatgaggagattaagcgggctgccttccagataatctcccaagtgatctcagaagcaaccgaacaggtgctggccaccacggttggcaaggttgcaggtcgtgtgtgtcaggccagtcagctccaagggcagaaggaagagagctgtgtcccagttcaccagaaaactgtcttgggcccagacactgcggagcctgccacagcagaggcagctgttgccccgccggatgctggcctccccttgccaggcctaccagcagagggctcaccaccaccaaagacctacgtgagctgcctgaagagccttctgtccagccccaccaaggacagtaagccaaatatctctgcacaccacatctccctggcctcctgcctggcactgaccacccccagtgaagagttgccggaccgggcaggcatcctggtggaagatgccacctgtgtcacctgcatgtcagacagcagccaaagtgtccctttggtggcttctccaggacactgctcagattctttcagcacttcagggcttgaagactcttgcacagagaccagctcgagccccagggacaaggccatcaccccgccactgccagaaagtactgtgcccttcagcaatggggtgctgaagggggagttgtcagacttgggggctgaggatggatggaccatggatgcggaagcagatcattcaggagttgcagctccacccccgggaaagcggggcactttgataacgaggtgtcctgggtttttcgagtgctgaccccagcgtagacagttcagaccgctaacttacaggttctgacaggaacagcatggattccgtggatagctgttgcagtctcaagaagactgagagcttccaaaatgcccaggcaggctccaaccctaagaaggtcgacctcatcatctgggagatcgaggtgccaaagcacttagtcggtcggctaattggcaagcaggggcgctatgtgagttttctgaagcaaacatctggtgccaagatctacatttcaaccctgccttacacccagagcgtccagatctgccacatagaaggctctcaacatcatgtagacaaagcgctgaacttgattgggaagaagttcaaagagctgaacctcaccaatatctacgctcccccattgccttcactggcactgccttctctgccgatgacatcctggctcatgctgcctgatggcatcaccgtggaggtcattgtggtcaaccaggtcaatgccgggcacctgttcgtgcagcagcacacacaccctaccttccacgcgctgcgcagcctcgaccagcagatgtacctctgttactctcagcctggaatccccaccttgcccaccccagtggaaataacggtcatctgtgccgcccctggtgcggacggggcctggtggcgagcccaagtggttgcctcctacgaggagaccaacgaagtggagattcgatacgtggactacggcggatataagagggtgaaagtagacgtgctccggcaaatcaggtctgactttgtcaccctgccgtttcagggagcagaagtccttctggacagtgtgatgcccctgtcagacgatgaccagttttcaccggaagcagatgccgccatgagcgagatgacggggaatacagcactgcttgctcaggtgacaagttacagtccaactggtcttcctctgattcagctgtggagtgtggttggagatgaagtggtgttgataaaccggtccctggtggagcgaggccttgcccagtgggtagacagctactacacaagccatatatagacaccaccatagacatagagtgtcattagagaagtagttttctaatcgcacattgtgtgcaaaattgcgcgcctcttggcactacaagtcctaagatgacaccattcaggaacaacacaaccagtgcgtcctctcccagcaagtccctatcatctatcgtccatagcatgtaagtcctattgacgagaagtgttctgtctctagagacaaaaatggattggaacatagtacgttcatactgggcaaatgacca

SEQ ID NO: 448768 - DNA, 2924 bp, Homo sapiens
actgtgacttacacaggcccctgaggatgaaggtaacagtcctgtgagcactgaggctgggctgggaccaacacctgagccatggctccagcactctgattcctggcccagccatgctgctgagggtgcacagcccaggcctaccatcgcccccacccttggtggcagaaccgagcactacccagcaaggtgtaattacttcaagcctccaggatggcaatccagttccgttcgctcttccccttggcattgcctgggatgctggcgctcctcggctggtggtggtttttctctcgtaaaaaaggccatgtcagcagccatgatgagcagcaggtggaggctggtgctgtgcagctgagggctgaccctgccatcaaggaacctctccccgtggaagacgtctgtcccaaagtagtgtccacaccccccagtgtcacagagcctccagaaaaggaactgtccaccgtgagcaagctgcctgcagagcccccagcattgctccagacacacccaccttgccgaagatcagagtcctcgggcattcttcctaacaccacagacatgagattgcgaccaggaacacgcagagatgacagtacaaagctggagctagccctgacaggtggtgaagccaaatcgattcctctagagtgccccctttcatccccaaagggtgtactattctccagcaaatcagctgaggtgtgtaagcaagattcccccttcagcagggtgccaaggaaggtccagccaggctaccccgtagtccccgcagagaagcgtagctctggggagagggcaagagagacaggtggggccgaagggactggtgatgccgtgttgggggaaaaggtgcttgaagaagctctgttgtctcgggagcatgtcttggaattggagaacagcaagggccccagcctggcctctttagagggggaagaagataaggggaagagcagctcatcccaggtggtggggccagtgcaggaggaagagtatgtagcagagaagttgccaagtaggttcatcgagtcggctcacacagagctggcaaaggacgatgcggcgccagcacccccagtcgcagacgccaaagcccaggacagaggtgtcgagggagaactgggcaatgaggagagcttggatagaaatgaggagggcttggatagaaatgaggagggcttggatagaaatgaggagagcttggatagaaatgaggagggcttggatagaaatgaggagattaagcgggctgccttccagataatctcccaagtgatctcagaagcaaccgaacaggtgctggccaccacggttggcaaggttgcaggtcgtgtgtgtcaggccagtcagctccaagggcagaaggaagagagctgtgtcccagttcaccagaaaactgtcttgggcccagacactgcggagcctgccacagcagaggcagctgttgccccgccggatgctggcctccccttgccaggcctaccagcagagggctcaccaccaccaaagacctacgtgagctgcctgaagagccttctgtccagccccaccaaggacagtaagccaaatatctctgcacaccacatctccctggcctcctgcctggcactgaccacccccagtgaagagttgccggaccgggcaggcatcctggtggaagatgccacctgtgtcacctgcatgtcagacagcagccaaagtgtccctttggtggcttctccaggacactgctcagattctttcagcacttcagggcttgaagactcttgcacagagaccagctcgagccccagggacaaggccatcaccccgccactgccagaaagtactgtgcccttcagcaatggggtgctgaagggggagttgtcagacttgggggctgaggatggatggaccatggatgcggaagcagatcattcaggagttgcagctccacccccgggaaagcggggcactttgataacgaggtgtcctgggtttttcgagtgctgaccccagcgtagacagttcagaccgctaacttacaggttctgacaggaacagcatggattccgtggatagctgttgcagtctcaagaagactgagagcttccaaaatgcccaggcaggctccaaccctaagaaggtcgacctcatcatctgggagatcgaggtgccaaagcacttagtcggtcggctaattggcaagcaggggcgctatgtgagttttctgaagcaaacatctggtgccaagatctacatttcaaccctgccttacacccagagcgtccagatctgccacatagaaggctctcaacatcatgtagacaaagcgctgaacttgattgggaagaagttcaaagagctgaacctcaccaatatctacgctcccccattgccttcactggcactgccttctctgccgatgacatcctggctcatgctgcctgatggcatcaccgtggaggtcattgtggtcaaccaggtcaatgccgggcacctgttcgtgcagcagcacacacaccctaccttccacgcgctgcgcagcctcgaccagcagatgtacctctgttactctcagcctggaatccccaccttgcccaccccagtggaaataacggtcatctgtgccgcccctggtgcggacggggcctggtggcgagcccaagtggttgcctcctacgaggagaccaacgaagtggagattcgatacgtggactacggcggatataagagggtgaaagtagacgtgctccggcaaatcagctgactttgtcaccctgccgtttaaggggacaaaattccttttgggaaagggtgaatgccccctgtaaaaacaatgaaccatttttttatccggaagacttatgccgccattaaaccaaattaactggggaattccatctattggtttggcttaggtgtacatagttatcattact

SEQ ID NO: 448769 - DNA, 2852 bp, Homo sapiens
actgtgacttacacaggcccctgaggatgaaggtaacagtcctgtgagcactgaggctgggctgggaccaacacctgagccatggctccagcactctgattcctggcccagccatgctgctgagggtgcacagcccaggcctaccatcgcccccacccttggtggcagaaccgagcactacccagcaaggtgtaattacttcaagcctccaggatggcaatccagttccgttcgctcttccccttggcattgcctgggatgctggcgctcctcggctggtggtggtttttctctcgtaaaaaaggccatgtcagcagccatgatgagcagcaggtggaggctggtgctgtgcagctgagggctgaccctgccatcaaggaacctctccccgtggaagacgtctgtcccaaagtagtgtccacaccccccagtgtcacagagcctccagaaaaggaactgtccaccgtgagcaagctgcctgcagagcccccagcattgctccagacacacccaccttgccgaagatcagagtcctcgggcattcttcctaacaccacagacatgagattgcgaccaggaacacgcagagatgacagtacaaagctggagctagccctgacaggtggtgaagccaaatcgattcctctagagtgccccctttcatccccaaagggtgtactattctccagcaaatcagctgaggtgtgtaagcaagattcccccttcagcagggtgccaaggaaggtccagccaggctaccccgtagtccccgcagagaagcgtagctctggggagagggcaagagagacaggtggggccgaagggactggtgatgccgtgttgggggaaaaggtgcttgaagaagctctgttgtctcgggagcatgtcttggaattggagaacagcaagggccccagcctggcctctttagagggggaagaagataaggggaagagcagctcatcccaggtggtggggccagtgcaggaggaagagtatgtagcagagaagttgccaagtaggttcatcgagtcggctcacacagagctggcaaaggacgatgcggcgccagcacccccagtcgcagacgccaaagcccaggacagaggtgtcgagggagaactgggcaatgaggagagcttggatagaaatgaggagggcttggatagaaatgaggagggcttggatagaaatgaggagagcttggatagaaatgaggagggcttggatagaaatgaggagattaagcgggctgccttccagataatctcccaagtgatctcagaagcaaccgaacaggtgctggccaccacggttggcaaggttgcaggtcgtgtgtgtcaggccagtcagctccaagggcagaaggaagagagctgtgtcccagttcaccagaaaactgtcttgggcccagacactgcggagcctgccacagcagaggcagctgttgccccgccggatgctggcctccccttgccaggcctaccagcagagggctcaccaccaccaaagacctacgtgagctgcctgaagagccttctgtccagccccaccaaggacagtaagccaaatatctctgcacaccacatctccctggcctcctgcctggcactgaccacccccagtgaagagttgccggaccgggcaggcatcctggtggaagatgccacctgtgtcacctgcatgtcagacagcagccaaagtgtccctttggtggcttctccaggacactgctcagattctttcagcacttcagggcttgaagactcttgcacagagaccagctcgagccccagggacaaggccatcaccccgccactgccagaaagtactgtgcccttcagcaatggggtgctgaagggggagttgtcagacttgggggctgaggatggatggaccatggatgcggaagcagatcattcaggaggttctgacaggaacagcatggattccgtggatagctgttgcagtctcaagaagactgagagcttccaaaatgcccaggcaggctccaaccctaagaaggtcgacctcatcatctgggagatcgaggtgccaaaggaaacgcttcttgaaatcgagatccgcgacgtatgtgaggtacatggcagggcgcggcatcatggtgacgtttctctgagaggcgatcacatctggtgccaagatctacatttcaaccctgccttacacccagagcgtccagatctgccacatagaaggctctcaacatcatgtagacaaagcgctgaacttgattgggaagaagttcaaagagctgaacctcaccaatatctacgctcccccattgccttcactggcactgccttctctgccgatgacatcctggctcatgctgcctgatggcatcaccgtggaggtcattgtggtcaaccaggtcaatgccgggcacctgttcgtgcagcagcacacacaccctaccttccacgcgctgcgcagcctcgaccagcagatgtacctctgttactctcagcctggaatccccaccttgcccaccccagtggaaataacggtcatctgtgccgcccctggtgcggacggggcctggtggcgagcccaagtggttgcctcctacgaggagaccaacgaagtggagattcgatacgtggactacggcggatataagagggtgaaagtagacgtgctccggcaaatcagctgactttgtcaccctgccgtttaaggggacaaaattccttttgggaaagggtgaatgccccctgtaaaaacaatgaaccatttttttatccggaagacttatgccgccattaaaccaaattaactggggaattccatctattggtttggcttaggtgtacatagttatcattact

SEQ ID NO: 448770 - DNA, 734 bp, Homo sapiens
gcgtcttcagtatttaatgtctctgtgttccacccgcctgggctagcacgtgggggagctgcggaagcgcggcgctgcgggccgggccgcggggcacagccgggggccggcggcggcgcgcggactccgcatcccgcaccccgatggtagccgaggagctggtgtaattacttcaagcctccaggatggcaatccagttccgttcgctcttccccttggcattgcctgggatgctggcgctcctcggctggtggtggtttttctctcgtaaaaaaggccatgtcagcagccatgatgagcagcaggtggaggctggtgctgtgcagctgagggctgaccctgccatcaaggaacctctccccgtggaagacgtctgtcccaaagtagtgtccacaccccccagtgtcacagagcctccagaaaaggaactgtccaccgtgagcaagctgcctgcagagcccccagcattgctccagacacacccaccttgccgaagatcagagtcctcgggcattcttcctaacaccacagacatgactttccaaaaaaaaaaaaaaaaaaaaaaaaaaaaaaaaaaaaaaaaaacgtggggggtattttatgtgtggggggggggagaagaaggtttaagagggggaatgggccaatgtgtgtttttggaggaccagttttttgtaaggggggaaaatggggggccccaaagagaaggggaaaatgaaaagggggtagtgttg

SEQ ID NO: 448771 - DNA, 457 bp, Homo sapiens
ggtgggggacagtcctagacaggacctcacaaccccactgtgagctaatttgggatctctagggtacccacatgaagtcatagcttactgtgacttacacaggcccctgaggatgaaggtaacagtcctgtgagcactgaggctgggctgggaccaacacctgagccatggctccagcactctgattcctggcccagccatgctgctgagggtgcacagcccaggcctaccatcgcccccacccttggtggcagaaccgagcactacccagcaaggtaggtgttggcggctgcagcatgtatccagccctcctgttcattggggccttctgggaacaccctttagagctgcattgtccagtaggtagctgccagctgcaggtggagagttcaagttaacctaaagtagaattcagtgccctagtcacactggtcacatttcaagtgctcagtaacct

SEQ ID NO: 448772 - DNA, 440 bp, Homo sapiens
tgagcttcctgagtggtcgctgtcaccttggcagaaagcctcagccattttctttctgtgcagttgcagctccacccccgggaaagcggggcactttgataacgaggtgtcctgggtttttcgagtgctgaccccagcgtagacagttcagaccgctaacttacaggtcagcagctcctgaccctgcttctgcaggcaccctggggtgttttcatttatctcatggagagaggccacgaatatcccgagtggctctctgacttgtttgtcctggagccattccctcccatttcagctccgggtaggttgggaatctttattgggaattttaccactttcagcagcatctagtttgtaccacacgctacattttgtcacctccaagatgctgttaagacactactgtttttatgtaccttggaaagaaaaaagtgctgcca

SEQ ID NO: 448773 - DNA, 519 bp, Homo sapiens
cttcccttgagtgccaggtatgggtgtgagtgttttgaatggtttttatttccttttaatcatgtgcttgttcccatgtcttcacctgctttccttctccagaagctcttacagggtaagtgcccaaagaacggccacagctttgaatacttgtgggaggcttgagcttcctgagtggtcgctgtcaccttggcagaaagcctcagccattttctttctgtgcagttgcagctccacccccgggaaagcggggcactttgataacgaggtgtcctgggtttttcgagtgctgaccccagcgtagacagttcagaccgctaacttacaggtcagcagctcctgaccctgcttctgcaggcaccctggggtgttttcatttatctcatggagagaggccacgaatatcccgagtggctctctgacttgtttgtcctggagccattccctcccatttcagctccgggtaggttgggaatctttattgggaattttaccactttcagcagcatctagtttgta

SEQ ID NO: 448774 - DNA, 3964 bp, Homo sapiens
  misc_feature (44)..(44): n is a, c, g, or t
ccacgagatatgttatatgtactgatacctcggtgtataattcnagtacgatggcttgttgtctaccgcgctatttactatggcacgtgggggagctgcggaagcgcggcgctgcgggccgggccgcggggcacagccgggggccggcggcggcgcgcggactccgcatcccgcaccccgatggtagccgaggagctggtgtaattacttcaagcctccaggatggcaatccagttccgttcgctcttccccttggcattgcctgggatgctggcgctcctcggctggtggtggtttttctctcgtaaaaaaggccatgtcagcagccatgatgagcagcaggtggaggctggtgctgtgcagctgagggctgaccctgccatcaaggaacctctccccgtggaagacgtctgtcccaaagtagtgtccacaccccccagtgtcacagagcctccagaaaaggaactgtccaccgtgagcaagctgcctgcagagcccccagcattgctccagacacacccaccttgccgaagatcagagtcctcgggcattcttcctaacaccacagacatgagattgcgaccaggaacacgcagagatgacagtacaaagctggagctagccctgacaggtggtgaagccaaatcgattcctctagagtgccccctttcatccccaaagggtgtactattctccagcaaatcagctgaggtgtgtaagcaagattcccccttcagcagggtgccaaggaaggtccagccaggctaccccgtagtccccgcagagaagcgtagctctggggagagggcaagagagacaggtggggccgaagggactggtgatgccgtgttgggggaaaaggtgcttgaagaagctctgttgtctcgggagcatgtcttggaattggagaacagcaagggccccagcctggcctctttagagggggaagaagataaggggaagagcagctcatcccaggtggtggggccagtgcaggaggaagagtatgtagcagagaagttgccaagtaggttcatcgagtcggctcacacagagctggcaaaggacgatgcggcgccagcacccccagtcgcagacgccaaagcccaggacagaggtgtcgagggagaactgggcaatgaggagagcttggatagaaatgaggagggcttggatagaaatgaggagggcttggatagaaatgaggagagcttggatagaaatgaggagggcttggatagaaatgaggagattaagcgggctgccttccagataatctcccaagtgatctcagaagcaaccgaacaggtgctggccaccacggttggcaaggttgcaggtcgtgtgtgtcaggccagtcagctccaagggcagaaggaagagagctgtgtcccagttcaccagaaaactgtcttgggcccagacactgcggagcctgccacagcagaggcagctgttgccccgccggatgctggcctccccttgccaggcctaccagcagagggctcaccaccaccaaagacctacgtgagctgcctgaagagccttctgtccagccccaccaaggacagtaagccaaatatctctgcacaccacatctccctggcctcctgcctggcactgaccacccccagtgaagagttgccggaccgggcaggcatcctggtggaagatgccacctgtgtcacctgcatgtcagacagcagccaaagtgtccctttggtggcttctccaggacactgctcagattctttcagcacttcagggcttgaagactcttgcacagagaccagctcgagccccagggacaaggccatcaccccgccactgccagaaagtactgtgcccttcagcaatggggtgctgaagggggagttgtcagacttgggggctgaggatggatggaccatggatgcggaagcagatcattcaggaggttctgacaggaacagcatggattccgtggatagctgttgcagtctcaagaagactgagagcttccaaaatgcccaggcaggctccaaccctaagaaggtcgacctcatcatctgggagatcgaggtgccaaagcacttagtcggtcggctaattggcaagcaggggcgctatgtgagttttctgaagcaaacatctggtgccaagatctacatttcaaccctgccttacacccagagcgtccagatctgccacatagaaggctctcaacatcatgtagacaaagcgctgaacttgattgggaagaagttcaaagagctgaacctcaccaatatctacgctcccccattgccttcactggcactgccttctctgccgatgacatcctggctcatgctgcctgatggcatcaccgtggaggtcattgtggtcaaccaggtcaatgccgggcacctgttcgtgcagcagcacacacaccctaccttccacgcgctgcgcagcctcgaccagcagatgtacctctgttactctcagcctggaatccccaccttgcccaccccagtggaaataacggtcatctgtgccgcccctggtgcggacggggcctggtggcgagcccaagtggttgcctcctacgaggagaccaacgaagtggagattcgatacgtggactacggcggatataagagggtgaaagtagacgtgctccggcaaatcaggtctgactttgtcaccctgccgtttcagggagcagaagtccttctggacagtgtgatgcccctgtcagacgatgaccagttttcaccggaagcagatgccgccatgagcgagatgacggggaatacagcactgcttgctcaggtgacaagttacagtccaactggtcttcctctgattcagctgtggagtgtggttggagatgaagtggtgttgataaaccggtccctggtggagcgaggccttgcccagtgggtagacagctactacacaagcctttgacccccatgctgcttcctgagagtctttttttgcactgttgaaattgggcttggcactcaagtcaaagatgaacatcggaataacaaacattgtcctctccagaaagtcctttctttctccatactgtagtcctattgagaagacatttcgtctctgagaaaaaaggatggaactatgggttctcttcgcaaagccaaaggatagtgtttaacaagccagctggcttatcctggttctcagctgtttaaaaaaaaaaaaaaaaaggaatagaaacagtttcaaccagattgtcctattccccctgttccattcccctcttcttccttctatctccttccccggcaaaaaccaaacaaactggcagacaggccagggatgtatgttgcttgcttgagagggtttcttttacttcaaaatctttcttcagggagcaagacatgaactgactaattggtatccactacttgtacagcttacataaatgagttgatgatatttaaccagtttttataaacttcatttaggtctctaaacacagactttttaaattgcaactgtaaatatgaaatggtcatcacatctgaccttggtcagtggggaggggaactggtatcctgccaagcctggttgtaatttgtaaccattttctatttgtgcaaactctgtaaatatgtgtttaaacaaatgtaatattttgtacaagatacactggagaacaaagggaactcaagattcttccagccacatgtcacctgtaggtagaagtaaactctgcagtgcagcttctgctcttggcccctctggccagggcccctgtggcttcctgcacactggacaggtgactgtatggtagagactgtgatctgggaactttttgctgtacaaatctgtttaaaaaaaaaaaaagtaactcattgaattaacttgcagtggtgtgtttgattcttttttagactggcttcagcattgtgcagtttaaaaataagtaagtaacttacataaatcttcaattgtatgaactgcaaaaaaa

SEQ ID NO: 448775 - DNA, 3934 bp, Homo sapiens
actgtgacttacacaggcccctgaggatgaaggtaacagtcctgtgagcactgaggctgggctgggaccaacacctgagccatggctccagcactctgattcctggcccagccatgctgctgagggtgcacagcccaggcctaccatcgcccccacccttggtggcagaaccgagcactacccagcaaggtgtaattacttcaagcctccaggatggcaatccagttccgttcgctcttccccttggcattgcctgggatgctggcgctcctcggctggtggtggtttttctctcgtaaaaaaggccatgtcagcagccatgatgagcagcaggtggaggctggtgctgtgcagctgagggctgaccctgccatcaaggaacctctccccgtggaagacgtctgtcccaaagtagtgtccacaccccccagtgtcacagagcctccagaaaaggaactgtccaccgtgagcaagctgcctgcagagcccccagcattgctccagacacacccaccttgccgaagatcagagtcctcgggcattcttcctaacaccacagacatgagattgcgaccaggaacacgcagagatgacagtacaaagctggagctagccctgacaggtggtgaagccaaatcgattcctctagagtgccccctttcatccccaaagggtgtactattctccagcaaatcagctgaggtgtgtaagcaagattcccccttcagcagggtgccaaggaaggtccagccaggctaccccgtagtccccgcagagaagcgtagctctggggagagggcaagagagacaggtggggccgaagggactggtgatgccgtgttgggggaaaaggtgcttgaagaagctctgttgtctcgggagcatgtcttggaattggagaacagcaagggccccagcctggcctctttagagggggaagaagataaggggaagagcagctcatcccaggtggtggggccagtgcaggaggaagagtatgtagcagagaagttgccaagtaggttcatcgagtcggctcacacagagctggcaaaggacgatgcggcgccagcacccccagtcgcagacgccaaagcccaggacagaggtgtcgagggagaactgggcaatgaggagagcttggatagaaatgaggagggcttggatagaaatgaggagggcttggatagaaatgaggagggcttggatagaaatgaggagattaagcgggctgccttccagataatctcccaagtgatctcagaagcaaccgaacaggtgctggccaccacggttggcaaggttgcaggtcgtgtgtgtcaggccagtcagctccaagggcagaaggaagagagctgtgtcccagttcaccagaaaactgtcttgggcccagacactgcggagcctgccacagcagaggcagctgttgccccgccggatgctggcctccccttgccaggcctaccagcagagggctcaccaccaccaaagacctacgtgagctgcctgaagagccttctgtccagccccaccaaggacagtaagccaaatatctctgcacaccacatctccctggcctcctgcctggcactgaccacccccagtgaagagttgccggaccgggcaggcatcctggtggaagatgccacctgtgtcacctgcatgtcagacagcagccaaagtgtccctttggtggcttctccaggacactgctcagattctttcagcacttcagggcttgaagactcttgcacagagaccagctcgagccccagggacaaggccatcaccccgccactgccagaaagtactgtgcccttcagcaatggggtgctgaagggggagttgtcagacttgggggctgaggatggatggaccatggatgcggaagcagatcattcaggaggttctgacaggaacagcatggattccgtggatagctgttgcagtctcaagaagactgagagcttccaaaatgcccaggcaggctccaaccctaagaaggtcgacctcatcatctgggagatcgaggtgccaaagcacttagtcggtcggctaattggcaagcaggggcgctatgtgagttttctgaagcaaacatctggtgccaagatctacatttcaaccctgccttacacccagagcgtccagatctgccacatagaaggctctcaacatcatgtagacaaagcgctgaacttgattgggaagaagttcaaagagctgaacctcaccaatatctacgctcccccattgccttcactggcactgccttctctgccgatgacatcctggctcatgctgcctgatggcatcaccgtggaggtcattgtggtcaaccaggtcaatgccgggcacctgttcgtgcagcagcacacacaccctaccttccacgcgctgcgcagcctcgaccagcagatgtacctctgttactctcagcctggaatccccaccttgcccaccccagtggaaataacggtcatctgtgccgcccctggtgcggacggggcctggtggcgagcccaagtggttgcctcctacgaggagaccaacgaagtggagattcgatacgtggactacggcggatataagagggtgaaagtagacgtgctccggcaaatcaggtctgactttgtcaccctgccgtttcagggagcagaagtccttctggacagtgtgatgcccctgtcagacgatgaccagttttcaccggaagcagatgccgccatgagcgagatgacggggaatacagcactgcttgctcaggtgacaagttacagtccaactggtcttcctctgattcagctgtggagtgtggttggagatgaagtggtgttgataaaccggtccctggtggagcgaggccttgcccagtgggtagacagctactacacaagcctttgacccccatgctgcttcctgagagtctttttttgcactgttgaaattgggcttggcactcaagtcaaagatgaacatcggaataacaaacattgtcctctccagaaagtcctttctttctccatactgtagtcctattgagaagacatttcgtctctgagaaaaaaggatggaactatgggttctcttcgcaaagccaaaggatagtgtttaacaagccagctggcttatcctggttctcagctgtttaaaaaaaaaaaaaaaaaggaatagaaacagtttcaaccagattgtcctattccccctgttccattcccctcttcttccttctatctccttccccggcaaaaaccaaacaaactggcagacaggccagggatgtatgttgcttgcttgagagggtttcttttacttcaaaatctttcttcagggagcaagacatgaactgactaattggtatccactacttgtacagcttacataaatgagttgatgatatttaaccagtttttataaacttcatttaggtctctaaacacagactttttaaattgcaactgtaaatatgaaatggtcatcacatctgaccttggtcagtggggaggggaactggtatcctgccaagcctggttgtaatttgtaaccattttctatttgtgcaaactctgtaaatatgtgtttaaacaaatgtaatattttgtacaagatacactggagaacaaagggaactcaagattcttccagccacatgtcacctgtaggtagaagtaaactctgcagtgcagcttctgctcttggcccctctggccagggcccctgtggcttcctgcacactggacaggtgactgtatggtagagactgtgatctgggaactttttgctgtacaaatctgtttaaaaaaaaaaaaagtaactcattgaattaacttgcagtggtgtgtttgattcttttttagactggcttcagcattgtgcagtttaaaaataagtaagtaacttacataaatcttcaattgtatgaactgcaaaaaaa

SEQ ID NO: 448776 - DNA, 3907 bp, Homo sapiens
actgtgacttacacaggcccctgaggatgaaggtaacagtcctgtgagcactgaggctgggctgggaccaacacctgagccatggctccagcactctgattcctggcccagccatgctgctgagggtgcacagcccaggcctaccatcgcccccacccttggtggcagaaccgagcactacccagcaaggtgtaattacttcaagcctccaggatggcaatccagttccgttcgctcttccccttggcattgcctgggatgctggcgctcctcggctggtggtggtttttctctcgtaaaaaaggccatgtcagcagccatgatgagcagcaggtggaggctggtgctgtgcagctgagggctgaccctgccatcaaggaacctctccccgtggaagacgtctgtcccaaagtagtgtccacaccccccagtgtcacagagcctccagaaaaggaactgtccaccgtgagcaagctgcctgcagagcccccagcattgctccagacacacccaccttgccgaagatcagagtcctcgggcattcttcctaacaccacagacatgagattgcgaccaggaacacgcagagatgacagtacaaagctggagctagccctgacaggtggtgaagccaaatcgattcctctagagtgccccctttcatccccaaagggtgtactattctccagcaaatcagctgaggtgtgtaagcaagattcccccttcagcagggtgccaaggaaggtccagccaggctaccccgtagtccccgcagagaagcgtagctctggggagagggcaagagagacaggtggggccgaagggactggtgatgccgtgttgggggaaaaggtgcttgaagaagctctgttgtctcgggagcatgtcttggaattggagaacagcaagggccccagcctggcctctttagagggggaagaagataaggggaagagcagctcatcccaggtggtggggccagtgcaggaggaagagtatgtagcagagaagttgccaagtaggttcatcgagtcggctcacacagagctggcaaaggacgatgcggcgccagcacccccagtcgcagacgccaaagcccaggacagaggtgtcgagggagaactgggcaatgaggagagcttggatagaaatgaggagggcttggatagaaatgaggagggcttggatagaaatgaggagagcttggatagaaatgaggagggcttggatagaaatgaggagattaagcgggctgccttccagataatctcccaagtgatctcagaagcaaccgaacaggtgctggccaccacggttggcaaggttgcaggtcgtgtgtgtcaggccagtcagctccaagggcagaaggaagagagctgtgtcccagttcaccagaaaactgtcttgggcccagacactgcggagcctgccacagcagaggcagctgttgccccgccggatgctggcctccccttgccaggcctaccagcagagggctcaccaccaccaaagacctacgtgagctgcctgaagagccttctgtccagccccaccaaggacagtaagccaaatatctctgcacaccacatctccctggcctcctgcctggcactgaccacccccagtgaagagttgccggaccgggcaggcatcctggtggaagatgccacctgtgtcacctgcatgtcagacagcagccaaagtgtccctttggtggcttctccaggacactgctcagattctttcagcacttcagggcttgaagactcttgcacagagaccagctcgagccccagggacaaggccatcaccccgccactgccagaaagtactgtgcccttcagcaatggggtgctgaagggggagttgtcagacttgggggctgaggatggatggaccatggatgcggaagcagatcattcaggagttgcagctccacccccgggaaagcggggcactttgataacgaggtgtcctgggtttttcgagtgctgaccccagcgtagacagttcagaccgctaacttacaggttctgacaggaacagcatggattccgtggatagctgttgcagtctcaagaagactgagagcttccaaaatgcccaggcaggctccaaccctaagaaggtcgacctcatcatctgggagatcgaggtgccaaagcacttagtcggtcggctaattggcaagcaggggcgctatgtgagttttctgaagcaaacatctggtgccaagatctacatttcaaccctgccttacacccagagcgtccagatctgccacatagaaggctctcaacatcatgtagacaaagcgctgaacttgattgggaagaagttcaaagagctgaacctcaccaatatctacgctcccccattgccttcactggcactgccttctctgccgatgacatcctggctcatgctgcctgatggcatcaccgtggaggtcattgtggtcaaccaggtcaatgccgggcacctgttcgtgcagcagcacacacaccctaccttccacgcgctgcgcagcctcgaccagcagatgtacctctgttactctcagcctggaatccccaccttgcccaccccagtggaaagtctgactttgtcaccctgccgtttcagggagcagaagtccttctggacagtgtgatgcccctgtcagacgatgaccagttttcaccggaagcagatgccgccatgagcgagatgacggggaatacagcactgcttgctcaggtgacaagttacagtccaactggtcttcctctgattcagctgtggagtgtggttggagatgaagtggtgttgataaaccggtccctggtggagcgaggccttgcccagtgggtagacagctactacacaagcctttgacccccatgctgcttcctgagagtctttttttgcactgttgaaattgggcttggcactcaagtcaaagatgaacatcggaataacaaacattgtcctctccagaaagtcctttctttctccatactgtagtcctattgagaagacatttcgtctctgagaaaaaaggatggaactatgggttctcttcgcaaagccaaaggatagtgtttaacaagccagctggcttatcctggttctcagctgtttaaaaaaaaaaaaaaaaaggaatagaaacagtttcaaccagattgtcctattccccctgttccattcccctcttcttccttctatctccttccccggcaaaaaccaaacaaactggcagacaggccagggatgtatgttgcttgcttgagagggtttcttttacttcaaaatctttcttcagggagcaagacatgaactgactaattggtatccactacttgtacagcttacataaatgagttgatgatatttaaccagtttttataaacttcatttaggtctctaaacacagactttttaaattgcaactgtaaatatgaaatggtcatcacatctgaccttggtcagtggggaggggaactggtatcctgccaagcctggttgtaatttgtaaccattttctatttgtgcaaactctgtaaatatgtgtttaaacaaatgtaatattttgtacaagatacactggagaacaaagggaactcaagattcttccagccacatgtcacctgtaggtagaagtaaactctgcagtgcagcttctgctcttggcccctctggccagggcccctgtggcttcctgcacactggacaggtgactgtatggtagagactgtgatctgggaactttttgctgtacaaatctgtttaaaaaaaaaaaaagtaactcattgaattaacttgcagtggtgtgtttgattcttttttagactggcttcagcattgtgcagtttaaaaataagtaagtaacttacataaatcttcaattgtatgaactgcaaaaaaa

SEQ ID NO: 448777 - DNA, 3030 bp, Homo sapiens
actgtgacttacacaggcccctgaggatgaaggtaacagtcctgtgagcactgaggctgggctgggaccaacacctgagccatggctccagcactctgattcctggcccagccatgctgctgagggtgcacagcccaggcctaccatcgcccccacccttggtggcagaaccgagcactacccagcaaggtgtaattacttcaagcctccaggatggcaatccagttccgttcgctcttccccttggcattgcctgggatgctggcgctcctcggctggtggtggtttttctctcgtaaaaaaggccatgtcagcagccatgatgagcagcaggtggaggctggtgctgtgcagctgagggctgaccctgccatcaaggaacctctccccgtggaagacgtctgtcccaaagtagtgtccacaccccccagtgtcacagagcctccagaaaaggaactgtccaccgtgagcaagctgcctgcagagcccccagcattgctccagacacacccaccttgccgaagatcagagtcctcgggcattcttcctaacaccacagacatgagattgcgaccaggaacacgcagagatgacagtacaaagctggagctagccctgacaggtggtgaagccaaatcgattcctctagagtgccccctttcatccccaaagggtgtactattctccagcaaatcagctgaggtgtgtaagcaagattcccccttcagcagggtgccaaggaaggtccagccaggctaccccgtagtccccgcagagaagcgtagctctggggagagggcaagagagacaggtggggccgaagggactggtgatgccgtgttgggggaaaaggtgcttgaagaagctctgttgtctcgggagcatgtcttggaattggagaacagcaagggccccagcctggcctctttagagggggaagaagataaggggaagagcagctcatcccaggtggtggggccagtgcaggaggaagagtatgtagcagagaagttgccaagtaggttcatcgagtcggctcacacagagctggcaaaggacgatgcggcgccagcacccccagtcgcagacgccaaagcccaggacagaggtgtcgagggagaactgggcaatgaggagagcttggatagaaatgaggagggcttggatagaaatgaggagggcttggatagaaatgaggagagcttggatagaaatgaggagggcttggatagaaatgaggagattaagcgggctgccttccagataatctcccaagtgatctcagaagcaaccgaacaggtgctggccaccacggttggcaaggttgcaggtcgtgtgtgtcaggccagtcagctccaagggcagaaggaagagagctgtgtcccagttcaccagaaaactgtcttgggcccagacactgcggagcctgccacagcagaggcagctgttgccccgccggatgctggcctccccttgccaggcctaccagcagagggctcaccaccaccaaagacctacgtgagctgcctgaagagccttctgtccagccccaccaaggacagtaagccaaatatctctgcacaccacatctccctggcctcctgcctggcactgaccacccccagtgaagagttgccggaccgggcaggcatcctggtggaagatgccacctgtgtcacctgcatgtcagacagcagccaaagtgtccctttggtggcttctccaggacactgctcagattctttcagcacttcagggcttgaagactcttgcacagagaccagctcgagccccagggacaaggccatcaccccgccactgccagaaagtactgtgcccttcagcaatggggtgctgaagggggagttgtcagacttgggggctgaggatggatggaccatggatgcggaagcagatcattcaggagttgcagctccacccccgggaaagcggggcactttgataacgaggtgtcctgggtttttcgagtgctgaccccagcgtagacagttcagaccgctaacttacaggttctgacaggaacagcatggattccgtggatagctgttgcagtctcaagaagactgagagcttccaaaatgcccaggcaggctccaaccctaagaaggtcgacctcatcatctgggagatcgaggtgccaaagcacttagtcggtcggctaattggcaagcaggggcgctatgtgagttttctgaagcaaacatctggtgccaagatctacatttcaaccctgccttacacccagagcgtccagatctgccacatagaaggctctcaacatcatgtagacaaagcgctgaacttgattgggaagaagttcaaagagctgaacctcaccaatatctacgctcccccattgccttcactggcactgccttctctgccgatgacatcctggctcatgctgcctgatggcatcaccgtggaggtcattgtggtcaaccaggtcaatgccgggcacctgttcgtgcagcagcacacacaccctaccttccacgcgctgcgcagcctcgaccagcagatgtacctctgttactctcagcctggaatccccaccttgcccaccccagtggaaataacggtcatctgtgccgcccctggtgcggacggggcctggtggcgagcccaagtggttgcctcctacgaggagaccaacgaagtggagattcgatacgtggactacggcggatataagagggtgaaagtagacgtgctccggcaaatcaggtctgactttgtcaccctgccgtttcagggagcagaagtccttctggacagtgtgatgcccctgtcagacgatgaccagttttcaccggaagcagatgccgccatgagcgagatgacggggaatacagcactgcttgctcaggtgacaagttacagtccaactggtcttcctctgattcagctgtggagtgtggttggagatgaaactggcttcagcattgtgcagtttaaaaataagtaagtaacttacataaatcttcaattgtatgaactgcaaaaaaa

SEQ ID NO: 448778 - DNA, 2744 bp, Homo sapiens
actgtgacttacacaggcccctgaggatgaaggtaacagtcctgtgagcactgaggctgggctgggaccaacacctgagccatggctccagcactctgattcctggcccagccatgctgctgagggtgcacagcccaggcctaccatcgcccccacccttggtggcagaaccgagcactacccagcaaggtgtaattacttcaagcctccaggatggcaatccagttccgttcgctcttccccttggcattgcctgggatgctggcgctcctcggctggtggtggtttttctctcgtaaaaaaggccatgtcagcagccatgatgagcagcaggtggaggctggtgctgtgcagctgagggctgaccctgccatcaaggaacctctccccgtggaagacgtctgtcccaaagtagtgtccacaccccccagtgtcacagagcctccagaaaaggaactgtccaccgtgagcaagctgcctgcagagcccccagcattgctccagacacacccaccttgccgaagatcagagtcctcgggcattcttcctaacaccacagacatgagattgcgaccaggaacacgcagagatgacagtacaaagctggagctagccctgacaggtggtgaagccaaatcgattcctctagagtgccccctttcatccccaaagggtgtactattctccagcaaatcagctgaggtgtgtaagcaagattcccccttcagcagggtgccaaggaaggtccagccaggctaccccgtagtccccgcagagaagcgtagctctggggagagggcaagagagacaggtggggccgaagggactggtgatgccgtgttgggggaaaaggtgcttgaagaagctctgttgtctcgggagcatgtcttggaattggagaacagcaagggccccagcctggcctctttagagggggaagaagataaggggaagagcagctcatcccaggtggtggggccagtgcaggaggaagagtatgtagcagagaagttgccaagtaggttcatcgagtcggctcacacagagctggcaaaggacgatgcggcgccagcacccccagtcgcagacgccaaagcccaggacagaggtgtcgagggagaactgggcaatgaggagagcttggatagaaatgaggagggcttggatagaaatgaggagggcttggatagaaatgaggagagcttggatagaaatgaggagggcttggatagaaatgaggagattaagcgggctgccttccagataatctcccaagtgatctcagaagcaaccgaacaggtgctggccaccacggttggcaaggttgcaggtcgtgtgtgtcaggccagtcagctccaagggcagaaggaagagagctgtgtcccagttcaccagaaaactgtcttgggcccagacactgcggagcctgccacagcagaggcagctgttgccccgccggatgctggcctccccttgccaggcctaccagcagagggctcaccaccaccaaagacctacgtgagctgcctgaagagccttctgtccagccccaccaaggacagtaagccaaatatctctgcacaccacatctccctggcctcctgcctggcactgaccacccccagtgaagagttgccggaccgggcaggcatcctggtggaagatgccacctgtgtcacctgcatgtcagacagcagccaaagtgtccctttggtggcttctccaggacactgctcagattctttcagcacttcagggcttgaagactcttgcacagagaccagctcgagccccagggacaaggccatcaccccgccactgccagaaagtactgtgcccttcagcaatggggtgctgaagggggagttgtcagacttgggggctgaggatggatggaccatggatgcggaagcagatcattcaggaggttctgacaggaacagcatggattccgtggatagctgttgcagtctcaagaagactgagagcttccaaaatgcccaggcaggctccaaccctaagaaggtcgacctcatcatctgggagatcgaggtgccaaagcacttagtcggtcggctaattggcaagcaggggcgctatgtgagttttctgaagcaaacatctggtgccaagatctacatttcaaccctgccttacacccagagcgtccagatctgccacatagaaggctctcaacatcatgtagacaaagcgctgaacttgattgggaagaagttcaaagagctgaacctcaccaatatctacgctcccccattgccttcactggcactgccttctctgccgatgacatcctgggtgagcgtgctactgggtgatccggacttcttgccactttcccccaaacctaccccaaacaagaaactccccagacctcaggctaagaaggccaagtgcacatgagtgcctgcgccctctcttctctggcctctgctggtcggttctgctatgggactgtgttctggggacagggcttaggtggtgatagcgctggcaggaaaccagaggcctcttggtccccacatgggaggactacttttcctggctctgccccctgggcaccttttaagttttctaggcgtttgcttagaaaggatggtgtagttcggacaggagattgggtgtgtccagggtcgccgttcaccacctgagacctgggtgggactagaatcatgggtttggatggcgcttgttctttcttctggttgagtcaggccttaacagtg

SEQ ID NO: 448779 - DNA, 766 bp, Homo sapiens
  misc_feature (766)..(766): n is a, c, g, or t
gcgtcttcagtatttaatgtctctgtgttccacccgcctgggctagcacgtgggggagctgcggaagcgcggcgctgcgggccgggccgcggggcacagccgggggccggcggcggcgcgcggactccgcatcccgcaccccgatggtagccgaggagctggtgtaattacttcaagcctccaggatggcaatccagttccgttcgctcttccccttggcattgcctgggatgctggcgctcctcggctggtggtggtttttctctcgtaaaaaaggccatgtcagcagccatgatgagcagcaggtggaggctggtgctgtgcagctgagggctgaccctgccatcaaggaacctctccccgtggaagacgtctgtcccaaagtagtgtccacaccccccagtgtcacagagcctccagaaaaggaactgtccaccgtgagcaagctgcctgcagagcccccagcattgctccagacacacccaccttgccgaagatcagagtcctcgggcattcttcctaacaccacagacatgactttccaaaaaaaaaaaaaaaaaaaaaaaaaaaaaaaaaaaaaaaaaaccgggagggcacaaaagggggggggggaaaaaaagggagaaaagggggcaggggacaaaacgggagaccgagaccaaaattcaggggcaaaaggggggaaaaaggagggacccaaaaaaggcgagcagaaaacacgaaaaacccgggacaccgcgtagaaaacccaacaaagagagaccan

SEQ ID NO: 448780 - DNA, 991 bp, Homo sapiens
agagacaagactaggtcttacagatctgtcacactccatttctttctgcttttgaatatgccatagattaaaatattttctgatcataactgcataaatgttgacctttaaacagtttattctagttccaattctgtgggaagcatataggatttaaatctttaaaaaaatcacagcagtgttttcagttactaatatataattaagataatttcttttttttttaaattagtttgttctgtcagtcaaaaccaagggagaagattgttcccaagtggcatgaaaagccctacgagtggaatcaggttgatccaaagctggtcatggagcaggccgaccgtgagagcagcagagggaagaacacctttctctaccagctccacaaactggttgtgctcggcacctgagcatgtccacaggtggcctccagcacacccctcaggaagctgtggaggctggattccaggctccctccgcagactgactttcctctgtgtctgggtgttacagtctgtgcccactgcatcctaaaggccttttctttcttcttttctctttgggtgatagtcagagagtggtgtttttgttcaggtgggaaggattggaaactctagtcttttctagaaacagaaaatcactgtattaaatattttggaaagattgttctgaaagaagtctgtttggataaagagctgtattttgctttaaatttattaaggtaaatataagtagttaatcttagatgtaaggttccagaatgtgcttacatattctgttctgttacagtgatttaaaccagtagtataggaaaaaacttaaaaaacaaaaaaaccatgtagtattttctgatttttttttccatgagggaaaatatctaatttttataagactaagttgagttatacttcttggttcacattttggaaatcagagattacagattacatggccatagcttatctgtgttaaaacaataaaagcattaaatgaa

SEQ ID NO: 448781 - DNA, 1224 bp, Homo sapiens
gtgtgtttggattgagaaggagagcatcaactctgtcattatcagtgacgcccctgaagaccttcaccagagaatgctggttgcagcttccctttccatcaatgcgactggatctacgatgctgctgagagaaacctctctgatgcctcatatccctggcctcccggctctcctcagcatgttattcgcaccggtgatagagttaaggattgatcagaatggcaagtactatactggagtcctttgtggtttggggtggaatccagctacaggggcttccatactgcccgagcacgacatggagcttgcgtttgacgttcaattcagcgtggaggatgtcgtcgaggttaatattctcagggctgctattaacaagctagtctgtgatggaccaaatggatgcaagtgtcttgggccagagagagttgcgcagcttcaagacattgcccgtcagaagcttttaggtttgttctgtcagtcaaaaccaagggagaagattgttcccaagtggcatgaaaagccctacgagtggaatcaggttgatccaaagctggtcatggagcaggccgaccgtgagagcagcagagggaagaacacctttctctaccagctccacaaactggttgtgctcggcacctgagcatgtccacaggtggcctccagcacacccctcaggaagctgtggaggctggattccaggctccctccgcagactgactttcctctgtgtctgggtgttacagtctgtgcccactgcatcctaaaggccttttctttcttcttttctctttgggtgatagtcagagagtggtgtttttgttcaggtgggaaggattggaaactctagtcttttctagaaacagaaaatcactgtattaaatattttggaaagattgttctgaaagaagtctgtttggataaagagctgtattttgctttaaatttattaaggtaaatataagtagttaatcttagatgtaaggttccagaatgtgcttacatattctgttctgttacagtgatttaaaccagtagtataggaaaaaacttaaaaaacaaaaaaaccatgtagtattttctgatttttttttccatgagggaaaatatctaatttttataagactaagttgagttatacttcttggttcacattttggaaatcagagattacagattacatggccatagcttatctgtgttaaaacaataaaagcattaaatgaa

SEQ ID NO: 448782 - DNA, 937 bp, Homo sapiens
agagacaagactaggtcttacagatctgtcacactccatttctttctgcttttgaatatgccatagattaaaatattttctgatcataactgcataaatgttgacctttaaacagtttattctagttccaattctgtgggaagcatataggatttaaatctttaaaaaaatcacagcagtgttttcagttactaatatataattaagataatttcttttttttttaaattagtttgttctgtcagtcaaaaccaagggagaagattgttcccaagtggcatgaacgtgagagcagcagagggaagaacacctttctctaccagctccacaaactggttgtgctcggcacctgagcatgtccacaggtggcctccagcacacccctcaggaagctgtggaggctggattccaggctccctccgcagactgactttcctctgtgtctgggtgttacagtctgtgcccactgcatcctaaaggccttttctttcttcttttctctttgggtgatagtcagagagtggtgtttttgttcaggtgggaaggattggaaactctagtcttttctagaaacagaaaatcactgtattaaatattttggaaagattgttctgaaagaagtctgtttggataaagagctgtattttgctttaaatttattaaggtaaatataagtagttaatcttagatgtaaggttccagaatgtgcttacatattctgttctgttacagtgatttaaaccagtagtataggaaaaaacttaaaaaacaaaaaaaccatgtagtattttctgatttttttttccatgagggaaaatatctaatttttataagactaagttgagttatacttcttggttcacattttggaaatcagagattacagattacatggccatagcttatctgtgttaaaacaataaaagcattaaatgaa

SEQ ID NO: 448783 - DNA, 2294 bp, Homo sapiens
ggtggctgttctagaggatcccaggggctcgcagtcatcgcgatagaggaattcagcattatcccggaggctcccatgaggagcagccaggtctctgcctgggggcttgaagctcaagaagatgaggacccatcctataagtggagagaggaacacagactctcagcaactcagcagagtgagttaagggatgtgtgtgactatgcgattgagacgatgccctcttttcccaaggaaggttctgcagatgtggagcccaatcaggaaagccttgtggctgaggcctgtgacactccggaacactgggaggcagtaccccagagcctagcaggccgacaagcaaggactctagctcccccagagctctgggcctgccccattcagagtgagcatctagacatggccccattttccagtgacctgggaagcgaagaagaggaggtggaatttgggccaggacttacttctttgacatggggatctggacaggcagaagaagaagaggaaacctcttcagataactctggtcagaccagatattattctccctgcgaagagcatcctgcagagaccaaccagaatgaaggcgctgaaagtgggactatcaggcagggggaagagctgccatctgaggagctgcaggaaagtcaagggctcttgcatccccaggaggtccaagttctggaggagcagggacagcaggaagcaggatttcggggggaaggaactctgagggaggatgtttgtgccgatgggctattaggggaggaacagatgatagagcaggttaatgatgaaaagggagaacagaagcaaaaacaggaacaggtacaagatgtgatgcttgggagacaaggagaaagaatggggctcactggggagccagagggtctgaatgacggtgagtgggagcaggaggatatggagaggaaggctcagggtcagggaggtccagaacagggagaagagaggaagagggagctgcaggtgccagaagagaacagggcggactctcaggacgaaaagagtcaaacctttttgggaaaatcagaggaagtaactggaaagcaagaagatcatggtataaaggagaaaggggtcccagtcagcgggcaggaggcgaaagagccagagagttgggatgggggcaggctgggggcagtgggaagagcgaggagcagggaagaggagaatgagcatcatgggccttcaatgcccgctctgatagcccctgaggactctcctcactgtgacctgtttccaggtgcctcatatctcgtgactcagattcccgggactcagacagagtccagggctgaggaactgtcccccgcagctctgtctcccttgctagagcccatcagatgctctcaccagcccatttctctactgggctcctttttgactgaggagtcacctgacaaggaaaaacttctatcagtactttgatatgtcacagtttcatgtttatccagttcaatgtatttttaaatttttccttgagacttctttgactgatagattattgtgaagtgtgtttttaaatttccaaatgtttagggattttcatatctttcttatgctgatttccaattggattccctacaatgatttctggttttcatctgctctggatgattactatctcttttaaatttgttgtggcgagttttagggcctaggacagctctatcttgccatgtgtttcgtcagcactcaaaaaaaatatgtgtattctgctgttactgtgtggaatattctgtaaatgccaaatagattcttttggttaatggcattttgagttgttttatattcttgttgattttcttttttttcctctttttaaaaacatgaaatgcttcacaaaattttgtgtaatctatattcaagaaccattttaatcttgttggcatcattctgattttagaaagtgctgccaaagccaacactccttgctgattttctgtctagttctatcaattattgaaaaaggcatgaggaaatttctaactataattgtggattcatctatatctcctttcagttttctttttttaaaaaaaatcaatgaaaatttattaaattaagcataaagttactttcacatttatctacaaccacagtgaatacagttcttggcatgaagacaccacaacctttagaatttaaagcctcctcacctgcaagattacatatataaaactcccactattgtttctctaagagtggattagttcaccaagttaaaagttatatgatctagaatataataaaatggaaatgatttactcata

SEQ ID NO: 448784 - DNA, 2312 bp, Homo sapiens
gattcagccctgatggaggctgaggaggcccagcatggagcctctcctcccatctctgccatagaggaattcagcattatcccggaggctcccatgaggagcagccaggtctctgcctgggggcttgaagctcaagaagatgaggacccatcctataagtggagagaggaacacagactctcagcaactcagcagagtgagttaagggatgtgtgtgactatgcgattgagacgatgccctcttttcccaaggaaggttctgcagatgtggagcccaatcaggaaagccttgtggctgaggcctgtgacactccggaacactgggaggcagtaccccagagcctagcaggccgacaagcaaggactctagctcccccagagctctgggcctgccccattcagagtgagcatctagacatggccccattttccagtgacctgggaagcgaagaagaggaggtggaatttgggccaggacttacttctttgacatggggatctggacaggcagaagaagaagaggaaacctcttcagataactctggtcagaccagatattattctccctgcgaagagcatcctgcagagaccaaccagaatgaaggcgctgaaagtgggactatcaggcagggggaagagctgccatctgaggagctgcaggaaagtcaagggctcttgcatccccaggaggtccaagttctggaggagcagggacagcaggaagcaggatttcggggggaaggaactctgagggaggatgtttgtgccgatgggctattaggggaggaacagatgatagagcaggttaatgatgaaaagggagaacagaagcaaaaacaggaacaggtacaagatgtgatgcttgggagacaaggagaaagaatggggctcactggggagccagagggtctgaatgacggtgagtgggagcaggaggatatggagaggaaggctcagggtcagggaggtccagaacagggagaagagaggaagagggagctgcaggtgccagaagagaacagggcggactctcaggacgaaaagagtcaaacctttttgggaaaatcagaggaagtaactggaaagcaagaagatcatggtataaaggagaaaggggtcccagtcagcgggcaggaggcgaaagagccagagagttgggatgggggcaggctgggggcagtgggaagagcgaggagcagggaagaggagaatgagcatcatgggccttcaatgcccgctctgatagcccctgaggactctcctcactgtgacctgtttccaggtgcctcatatctcgtgactcagattcccgggactcagacagagtccagggctgaggaactgtcccccgcagctctgtctcccttgctagagcccatcagatgctctcaccagcccatttctctactgggctcctttttgactgaggagtcacctgacaaggaaaaacttctatcagtactttgatatgtcacagtttcatgtttatccagttcaatgtatttttaaatttttccttgagacttctttgactgatagattattgtgaagtgtgtttttaaatttccaaatgtttagggattttcatatctttcttatgctgatttccaattggattccctacaatgatttctggttttcatctgctctggatgattactatctcttttaaatttgttgtggcgagttttagggcctaggacagctctatcttgccatgtgtttcgtcagcactcaaaaaaaatatgtgtattctgctgttactgtgtggaatattctgtaaatgccaaatagattcttttggttaatggcattttgagttgttttatattcttgttgattttcttttttttcctctttttaaaaacatgaaatgcttcacaaaattttgtgtaatctatattcaagaaccattttaatcttgttggcatcattctgattttagaaagtgctgccaaagccaacactccttgctgattttctgtctagttctatcaattattgaaaaaggcatgaggaaatttctaactataattgtggattcatctatatctcctttcagttttctttttttaaaaaaaatcaatgaaaatttattaaattaagcataaagttactttcacatttatctacaaccacagtgaatacagttcttggcatgaagacaccacaacctttagaatttaaagcctcctcacctgcaagattacatatataaaactcccactattgtttctctaagagtggattagttcaccaagttaaaagttatatgatctagaatataataaaatggaaatgatttactcata

SEQ ID NO: 448785 - DNA, 2315 bp, Homo sapiens
ggtggctgttctagaggatcccaggggctcgcagtcatcgcgatagaggaattcagcattatcccggaggctcccatgaggagcagccaggtctctgcctgggggcttgaagctcaagaagatgaggacccatcctataagtggagagaggaacacagactctcagcaactcagcagagtgagttaagggatgtgtgtgactatgcgattgagacgatgccctcttttcccaaggaaggttctgcagatgtggagcccaatcaggaaagccttgtggctgaggcctgtgacactccggaacactgggaggcagtaccccagagcctagcaggccgacaagcaaggactctagctcccccagagctctgggcctgccccattcagagtgagcatctagacatggccccattttccagtgacctgggaagcgaagaagaggaggtggaatttgggccaggacttacttctttgacatggggatctggacaggcagaagaagaagaggaaacctcttcagataactctggtcagaccagatattattctccctgcgaagagcatcctgcagagaccaaccagaatgaaggcgctgaaagtgggactatcaggcagggggaagagctgccatctgaggagctgcaggaaagtcaagggctcttgcatccccaggaggtccaagttctggaggagcagggacagcaggaagcaggatttcggggggaaggaactctgagggaggatgtttgtgccgatgggctattaggggaggaacagatgatagagcaggttaatgatgaaaagggagaacagaagcaaaaacaggaacaggtacaagatgtgatgcttgggagacaaggagaaagaatggggctcactggggagccagagggtctgaatgacggtgagtgggagcaggaggatatggagaggaaggctcagggtcagggaggtccagaacagggagaagagaggaagagggagctgcaggtgccagaagagaacagggcggactctcaggacgaaaagagtcaaacctttttgggaaaatcagaggaagtaactggaaagcaagaagatcatggtataaaggagaaaggggtcccagtcagcgggcaggaggcgaaagagccagagagttgggatgggggcaggctgggggcagtgggaagagcgaggagcagggaagaggagaatgagcatcatgggccttcaatgcccgctctgatagcccctgaggactctcctcactgtgacctgtttccaggtgcctcatatctcgtgactcagattcccgggactcagacagagtccagggctgaggaactgtcccccgcagctctgtctcccttgctagagcccatcagatgctctcaccagcccatttctctactgggctcctttttgactgaggagtcacctgacaaggaaaaacttctatcagtactttgatatgtcacagtttcatgtttatccagttcaatgtatttttaaatttttccttgagacttctttgactgatagattattgtgaagtgtgtttttaaatttccaaatgtttagggattttcatatctttcttatgctgatttccaattggattccctacaatgatttctggttttcatctgctctggatgattactatctcttttaaatttgttgtggcgagttttagggcctaggacagctctatcttgccatgtgtttcgtcagcactcaaaaaaaatatgtgtattctgctgttactgtgtggaatattctgtaaatgccaaatagattcttttggttaatggcattttgagttgttttatattcttgttgattttcttttttttcctctttttaaaaacatgaaatgcttcacaaaattttgtgtaatctatattcaagaaccattttaatcttgttggcatcattctgattttagaaagtgctgccaaagccaacactccttgctgattttctgtctagttctatcaattattgaaaaaggcatgaggaaatttctaactataattgtggattcatctatatctcctttcagttttctttttttaaaaaaaatcaatgaaaatttattaaattaagcataaagttactttcacatttatctacaaccacagtgaatacagttcttggcatgaagacaccacaacctttagaatttaaagcctcctcacctgcaagattacatatataaaactcccactattgtttctctaagagtggattagttcaccaagttaaataaagcccagaataaaggatggagtgtggagaaaaagaaagaaaaaacattgcggcgcagttatccg

SEQ ID NO: 448786 - DNA, 211 bp, Homo sapiens
gcgccgcagctatggagtgtcccgggagacggcgggcatgacggctacaggatgggcgcgaacaatggcaaacagtacggcagtgagggcaaaggcagctcgagcatctcatcagcctctcagagtgctgggattacagtcatgagccactacactgggctgagcatctttttgtgtgcttgttttatatgctgtctttggaggatacctc

SEQ ID NO: 448787 - DNA, 4142 bp, Homo sapiens
gcgccgcagctatggagtgtcccgggagacggcgggcatgacggctacaggatgggcgcgaacaatggcaaacagtacggcagtgagggcaaaggcagctcgagcatctcatctgacgtgagttcaagtacagatcacacgcccactaaagcccagaagaatgtggctaccagcgaagactccgacctgagcatgcgcacactgagcacgcccagcccagccctgatatgtccaccgaatctcccaggatttcagaatggaaggggctcgtccacctcctcgtcctccatcaccggggagacggtggccatggtgcactccccgcccccgacccgcctcacacacccgctcatccggctcgcctccagaccccagaaggagcaggccagcatagaccggctcccggaccactccatggtgcagatcttctccttcctgcccaccaaccagctgtgccgctgcgcgcgagtgtgccgccgctggtacaacctggcctgggacccgcggctctggaggactatccgcctgacgggcgagaccatcaacgtggaccgcgccctcaaggtgctgacccgcagactctgccaggacacccccaacgtgtgtctcatgctggaaaccgtaactgtcagtggctgcaggcggctcacagaccgagggctgtacaccatcgcccagtgctgccccgaactgaggcgactggaagtctcaggctgttacaatatctccaacgaggccgtctttgatgtggtgtccctctgccctaatctggagcacctggatgtgtcaggatgctccaaagtgacctgcatcagcttgacccgggaggcctccattaaactgtcacccttgcatggcaaacagatttccatccgctacctggacatgacggactgcttcgtgctggaggacgaaggcctgcacaccatcgcggcgcactgcacgcagctcacccacctctacctgcgccgctgcgtccgcctgaccgacgaaggcctgcgctacctggtgatctactgcgcctccatcaaggagctgagcgtcagcgactgccgcttcgtcagcgacttcggcctgcgggagatcgccaagctggagtcccgcctgcggtacctgagcatcgcgcactgcggccgggtcaccgacgtgggcatccgctacgtggccaagtactgcagcaagctgcgctacctcaacgcgaggggctgcgagggcatcacggaccacggtgtggagtacctcgccaagaactgcaccaaactcaaatccctggatatcggcaaatgccctttggtatccgacacgggcctggagtgcctggccctgaactgcttcaacctcaagcggctcagcctcaagtcctgcgagagcatcaccggccagggcttgcagatcgtggccgccaactgctttgacctccagacgctgaatgtccaggactgcgaggtctccgtggaggccctgcgctttgtcaaacgccactgcaagcgctgcgtcatcgagcacaccaacccggctttcttctgaagggacagagttcatccggcgttgtattcacacaaacctgaacaaagcaaatttttttaaaagcagcgtatgtaagcaccgacacccactcaaaacagctctttcttccgggaaggttattaggaatctggcctttatttttcctcatttctcatgggcaacagaggccaaagaaacgaagcaagacaaacagcaaacaggcattttggtcaggtcatttgtaggcagtttctcttctcacaaaagatgtacttaagcaggctgatcgctgttccttgagcaaggcgcttactctcctccgctcaggcccccaaggccgccctttccctcgcacacaggccccacccccacagttccacgccccccccccaaggccacaccctccctccctagagcagcagcgaggatccatcatcagaatcacagtgctctccagacctcctctctaaactgcttcattgacctaagtcactctcttcaatcccacacccatggacattcttgtcaactcaataccatagcactttgcataggcaaaatacttttcaggcctttttaaaaaattcattacagcaaacagctggggaaggacatgcagtcctcccccagctctgtcaatgactatgaccttggccaaagcacttcactgctctgggctgcagcttccagcactgaatcagaggccacacagcccaaagattagcttcatgtccattatagcattgagggagcagagatacccatacacagaagcaccttggcatagagcacccaggcatcgacctcttccaggagaactgattctgtggatggatgtgatttcaggagattgtgcagtgccagcatcagtgcataaagggtcctgtatgtcctttggctgcaaatcacccacttccctgtgtttcagtgggagaatttcctctcccacctcctcacatcctcttttgccaggctggatgctgtcgtctctgtacacaaatactttctgcattcccccctccacaccatcctagcgaggcaccagcacacctaatcacagcaaagcccagatccccccatcagttgcttttactcagtgttttcaaataggagtaaaggcccttgcaatttttaattaacaagcaaggcccaagggaacacatgtcctcaaaagtttttctgatccctcgccttgcacacctggcatgcatcaggcacatctgtcctacagctggcagagacagatgcctcggttctttgtcattcagattgcatttgacctcttctcatctatttatttctttatacatccagacttcatcacatgaagcctattggggttaagtttgtaagtgtttaattgtgcaaattgccaccctgtgtacctcctccatgtctgtctgcgtgttttccaccaaagaatgcaaagcagacttccaggtgtttaaattctgttcactcaacaatgccagatgaatggaagagggaacacactgagatgacttagactctggtccaccaaccagacccttggaaaggaatactaaaatcattacaaggtatggattttaaatggatgaaacttcaaattatcttatttggatagaagtctatattctagcctcatttgcatgaagtcagatagccagaagaaattccattgctggttttcacgaaattcacttgtcttttgctaataaacacatggccctttcccagattattctctagccaagccccacctttgttacgttgaaatccctcatttattttcttctcaaaatgcccattatccaaatgcagaacctctgcatctccaagccagttatgctgaatttgtcaaacttagacacccttgacaactgcactcctactgtaggctcctgtgcatactgtcgtcttctgtgggggatggagaggttagtgtgatgaggtggtgtctgcccaggaggtttctttcaaacatcatggcctcccatccaatcaacatcatcaaattacatgtgtaatcaaggctctgtgccatgggggaaatgaatcatttagctaggccaggatctagtgaaagccacagagtttaaaaccatgaaagaagttgaaggcagcattcctcagctctgtgacttgtgaccctatttgaagtttcaggatttgggtgtcacaaaggattgtccctaatccttggccctggggtcttccgagtgagctggtttaatactctgagaatgagcagggagatccagagaatgaatccctgaccgcatcacctaaactgtcttccaaacatgagacaaagctgactgttcacactgattgcccagcacataccgtcttgccagtttcttcttttctcccagtctcctgttcatccattctgttctcccttggggtgggaatctatgatggaggttactggggaaacagctcagcagatttttggagaccaaaccaaaggtctcactaggaaatttatctgttttaaaacattgcttccttcctggctctgctaaattgaatgctcattgtttgttgttgttgttttttaattctaatgttcaaatcactgcgtgctgtatgaatctagaaagccttaatttactaccaagaaataaagcaatatgttcgtaaaaaaaaca

SEQ ID NO: 448788 - DNA, 398 bp, Homo sapiens
atggttccatcccactttgactcacactgagcttagtcaactgaaattcttgcctctctcccaccttgtatttagtttttcattttagcccaaatatagtactttatgtggattcctggtgaatttttaacatccaagttttattctagtctccctgatctttttggatccagcacgtgtcacccaagccattggctcttcaacttcacgtcacccatacattttgtgaggaagccatcgatattttcccatgtaaaccatattaaaatgttttatatggcaaggatcaaatactagtctccacccacaaggctgatatagattatccagcctgttttaagggaagtcatgtttctttttaccacttatatttatgtcttcctcctcattagaattga

SEQ ID NO: 448789 - DNA, 684 bp, Homo sapiens
catctagatggaagctggggcttccttcctttcagatattggtgctaacatgaagctgaccaaagaattgatgggatctgcacactgtaaagccggtttcaggatggctgagctgacggtcaagaaagaagagaagatatgagccgcctgcattttggggtggtggcagtgaaatttagacttgtgatttggtatgacaatatatggctttttgtgattgttaacattaatgaaaacaagaaaaattagttgctcaaaagttgaaaaatggattcataaactttttattagagtaaggcaaaagaacatattaaaatagaggtaaattagaaatgtcaataagaacccatggacattttttataaggagactttatctgttctgtccctacagtgatttatgctcttggatatttttgctgtcatcctgacaaattctagttggaatatggaacaagcttatttgtagacctagtgcctgtggcttctaaagcaattttctgaaaagagaaaccactgcctgttggaagaatagttgattccatacctcaagctagggaaaaaaaatcagaattagtctgtgaattctagatgttgagagaaagcagggtttcattagggcatcggagagtcacaagtccataggatgcaaaaaggaagatgaaataaaattgcctgaaaaacg

SEQ ID NO: 448790 - DNA, 644 bp, Homo sapiens
cgttgtggcaggggtttttggaacagatatccagggcgacgaggaggctgggggcgcagagcagcgcgccgcacagcgcggccagcaggcgggggcgcggcatgctgcggggacgcgggcgctggaatgggcacgctgggctgctcagaccccgcggggttctggcgccttctcctctgggacccgccaacatgggccgcgttcgcaccaaaaccgtgaagaaggcggcccgggtcatcatagaaaagtactacacgcgcctgggcaacgacttccacacgaacaagcgcgtgtgcgaggagatcgccattatccccagcaaaaagctccgcaacaagatagcaggttatgtcacgcatctgatgaagcgaattcagagaggcccagtaagaggtatctccatcaagctgcaggaggaggagagagaaaggagagacaattatgttcctgaggtctcagccttggatcaggagattattgaagtagatcctgacactaaggaaatgctgaagcttttggacttcggcagtctgtccaaccttcaggtcactcagcctacagttgggatgaatttcaaaacgcctcggggacctgtttgaattttttctgtagtgctgtattattttcaataaatctgggacaac

SEQ ID NO: 448791 - DNA, 520 bp, Homo sapiens
  misc_feature (3)..(3): n is a, c, g, or t
aanaaaaaaccttccttgcgaattcggcacgagccaacatgggccgcgttcgcaccaaaaccgtgaagaaggcggcccgggtcatcatagaaaagtactacacgcgcctgggcaacgacttccacacgaacaagcgcgtgtgcgaggagatcgccattatccccagcaaaaagctccgcaacaagatagcaggttatgtcacgcatctgatgaagcgaattcagagaggcccagtaagaggtatctccatcaagctgcaggaggaggagagagaaaggagagacaattatgttcctgaggtctcagccttggatcaggagattattgaagtagatcctgacactaaggaaatgctgaagcttttggacttcggcagtctgtccaaccttcaggtcactcagcctacagttgggatgaatttcaaaacgcctcggggacctgtttgaattttttctgtagtgctgtattattttcaataaatctgggacaaccacggtggcggggggggggtgtggggggg

SEQ ID NO: 448792 - DNA, 825 bp, Homo sapiens
cgttgtggcaggggtttttggaacagatatccagggcgacgaggaggctgggggcgcagagcagcgcgccgcacagcgcggccagcaggcgggggcgcggcatgctgcggggacgcgggcgctggaatgggcacgctgggctgctcagaccccgcggggttctggcgccttctcctctgggacccgccaacatgggccgcgttcgcaccaaaaccgtgaagaaggcggcccgggtcatcatagaaaagtactacacgcgcctgggcaacgacttccacacgaacaagcgcgtgtgcgaggagatcgccattatccccagcaaaaagctccgcaacaagatagcaggttatgtcacgcatctgatgaagcgaattcagagaggcccagtaagaggtatctccatcaagctgcaggaggaggagagagaaaggagagacaattatgttcctgaggtctcagccttggatcaggagattattgaagtagatcctgacactaaggaaatgctgaagcttttggacttcggcagtctgtccaaccttcaggtcactcagcctacagttgggatgaatttcaaaacgcctcggggacctgtttgaattttttctgtagtgctgtattattttcaataaatctgggacaacaaaacacacaacaacccacacacacacaaaaaaacacacaaacaaaaaagaacaacacgtcgcgggggctcttatgggggggggaacacacggttctaaacaggcacagtggccacaagtgttcctctgacccccgtttttgtcacagggggaaatgccgggccccctatggagggcgcaa

SEQ ID NO: 448793 - DNA, 261 bp, Homo sapiens
gggggagagagagagagagagagactgcaggaggaggagagagaaaggagagacaattatgttcctgaggtctcagccttggatcaggagattattgaagtagatcctgacactaaggaaatgctgaagcttttggacttcggcagtctgtccaaccttcaggtcactcagcctacagttgggatgaatttcaaaacgcctcggggacctgtttgaattttttctgtagtgctgtattattttcaataaatctgggacaac

SEQ ID NO: 448794 - DNA, 245 bp, Homo sapiens
aatgtgactgaaatgatgatctaagagaaaggagagacaattatgttcctgaggtctcagccttggatcaggagattattgaagtagatcctgacactaaggaaatgctgaagcttttggacttcggcagtctgtccaaccttcaggtcactcagcctacagttgggatgaatttcaaaacgcctcggggacctgtttgaattttttctgtagtgctgtattattttcaataaatctgggacaac

SEQ ID NO: 448795 - DNA, 421 bp, Homo sapiens
gcgtgacataacctgctatcttgttgcggagctttttgctggggataatggcgatctcctcgcacacgcgcttgttcgtgtggaagtcgttgcccaggcgcgtgtagtacttttctatgatgacccgggccgccttcttcacggttttggtgcgaacgcggcccatgttggcgggtccttggtactgcaggaggaggagagagaaaggagagacaattatgttcctgaggtctcagccttggatcaggagattattgaagtagatcctgacactaaggaaatgctgaagcttttggacttcggcagtctgtccaaccttcaggtcactcagcctacagttgggatgaatttcaaaacgcctcggggacctgtttgaattttttctgtagtgctgtattattttcaataaatctgggacaac

SEQ ID NO: 448796 - DNA, 291 bp, Homo sapiens
gtctatcggaaggccctggtgatcaccaattcagccagaaaatcctccacggtcctgcaggaggaggagagagaaaggagagacaattatgttcctgaggtctcagccttggatcaggagattattgaagtagatcctgacactaaggaaatgctgaagcttttggacttcggcagtctgtccaaccttcaggtcactcagcctacagttgggatgaatttcaaaacgcctcggggacctgtttgaattttttctgtagtgctgtattattttcaataaatctgggacaac

SEQ ID NO: 448797 - DNA, 591 bp, Homo sapiens
agaggtacaatcccccggaacactatgccatgttacccagcttatcggaccatataggaagttgtacgctgcagtaccgtcggaatccgggtagcctactactactaaattcgcggccgctcgacaggacccgccaacatgggccgcgttcgcaccaaaaccgtgaagaaggcggcccgggtcatcatagaaaagtactacacgcgcctgggcaacgacttccacacgaacaagcgcgtgtgcgaggagatcgccattatccccagcaaaaagctccgcaacaagatagcaggttatgtcacgcatctgatgaagcgaattcagagaggcccagtaagaggtatctccatcaagctgcaggaggaggagagagaaaggagagacaattatgttcctgaggtctcagccttggatcaggagattattgaagtagatcctgacactaaggaaatgctgaagcttttggacttcggcagtctgtccaaccttcaggtcactcagcctacagttgggatgaatttcaaaacgcctcggggacctgtttgaattttttctgtagtgctgtattattttcaataaatctgggacaac

SEQ ID NO: 448798 - DNA, 500 bp, Homo sapiens
tccccccaccccaccccccaccctagctagacgaggctggtgtagcaatgggccgcgttcgcaccaaaaccgtgaagaaggcggcccgggtcatcatagaaaagtactacacgcgcctgggcaacgacttccacacgaacaagcgcgtgtgcgaggagatcgccattatccccagcaaaaagctccgcaacaagatagcaggttatgtcacgcatctgatgaagcgaattcagagaggcccagtaagaggtatctccatcaagctgcaggaggaggagagagaaaggagagacaattatgttcctgaggtctcagccttggatcaggagattattgaagtagatcctgacactaaggaaatgctgaagcttttggacttcggcagtctgtccaaccttcaggtcactcagcctacagttgggatgaatttcaaaacgcctcggggacctgtttgaattttttctgtagtgctgtattattttcaataaatctgggacaac

SEQ ID NO: 448799 - DNA, 509 bp, Homo sapiens
caggagtggctgcagctgactatgtattcctgaactggagccccagacccgccaacatgggccgcgttcgcaccaaaaccgtgaagaaggcggcccgggtcatcatagaaaagtactacacgcgcctgggcaacgacttccacacgaacaagcgcgtgtgcgaggagatcgccattatccccagcaaaaagctccgcaacaagatagcaggttatgtcacgcatctgatgaagcgaattcagagaggcccagtaagaggtatctccatcaagctgcaggaggaggagagagaaaggagagacaattatgttcctgaggtctcagccttggatcaggagattattgaagtagatcctgacactaaggaaatgctgaagcttttggacttcggcagtctgtccaaccttcaggtcactcagcctacagttgggatgaatttcaaaacgcctcggggacctgtttgaattttttctgtagtgctgtattattttcaataaatctgggacaac

SEQ ID NO: 448800 - DNA, 628 bp, Homo sapiens
acataaaaccctcattcacacgagaaaacaccctcatgttcatacacctatcccccattctcctcctatccctcaaccccgacatcattaccgggttttcctcttaaaaaaaaaaaaaaaaaaaaaaaaaaaaaaaaaaaaaaaaaaaaaaaacttttaccaaggacccgccaacatgggccgcgttcgcaccaaaaccgtgaagaaggcggcccgggtcatcatagaaaagtactacacgcgcctgggcaacgacttccacacgaacaagcgcgtgtgcgaggagatcgccattatccccagcaaaaagctccgcaacaagatagcaggttatgtcacgcatctgatgaagcgaattcagagaggcccagtaagaggtatctccatcaagctgcaggaggaggagagagaaaggagagacaattatgttcctgaggtctcagccttggatcaggagattattgaagtagatcctgacactaaggaaatgctgaagcttttggacttcggcagtctgtccaaccttcaggtcactcagcctacagttgggatgaatttcaaaacgcctcggggacctgtttgaattttttctgtagtgctgtattattttcaataaatctgggacaac

SEQ ID NO: 448801 - DNA, 722 bp, Homo sapiens
cggtgacagaaaagcagccgaggcggcgcaccgcatcagtacgcgcgcttgggaccccgctggagcccccgagagctcacacacgagcaggccgccagtcgcaatccgccaaaattcacgcggggggaaatcctgctgtgggtgcaagggcgcaatagcccaatcgccgttttcgcgttagagaaccacgcgaataaaagtgtgctagtccgaaaatcccgaaaaaaaaaaaaagggcggccgctcgcgatctagaactagtcgccaacatgggccgcgttcgcaccaaaaccgtgaagaaggcggcccgggtcatcatagaaaagtactacacgcgcctgggcaacgacttccacacgaacaagcgcgtgtgcgaggagatcgccattatccccagcaaaaagctccgcaacaagatagcaggttatgtcacgcatctgatgaagcgaattcagagaggcccagtaagaggtatctccatcaagctgcaggaggaggagagagaaaggagagacaattatgttcctgaggtctcagccttggatcaggagattattgaagtagatcctgacactaaggaaatgctgaagcttttggacttcggcagtctgtccaaccttcaggtcactcagcctacagttgggatgaatttcaaaacgcctcggggacctgtttgaattttttctgtagtgctgtattattttcaataaatctgggacaac

SEQ ID NO: 448802 - DNA, 722 bp, Homo sapiens; identical to SEQ ID NO: 448801

SEQ ID NO: 448803 - DNA, 250 bp, Homo sapiens
tttttcactgtgaaggagagagagagagacaagacagacgaggtgttgctcactgcaggtctcagccttggatcaggagattattgaagtagatcctgacactaaggaaatgctgaagcttttggacttcggcagtctgtccaaccttcaggtcactcagcctacagttgggatgaatttcaaaacgcctcggggacctgtttgaattttttctgtagtgctgtattattttcaataaatctgggacaac

SEQ ID NO: 448804 - DNA, 719 bp, Homo sapiens
  misc_feature (5)..(5): n is a, c, g, or t
  misc_feature (25)..(26): n is a, c, g, or t
  misc_feature (390)..(390): n is a, c, g, or t
ggtantctgaatcaaggacccgccnnctgggccgcgttcgcaccaaaaccgtgaagaaggcggcccgggtcatcatagaaaagtactacacgcgcctgggcaacgacttccacacgaacaagcgcgtgtgcgaggagatcgccattatccccagcaaaaagctccgcaacaagatagcaggttatgtcacgcatctgatgaagcgaattcagagaggcccagtaagaggtatctccatcaagattccaaagccctggcccaaggggggcacggggcacggagagagaaacggaccgacggaaccccaaaaacaaaaaaacgttttttttaaaaaaccttttttgggctttttttataccccaccctcttgaaaaggttcttccagccctntgcgggcaacaccttttttttccccaaaaaaaaggggggccggggggggcaaaaccgcggcaacttttacttgacagtacgaattcccgtttttggggggcaaaaaagccaaaaacccctaaagcgacaatggctgaaagggcccccccttttttatcttttcatcattggagcggcaacctttccgggacaaaagaggtaccctaggggtttcacccaaaaccccttccagggttccaaacctttcccaaaaggccaccataacccaaggttagggggaacttggaaactctttccaaaaccgggccccattttcccggggctaggga

SEQ ID NO: 448805 - DNA, 569 bp, Homo sapiens
  misc_feature (553)..(553): n is a, c, g, or t
gctggggttaattcggcacggagggccgacgggaggcgcggtcgcgccgaggcaccggaaggaagtgagacggcgtcgagaaaaaaccggggccgcgttcgcaccaaaaccgtgaagaaggcggcccgggtcatcatagaaaagtactacacgcgcctgggcaacgacttccacacgaacaagcgcgtgtgcgaggagatcgccattatccccagcaaaaagctccgcaacaagatagcaggttatgtcacgcatctgatgaagcgaattcagagaggcccagtaagaggtatctccatcaagctgcaggaggaggagagagaaaggagagacaattatgttcctgaggtctcagccttggatcaggagattattgaagtagatcctgacactaaggaaatgctgaagcttttggacttcggcagtctgtccaaccttcaggtcactcagcctacagttgggatgaatttcaaaacgcctcggggacctgtttgaattttttctgtagtgctgtattattttcaataaatctgggacaacgcaaaaaaacaanaaaaaaaaaacctccg

SEQ ID NO: 448806 - DNA, 1164 bp, Homo sapiens
  misc_feature (769)..(769): n is a, c, g, or t
cggtgacagaaaagcagccgaggcggcgcaccgcatcagtacgcgcgcttgggaccccgctggagcccccgagagctcacacacgagcaggccgccagtcgcaatccgccaaaattcacgcggggggaaatcctgctgtgggtgcaagggcgcaatagcccaatcgccgttttcgcgttagagaaccacgcgaataaaagtgtgctagtccgaaaatcccgaaaaaaaaaaaaagggcggccgctcgcgatctagaactagtcgccaacatgggccgcgttcgcaccaaaaccgtgaagaaggcggcccgggtcatcatagaaaagtactacacgcgcctgggcaacgacttccacacgaacaagcgcgtgtgcgaggagatcgccattatccccagcaaaaagctccgcaacaagatagcaggttatgtcacgcatctgatgaagcgaattcagagaggcccagtaagaggtatctccatcaagctgcaggaggaggagagagaaaggagagacaattatgttcctgaggtctcagccttggatcaggagattattgaagtagatcctgacactaaggaaatgctgaagcttttggacttcggcagtctgtccaaccttcaggtcactcagcctacagttgggatgaatttcaaaacgcctcggggacctgtttgaattttttctgtagtgctgtattattttcaataaatctgggacaacaaaaaaaaaaaaaaaaaaaaaaaaaaaaaaaaaaaaaaaaaaagccngggggccttttttgggggggggaaaaacaaggggctctacacaaggcggccatggtggccacctcgtgttccctagacccccgttttttggtgacacagcgggaacaaaccgcgggagggcccccaaatataggagggcgcggataaaattccgataacaccgcgggtgttccctttttatttcttctcgtcactacacccgccgaccaacacagccgccccgagcccgcgcgcgccacagcgtcgtgggggcctacacccatgtgttgtcccacaccaactgttgagtcgggagagaaacagtcttacacactcgttggtcccgctataaaccactattacgccaccaacaccagacgactagtcctccgcacgctctccctcttctcacctca

SEQ ID NO: 448807 - DNA, 532 bp, Homo sapiens
tatgtgcgaggcctgggtggcgcgccaacatgggccgcgttcgcaccaaaaccgtgaagaaggcggcccgggtcatcatagaaaagtactacacgcgcctgggcaacgacttccacacgaacaagcgcgtgtgcgaggagatcgccattatccccagcaaaaagctccgcaacaagatagcaggttatgtcacgcatctgatgaagcgaattcagagaggcccagtaagaggtatctccatcaagctgcaggaggaggagagagaaaggagagacaattatgttcctgaggtctcagccttggatcaggagattattgaagtagatcctgacactaaggaaatgctgaagcttttggacttcggcagtctgtccaaccttcaggtcactcagcctacagttgggatgaatttcaaaacgcctcggggacctgtttgaattttttctgtagtgctgtattattttcaataaatctgggacaacaaaaaaaaaacataaccccacctccccccccaattacataaccactactt

SEQ ID NO: 448808 - DNA, 279 bp, Homo sapiens
ggagagacctcaggaacataattgtctctcctttctctctccatcaagctgcaggaggaggagagagaaaggagagacctcaggaacgtctcagccttggatcaggagattattgaagtagatcctgacactaaggaaatgctgaagcttttggacttcggcagtctgtccaaccttcaggtcactcagcctacagttgggatgaatttcaaaacgcctcggggacctgtttgaattttttctgtagtgctgtattattttcaataaatctgggacaac

SEQ ID NO: 448809 - DNA, 482 bp, Homo sapiens
tatgtgcgaggcctgggtggcgcgccaacatgggccgcgttcgcaccaaaaccgtgaagaaggcggcccgggtcatcatagaaaagtactacacgcgcctgggcaacgacttccacacgaacaagcgcgtgtgcgaggagatcgccattatccccagcaaaaagctccgcaacaagatagcaggttatgtcacgcatctgatgaagcgaattcagagaggcccagtaagaggtatctccatcaagctgcaggaggaggagagagaaaggagagacaattatgttcctgaggtctcagccttggatcaggagattattgaagtagatcctgacactaaggaaatgctgaagcttttggacttcggcagtctgtccaaccttcaggtcactcagcctacagttgggatgaatttcaaaacgcctcggggacctgtttgaattttttctgtagtgctgtattattttcaataaatctgggacaac

SEQ ID NO: 448810 - DNA, 509 bp, Homo sapiens; identical to SEQ ID NO: 448799

SEQ ID NO: 448811 - DNA, 532 bp, Homo sapiens
gcccgccaacatgggccgcgttcgcaccaaaaccgtgaagaaggcggcccgggtcatcatagaaaagtactacacgcgcctgggccgcgttcgcaccaaaaccgtgaagaaggcggcccgggtcatcatagaaaagtactacacgcgcctgggcaacgacttccacacgaacaagcgcgtgtgcgaggagatcgccattatccccagcaaaaagctccgcaacaagatagcaggttatgtcacgcatctgatgaagcgaattcagagaggcccagtaagaggtatctccatcaagctgcaggaggaggagagagaaaggagagacaattatgttcctgaggtctcagccttggatcaggagattattgaagtagatcctgacactaaggaaatgctgaagcttttggacttcggcagtctgtccaaccttcaggtcactcagcctacagttgggatgaatttcaaaacgcctcggggacctgtttgaattttttctgtagtgctgtattattttcaataaatctgggacaac

SEQ ID NO: 448812 - DNA, 453 bp, Homo sapiens
ttttttttttgttgtcccagatttattgaaaataatacagcactacagaaaaaattcaaacaggtccccgaggagatcgccattatccccagcaaaaagctccgcaacaagatagcaggttatgtcacgcatctgatgaagcgaattcagagaggcccagtaagaggtatctccatcaagctgcaggaggaggagagagaaaggagagacaattatgttcctgaggtctcagccttggatcaggagattattgaagtagatcctgacactaaggaaatgctgaagcttttggacttcggcagtctgtccaaccttcaggtcactcagcctacagttgggatgaatttcaaaacgcctcggggacctgtttgaattttttctgtagtgctgtattattttcaataaatctgggacaacagaagataaataccttgctaatctatatagacatgt

SEQ ID NO: 448813 - DNA, 840 bp, Homo sapiens
  misc_feature (41)..(41): n is a, c, g, or t
caaattacggctaggtagcgaggcttgggttgcgcaaggancgccaacatgggccgcgttcgcaccaaaaccgtgaagaaggcggcccgggtcatcatagaaaagtactacacgcgcctgggcaacgacttccacacgaacaagcgcgtgtgcgaggagatcgccattatccccagcaaaaagctccgcaacaagatagcaggttatgtcacgcatctgatgaagcgaattcagagaggcccagtaagaggtatctccatcaagctgcaggaggaggagagagaaaggagagacaattatgttcctgaggtctcagccttggatcaggagattattgaagtagatcctgacactaaggaaatgctgaagcttttggacttcggcagtctgtccaaccttcaggtcactcagcctacagttgggatgaatttcaaaacgcctcggggacctgtttgaattttttctgtagtgctgtattattttcaataaatctgggacaacaaaaaaaaaaacaaaaaaaaaaaaaaaaaaaaaaaaaaaaaaaaaaaaaaaagaaaaaaaaaaaaaaaaaaaaaaaaaaaaaaaaagaaggggcgggcgccgacgtaaaaaaatgaactccgccggaggagcacccccacaaactgccctgcccgccacatttttttatgagaagaggcggccctaccactttatggggacttttatataaaagcacagcgccgcgcgctgcgttaaaaccaccgagcgtggggcaaaaaaaacctgcggccagcgagctcgttttaggaggaccgcccccctcgggggggggggacaaacacgtggcgaaccccccag

SEQ ID NO: 448814 - DNA, 458 bp, Homo sapiens
agaggtacaatcccccggaacactatgccatgttacccagcttatcggaccatataggaagttgtacgctgcagtaccgtcggaatccgggtagcctactactactaaattcgcggccgctcgactatccccagcaaaaagctccgcttaagatagcaggttatgtcacgcatctgatgaagcgaattcagagaggcccagtaagaggtatctccatcaagctgcaggaggaggagagagaaaggagagacaattatgttcctgaggtctcagccttggatcaggagattattgaagtagatcctgacactaaggaaatgctgaagcttttggacttcggcagtctgtccaaccttcaggtcactcagcctacagttgggatgaatttcaaaacgcctcggggacctgtttgaattttttctgtagtgctgtattattttcaataaatctgggacaac

SEQ ID NO: 448815 - DNA, 523 bp, Homo sapiens
gggggagagagagagagagagagagagagagagagagagagagagagagagagagcaaggacccgccaacatgggccgcgttcgcaccaaaaccgtgaagaaggcggcccgggtcatcatagaaaagtactacacgcgcctgggcaacgacttccacacgaacaagcgcgtgtgcgaggagatcgccattatccccagcaaaaagctccgcaacaagatagcaggttatgtcacgcatctgatgaagcgaattcagagaggcccagtaagaggtatctccatcaagctgcaggaggaggagagagaaaggagagacaattatgttcctgaggtctcagccttggatcaggagattattgaagtagatcctgacactaaggaaatgctgaagcttttggacttcggcagtctgtccaaccttcaggtcactcagcctacagttgggatgaatttcaaaacgcctcggggacctgtttgaattttttctgtagtgctgtattattttcaataaatctgggacaac

SEQ ID NO: 448816 - DNA, 809 bp, Homo sapiens
  misc_feature (3)..(3): n is a, c, g, or t
  misc_feature (662)..(662): n is a, c, g, or t
  misc_feature (706)..(707): n is a, c, g, or t
  misc_feature (709)..(709): n is a, c, g, or t
  misc_feature (712)..(712): n is a, c, g, or t
  misc_feature (718)..(718): n is a, c, g, or t
aanaaaaaaccttccttgcgaattcggcacgagccaacatgggccgcgttcgcaccaaaaccgtgaagaaggcggcccgggtcatcatagaaaagtactacacgcgcctgggcaacgacttccacacgaacaagcgcgtgtgcgaggagatcgccattatccccagcaaaaagctccgcaacaagatagcaggttatgtcacgcatctgatgaagcgaattcagagaggcccagtaagaggtatctccatcaagctgcaggaggaggagagagaaaggagagacaattatgttcctgaggtctcagccttggatcaggagattattgaagtagatcctgacactaaggaaatgctgaagcttttggacttcggcagtctgtccaaccttcaggtcactcagcctacagttgggatgaatttcaaaacgcctcggggacctgtttgaattttttctgtagtgctgtattattttcaataaatctgggacaacaaaaaaaaaaaaaaaaaaaaaaaaaaaaaaaaaaaaaaaaaaaaaaaccccggggacccattggcgggggggggaaaaaggggtttggaaggggcccggggccaaaggtgtgttcccgggacccagttttcttggcacaagggggcaaaaccggcgcggggcccccaaaanggggagcgcggaataaattcgaaaaccccgggtacccggttagnncncgnaaaagncacgtcacatatgcacctacacagacacatgaagcaggtccacatatactcaaacacgccaataccatcagcgtaataaacatctcacaca

SEQ ID NO: 448817 - DNA, 927 bp, Homo sapiens
  misc_feature (3)..(3): n is a, c, g, or t
  misc_feature (729)..(729): n is a, c, g, or t
aanaaaaaaccttccttgcgaattcggcacgagccaacatgggccgcgttcgcaccaaaaccgtgaagaaggcggcccgggtcatcatagaaaagtactacacgcgcctgggcaacgacttccacacgaacaagcgcgtgtgcgaggagatcgccattatccccagcaaaaagctccgcaacaagatagcaggttatgtcacgcatctgatgaagcgaattcagagaggcccagtaagaggtatctccatcaagctgcaggaggaggagagagaaaggagagacaattatgttcctgaggtctcagccttggatcaggagattattgaagtagatcctgacactaaggaaatgctgaagcttttggacttcggcagtctgtccaaccttcaggtcactcagcctacagttgggatgaatttcaaaacgcctcggggacctgtttgaattttttctgtagtgctgtattattttcaataaatctgggacaacaaaaaaaaaaaaaaaaaaaaaaaaaaaaaaaaaaaaaaaaaaaaaaacgaggggggaaatatggcggggggggaaaaaaggggtttaaaagggggcgggggcagggggttgagggacacgtttttgtggtcaccgagagggggatacacggcgcgggaccccccataaggggaggagggcgtaaaaattctgcgaaagcggggggttctcgtgtttttatgactctgtgctaaatacnaaaataataatacgagaataagagtagaaagaataggggggtgtaaactaatgagtaaaacaaaaatgtgatgtgcgacaagaatgaacataatcatattcatataaactaagcacgagagacaagctatagatgataatacataatagtgactataataatgattaatattaagaagaataagagaactagtagata

SEQ ID NO: 448818 - DNA, 710 bp, Homo sapiens
  misc_feature (3)..(3): n is a, c, g, or t
  misc_feature (571)..(572): n is a, c, g, or t
  misc_feature (614)..(614): n is a, c, g, or t
  misc_feature (648)..(648): n is a, c, g, or t
aanaaaaaaccttccttgcgaattcggcacgagccaacatgggccgcgttcgcaccaaaaccgtgaagaaggcggcccgggtcatcatagaaaagtactacacgcgcctgggcaacgacttccacacgaacaagcgcgtgtgcgaggagatcgccattatccccagcaaaaagctccgcaacaagatagcaggttatgtcacgcatctgatgaagcgaattcagagaggcccagtaagaggtatctccatcaagctgcaggaggaggagagagaaaggagagacaattatgttcctgaggtctcagccttggatcaggagattattgaagtagatcctgacactaaggaaatgctgaagcttttggacttcggcagtctgtccaaccttcaggtcactcagcctacagttgggatgaatttcaaaacgcctcggggacctgtttgaattttttctgtagtgctgtattattttcaataaatctgggacaacaaaaaaaaaaaaaaaaaaaaaaaaaaacgcgggggcttttatggggggggggggaaaaagggggaaaagaaagggggccnnggggcacaaagggtgtgtccccggacccacagttttgtgggncacaaggggggaaaactcggcggggatcccccanatgagggaggcgggaaaaaattccgaaaaacccgtggtaacccgggatagaagaagagggac

SEQ ID NO: 448819 - DNA, 1206 bp, Homo sapiens
  misc_feature (3)..(3): n is a, c, g, or t
aanaaaaaaccttccttgcgaattcggcacgagccaacatgggccgcgttcgcaccaaaaccgtgaagaaggcggcccgggtcatcatagaaaagtactacacgcgcctgggcaacgacttccacacgaacaagcgcgtgtgcgaggagatcgccattatccccagcaaaaagctccgcaacaagatagcaggttatgtcacgcatctgatgaagcgaattcagagaggcccagtaagaggtatctccatcaagctgcaggaggaggagagagaaaggagagacaattatgttcctgaggtctcagccttggatcaggagattattgaagtagatcctgacactaaggaaatgctgaagcttttggacttcggcagtctgtccaaccttcaggtcactcagcctacagttgggatgaatttcaaaacgcctcggggacctgtttgaattttttctgtagtgctgtattattttcaataaatctgggacaacaaaaaaaaaaaaaaaaaaaaaaaaaaacgggggaaaaaattctccccgcgggaaaaccctctgcgggaagagagaaaccccgaaagggtggcgcgggggaaaccccggggccccgtcaaaatgtgtattggggggggaaaggggggtctggggaaaaaagaacttggggaaaaggtattgggagggggaaaatggaaaaaacgttttttacccctggggtggtgcgggttaatcctatggtgttccccaacccaaaaggggaactataaaggtccagtcgttgggggaacagcgcggccgggaaacatcgggggggccggaacaagcgcatattattcaaaccatggtgtgcccacaaaggtggggacgaacccaaacgtcactacaaagagtgtggcgacgcgggctagaaaactgggtccgctgttgggtgcagaacatccccctgggttctgtgctgccacccggcgcggcacatgaggcagcgaaacggcgagggggaacacaaggtgttcaccgcagaaaacacttgggcaccaaatgcggccaacgaaacaccgtggaaaacccaccggcgtgtgtgcaaccacgggggcacccatgatgatatgagggacgctcccccacaaaagatgtgacccgcgagcaatacaaccacagagacgaacccccgagcacacgaagtacacgcacagtttgaggcgtccggaaacga

SEQ ID NO: 448820 - DNA, 697 bp, Homo sapiens
  misc_feature (3)..(3): n is a, c, g, or t
aanaaaaaaccttccttgcgaattcggcacgagccaacatgggccgcgttcgcaccaaaaccgtgaagaaggcggcccgggtcatcatagaaaagtactacacgcgcctgggcaacgacttccacacgaacaagcgcgtgtgcgaggagatcgccattatccccagcaaaaagctccgcaacaagatagcaggttatgtcacgcatctgatgaagcgaattcagagaggcccagtaagaggtatctccatcaagctgcaggaggaggagagagaaaggagagacaattatgttcctgaggtctcagccttggatcaggagattattgaagtagatcctgacactaaggaaatgctgaagcttttggacttcggcagtctgtccaaccttcaggtcactcagcctacagttgggatgaatttcaaaacgcctcggggacctgtttgaattttttctgtagtgctgtattattttcaataaatctgggacaacaaaaaaaaaaacaaaaaaaaaaaaaattcggggggatttaatgggggggggggaaaaaaggggtaatggaaaggggccatgggccatagcggtgtttccgggacccaggttttttggtccaagggggaaaatctggggggtccccctaatggggagtcgtataaatcggaaaagccgggtaaccggattaggccggggggaaaagc

SEQ ID NO: 448821 - DNA, 672 bp, Homo sapiens
  misc_feature (3)..(3): n is a, c, g, or t
aanaaaaaaccttccttgcgaattcggcacgagccaacatgggccgcgttcgcaccaaaaccgtgaagaaggcggcccgggtcatcatagaaaagtactacacgcgcctgggcaacgacttccacacgaacaagcgcgtgtgcgaggagatcgccattatccccagcaaaaagctccgcaacaagatagcaggttatgtcacgcatctgatgaagcgaattcagagaggcccagtaagaggtatctccatcaagctgcaggaggaggagagagaaaggagagacaattatgttcctgaggtctcagccttggatcaggagattattgaagtagatcctgacactaaggaaatgctgaagcttttggacttcggcagtctgtccaaccttcaggtcactcagcctacagttgggatgaatttcaaaacgcctcggggacctgtttgaattttttctgtagtgctgtattattttcaataaatctgggacaacaaaacacacaacaacccacacacacacaaaaaaacacacaaacaaaaaagaacaacacgtcgcgggggctcttatgggggggggaacacacggttctaaacaggcacagtggccacaagtgttcctctgacccccgtttttgtcacagggggaaatgccgggccccctatggagggcgcaa

SEQ ID NO: 448822 - DNA, 732 bp, Homo sapiens
  misc_feature (3)..(3): n is a, c, g, or t
  misc_feature (593)..(594): n is a, c, g, or t
  misc_feature (636)..(636): n is a, c, g, or t
  misc_feature (670)..(670): n is a, c, g, or t
aanaaaaaaccttccttgcgaattcggcacgagccaacatgggccgcgttcgcaccaaaaccgtgaagaaggcggcccgggtcatcatagaaaagtactacacgcgcctgggcaacgacttccacacgaacaagcgcgtgtgcgaggagatcgccattatccccagcaaaaagctccgcaacaagatagcaggttatgtcacgcatctgatgaagcgaattcagagaggcccagtaagaggtatctccatcaagctgcaggaggaggagagagaaaggagagacaattatgttcctgaggtctcagccttggatcaggagattattgaagtagatcctgacactaaggaaatgctgaagcttttggacttcggcagtctgtccaaccttcaggtcactcagcctacagttgggatgaatttcaaaacgcctcggggacctgtttgaattttttctgtagtgctgtattattttcaataaatctgggacaacaaaaaaaaaaaaaaaaaaaaaaaaaaaaaaaaaaaaaaaaaaaaaaaaccgcgggggcttttatggggggggggggaaaaagggggaaaagaaagggggccnnggggcacaaagggtgtgtccccggacccacagttttgtgggncacaaggggggaaaactcggcggggatcccccanatgagggaggcgggaaaaaattccgaaaaacccgtggtaacccgggatagaagaagagggac

SEQ ID NO: 448823 - DNA, 761 bp, Homo sapiens
  misc_feature (3)..(3): n is a, c, g, or t
aanaaaaaaccttccttgcgaattcggcacgagccaacatgggccgcgttcgcaccaaaaccgtgaagaaggcggcccgggtcatcatagaaaagtactacacgcgcctgggcaacgacttccacacgaacaagcgcgtgtgcgaggagatcgccattatccccagcaaaaagctccgcaacaagatagcaggttatgtcacgcatctgatgaagcgaattcagagaggcccagtaagaggtatctccatcaagctgcaggaggaggagagagaaaggagagacaattatgttcctgaggtctcagccttggatcaggagattattgaagtagatcctgacactaaggaaatgctgaagcttttggacttcggcagtctgtccaaccttcaggtcactcagcctacagttgggatgaatttcaaaacgcctcggggacctgtttgaattttttctgtagtgctgtattattttcaataaatctgggacaacaaaaaaaaaattgcagtggaacaagctaaatgctgtattcattccaaatgaaaagaactagactggtgattgtactgtaggataaggggaaggcgggctgaggttatccttgaagggtgtcaaggggtagggaggagaagagagttatctacaagcataacctctaatttcatcagaatcagcgtatcagaagctgtgaacttagattggtatacagatgaggagcgtggtccttgaaccttttgggcgatttattccgggcggggcctg

SEQ ID NO: 448824 - DNA, 820 bp, Homo sapiens
  misc_feature (3)..(3): n is a, c, g, or t
aanaaaaaaccttccttgcgaattcggcacgagccaacatgggccgcgttcgcaccaaaaccgtgaagaaggcggcccgggtcatcatagaaaagtactacacgcgcctgggcaacgacttccacacgaacaagcgcgtgtgcgaggagatcgccattatccccagcaaaaagctccgcaacaagatagcaggttatgtcacgcatctgatgaagcgaattcagagaggcccagtaagaggtatctccatcaagctgcaggaggaggagagagaaaggagagacaattatgttcctgaggtctcagccttggatcaggagattattgaagtagatcctgacactaaggaaatgctgaagcttttggacttcggcagtctgtccaaccttcaggtcactcagcctacagttgggatgaatttcaaaacgcctcggggacctgtttgaattttttctgtagtgctgtattattttcaataaatctgggacaacaaaaaaaaaaaaaaaaaaaaaaaaaaaaaaaaaaaacaaaacaaaaacaaaaaaaaaaaaaaaaaaaaaaaaaaaagaaggggcgggcgccgacgtaaaaaaatgaactccgccggaggagcacccccacaaactgccctgcccgccacatttttttatgagaagaggcggccctaccactttatggggacttttatataaaagcacagcgccgcgcgctgcgttaaaaccaccgagcgtggggcaaaaaaaacctgcggccagcgagctcgttttaggaggaccgcccccctcgggggggggggacaaacacgtggcgaaccccccag

SEQ ID NO: 448825 - DNA, 1297 bp, Homo sapiens
  misc_feature (3)..(3): n is a, c, g, or t
aanaaaaaaccttccttgcgaattcggcacgagccaacatgggccgcgttcgcaccaaaaccgtgaagaaggcggcccgggtcatcatagaaaagtactacacgcgcctgggcaacgacttccacacgaacaagcgcgtgtgcgaggagatcgccattatccccagcaaaaagctccgcaacaagatagcaggttatgtcacgcatctgatgaagcgaattcagagaggcccagtaagaggtatctccatcaagctgcaggaggaggagagagaaaggagagacaattatgttcctgaggtctcagccttggatcaggagattattgaagtagatcctgacactaaggaaatgctgaagcttttggacttcggcagtctgtccaaccttcaggtcactcagcctacagttgggatgaatttcaaaacgcctcggggacctgtttgaattttttctgtagtgctgtattattttcaataaatctgggacaacaaaaaaaaaaaaaaaaaaaaaaaaaaaaaaaaaaaaaaaaaaagtttgcgcggcccacgtggcccagagaaaaggtcctccagacacaattggcgttggggcgggcgcggggccaccaccgttgtctgagaacaagagacggcagggagagacacggttgacctcagagaagacaccgcggtcccaggactgcggctcgggtacatccatacaaagaaaaaaatgcccggggcataacgacgacttttgtgcgaaagaaacactgcataatggcggtacttcaggagcccaaggagggaggccttaaaacaacgggtgctgcactacgcagcacgtgagtaagaatatgttgccctgcccgctgcggggtggaaatgagcattgtcatccgaacccttggagccacaggcagctcctcacctggcccgggaattcatgatcaaaagccgccgtaaggaagggcctcagtgaaggatgtgagcatcagcaaattcttcgatgatcctatgttgctggaaacttgccaaacaaggatgtagtgctcaattaccccatgtgagtgcgtggactcctgggagctccatgctcactacagtgggcttgcactcctgtacttgaaggctgagactcatatgacgttggccttcgagtaggcagaagagtgtctggaagctgctgtagcatcttgcaacaacgtcagcgaagctccaaaccagagccccagtgagagaggaccctcggcctcctgcttcttctgtgcctctgccgggctcattccaggaaagacaggagttggggctcccaga

SEQ ID NO: 448826 - DNA, 534 bp, Homo sapiens
  misc_feature (3)..(3): n is a, c, g, or t
aanaaaaaaccttccttgcgaattcggcacgagccaacatgggccgcgttcgcaccaaaaccgtgaagaaggcggcccgggtcatcatagaaaagtactacacgcgcctgggcaacgacttccacacgaacaagcgcgtgtgcgaggagatcgccattatccccagcaaaaagctccgcaacaagatagcaggttatgtcacgcatctgatgaagcgaattcagagaggcccagtaagaggtatctccatcaagctgcaggaggaggagagagaaaggagagacaattatgttcctgaggtctcagccttggatcaggagattattgaagtagatcctgacactaaggaaatgctgaagcttttggacttcggcagtctgtccaaccttcaggtcactcagcctacagttgggatgaatttcaaaacgcctcggggacctgtttgaattttttctgtagtgctgtattattttcaataaatctgggacaacaaaagtcgacgcggccgcgaatttagtagtagtaggcggcagc

SEQ ID NO: 448827 - DNA, 694 bp, Homo sapiens
  misc_feature (3)..(3): n is a, c, g, or t
  misc_feature (502)..(502): n is a, c, g, or t
aanaaaaaaccttccttgcgaattcggcacgagccaacatgggccgcgttcgcaccaaaaccgtgaagaaggcggcccgggtcatcatagaaaagtactacacgcgcctgggcaacgacttccacacgaacaagcgcgtgtgcgaggagatcgccattatccccagcaaaaagctccgcaacaagatagcaggttatgtcacgcatctgatgaagcgaattcagagaggcccagtaagaggtatctccatcaagctgcaggaggaggagagagaaaggagagacaattatgttcctgaggtctcagccttggatcaggagattattgaagtagatcctgacactaaggaaatgctgaagcttttggacttcggcagtctgtccaaccttcaggtcactcagcctacagttgggatgaatttcaaaacgcctcggggacctgtttgaattttttctgtagtgctgtattattttcaataaatctgggacaacaaaaaaaaaanaaaaaaaaaaaattcggggggatttaatgggggggggggaaaaaaggggtaatggaaaggggccatgggccatagcggtgtttccgggacccaggttttttggtccaagggggaaaatctggggggtccccctaatggggagtcgtataaatcggaaaagccgggtaaccggattaggccggggggaaaagc

SEQ ID NO: 448828 - DNA, 863 bp, Homo sapiens
  misc_feature (3)..(3): n is a, c, g, or t
  misc_feature (502)..(502): n is a, c, g, or t
aanaaaaaaccttccttgcgaattcggcacgagccaacatgggccgcgttcgcaccaaaaccgtgaagaaggcggcccgggtcatcatagaaaagtactacacgcgcctgggcaacgacttccacacgaacaagcgcgtgtgcgaggagatcgccattatccccagcaaaaagctccgcaacaagatagcaggttatgtcacgcatctgatgaagcgaattcagagaggcccagtaagaggtatctccatcaagctgcaggaggaggagagagaaaggagagacaattatgttcctgaggtctcagccttggatcaggagattattgaagtagatcctgacactaaggaaatgctgaagcttttggacttcggcagtctgtccaaccttcaggtcactcagcctacagttgggatgaatttcaaaacgcctcggggacctgtttgaattttttctgtagtgctgtattattttcaataaatctgggacaacaaaaaaaaaanaaaaaaaaaaaaaaaaaaaaaaaaaaaaaaaaaaaaaaacaaaaaaaaaaacaaacaagaaaaaaatagaaaaaaaaaaaaaaaaaaaaaaaaaaaaaaaaaaaaaaagaaggggcgggcgccgacgtaaaaaaatgaactccgccggaggagcacccccacaaactgccctgcccgccacatttttttatgagaagaggcggccctaccactttatggggacttttatataaaagcacagcgccgcgcgctgcgttaaaaccaccgagcgtggggcaaaaaaaacctgcggccagcgagctcgttttaggaggaccgcccccctcgggggggggggacaaacacgtggcgaaccccccag

SEQ ID NO: 448829 - DNA, 634 bp, Homo sapiens
  misc_feature (3)..(3): n is a, c, g, or t
aanaaaaaaccttccttgcgaattcggcacgagccaacatgggccgcgttcgcaccaaaaccgtgaagaaggcggcccgggtcatcatagaaaagtactacacgcgcctgggcaacgacttccacacgaacaagcgcgtgtgcgaggagatcgccattatccccagcaaaaagctccgcaacaagatagcaggttatgtcacgcatctgatgaagcgaattcagagaggcccagtaagaggtatctccatcaagctgcaggaggaggagagagaaaggagagacaattatgttcctgaggtctcagccttggatcaggagattattgaagtagatcctgacactaaggaaatgctgaagcttttggacttcggcagtctgtccaaccttcaggtcactcagcctacagttgggatgaatttcaaaacgcctcggggacctgtttgaattttttctgtagtgctgtattattttcaataaatctgggacaacaaaaatagaaaaaaaaaaaaggccccgcgcggtgaggttgtctagtccacgctcggagccatgccgtccaagggtccgttgcagtcggtgcaggtcttcggacgcaagaagacagcgacgttgtggcgcactgaaacgcggca

SEQ ID NO: 448830 - DNA, 520 bp, Homo sapiens
  misc_feature (3)..(3): n is a, c, g, or t
  misc_feature (504)..(504): n is a, c, g, or t
aanaaaaaaccttccttgcgaattcggcacgagccaacatgggccgcgttcgcaccaaaaccgtgaagaaggcggcccgggtcatcatagaaaagtactacacgcgcctgggcaacgacttccacacgaacaagcgcgtgtgcgaggagatcgccattatccccagcaaaaagctccgcaacaagatagcaggttatgtcacgcatctgatgaagcgaattcagagaggcccagtaagaggtatctccatcaagctgcaggaggaggagagagaaaggagagacaattatgttcctgaggtctcagccttggatcaggagattattgaagtagatcctgacactaaggaaatgctgaagcttttggacttcggcagtctgtccaaccttcaggtcactcagcctacagttgggatgaatttcaaaacgcctcggggacctgtttgaattttttctgtagtgctgtattattttcaataaatctgggacaacgcaaaaaaacaanaaaaaaaaaacctccg

SEQ ID NO: 448831 - DNA, 708 bp, Homo sapiens
  misc_feature (3)..(3): n is a, c, g, or t
aanaaaaaaccttccttgcgaattcggcacgagccaacatgggccgcgttcgcaccaaaaccgtgaagaaggcggcccgggtcatcatagaaaagtactacacgcgcctgggcaacgacttccacacgaacaagcgcgtgtgcgaggagatcgccattatccccagcaaaaagctccgcaacaagatagcaggttatgtcacgcatctgatgaagcgaattcagagaggcccagtaagaggtatctccatcaagctgcaggaggaggagagagaaaggagagacaattatgttcctgaggtctcagccttggatcaggagattattgaagtagatcctgacactaaggaaatgctgaagcttttggacttcggcagtctgtccaaccttcaggtcactcagcctacagttgggatgaatttcaaaacgcctcggggacctgtttgaattttttctgtagtgctgtattattttcaataaatctgggacaacttatacggaatctacagcgcgtgtacgaggtgatcgccattatccccagcaaaaagctccgcaacaagatagcaggttatgtcacgcatctgatgaagcgaattcagagaggcccagtaagaggtatctccatcaagctgcaggaggaggagggagaaaggagagacaattatgttcctgaggtctcagccttggatcaggagattattgacgcaca

SEQ ID NO: 448832 - DNA, 1260 bp, Homo sapiens
  misc_feature (3)..(3): n is a, c, g, or t
aanaaaaaaccttccttgcgaattcggcacgagccaacatgggccgcgttcgcaccaaaaccgtgaagaaggcggcccgggtcatcatagaaaagtactacacgcgcctgggcaacgacttccacacgaacaagcgcgtgtgcgaggagatcgccattatccccagcaaaaagctccgcaacaagatagcaggttatgtcacgcatctgatgaagcgaattcagagaggcccagtaagaggtatctccatcaagctgcaggaggaggagagagaaaggagagacaattatgttcctgaggtctcagccttggatcaggagattattgaagtagatcctgacactaaggaaatgctgaagcttttggacttcggcagtctgtccaaccttcaggtcactcagcctacagttgggatgaatttcaaaacgcctcggggacctgtttgaattttttctgtagtgctgtattattttcaataaatctgggacaacaaaaaaaaaaaaaaaaaaaaaaaaaaaaaaaaaaaaaaaaaaaaaaagaaaaaaaaaaaaaaaaaaaaaaaaaaaaaaaaacgggggaaaaaattctccccgcgggaaaaccctctgcgggaagagagaaaccccgaaagggtggcgcgggggaaaccccggggccccgtcaaaatgtgtattggggggggaaaggggggtctggggaaaaaagaacttggggaaaaggtattgggagggggaaaatggaaaaaacgttttttacccctggggtggtgcgggttaatcctatggtgttccccaacccaaaaggggaactataaaggtccagtcgttgggggaacagcgcggccgggaaacatcgggggggccggaacaagcgcatattattcaaaccatggtgtgcccacaaaggtggggacgaacccaaacgtcactacaaagagtgtggcgacgcgggctagaaaactgggtccgctgttgggtgcagaacatccccctgggttctgtgctgccacccggcgcggcacatgaggcagcgaaacggcgagggggaacacaaggtgttcaccgcagaaaacacttgggcaccaaatgcggccaacgaaacaccgtggaaaacccaccggcgtgtgtgcaaccacgggggcacccatgatgatatgagggacgctcccccacaaaagatgtgacccgcgagcaatacaaccacagagacgaacccccgagcacacgaagtacacgcacagtttgaggcgtccggaaacga

SEQ ID NO: 448833 - DNA, 502 bp, Homo sapiens
  misc_feature (3)..(3): n is a, c, g, or t
aanaaaaaaccttccttgcgaattcggcacgagccaacatgggccgcgttcgcaccaaaaccgtgaagaaggcggcccgggtcatcatagaaaagtactacacgcgcctgggcaacgacttccacacgaacaagcgcgtgtgcgaggagatcgccattatccccagcaaaaagctccgcaacaagatagcaggttatgtcacgcatctgatgaagcgaattcagagaggcccagtaagaggtatctccatcaagctgcaggaggaggagagagaaaggagagacaattatgttcctgaggtctcagccttggatcaggagattattgaagtagatcctgacactaaggaaatgctgaagcttttggacttcggcagtctgtccaaccttcaggtcactcagcctacagttgggatgaatttcaaaacgcctcggggacctgtttgaattttttcttcagctgggttttcatatctgccgttttttttttctcttgtttcgtt

SEQ ID NO: 448834 - DNA, 1957 bp, Homo sapiens
  misc_feature (3)..(3): n is a, c, g, or t
aanaaaaaaccttccttgcgaattcggcacgagccaacatgggccgcgttcgcaccaaaaccgtgaagaaggcggcccgggtcatcatagaaaagtactacacgcgcctgggcaacgacttccacacgaacaagcgcgtgtgcgaggagatcgccattatccccagcaaaaagctccgcaacaagatagcaggttatgtcacgcatctgatgaagcgaattcagagaggcccagtaagaggtatctccatcaagctgcaggaggaggagagagaaaggagagacaattatgttcctgaggtctcagccttggatcaggagattattgaagtagatcctgacactaaggaaatgctgaagcttttggtaagtgtttgctggattcctaaagtggtattttcctggtcaaaaaccatcagtaggtcttattatccaaggtcacccagctagtaagtggcagagttgggaatcccatctaaacttgtagccactaaactggactgctttcataaggggtgtagcggaagttgtgtgcattgagttagttcgccacaagatcatgattcccaaatctagtggcttccaggacaccttttctctcttggctgcttctgttcttggttttatagctggcttacgttgccccctttgtgtcagccctggctgaatctgcctgcttttcttctgtgaaggcattcctttggtgtctccatgctaaccactcagaaatgagctttggtccatttccaggtacatacaaggcactacttaggtagttcacgagtatcttcattgcactttgatgttttttctatggcttatcttagtccttttgcatacttgggtgaaagcatgggcttcatgggcggttggtgattttgaacaacttcatttttcctatttttatggtcattaaatgtttaagacactcaaaaaggtagtagcaaaatgaactcacatgtactttcccagcttcagaaaaacatcaccagtacagctacagccccgctgtgggtcttttcttcctgaaataaccactgcgctgaatgcagcatttttgttgaaactaaaatgggtttctgaggaccaaataggacatggagttccaggtataagttgggcccttggcttcttgccctgcctaccagcctgaacttgtttgagggcagggtctgctcttgcctccctcccttctgcttgatgccttgtgtacttgggcccttcacaaatgttgattagattagtaatagctcttacccagggctggtcctggaaagcaagtggcactgtgtattctcaaagggacagagttttgctttagaggacatttggcaatgtccagacacatttttcgttctcatagccaggggatacctgctaacttctaaggggtagaggccaaggatgttgctaaactttctgcaatacacagtacagctgcctataacaaagaatgtccagcccaggatgtctacgttgccaagattgagaaacggtgttttagagtgattgataggaaggggttgtgaaaacagatacaaatggcatggtacattgggtaaaagtcatagagttgtaaatggggataccacatggtcaggtgtgtgttgaaggaagatcactctggaaaagtgggaggcattgagaaccctgttggctcttaaagggtccttcaggtcgcctctggacccccttgagagtgctgtggctctaggggcctgtgttttcttctggggtccactcacagatctcaccagtaactgctcactgaatccattttctcgttccaggacttcggcagtctgtccaaccttcaggtcactcagcctacagttgggatgaatttcaaaacgcctcggggacctgtttgaattttttctgtagtgctgtattattttcaataaatctgggacaacgcagcggcgcttataaaaaaaaaataaaagacggaaaagtca

SEQ ID NO: 448835 - DNA, 504 bp, Homo sapiens
  misc_feature (3)..(3): n is a, c, g, or t
  misc_feature (379)..(379): n is a, c, g, or t
  misc_feature (398)..(398): n is a, c, g, or t
  misc_feature (434)..(434): n is a, c, g, or t
  misc_feature (439)..(439): n is a, c, g, or t
  misc_feature (448)..(449): n is a, c, g, or t
  misc_feature (467)..(467): n is a, c, g, or t
  misc_feature (474)..(474): n is a, c, g, or t
  misc_feature (476)..(476): n is a, c, g, or t
  misc_feature (479)..(479): n is a, c, g, or t
  misc_feature (483)..(484): n is a, c, g, or t
  misc_feature (498)..(498): n is a, c, g, or t
  misc_feature (500)..(500): n is a, c, g, or t
aanaaaaaaccttccttgcgaattcggcacgagccaacatgggccgcgttcgcaccaaaaccgtgaagaaggcggcccgggtcatcatagaaaagtactacacgcgcctgggcaacgacttccacacgaacaagcgcgtgtgcgaggagatcgccattatccccagcaaaaagctccgcaacaagatagcaggttatgtcacgcatctgatgaagcgaattcagagaggcccagtaagaggtatctccatcaagctgcaggaggaggagagagaaaggagagacaattatgttcctgaggtctcagccttggatcaggagattattgaagtagatcctgacactaaggaaatgctgaagcttttggactccgccagtcngtccaactttcaggtcagncaccgtccagatggaatgaatttccaaacgccttgnggccnagtttgaanngtttttagtgtggtgtangacagtngncantgtnncacagtagcaggantnaggt

SEQ ID NO: 448836 - DNA, 2424 bp, Homo sapiens
  misc_feature (3)..(3): n is a, c, g, or t
aanaaaaaaccttccttgcgaattcggcacgagccaacatgggccgcgttcgcaccaaaaccgtgaagaaggcggcccgggtcatcatagaaaagtactacacgcgcctgggcaacgacttccacacgaacaagcgcgtgtgcgaggagatcgccattatccccagcaaaaagctccgcaacaagatagcaggttatgtcacgcatctgatgaagcgaattcagagaggcccagtaagaggtatctccatcaagctgcaggaggaggagagagaaaggagagacaattatgttcctgagggtaaactttctggatatttgggcttctggctaatcctcaaatgataaagctatgggttcttggcttccaaagggacctcagctgaatctgagacctttaatccatacattccataaccagctgtgggtgcccataggccccctaccagtttcttagcctccattctgctcttctggaaccagttaagtctattccatatttcatgagagcccttaatgttgatttgatgactgctgtcgtggctcgattgtttgcccctaatatagtattctttggtgtaaacacagacttcaagtgttctgaatactgaatgagggcatgggaaggtaaggccagaagaacaggtcatcggggtctgtaatactgtaagagactgctcaccttgtgagaggaatgctatccttgtgcagctcctcttccccatatttaagaacctggggagaggaggaggagaggtgagtgataatctcattgattggtattttgaccctacctcgtttccttgtaggtctcagccttggatcaggagattattgaagtagatcctgacactaaggaaatgctgaagcttttggtaagtgtttgctggattcctaaagtggtattttcctggtcaaaaaccatcagtaggtcttattatccaaggtcacccagctagtaagtggcagagttgggaatcccatctaaacttgtagccactaaactggactgctttcataaggggtgtagcggaagttgtgtgcattgagttagttcgccacaagatcatgattcccaaatctagtggcttccaggacaccttttctctcttggctgcttctgttcttggttttatagctggcttacgttgccccctttgtgtcagccctggctgaatctgcctgcttttcttctgtgaaggcattcctttggtgtctccatgctaaccactcagaaatgagctttggtccatttccaggtacatacaaggcactacttaggtagttcacgagtatcttcattgcactttgatgttttttctatggcttatcttagtccttttgcatacttgggtgaaagcatgggcttcatgggcggttggtgattttgaacaacttcatttttcctatttttatggtcattaaatgtttaagacactcaaaaaggtagtagcaaaatgaactcacatgtactttcccagcttcagaaaaacatcaccagtacagctacagccccgctgtgggtcttttcttcctgaaataaccactgcgctgaatgcagcatttttgttgaaactaaaatgggtttctgaggaccaaataggacatggagttccaggtataagttgggcccttggcttcttgccctgcctaccagcctgaacttgtttgagggcagggtctgctcttgcctccctcccttctgcttgatgccttgtgtacttgggcccttcacaaatgttgattagattagtaatagctcttacccagggctggtcctggaaagcaagtggcactgtgtattctcaaagggacagagttttgctttagaggacatttggcaatgtccagacacatttttcgttctcatagccaggggatacctgctaacttctaaggggtagaggccaaggatgttgctaaactttctgcaatacacagtacagctgcctataacaaagaatgtccagcccaggatgtctacgttgccaagattgagaaacggtgttttagagtgattgataggaaggggttgtgaaaacagatacaaatggcatggtacattgggtaaaagtcatagagttgtaaatggggataccacatggtcaggtgtgtgttgaaggaagatcactctggaaaagtgggaggcattgagaaccctgttggctcttaaagggtccttcaggtcgcctctggacccccttgagagtgctgtggctctaggggcctgtgttttcttctggggtccactcacagatctcaccagtaactgctcactgaatccattttctcgttccaggacttcggcagtctgtccaaccttcaggtcactcagcctacagttgggatgaatttcaaaacgcctcggggacctgtttgaattttttctgtagtgctgtattattttcaataaatctgggacaac

SEQ ID NO: 448837 - DNA, 328 bp, Homo sapiens
  misc_feature (3)..(3): n is a, c, g, or t
aanaaaaaaccttccttgcgaattcggcacgagccaacatgggccgcgttcgcaccaaaaccgtgaagaaggcggcccgggtcatcatagaaaagtactacacgcgcctgggcaacgacttccacacgaacaagcgcgtgtgcgaggagatcgccattatccccagcaaaaagctccgcaacaagatagcaggttatgtcacgcatctgatgaagcgaattcagagaggcccagtaagaggtatctccatcaagctgcaggaggaggagagagaaaggagagacaattatgttcctgaggacttcccaacatagggaccgaatgttca

SEQ ID NO: 448838 - DNA, 731 bp, Homo sapiens
  misc_feature (3)..(3): n is a, c, g, or t
  misc_feature (402)..(402): n is a, c, g, or t
aanaaaaaaccttccttgcgaattcggcacgagccaacatgggccgcgttcgcaccaaaaccgtgaagaaggcggcccgggtcatcatagaaaagtactacacgcgcctgggcaacgacttccacacgaacaagcgcgtgtgcgaggagatcgccattatccccagcaaaaagctccgcaacaagatagcaggttatgtcacgcatctgatgaagcgaattcagagaggcccagtaagaggtatctccatcaagattccaaagccctggcccaaggggggcacggggcacggagagagaaacggaccgacggaaccccaaaaacaaaaaaacgttttttttaaaaaaccttttttgggctttttttataccccaccctcttgaaaaggttcttccagccctntgcgggcaacaccttttttttccccaaaaaaaaggggggccggggggggcaaaaccgcggcaacttttacttgacagtacgaattcccgtttttggggggcaaaaaagccaaaaacccctaaagcgacaatggctgaaagggcccccccttttttatcttttcatcattggagcggcaacctttccgggacaaaagaggtaccctaggggtttcacccaaaaccccttccagggttccaaacctttcccaaaaggccaccataacccaaggttagggggaacttggaaactctttccaaaaccgggccccattttcccggggctaggga

SEQ ID NO: 448839 - DNA, 491 bp, Homo sapiens
  misc_feature (3)..(3): n is a, c, g, or t
aanaaaaaaccttccttgcgaattcggcacgagccaacatgggccgcgttcgcaccaaaaccgtgaagaaggcggcccgggtcatcatagaaaagtactacacgcgcctgggcaacgacttccacacgaacaagcgcgtgtgcgaggagatcgccattatccccagcaaaaagctccgcaacaagatagcaggttatgtcacgcatctgatgaagcgaattcagagaggcccagtaagaggtatctccatcaagctgcaggaggaggagagagaaaggagagacaattatgttcctgaggtctcagccttggatcaggagattattgaagtagatcctgacactaaggaaatgctgaagcttttggacttcggcagtctgtccaaccttcaggtcactcagcctacagttgggatgaatttcaaaacgcctcggggacctgtttgaattttttctgtagtgctgtattattttcaataaatctgggacaac

SEQ ID NO: 448840 - DNA, 504 bp, Homo sapiens
  misc_feature (7)..(7): n is a, c, g, or t
aaaactnaggctaggtacgaggctgggtgttgaatcggccgaggcgccaacatgggccgcgttcgcaccaaaaccgtgaagaaggcggcccgggtcatcatagaaaagtactacacgcgcctgggcaacgacttccacacgaacaagcgcgtgtgcgaggagatcgccattatccccagcaaaaagctccgcaacaagatagcaggttatgtcacgcatctgatgaagcgaattcagagaggcccagtaagaggtatctccatcaagctgcaggaggaggagagagaaaggagagacaattatgttcctgaggtctcagccttggatcaggagattattgaagtagatcctgacactaaggaaatgctgaagcttttggacttcggcagtctgtccaaccttcaggtcactcagcctacagttgggatgaatttcaaaacgcctcggggacctgtttgaattttttctgtagtgctgtattattttcaataaatctgggacaac

SEQ ID NO: 448841 - DNA, 710 bp, Homo sapiens
  misc_feature (7)..(7): n is a, c, g, or t
aaaactnaggctaggtacgaggctgggtgttgaatcggccgaggcgccaacatgggccgcgttcgcaccaaaaccgtgaagaaggcggcccgggtcatcatagaaaagtactacacgcgcctgggcaacgacttccacacgaacaagcgcgtgtgcgaggagatcgccattatccccagcaaaaagctccgcaacaagatagcaggttatgtcacgcatctgatgaagcgaattcagagaggcccagtaagaggtatctccatcaagctgcaggaggaggagagagaaaggagagacaattatgttcctgaggtctcagccttggatcaggagattattgaagtagatcctgacactaaggaaatgctgaagcttttggacttcggcagtctgtccaaccttcaggtcactcagcctacagttgggatgaatttcaaaacgcctcggggacctgtttgaattttttctgtagtgctgtattattttcaataaatctgggacaacaaaaaaaaaaacaaaaaaaaaaaaaattcggggggatttaatgggggggggggaaaaaaggggtaatggaaaggggccatgggccatagcggtgtttccgggacccaggttttttggtccaagggggaaaatctggggggtccccctaatggggagtcgtataaatcggaaaagccgggtaaccggattaggccggggggaaaagc

SEQ ID NO: 448842 - DNA, 512 bp, Homo sapiens
gcggccgcctactactactactactgctcgaattcaagcttctaacgatgtacggggacatgggccgcgttcgcaccaaaaccgtgaagaaggcggcccgggtcatcatagaaaagtactacacgcgcctgggcaacgacttccacacgaacaagcgcgtgtgcgaggagatcgccattatccccagcaaaaagctccgcaacaagatagcaggttatgtcacgcatctgatgaagcgaattcagagaggcccagtaagaggtatctccatcaagctgcaggaggaggagagagaaaggagagacaattatgttcctgaggtctcagccttggatcaggagattattgaagtagatcctgacactaaggaaatgctgaagcttttggacttcggcagtctgtccaaccttcaggtcactcagcctacagttgggatgaatttcaaaacgcctcggggacctgtttgaattttttctgtagtgctgtattattttcaataaatctgggacaac

SEQ ID NO: 448843 - DNA, 536 bp, Homo sapiens
  misc_feature (1)..(1): n is a, c, g, or t
  misc_feature (78)..(78): n is a, c, g, or t
nccccgccacacccccccccccccacccccacccccacccgcccaaccccaactaggctaggtacgaggcgggtgtgngcaacatgggccgcgttcgcaccaaaaccgtgaagaaggcggcccgggtcatcatagaaaagtactacacgcgcctgggcaacgacttccacacgaacaagcgcgtgtgcgaggagatcgccattatccccagcaaaaagctccgcaacaagatagcaggttatgtcacgcatctgatgaagcgaattcagagaggcccagtaagaggtatctccatcaagctgcaggaggaggagagagaaaggagagacaattatgttcctgaggtctcagccttggatcaggagattattgaagtagatcctgacactaaggaaatgctgaagcttttggacttcggcagtctgtccaaccttcaggtcactcagcctacagttgggatgaatttcaaaacgcctcggggacctgtttgaattttttctgtagtgctgtattattttcaataaatctgggacaac

SEQ ID NO: 448844 - DNA, 564 bp, Homo sapiens
tcccgagtaggctcagagcgaccgtggccgggcggaagcggctttctggcctaagctttaacaggcttcgcctgtgcttcctgtttcctcttttaccaaggacccgccaacatgggccgcgttcgcaccaaaaccgtgaagaaggcggcccgggtcatcatagaaaagtactacacgcgcctgggcaacgacttccacacgaacaagcgcgtgtgcgaggagatcgccattatccccagcaaaaagctccgcaacaagatagcaggttatgtcacgcatctgatgaagcgaattcagagaggcccagtaagaggtatctccatcaagctgcaggaggaggagagagaaaggagagacaattatgttcctgaggtctcagccttggatcaggagattattgaagtagatcctgacactaaggaaatgctgaagcttttggacttcggcagtctgtccaaccttcaggtcactcagcctacagttgggatgaatttcaaaacgcctcggggacctgtttgaattttttctgtagtgctgtattattttcaataaatctgggacaac

SEQ ID NO: 448845 - DNA, 720 bp, Homo sapiens
caggagtggctgcagctgactatgtattcctgaactggagccccagacccgccaacatgggccgcgttcgcaccaaaaccgtgaagaaggcggcccgggtcatcatagaaaagtactacacgcgcctgggcaacgacttccacacgaacaagcgcgtgtgcgaggagatcgccattatccccagcaaaaagctccgcaacaagatagcaggttatgtcacgcatctgatgaagcgaattcagagaggcccagtaagaggtatctccatcaagctgcaggaggaggagagagaaaggagagacaattatgttcctgaggtctcagccttggatcaggagattattgaagtagatcctgacactaaggaaatgctgaagcttttggacttcggcagtctgtccaaccttcaggtcactcagcctacagttgggatgaatttcaaaacgcctcggggacctgtttgaattttttctgtagtgctgtattattttcaataaatctgggacaacaaaaaaaaaaaaaaaaaaaaaaaaaagaaaaaaaagagaagaaaaaaaaaaaaccgcggggaattaattttgtgggggggggaaaaaaagtgtataatagtggggggtgggtatggtgttcacgaccccgttttttgtaaaaaggggggaagaagcgggggccccaaagagggggcggaatatatatggaaaagcgggggtcctcgttaaa

SEQ ID NO: 448846 - DNA, 575 bp, Homo sapiens
agaggtacaatcccccggaacactatgccatgttacccagcttatcggaccatataggaagttgtacgctgcagtaccgtcggaatccgggtagcctactactactaaattcgcggccgctcgacggccgcgttcgcaccaaaaccgtgaagaaggcggcccgggtcatcatagaaaagtactacacgcgcctgggcaacgacttccacacgaacaagcgcgtgtgcgaggagatcgccattatccccagcaaaaagctccgcaacaagatagcaggttatgtcacgcatctgatgaagcgaattcagagaggcccagtaagaggtatctccatcaagctgcaggaggaggagagagaaaggagagacaattatgttcctgaggtctcagccttggatcaggagattattgaagtagatcctgacactaaggaaatgctgaagcttttggacttcggcagtctgtccaaccttcaggtcactcagcctacagttgggatgaatttcaaaacgcctcggggacctgtttgaattttttctgtagtgctgtattattttcaataaatctgggacaac

SEQ ID NO: 448847 - DNA, 542 bp, Homo sapiens
caacagaagattacgaggcaggtaccggttttgtatttcaggacgcagggcgggtgtggaatagaaattgacataggcccggcggctgacatggccgcgttcgcaccaaaaccgtgaagaaggcggcccgggtcatcatagaaaagtactacacgcgcctgggcaacgacttccacacgaacaagcgcgtgtgcgaggagatcgccattatccccagcaaaaagctccgcaacaagatagcaggttatgtcacgcatctgatgaagcgaattcagagaggcccagtaagaggtatctccatcaagctgcaggaggaggagagagaaaggagagacaattatgttcctgaggtctcagccttggatcaggagattattgaagtagatcctgacactaaggaaatgctgaagcttttggacttcggcagtctgtccaaccttcaggtcactcagcctacagttgggatgaatttcaaaacgcctcggggacctgtttgaattttttctgtagtgctgtattattttcaataaatctgggacaac

SEQ ID NO: 448848 - DNA, 886 bp, Homo sapiens
  misc_feature (1)..(1): n is a, c, g, or t
  misc_feature (78)..(78): n is a, c, g, or t
  misc_feature (645)..(645): n is a, c, g, or t
  misc_feature (650)..(650): n is a, c, g, or t
  misc_feature (663)..(663): n is a, c, g, or t
  misc_feature (668)..(668): n is a, c, g, or t
  misc_feature (670)..(670): n is a, c, g, or t
nccccgccacacccccccccccccacccccacccccacccgcccaaccccaactaggctaggtacgaggcgggtgtgngcaacatgggccgcgttcgcaccaaaaccgtgaagaaggcggcccgggtcatcatagaaaagtactacacgcgcctgggcaacgacttccacacgaacaagcgcgtgtgcgaggagatcgccattatccccagcaaaaagctccgcaacaagatagcaggttatgtcacgcatctgatgaagcgaattcagagaggcccagtaagaggtatctccatcaagctgcaggaggaggagagagaaaggagagacaattatgttcctgaggtctcagccttggatcaggagattattgaagtagatcctgacactaaggaaatgctgaagcttttggacttcggcagtctgtccaaccttcaggtcactcagcctacagttgggatgaatttcaaaacgcctcggggacctgtttgaattttttctgtagtgctgtattattttcaataaatctgggacaacaaaaaaaaaaaaaaaaaaaaaaaaaaaaaaaaaaaaaaaaaaaggggggggggggaaaaagagattccccgggggggccaaagttaaggggaaccacaggtttttgtgnacaangggggcccataanggacncncgataaaagccaagcgcgaggccggacgtacaacaagcgtggacagggaacacaggccagcggggaaccagggggagagaacccaaatccggggggtgggacaaatgggacaaatacctacgaaattaaaaggctaaggaactttaacttaaggggcaaagggttaacaacgcaattgctggtttgaaaaattggaaggactagattgaaattacg

SEQ ID NO: 448849 - DNA, 492 bp, Homo sapiens
cgagagcgggtgttgacttcgtcacgctggccggccaacatgggccgcgttcgcaccaaaaccgtgaagaaggcggcccgggtcatcatagaaaagtactacacgcgcctgggcaacgacttccacacgaacaagcgcgtgtgcgaggagatcgccattatccccagcaaaaagctccgcaacaagatagcaggttatgtcacgcatctgatgaagcgaattcagagaggcccagtaagaggtatctccatcaagctgcaggaggaggagagagaaaggagagacaattatgttcctgaggtctcagccttggatcaggagattattgaagtagatcctgacactaaggaaatgctgaagcttttggacttcggcagtctgtccaaccttcaggtcactcagcctacagttgggatgaatttcaaaacgcctcggggacctgtttgaattttttctgtagtgctgtattattttcaataaatctgggacaac

SEQ ID NO: 448850 - DNA, 536 bp, Homo sapiens; identical to SEQ ID NO: 448843
  misc_feature (1)..(1): n is a, c, g, or t
  misc_feature (78)..(78): n is a, c, g, or t

SEQ ID NO: 448851 - DNA, 803 bp, Homo sapiens
  misc_feature (562)..(562): n is a, c, g, or t
  misc_feature (567)..(567): n is a, c, g, or t
  misc_feature (580)..(580): n is a, c, g, or t
  misc_feature (585)..(585): n is a, c, g, or t
  misc_feature (587)..(587): n is a, c, g, or t
tagggatacgcgaccacgccgtcggacccgccaacatgggccgcgttcgcaccaaaaccgtgaagaaggcggcccgggtcatcatagaaaagtactacacgcgcctgggcaacgacttccacacgaacaagcgcgtgtgcgaggagatcgccattatccccagcaaaaagctccgcaacaagatagcaggttatgtcacgcatctgatgaagcgaattcagagaggcccagtaagaggtatctccatcaagctgcaggaggaggagagagaaaggagagacaattatgttcctgaggtctcagccttggatcaggagattattgaagtagatcctgacactaaggaaatgctgaagcttttggacttcggcagtctgtccaaccttcaggtcactcagcctacagttgggatgaatttcaaaacgcctcggggacctgtttgaattttttctgtagtgctgtattattttcaataaatctgggacaacaaaaaaaaaaaaaaaaaaaaaaaaaaagattccccgggggggccaaagttaaggggaaccacaggtttttgtgnacaangggggcccataanggacncncgataaaagccaagcgcgaggccggacgtacaacaagcgtggacagggaacacaggccagcggggaaccagggggagagaacccaaatccggggggtgggacaaatgggacaaatacctacgaaattaaaaggctaaggaactttaacttaaggggcaaagggttaacaacgcaattgctggtttgaaaaattggaaggactagattgaaattacg

SEQ ID NO: 448852 - DNA, 501 bp, Homo sapiens
  misc_feature (41)..(41): n is a, c, g, or t
caaattacggctaggtagcgaggcttgggttgcgcaaggancgccaacatgggccgcgttcgcaccaaaaccgtgaagaaggcggcccgggtcatcatagaaaagtactacacgcgcctgggcaacgacttccacacgaacaagcgcgtgtgcgaggagatcgccattatccccagcaaaaagctccgcaacaagatagcaggttatgtcacgcatctgatgaagcgaattcagagaggcccagtaagaggtatctccatcaagctgcaggaggaggagagagaaaggagagacaattatgttcctgaggtctcagccttggatcaggagattattgaagtagatcctgacactaaggaaatgctgaagcttttggacttcggcagtctgtccaaccttcaggtcactcagcctacagttgggatgaatttcaaaacgcctcggggacctgtttgaattttttctgtagtgctgtattattttcaataaatctgggacaac

SEQ ID NO: 448853 - DNA, 927 bp, Homo sapiens
  misc_feature (927)..(927): n is a, c, g, or t
cgagagcgggtgttgacttcgtcacgctggccggccaacatgggccgcgttcgcaccaaaaccgtgaagaaggcggcccgggtcatcatagaaaagtactacacgcgcctgggcaacgacttccacacgaacaagcgcgtgtgcgaggagatcgccattatccccagcaaaaagctccgcaacaagatagcaggttatgtcacgcatctgatgaagcgaattcagagaggcccagtaagaggtatctccatcaagctgcaggaggaggagagagaaaggagagacaattatgttcctgaggtctcagccttggatcaggagattattgaagtagatcctgacactaaggaaatgctgaagcttttggacttcggcagtctgtccaaccttcaggtcactcagcctacagttgggatgaatttcaaaacgcctcggggacctgtttgaattttttctgtagtgctgtattattttcaataaatctgggacaacaaaaaaaaaaaaaaaaaaaaaaaaaaaaaaaaaaaaaaaaaaagaaaaaaaaaaaaaaaaaaaaaaaaaaaaaaaaaaaaaaaaaaaaaaacaaacaaaaaaaggggggggggggcagtcataataaaacgccgcaccgcaggcggcagccaaagacgacgacccccaaacgaacgatttaataacgcagagacgagcggcaccagcaggagggaggacagacaaaataacaaccgggcgcgcccgcgagaaaaagtagcaggaggaaaagaaagcacagcgtaggtaggcagaggcaaccacaccatcggggggggcgcaccaagaagcgacgccacccgcaagaggaaccggcgacagaggataaaccaacaacggagcgaaggtgcaaacaccgcaggatctgagcggagaagacgcgacggagtaaaagan

SEQ ID NO: 448854 - DNA, 883 bp, Homo sapiens
gggggagagagagagagagagagagagagagagagagagagagagagagagagagcaaggacccgccaacatgggccgcgttcgcaccaaaaccgtgaagaaggcggcccgggtcatcatagaaaagtactacacgcgcctgggcaacgacttccacacgaacaagcgcgtgtgcgaggagatcgccattatccccagcaaaaagctccgcaacaagatagcaggttatgtcacgcatctgatgaagcgaattcagagaggcccagtaagaggtatctccatcaagctgcaggaggaggagagagaaaggagagacaattatgttcctgaggtctcagccttggatcaggagattattgaagtagatcctgacactaaggaaatgctgaagcttttggacttcggcagtctgtccaaccttcaggtcactcagcctacagttgggatgaatttcaaaacgcctcggggacctgtttgaattttttctgtagtgctgtattattttcaataaatctgggacaacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggggcagataatatacaacgggggggggcacaatttattagcgaacacatagttgtttgataggaggagacagcaagaggggggaatttataaagagaaggcggggcggataaaaaacaggtaggtagagaaaacagagtgtggtagtttgcgaagagccccttgtggtggggaatatgggggacccaacgagtagtatagcgcaggaataatatggggtgttgtggccgctgttggtggagagtgcttttttaaatcggcaag

SEQ ID NO: 448855 - DNA, 844 bp, Homo sapiens
  misc_feature (3)..(3): n is a, c, g, or t
  misc_feature (603)..(603): n is a, c, g, or t
  misc_feature (608)..(608): n is a, c, g, or t
  misc_feature (621)..(621): n is a, c, g, or t
  misc_feature (626)..(626): n is a, c, g, or t
  misc_feature (628)..(628): n is a, c, g, or t
aanaaaaaaccttccttgcgaattcggcacgagccaacatgggccgcgttcgcaccaaaaccgtgaagaaggcggcccgggtcatcatagaaaagtactacacgcgcctgggcaacgacttccacacgaacaagcgcgtgtgcgaggagatcgccattatccccagcaaaaagctccgcaacaagatagcaggttatgtcacgcatctgatgaagcgaattcagagaggcccagtaagaggtatctccatcaagctgcaggaggaggagagagaaaggagagacaattatgttcctgaggtctcagccttggatcaggagattattgaagtagatcctgacactaaggaaatgctgaagcttttggacttcggcagtctgtccaaccttcaggtcactcagcctacagttgggatgaatttcaaaacgcctcggggacctgtttgaattttttctgtagtgctgtattattttcaataaatctgggacaacaaaaaaaaaaaaaaaaaaaaaaaaaaaaaaaaaaaaaaaaaaaaaaagggggggggggaaaaagagattccccgggggggccaaagttaaggggaaccacaggtttttgtgnacaangggggcccataanggacncncgataaaagccaagcgcgaggccggacgtacaacaagcgtggacagggaacacaggccagcggggaaccagggggagagaacccaaatccggggggtgggacaaatgggacaaatacctacgaaattaaaaggctaaggaactttaacttaaggggcaaagggttaacaacgcaattgctggtttgaaaaattggaaggactagattgaaattacg

SEQ ID NO: 448856 - DNA, 818 bp, Homo sapiens
  misc_feature (3)..(3): n is a, c, g, or t
aanaaaaaaccttccttgcgaattcggcacgagccaacatgggccgcgttcgcaccaaaaccgtgaagaaggcggcccgggtcatcatagaaaagtactacacgcgcctgggcaacgacttccacacgaacaagcgcgtgtgcgaggagatcgccattatccccagcaaaaagctccgcaacaagatagcaggttatgtcacgcatctgatgaagcgaattcagagaggcccagtaagaggtatctccatcaagctgcaggaggaggagagagaaaggagagacaattatgttcctgaggtctcagccttggatcaggagattattgaagtagatcctgacactaaggaaatgctgaagcttttggacttcggcagtctgtccaaccttcaggtcactcagcctacagttgggatgaatttcaaaacgcctcggggacctgtttgaattttttctgtagtgctgtattattttcaataaatctgggacaacaaaaaaaaaaaaaaaaaaaaaaaaaaaaaaaaaaaaaaaaaaaaaaaaaaaaaaaaaaaaaaaaaaaaaaaaaagaaggggcgggcgccgacgtaaaaaaatgaactccgccggaggagcacccccacaaactgccctgcccgccacatttttttatgagaagaggcggccctaccactttatggggacttttatataaaagcacagcgccgcgcgctgcgttaaaaccaccgagcgtggggcaaaaaaaacctgcggccagcgagctcgttttaggaggaccgcccccctcgggggggggggacaaacacgtggcgaaccccccag

SEQ ID NO: 448857 - DNA, 699 bp, Homo sapiens
  misc_feature (3)..(3): n is a, c, g, or t
aanaaaaaaccttccttgcgaattcggcacgagccaacatgggccgcgttcgcaccaaaaccgtgaagaaggcggcccgggtcatcatagaaaagtactacacgcgcctgggcaacgacttccacacgaacaagcgcgtgtgcgaggagatcgccattatccccagcaaaaagctccgcaacaagatagcaggttatgtcacgcatctgatgaagcgaattcagagaggcccagtaagaggtatctccatcaagctgcaggaggaggagagagaaaggagagacaattatgttcctgaggtctcagccttggatcaggagattattgaagtagatcctgacactaaggaaatgctgaagcttttggacttcggcagtctgtccaaccttcaggtcactcagcctacagttgggatgaatttcaaaacgcctcggggacctgtttgaattttttctgtagtgctgtattattttcaataaatctgggacaacaaaaaaaaaaaaaaaaaaaaaaaaaaacttcggggggatttaatgggggggggggaaaaaaggggtaatggaaaggggccatgggccatagcggtgtttccgggacccaggttttttggtccaagggggaaaatctggggggtccccctaatggggagtcgtataaatcggaaaagccgggtaaccggattaggccggggggaaaagc

SEQ ID NO: 448858 - DNA, 819 bp, Homo sapiens
  misc_feature (3)..(3): n is a, c, g, or t
  misc_feature (537)..(537): n is a, c, g, or t
  misc_feature (550)..(550): n is a, c, g, or t
  misc_feature (612)..(612): n is a, c, g, or t
  misc_feature (618)..(618): n is a, c, g, or t
  misc_feature (672)..(672): n is a, c, g, or t
  misc_feature (716)..(717): n is a, c, g, or t
  misc_feature (719)..(719): n is a, c, g, or t
  misc_feature (722)..(722): n is a, c, g, or t
  misc_feature (728)..(728): n is a, c, g, or t
aanaaaaaaccttccttgcgaattcggcacgagccaacatgggccgcgttcgcaccaaaaccgtgaagaaggcggcccgggtcatcatagaaaagtactacacgcgcctgggcaacgacttccacacgaacaagcgcgtgtgcgaggagatcgccattatccccagcaaaaagctccgcaacaagatagcaggttatgtcacgcatctgatgaagcgaattcagagaggcccagtaagaggtatctccatcaagctgcaggaggaggagagagaaaggagagacaattatgttcctgaggtctcagccttggatcaggagattattgaagtagatcctgacactaaggaaatgctgaagcttttggacttcggcagtctgtccaaccttcaggtcactcagcctacagttgggatgaatttcaaaacgcctcggggacctgtttgaattttttctgtagtgctgtattattttcaataaatctgggacaacaaaaaaaaaaaaaaaaaaaaaaaaaaaaaaaaaaaaaaaaaaagancggggggcatctnaatagtgggggggggggaaaaagagagaggaaagagaaaggggcacaagtgggccaaaaggnggtccngggacccagttttcttggcacaagggggcaaaaccggcgcggggcccccaaaanggggagcgcggaataaattcgaaaaccccgggtacccggttagnncncgnaaaagncacgtcacatatgcacctacacagacacatgaagcaggtccacatatactcaaacacgccaataccatcagcgtaataaacatctcacaca

SEQ ID NO: 448859 - DNA, 491 bp, Homo sapiens; identical to SEQ ID NO: 448839
  misc_feature (3)..(3): n is a, c, g, or t

SEQ ID NO: 448860 - DNA, 1204 bp, Homo sapiens
  misc_feature (3)..(3): n is a, c, g, or t
aanaaaaaaccttccttgcgaattcggcacgagccaacatgggccgcgttcgcaccaaaaccgtgaagaaggcggcccgggtcatcatagaaaagtactacacgcgcctgggcaacgacttccacacgaacaagcgcgtgtgcgaggagatcgccattatccccagcaaaaagctccgcaacaagatagcaggttatgtcacgcatctgatgaagcgaattcagagaggcccagtaagaggtatctccatcaagctgcaggaggaggagagagaaaggagagacaattatgttcctgaggtctcagccttggatcaggagattattgaagtagatcctgacactaaggaaatgctgaagcttttggacttcggcagtctgtccaaccttcaggtcactcagcctacagttgggatgaatttcaaaacgcctcggggacctgtttgaattttttctgtagtgctgtattattttcaataaatctgggacaacaaaaaaaaaaaacaaaaaaaaaaaaagaaaaaaaaacaaaacaaaaacaaggaggggcggcgcgcgcgcctccagagagatatctctccccgcgcggagggcgcccaccgagttcagccgctcttccccccggtctttttgtggtgtgcacagagaggggcgcccccctctaagggagggagagctgctctatatatatatacacgcctctaggagcacgcgggcgccgcgcgcgctgttttcacacacagcgtgcgcggcgcgctggggggcgaacaaatcgcggggtcacccgggcggggaactatctctggtgcgagagaggaggacacccccttttaaatctgtgcgggggggggggggcgagaacccacatgagggtgggggcaacacacacatatctccccaatacgcgagagagatatatataagacgagccctcctcaagagggggtgacacatatatgttaatacacaccgtctttcaaaggcgcggtgtcatatatcacggtgggtcgtgttctacacacacccctgcgccgcgctgcaccatatagttgtgcccctgcgccggtcgctgcctgatgaaaacacgaatgttttgttgtcgcgcctccaaatcccgagaggacatattatattaagatctctcctggatcagggacaaaatcaatcttctctttctttgtctcccccccacggcgggaggggcc

SEQ ID NO: 448861 - DNA, 1265 bp, Homo sapiens
  misc_feature (3)..(3): n is a, c, g, or t
aanaaaaaaccttccttgcgaattcggcacgagccaacatgggccgcgttcgcaccaaaaccgtgaagaaggcggcccgggtcatcatagaaaagtactacacgcgcctgggcaacgacttccacacgaacaagcgcgtgtgcgaggagatcgccattatccccagcaaaaagctccgcaacaagatagcaggttatgtcacgcatctgatgaagcgaattcagagaggcccagtaagaggtatctccatcaagctgcaggaggaggagagagaaaggagagacaattatgttcctgaggtctcagccttggatcaggagattattgaagtagatcctgacactaaggaaatgctgaagcttttggacttcggcagtctgtccaaccttcaggtcactcagcctacagttgggatgaatttcaaaacgcctcggggacctgtttgaattttttctgtagtgctgtattattttcaataaatctgggacaacaaaaaaaaaaacaaaaaaaaaaaaaaaaaaaaaaaaaaaaaaaaaaaaaaaagaaaaaaaaaaaaaaaaaaaaaaaaaaaaaaaaacgggggaaaaaattctccccgcgggaaaaccctctgcgggaagagagaaaccccgaaagggtggcgcgggggaaaccccggggccccgtcaaaatgtgtattggggggggaaaggggggtctggggaaaaaagaacttggggaaaaggtattgggagggggaaaatggaaaaaacgttttttacccctggggtggtgcgggttaatcctatggtgttccccaacccaaaaggggaactataaaggtccagtcgttgggggaacagcgcggccgggaaacatcgggggggccggaacaagcgcatattattcaaaccatggtgtgcccacaaaggtggggacgaacccaaacgtcactacaaagagtgtggcgacgcgggctagaaaactgggtccgctgttgggtgcagaacatccccctgggttctgtgctgccacccggcgcggcacatgaggcagcgaaacggcgagggggaacacaaggtgttcaccgcagaaaacacttgggcaccaaatgcggccaacgaaacaccgtggaaaacccaccggcgtgtgtgcaaccacgggggcacccatgatgatatgagggacgctcccccacaaaagatgtgacccgcgagcaatacaaccacagagacgaacccccgagcacacgaagtacacgcacagtttgaggcgtccggaaacga

SEQ ID NO: 448862 - DNA, 1270 bp, Homo sapiens
  misc_feature (3)..(3): n is a, c, g, or t
aanaaaaaaccttccttgcgaattcggcacgagccaacatgggccgcgttcgcaccaaaaccgtgaagaaggcggcccgggtcatcatagaaaagtactacacgcgcctgggcaacgacttccacacgaacaagcgcgtgtgcgaggagatcgccattatccccagcaaaaagctccgcaacaagatagcaggttatgtcacgcatctgatgaagcgaattcagagaggcccagtaagaggtatctccatcaagctgcaggaggaggagagagaaaggagagacaattatgttcctgaggtctcagccttggatcaggagattattgaagtagatcctgacactaaggaaatgctgaagcttttggacttcggcagtctgtccaaccttcaggtcactcagcctacagttgggatgaatttcaaaacgcctcggggacctgtttgaattttttctgtagtgctgtattattttcaataaatctgggacaacaaaaaaaaaaaaaaaaaaaaaaaaaaaaaaaaaaaaaaaaaaagaaaaaaaaaaaaaaaaaaaaaaaaaaaaaaaaaaaaaaaaaaaaaaacgggggaaaaaattctccccgcgggaaaaccctctgcgggaagagagaaaccccgaaagggtggcgcgggggaaaccccggggccccgtcaaaatgtgtattggggggggaaaggggggtctggggaaaaaagaacttggggaaaaggtattgggagggggaaaatggaaaaaacgttttttacccctggggtggtgcgggttaatcctatggtgttccccaacccaaaaggggaactataaaggtccagtcgttgggggaacagcgcggccgggaaacatcgggggggccggaacaagcgcatattattcaaaccatggtgtgcccacaaaggtggggacgaacccaaacgtcactacaaagagtgtggcgacgcgggctagaaaactgggtccgctgttgggtgcagaacatccccctgggttctgtgctgccacccggcgcggcacatgaggcagcgaaacggcgagggggaacacaaggtgttcaccgcagaaaacacttgggcaccaaatgcggccaacgaaacaccgtggaaaacccaccggcgtgtgtgcaaccacgggggcacccatgatgatatgagggacgctcccccacaaaagatgtgacccgcgagcaatacaaccacagagacgaacccccgagcacacgaagtacacgcacagtttgaggcgtccggaaacga

SEQ ID NO: 448863 - DNA, 1250 bp, Homo sapiens
  misc_feature (3)..(3): n is a, c, g, or t
aanaaaaaaccttccttgcgaattcggcacgagccaacatgggccgcgttcgcaccaaaaccgtgaagaaggcggcccgggtcatcatagaaaagtactacacgcgcctgggcaacgacttccacacgaacaagcgcgtgtgcgaggagatcgccattatccccagcaaaaagctccgcaacaagatagcaggttatgtcacgcatctgatgaagcgaattcagagaggcccagtaagaggtatctccatcaagctgcaggaggaggagagagaaaggagagacaattatgttcctgaggtctcagccttggatcaggagattattgaagtagatcctgacactaaggaaatgctgaagcttttggacttcggcagtctgtccaaccttcaggtcactcagcctacagttgggatgaatttcaaaacgcctcggggacctgtttgaattttttctgtagtgctgtattattttcaataaatctgggacaacaaaaaaaaaaaaaaaaaaaaaaaaaaaaaaaaaaaaaaaaaaagaaaaaaaaaaaaaaaaaaaaaaaaaaacgggggaaaaaattctccccgcgggaaaaccctctgcgggaagagagaaaccccgaaagggtggcgcgggggaaaccccggggccccgtcaaaatgtgtattggggggggaaaggggggtctggggaaaaaagaacttggggaaaaggtattgggagggggaaaatggaaaaaacgttttttacccctggggtggtgcgggttaatcctatggtgttccccaacccaaaaggggaactataaaggtccagtcgttgggggaacagcgcggccgggaaacatcgggggggccggaacaagcgcatattattcaaaccatggtgtgcccacaaaggtggggacgaacccaaacgtcactacaaagagtgtggcgacgcgggctagaaaactgggtccgctgttgggtgcagaacatccccctgggttctgtgctgccacccggcgcggcacatgaggcagcgaaacggcgagggggaacacaaggtgttcaccgcagaaaacacttgggcaccaaatgcggccaacgaaacaccgtggaaaacccaccggcgtgtgtgcaaccacgggggcacccatgatgatatgagggacgctcccccacaaaagatgtgacccgcgagcaatacaaccacagagacgaacccccgagcacacgaagtacacgcacagtttgaggcgtccggaaacga

SEQ ID NO: 448864 - DNA, 811 bp, Homo sapiens
  misc_feature (3)..(3): n is a, c, g, or t
aanaaaaaaccttccttgcgaattcggcacgagccaacatgggccgcgttcgcaccaaaaccgtgaagaaggcggcccgggtcatcatagaaaagtactacacgcgcctgggcaacgacttccacacgaacaagcgcgtgtgcgaggagatcgccattatccccagcaaaaagctccgcaacaagatagcaggttatgtcacgcatctgatgaagcgaattcagagaggcccagtaagaggtatctccatcaagctgcaggaggaggagagagaaaggagagacaattatgttcctgaggtctcagccttggatcaggagattattgaagtagatcctgacactaaggaaatgctgaagcttttggacttcggcagtctgtccaaccttcaggtcactcagcctacagttgggatgaatttcaaaacgcctcggggacctgtttgaattttttctgtagtgctgtattattttcaataaatctgggacaacaaccacaaaacacccaccacatccctgagcgcattccattgcttcgggtctgcacgacaacaagcggcgatcatgtcgcagtgtgccactgtgtgtgtcaatacgcgttgtatcatcctgagacccccagctttatttttgtatcccaaggtgggtaataatcctgcccgggaccacaccccaacatatgcggagcccggttattaaacgttgccgaataacccgagggtcttaccttggcatttacgtaagcctccgtacacagcacgtcataggcgtactgtcagaccactcactacgacacatacagactacagcag

SEQ ID NO: 448865 - DNA, 821 bp, Homo sapiens
  misc_feature (3)..(3): n is a, c, g, or t
aanaaaaaaccttccttgcgaattcggcacgagccaacatgggccgcgttcgcaccaaaaccgtgaagaaggcggcccgggtcatcatagaaaagtactacacgcgcctgggcaacgacttccacacgaacaagcgcgtgtgcgaggagatcgccattatccccagcaaaaagctccgcaacaagatagcaggttatgtcacgcatctgatgaagcgaattcagagaggcccagtaagaggtatctccatcaagctgcaggaggaggagagagaaaggagagacaattatgttcctgaggtctcagccttggatcaggagattattgaagtagatcctgacactaaggaaatgctgaagcttttggacttcggcagtctgtccaaccttcaggtcactcagcctacagttgggatgaatttcaaaacgcctcggggacctgtttgaattttttctgtagtgctgtattattttcaataaatctgggacaacaaaaaaaaaaaaaaaaaaaaaaaaaaaaaaaaaaaaaaaaaaaaaaaaccaaaaaaaaaaaaaaaaaaaaaaaaaaagaaggggcgggcgccgacgtaaaaaaatgaactccgccggaggagcacccccacaaactgccctgcccgccacatttttttatgagaagaggcggccctaccactttatggggacttttatataaaagcacagcgccgcgcgctgcgttaaaaccaccgagcgtggggcaaaaaaaacctgcggccagcgagctcgttttaggaggaccgcccccctcgggggggggggacaaacacgtggcgaaccccccag

SEQ ID NO: 448866 - DNA, 668 bp, Homo sapiens
  misc_feature (3)..(3): n is a, c, g, or t
aanaaaaaaccttccttgcgaattcggcacgagccaacatgggccgcgttcgcaccaaaaccgtgaagaaggcggcccgggtcatcatagaaaagtactacacgcgcctgggcaacgacttccacacgaacaagcgcgtgtgcgaggagatcgccattatccccagcaaaaagctccgcaacaagatagcaggttatgtcacgcatctgatgaagcgaattcagagaggcccagtaagaggtatctccatcaagctgcaggaggaggagagagaaaggagagacaattatgttcctgaggtctcagccttggatcaggagattattgaagtagatcctgacactaaggaaatgctgaagcttttggacttcggcagtctgtccaaccttcaggtcactcagcctacagttgggatgaatttcaaaacgcctcggggacctgtttgaattttttctgtagtgctgtattattttcaataaatctgggacaactaaaatcacctatgagactcagatctccccacggccccaacctgaaagtgtcagctgtatccttcaagagcccaagaggaatctcgccttcttccagctgaggaaggtgtggggccaggtctggcacagcatccagaccctgaaggaagattgcaaccggctgcagcagggacagcg

SEQ ID NO: 448867 - DNA, 491 bp, Homo sapiens; identical to SEQ ID NO: 448839
  misc_feature (3)..(3): n is a, c, g, or t

SEQ ID NO: 448868 - DNA, 1915 bp, Homo sapiens
  misc_feature (3)..(3): n is a, c, g, or t
aanaaaaaaccttccttgcgaattcggcacgagccaacatgggccgcgttcgcaccaaaaccgtgaagaaggcggcccgggtcatcatagaaaagtactacacgcgcctgggcaacgacttccacacgaacaagcgcgtgtgcgaggagatcgccattatccccagcaaaaagctccgcaacaagatagcaggttatgtcacgcatctgatgaagcgaattcagagaggcccagtaagaggtatctccatcaagctgcaggaggaggagagagaaaggagagacaattatgttcctgaggtctcagccttggatcaggagattattgaagtagatcctgacactaaggaaatgctgaagcttttggtaagtgtttgctggattcctaaagtggtattttcctggtcaaaaaccatcagtaggtcttattatccaaggtcacccagctagtaagtggcagagttgggaatcccatctaaacttgtagccactaaactggactgctttcataaggggtgtagcggaagttgtgtgcattgagttagttcgccacaagatcatgattcccaaatctagtggcttccaggacaccttttctctcttggctgcttctgttcttggttttatagctggcttacgttgccccctttgtgtcagccctggctgaatctgcctgcttttcttctgtgaaggcattcctttggtgtctccatgctaaccactcagaaatgagctttggtccatttccaggtacatacaaggcactacttaggtagttcacgagtatcttcattgcactttgatgttttttctatggcttatcttagtccttttgcatacttgggtgaaagcatgggcttcatgggcggttggtgattttgaacaacttcatttttcctatttttatggtcattaaatgtttaagacactcaaaaaggtagtagcaaaatgaactcacatgtactttcccagcttcagaaaaacatcaccagtacagctacagccccgctgtgggtcttttcttcctgaaataaccactgcgctgaatgcagcatttttgttgaaactaaaatgggtttctgaggaccaaataggacatggagttccaggtataagttgggcccttggcttcttgccctgcctaccagcctgaacttgtttgagggcagggtctgctcttgcctccctcccttctgcttgatgccttgtgtacttgggcccttcacaaatgttgattagattagtaatagctcttacccagggctggtcctggaaagcaagtggcactgtgtattctcaaagggacagagttttgctttagaggacatttggcaatgtccagacacatttttcgttctcatagccaggggatacctgctaacttctaaggggtagaggccaaggatgttgctaaactttctgcaatacacagtacagctgcctataacaaagaatgtccagcccaggatgtctacgttgccaagattgagaaacggtgttttagagtgattgataggaaggggttgtgaaaacagatacaaatggcatggtacattgggtaaaagtcatagagttgtaaatggggataccacatggtcaggtgtgtgttgaaggaagatcactctggaaaagtgggaggcattgagaaccctgttggctcttaaagggtccttcaggtcgcctctggacccccttgagagtgctgtggctctaggggcctgtgttttcttctggggtccactcacagatctcaccagtaactgctcactgaatccattttctcgttccaggacttcggcagtctgtccaaccttcaggtcactcagcctacagttgggatgaatttcaaaacgcctcggggacctgtttgaattttttctgtagtgctgtattattttcaataaatctgggacaac

SEQ ID NO: 448869 - DNA, 445 bp, Homo sapiens
  misc_feature (3)..(3): n is a, c, g, or t
aanaaaaaaccttccttgcgaattcggcacgagccaacatgggccgcgttcgcaccaaaaccgtgaagaaggcggcccgggtcatcatagaaaagtactacacgcgcctgggcaacgacttccacacgaacaagcgcgtgtgcgaggagatcgccattatccccagcaaaaagctccgcaacaagatagcaggttatgtcacgcatctgatgaagcgaattcagagaggcccagtaagaggtatctccatcaagctgcaggaggaggagagagaaaggagagacaattatgttcctgaggtctcagccttggatcaggagattattgaagtagatcctgacactaaggaaatgctgaagcttttggacttcggcagtctgtccaaccttcaggtccccgaggcgttttgaaaatcatcccaactgtaggctgagtgaccgtcgac

SEQ ID NO: 448870 - DNA, 1000 bp, Homo sapiens
  misc_feature (3)..(3): n is a, c, g, or t
aanaaaaaaccttccttgcgaattcggcacgagccaacatgggccgcgttcgcaccaaaaccgtgaagaaggcggcccgggtcatcatagaaaagtactacacgcgcctgggcaacgacttccacacgaacaagcgcgtgtgcgaggagatcgccattatccccagcaaaaagctccgcaacaagatagcaggttatgtcacgcatctgatgaagcgaattcagagaggcccagtaagaggtatctccatcaagctgcaggaggaggagagagaaaggagagacaattatgttcctgagggtaaactttctggatatttgggcttctggctaatcctcaaatgataaagctatgggttcttggcttccaaagggacctcagctgaatctgagacctttaatccatacattccataaccagctgtgggtgcccataggccccctaccagtttcttagcctccattctgctcttctggaaccagttaagtctattccatatttcatgagagcccttaatgttgatttgatgactgctgtcgtggctcgattgtttgcccctaatatagtattctttggtgtaaacacagacttcaagtgttctgaatactgaatgagggcatgggaaggtaaggccagaagaacaggtcatcggggtctgtaatactgtaagagactgctcaccttgtgagaggaatgctatccttgtgcagctcctcttccccatatttaagaacctggggagaggaggaggagaggtgagtgataatctcattgattggtattttgaccctacctcgtttccttgtaggtctcagccttggatcaggagattattgaagtagatcctgacactaaggaaatgctgaagcttttggacttcggcagtctgtccaaccttcaggtcactcagcctacagttgggatgaatttcaaaacgcctcggggacctgtttgaattttttctgtagtgctgtattattttcaataaatctgggacaac

SEQ ID NO: 448871 - DNA, 1252 bp, Homo sapiens
  misc_feature (3)..(3): n is a, c, g, or t
aanaaaaaaccttccttgcgaattcggcacgagccaacatgggccgcgttcgcaccaaaaccgtgaagaaggcggcccgggtcatcatagaaaagtactacacgcgcctgggcaacgacttccacacgaacaagcgcgtgtgcgaggagatcgccattatccccagcaaaaagctccgcaacaagatagcaggttatgtcacgcatctgatgaagcgaattcagagaggcccagtaagaggtatctccatcaaggtctcagccttggatcaggagattattgaagtagatcctgacactaaggaaatgctgaagcttttggacttcggcagtctgtccaaccttcaggtcactcagcctacagttgggatgaatttcaaaacgcctcggggacctgtttgaattttttctgtagtgctgtattattttcaataaatctgggacaacaaaaaaaaaaaaaaaaaaaaaaaaaaaaaaaaaaaaaaaaaaagtttgcgcggcccacgtggcccagagaaaaggtcctccagacacaattggcgttggggcgggcgcggggccaccaccgttgtctgagaacaagagacggcagggagagacacggttgacctcagagaagacaccgcggtcccaggactgcggctcgggtacatccatacaaagaaaaaaatgcccggggcataacgacgacttttgtgcgaaagaaacactgcataatggcggtacttcaggagcccaaggagggaggccttaaaacaacgggtgctgcactacgcagcacgtgagtaagaatatgttgccctgcccgctgcggggtggaaatgagcattgtcatccgaacccttggagccacaggcagctcctcacctggcccgggaattcatgatcaaaagccgccgtaaggaagggcctcagtgaaggatgtgagcatcagcaaattcttcgatgatcctatgttgctggaaacttgccaaacaaggatgtagtgctcaattaccccatgtgagtgcgtggactcctgggagctccatgctcactacagtgggcttgcactcctgtacttgaaggctgagactcatatgacgttggccttcgagtaggcagaagagtgtctggaagctgctgtagcatcttgcaacaacgtcagcgaagctccaaaccagagccccagtgagagaggaccctcggcctcctgcttcttctgtgcctctgccgggctcattccaggaaagacaggagttggggctcccaga

SEQ ID NO: 448872 - DNA, 1505 bp, Homo sapiens
actctagagatccccctgctcccatcaaaataagtaaaagaaatataggaatattccagtcaatctctgaaatgtttatgaaaaacaggttaatatgttgtatttttttccttgtatcaagatgcaaaacataatttgcaaaattttataattgaaataaaacttggtatgctgttttataataaattagcaatatactttaaaaaaaatccagtttctcctataacatgatgtaaattaaatattcaggaatatttcaggtctgaaatctgctgctgaacttgttagacatttttgaaaggaaaattaggttagcgtacaatttatcataaatatatgaggtaaaatttgcaaaactttccacagtactttcttgaattataatactgaatgttttctgttccgatagagaaaagtgaagcaaatatgtgaggaatgaagtgatctagtgcaagttggtaattccagctaatgggagagaatgtaaatgtgcaaaggtacatattaagcttagggatttttgaatttttacgtcagtttatattttaattcttactgtacttggcatgcgcaataaagcagcacatgtaaaaaaaaaatacacagtgcaaggactttattataaaggttggatgtagttttccttagaaatttaggtgagagattttggccttttttattggataaattgggccagaaaggcagggtagatttcgaagcactggttctgttgaagttaagtttattaagcctgggaacattaaaagctaatttataaaagcaatactttttaatatgaaaacttactgcaaagtttgtttatacttttgcctaaaaaggaaattggatgggatactgtggcaaatcataaaaaaccagataattgaactttgaagttatagaaaatcagagaggggtaagtttatagggcattttgttctgatggttcaaccagaggtctgggaaatagcactgttggcccaaacagaacaggcttttagaagataaaagcgacaagaaggaatctggtgaattttagtcatcccagctttttagtcttaaccacagttctcactctcttaaatggtacctcaaaaagctggagcctctctgccatgattatgcttctacaaatttcttttataaagagactcaaagctaatgatagcttaaaagaaaagttaatgccttctcattggaaatgtataatcaaataagtagttaagggcttttggtattaaagatattctgaagctctgaaatgctagaaaaaaatttggaatggagtatatgcctgaaaaggttttggattcagaaagaaaaaggatggttagtttaatcagtgattctttttaaactcttcaaatatcatgaacaagatactaaattgtacctaaggatttgtatttctttacaatttgttctaaatatctgtttaatgactagttgatatttgtgcatgttatttaataaagagttatatttttatagaaaaaaaagtgaaa

SEQ ID NO: 448873 - DNA, 1687 bp, Homo sapiens
gggggcgacgctgtcctgggagcgaggaggctgtggtgagagacggaccgagaccggagatgttttcaagcccggctccggcggctttacaggcggctgcagcggcgacgaagacaacgacagcgacggctacgccgaagcactcgttccgggggtgaagcctcctgcgccggccttgcctcggatccaggatgagaagactgataaaagaagaagctagctgaacagctgtaaaatgcccaaatctgggttcacaaaaccaattcagagtgaaaattctgacagtgacagcaatatggtagagaaaccatatggaagaaagagtaaagacaagattgcatcctacagcaaaactccaaaaattgaacgaagtgatgtgagcaaggagatgaaagagaaatcatccatgaaacgtaaacttccttttactattagcccatcaagaaatgaagaacgagattcagacacagattcagatccaggacatacaagtgaaaattggggggagagacttatatcttcttacaggacatactcagagaaagaaggtccagaaaagaagaagacaaaaaaggaagctggaaataagaaatccacaccagttagcattctttttggttatccactctctgagcgaaaacagatggcacttcttatgcagatgacagcaagagacaacagtccagattccacaccaaatcatccatcacaaacaacgcctgcccaaaagaaaactcccagttcttcatctcgacagaaagataaagttaataaaagaaatgaacgtggtgaaactcctttacacatggctgctattcgaggagatgtgaaacaagttaaagaattaataagtttaggggcaaatgtgaatgtgaaagattttgcaggttggacaccactgcatgaagcttgcaatgttggatattacgatgttgctaagatacttatagcagctggagcagatgttaacacacaaggattagatgatgacactccactccatgattctgctagtagtgggcacagagatatagtaaagctgttacttcgtcacggtggaaatccatttcaagctaataaacatggggagcgtccagtggatgtagcagaaacagaggagttggagttgctactaaaaagagaggtgcctttatctgatgatgatgaaagttacacagattccgaagaggctcaatctgtaaatccttctagtgttgatgaaaatattgactctgaaacagagaaagactctctcatctgtgaaagtaaacagatacttcccagtaaaacacctcttccatctgcccttgatgagtatgagttcaaagatgatgatgatgaagaaattaataagatgattgatgataggcatattcttaggaaagaacaacgaaaagaaaatgaacctgaagcagaaaaaactcatttatttgcaaaacaggagaaagccttctatcctaaatcatttaaaagtaaaaaacaaaagccatctagggtcttatattcaagtactgaaagttctgatgaagaagctcttcagaataaaaagatttctacttcatgttccgtcatccctgaaacatcaaattctgatatgcaaaccaaaaaggaatatgtagtttcaggtgaacacaaacagaaaggcaaagttaaaagaaaattgaaaaatcagaataaaaataaagag

SEQ ID NO: 448874 - DNA, 1116 bp, Homo sapiens
  misc_feature (983)..(983): n is a, c, g, or t
  misc_feature (1006)..(1006): n is a, c, g, or t
  misc_feature (1016)..(1016): n is a, c, g, or t
gggggcgacgctgtcctgggagcgaggaggctgtggtgagagacggaccgagaccggagatgttttcaagcccggctccggcggctttacaggcggctgcagcggcgacgaagacaacgacagcgacggctacgccgaagcactcgttccgggggtgaagcctcctgcgccggccttgcctcggatccaggatgagaagactgataaaagaagaagctagctgaacagctgtaaaatgcccaaatctgggttcacaaaaccaattcagagtgaaaattctgacagtgacagcaatatggtagagaaaccatatggaagaaagagaaagaaggtccagaaaagaagaagacaaaaaaggaagctggaaataagaaatccacaccagttagcattctttttggttatccactctctgagcgaaaacagatggcacttcttatgcagatgacagcaagagacaacagtccagattccacaccaaatcatccatcacaaacaacgcctgcccaaaagaaaactcccagttcttcatctcgacagaaagataaagttaataaaagaaatgaacgtggtgaaactcctttacacatggctgctattcgaggagatgtgaaacaagttaaagaattaataagtttaggggcaaatgtgaatgtgaaagattttgcaggttggacaccactgcatgaagcttgcaatgttggatattacgatgttgctaagatacttatagcagctggagcagatgttaacacacaaggattagatgatgacactccactccatgattctgctagtagtgggcacagagatatagtaaagctgttacttcgtcacggtggaaatccatttcaagctaataaacatggggagcgtccagtggatgtagcagaaacagaggagttggagttgctactaaaaagagaggtgcctttatctgatgatgatgaaagttacacagatccaggatgagaagactgatnaaagaagaagctagctgaacagntgtaaaatgnccaaatctgggttcacaaaacaattcagagtgaaaattctgacagtgacagcatatggtagagaaaccatttggaagaaagagtaagacaagatggatcg

SEQ ID NO: 448875 - DNA, 270 bp, Homo sapiens
caaaagtgcctcttctatatctacacaacacccgacaagctatattcgcatcacacagaaaaatgccataaagaaggtgagaagagcaaaaatactgctgctattaaaaaaactgacgacagagagaaaagtagagaaaagatggataggaaacatgacaaagaaaagcctgaaaaagagaggcatctagcagaaagcaaagaaaagcacttgatggagaaaaaaaataaacaatcagataatagtgaatacagtaaatcagaaaaaggc

SEQ ID NO: 448876 - DNA, 9002 bp, Homo sapiens
gggggcgacgctgtcctgggagcgaggaggctgtggtgagagacggaccgagaccggagatgttttcaagcccggctccggcggctttacaggcggctgcagcggcgacgaagacaacgacagcgacggctacgccgaagcactcgttccgggggtgaagcctcctgcgccggccttgcctcggatccaggatgagaagactgataaaagaagaagctagctgaacagctgtaaaatgcccaaatctgggttcacaaaaccaattcagagtgaaaattctgacagtgacagcaatatggtagagaaaccatatggaagaaagagtaaagacaagattgcatcctacagcaaaactccaaaaattgaacgaagtgatgtgagcaaggagatgaaagagaaatcatccatgaaacgtaaacttccttttactattagcccatcaagaaatgaagaacgagattcagacacagagaaagaaggtccagaaaagaagaagacaaaaaaggaagctggaaataagaaatccacaccagttagcattctttttggttatccactctctgagcgaaaacagatggcacttcttatgcagatgacagcaagagacaacagtccagattccacaccaaatcatccatcacaaacaacgcctgcccaaaagaaaactcccagttcttcatctcgacagaaagataaagttaataaaagaaatgaacgtggtgaaactcctttacacatggctgctattcgaggagatgtgaaacaagttaaagaattaataagtttaggggcaaatgtgaatgtgaaagattttgcaggttggacaccactgcatgaagcttgcaatgttggatattacgatgttgctaagatacttatagcagctggagcagatgttaacacacaaggattagatgatgacactccactccatgattctgctagtagtgggcacagagatatagtaaagctgttacttcgtcacggtggaaatccatttcaagctaataaacatggggagcgtccagtggatgtagcagaaacagaggagttggagttgctactaaaaagagaggtgcctttatctgatgatgatgaaagttacacagattccgaagaggctcaatctgtaaatccttctagtgttgatgaaaatattgactctgaaacagagaaagactctctcatctgtgaaagtaaacagatacttcccagtaaaacacctcttccatctgcccttgatgagtatgagttcaaagatgatgatgatgaagaaattaataagatgattgatgataggcatattcttaggaaagaacaacgaaaagaaaatgaacctgaagcagaaaaaactcatttatttgcaaaacaggagaaagccttctatcctaaatcatttaaaagtaaaaaacaaaagccatctagggtcttatattcaagtactgaaagttctgatgaagaagctcttcagaataaaaagatttctacttcatgttccgtcatccctgaaacatcaaattctgatatgcaaaccaaaaaggaatatgtagtttcaggtgaacacaaacagaaaggcaaagttaaaagaaaattgaaaaatcagaataaaaataaagagaaccaagagctaaagcaagaaaaggaaggaaaagaaaatacaagaataacaaacttgacagtaaatactggactagattgttcagaaaagaccagagaggaggggaactttaggaaatcttttagcccaaaagatgatacttcattacatttatttcatatttccactggtaaatctcccaaacattcttgtggattaagtgaaaaacagtcaacaccactaaaacaagaacatactaaaacatgtttatcaccaggaagttctgaaatgtcattacagcctgatcttgttcggtatgataatacagaatctgaattcttgccagaaagttcaagtgtaaaatcttgtaagcataaggaaaaaagcaaacatcagaaagatttccacttagaatttggtgaaaaatcaaatgccaaaataaaggatgaagatcatagtccaacatttgaaaattcagattgcacactgaaaaaaatggataaagaaggtaaaacattaaaaaaacataaattgaagcataaagagagggaaaaagaaaagcataaaaaagaaattgaaggtgaaaaggaaaaatacaaaactaaggatagtgccaaagaactgcagaggagtgtggaatttgatagagaattttggaaagagaatttttttaaaagtgatgaaactgaagatctctttttaaatatggaacatgaatccttaacattagaaaaaaaatcaaaattggaaaaaaacatcaaagatgataaatcaaccaaggaaaagcatgtgtcaaaagagaggaactttaaagaggaacgagacaagattaaaaaggaaagcgagaaatcttttagggaggaaaaaataaaagatctaaaagaagagagagaaaacatacccacagataaagactcagaatttacttctttgggtatgagtgccattgaggaatctatagggcttcatttagtggaaaaggaaatagacattgaaaaacaagaaaagcatataaaggaaagtaaagaaaaacctgagaagcgatctcaaattaaagaaaaggacattgagaagatggaaagaaaaacctttgaaaaagaaaagaagataaaacatgagcataagtcagaaaaagacaaattagatcttagtgaatgtgttgataaaataaaagaaaaggacaagctatattcgcatcacacagaaaaatgccataaagaaggtgagaagagcaaaaatactgctgctattaaaaaaactgacgacagagagaaaagtagagaaaagatggataggaaacatgacaaagaaaagcctgaaaaagagaggcatctagcagaaagcaaagaaaagcacttgatggagaaaaaaaataaacaatcagataatagtgaatacagtaaatcagaaaaaggcaaaaataaagaaaaagacagggagctagataaaaaggaaaaatctagagataaagaaagtataaatataactaactccaaacacatacaggaagaaaaaaaatcaagtatagtagacggtaataaagcacaacatgaaaaacccttatcccttaaagaaaaaacaaaagatgaacctttgaaaactccagatggaaaagaaaaagataaaaaagataaagatatagatagatacaaagaacgagacaaacataaagataaaattcaaataaatagcttactcaaactaaaatctgaagcagataagcctaaacctaagtcatcaccagcatcaaaagatacccgacctaaagaaaagaggttagtgaatgatgatttaatgcagacaagttttgaacgaatgctaagccttaaagacctagaaatagaacagtggcacaaaaaacataaggaaaaaattaagcaaaaagaaaaggaacggttgagaaaccgaaactgtttagaacttaaaataaaagataaagaaaaaacaaagcatacaccaactgaatccaaaaataaagaacttactaggtcaaagagttcagaagtgactgatgcatataccaaggagaaacaacctaaagatgctgtaagtaacagatcacaatctgttgacaccaaaaatgtaatgactttagggaagtcatcttttgtttcagataatagcttaaacaggtctcctagatcagaaaatgaaaagccgggtctcagctccagatctgtatccatgatttctgttgctagttcagaagattcctgccatactacagtgacaaccccaaggcctccagttgagtatgactctgactttatgttagagagttcagaatcccaaatgtccttttcccagtcaccttttttgtcaattgccaaatctcctgctcttcatgaaagggaattggacagcctggctgacttgccggagcggattaaaccaccatatgcaaacagactttcaacatcccatcttaggtcatcttctgtagaagatgttaaactaattataagcgaggggagacctaccatagaagttcgaagatgtagcatgccttctgtcatttgtgaacataccaaacaattccaaacaatatcagaagagagcaatcaaggtagcttattaactgtgccaggagatactagtccttctcccaaacctgaggtattctcaaatgtgcctgaaagagacctttcaaatgtatctaacatacattccagttttgcaacttctccaactggagcttcaaacagcaagtatgtttcagctgatagaaatctcatcaagaatactgccccagtgaacactgtaatggacagtccagtgcatttagagccatctagtcaggttggtgtgatccagaataaatcatgggagatgcctgttgatagactagagacattaagcaccagagactttatctgcccaaattctaacatacctgatcaagaatcctctcttcagagtttttgtaattctgaaaataaggtattgaaagaaaatgctgattttttatccctgcgccagactgaactgccaggaaactcttgtgctcaggatccggcatcctttatgcctccacagcagccttgctctttccccagccaatcactttcagatgctgaatcgatttctaaacatatgtctttgtcatatgttgctaatcaagagccaggtattttacaacaaaaaaatgcagttcagattattagttctgctttagatactgataatgaatctacaaaagatacagaaaatacttttgtcctaggagatgttcaaaaaacagatgcctttgtcccagtgtactctgacagcactattcaagaagcatcaccaaactttgagaaagcttatactttacctgtgttaccatcagaaaaggactttaatggaagtgatgcctctacccagctaaatacacattatgcatttagcaaactaacttacaagtcttccagtggccatgaagttgagaatagcacaactgatactcaggtcatttcacatgaaaaagaaaacaaactggagagtttggttttaactcatttgagtaggtgtgattctgatttatgtgaaatgaatgcagggatgccaaaaggaaacctaaatgaacaagatccaaaacattgtcctgaaagtgaaaagtgtttgctttccatagaagatgaggaatctcaacaaagcattttatcaagtctggaaaaccattcacagcagtcaactcaaccagaaatgcataaatatggtcagttagttaaagtagaattagaagaaaatgccgaagatgataaaactgaaaaccaaatccctcaaagaatgactagaaacaaagcaaatacaatggcaaatcaaagcaaacagattcttgctagctgtacactattatcagaaaaagacagtgaatcctcatctcctagaggaagaataagattaactgaagatgacgatcctcaaattcaccatccacggaaaaggaaagtgtcacgtgtacctcagcctgtgcaagtgagtccctctttactacaagcaaaagagaaaactcagcaatctctggcagccattgtagattctctaaaactagatgagattcagccatacagttcagagagagcaaatccatattttgaatacttgcacataaggaaaaaaatagaagaaaaacgcaaattactgtgtagtgtgattcctcaagcacctcagtactatgacgaatatgtaacatttaacggatcatatctcctggatggaaaccccttaagcaagatttgtattcccacaattacaccaccaccttcactgtcagatccacttaaagagctttttcgacaacaggaagttgtaaggatgaaactacgtttgcaacacagtattgaaagggaaaaactcattgtatccaacgaacaagaagttttgcgagttcattacagagctgcaagaacattggcaaatcaaacactgccatttagtgcttgtactgttttgctggatgccgaagtatacaatgtaccattggactctcagtctgatgacagtaaaacttctgtgagggatcgctttaatgcaagacaattcatgtcttggttacaagatgtggatgataaatttgacaaattaaagacctgtcttttaatgaggcaacaacatgaagctgcggctttaaatgctgtccagaggttagaatggcagctcaaactccaggaacttgatcctgccacctataaatctatcagcatttacgaaatccaggagttttatgttccccttgttgatgttaacgacgactttgaattgactcctatatagcagtcagtacttcctgatggtattgtcctaaactggtgatgctcaagcattatactgtggaatactgccttttgacaaaaatactcatgcctttacaattgttagtaaagttcgattatagttggttatgtagtaaacactgtcattttataaaaaatgagaattattttggatcttagatccaaacacagtttctaatagaaaactattatttatattgggaaaggtaactattgcattagagcatgttggcagactggtaggtatttaaaaagttgagaatctgctaacagcgctggaagttgttagcgctctaagtaataagataaccactagtattcaaatctctttcaggttttattaaaaaatatatatcaataaactaaaaggttcaattcctaccaaatagtttctaatgtgggagaaaaacttggcacaaaatttcttcagtttattatctgtaaattgtacagttttctttttgaaagttttaatattgtcttcctttttaataacttattttatacatattgtgcagatgtaaatcttgtaattaatggtcaaactgtataaagggattggtagtcaaaacatgtacaaagaaatacctgtaaaactgttttgtctcatgttttattggaccaaagttgtggtttgtatggagtgtagtagtagtgtgtacaggtagaaaacttttaaatacagcatgcaggtgtttcagttagcttgttttcatcaccataactgcaaagatgtggcttagttgtattgcatgcttcctataatttaactctccataattgatgcctgcagtagtgtaaggcatttcatactagtctcctctagtagacctgtgacttactgtgttggacatattatttagacttagtcatacaaagaaacttagctcttttttcatctcacagtaaagcctatttccccaggaaaaaaataaatgcctttgaatgaaaattctgaaattgtaaatgtctattttaatattcacctatgaaagaatctgtgaatatatgtaaatacgtttaataaattttattggtcatgttaaatcattgtaaaacttttttacattgcttaatgttttaagcttaatagcctttgcacttttaaaataaaaaccaagtatgcaaatcaaagatatttggtagtcaaaataagtaaaagaaatataggaatattccagtcaatctctgaaatgtttatgaaaaacaggttaatatgttgtatttttttccttgtatcaagatgcaaaacataatttgcaaaattttataattgaaataaaacttggtatgctgttttataataaattagcaatatactttaaaaaaaatccagtttctcctataacatgatgtaaattaaatattcaggaatatttcaggtctgaaatctgctgctgaacttgttagacatttttgaaaggaaaattaggttagcgtacaatttatcataaatatatgaggtaaaatttgcaaaactttccacagtactttcttgaattataatactgaatgttttctgttccgatagagaaaagtgaagcaaatatgtgaggaatgaagtgatctagtgcaagttggtaattccagctaatgggagagaatgtaaatgtgcaaaggtacatattaagcttagggatttttgaatttttacgtcagtttatattttaattcttactgtacttggcatgcgcaataaagcagcacatgtaaaaaaaaaatacacagtgcaaggactttattataaaggttggatgtagttttccttagaaatttaggtgagagattttggccttttttattggataaattgggccagaaaggcagggtagatttcgaagcactggttctgttgaagttaagtttattaagcctgggaacattaaaagctaatttataaaagcaatactttttaatatgaaaacttactgcaaagtttgtttatacttttgcctaaaaaggaaattggatgggatactgtggcaaatcataaaaaaccagataattgaactttgaagttatagaaaatcagagaggggtaagtttatagggcattttgttctgatggttcaaccagaggtctgggaaatagcactgttggcccaaacagaacaggcttttagaagataaaagcgacaagaaggaatctggtgaattttagtcatcccagctttttagtcttaaccacagttctcactctcttaaatggtacctcaaaaagctggagcctctctgccatgattatgcttctacaaatttcttttataaagagactcaaagctaatgatagcttaaaagaaaagttaatgccttctcattggaaatgtataatcaaataagtagttaagggcttttggtattaaagatattctgaagctctgaaatgctagaaaaaaatttggaatggagtatatgcctgaaaaggttttggattcagaaagaaaaaggatggttagtttaatcagtgattctttttaaactcttcaaatatcatgaacaagatactaaattgtacctaaggatttgtatttctttacaatttgttctaaatatctgtttaatgactagttgatatttgtgcatgttatttaataaagagttatatttttatagaaaaaaaagtgaaa

SEQ ID NO: 448877 - DNA, 8854 bp, Homo sapiens
gggggcgacgctgtcctgggagcgaggaggctgtggtgagagacggaccgagaccggagatgttttcaagcccggctccggcggctttacaggcggctgcagcggcgacgaagacaacgacagcgacggctacgccgaagcactcgttccgggggtgaagcctcctgcgccggccttgcctcggatccaggatgagaagactgataaaagaagaagctagctgaacagctgtaaaatgcccaaatctgggttcacaaaaccaattcagagtgaaaattctgacagtgacagcaatatggtagagaaaccatatggaagaaagagaaagaaggtccagaaaagaagaagacaaaaaaggaagctggaaataagaaatccacaccagttagcattctttttggttatccactctctgagcgaaaacagatggcacttcttatgcagatgacagcaagagacaacagtccagattccacaccaaatcatccatcacaaacaacgcctgcccaaaagaaaactcccagttcttcatctcgacagaaagataaagttaataaaagaaatgaacgtggtgaaactcctttacacatggctgctattcgaggagatgtgaaacaagttaaagaattaataagtttaggggcaaatgtgaatgtgaaagattttgcaggttggacaccactgcatgaagcttgcaatgttggatattacgatgttgctaagatacttatagcagctggagcagatgttaacacacaaggattagatgatgacactccactccatgattctgctagtagtgggcacagagatatagtaaagctgttacttcgtcacggtggaaatccatttcaagctaataaacatggggagcgtccagtggatgtagcagaaacagaggagttggagttgctactaaaaagagaggtgcctttatctgatgatgatgaaagttacacagattccgaagaggctcaatctgtaaatccttctagtgttgatgaaaatattgactctgaaacagagaaagactctctcatctgtgaaagtaaacagatacttcccagtaaaacacctcttccatctgcccttgatgagtatgagttcaaagatgatgatgatgaagaaattaataagatgattgatgataggcatattcttaggaaagaacaacgaaaagaaaatgaacctgaagcagaaaaaactcatttatttgcaaaacaggagaaagccttctatcctaaatcatttaaaagtaaaaaacaaaagccatctagggtcttatattcaagtactgaaagttctgatgaagaagctcttcagaataaaaagatttctacttcatgttccgtcatccctgaaacatcaaattctgatatgcaaaccaaaaaggaatatgtagtttcaggtgaacacaaacagaaaggcaaagttaaaagaaaattgaaaaatcagaataaaaataaagagaaccaagagctaaagcaagaaaaggaaggaaaagaaaatacaagaataacaaacttgacagtaaatactggactagattgttcagaaaagaccagagaggaggggaactttaggaaatcttttagcccaaaagatgatacttcattacatttatttcatatttccactggtaaatctcccaaacattcttgtggattaagtgaaaaacagtcaacaccactaaaacaagaacatactaaaacatgtttatcaccaggaagttctgaaatgtcattacagcctgatcttgttcggtatgataatacagaatctgaattcttgccagaaagttcaagtgtaaaatcttgtaagcataaggaaaaaagcaaacatcagaaagatttccacttagaatttggtgaaaaatcaaatgccaaaataaaggatgaagatcatagtccaacatttgaaaattcagattgcacactgaaaaaaatggataaagaaggtaaaacattaaaaaaacataaattgaagcataaagagagggaaaaagaaaagcataaaaaagaaattgaaggtgaaaaggaaaaatacaaaactaaggatagtgccaaagaactgcagaggagtgtggaatttgatagagaattttggaaagagaatttttttaaaagtgatgaaactgaagatctctttttaaatatggaacatgaatccttaacattagaaaaaaaatcaaaattggaaaaaaacatcaaagatgataaatcaaccaaggaaaagcatgtgtcaaaagagaggaactttaaagaggaacgagacaagattaaaaaggaaagcgagaaatcttttagggaggaaaaaataaaagatctaaaagaagagagagaaaacatacccacagataaagactcagaatttacttctttgggtatgagtgccattgaggaatctatagggcttcatttagtggaaaaggaaatagacattgaaaaacaagaaaagcatataaaggaaagtaaagaaaaacctgagaagcgatctcaaattaaagaaaaggacattgagaagatggaaagaaaaacctttgaaaaagaaaagaagataaaacatgagcataagtcagaaaaagacaaattagatcttagtgaatgtgttgataaaataaaagaaaaggacaagctatattcgcatcacacagaaaaatgccataaagaaggtgagaagagcaaaaatactgctgctattaaaaaaactgacgacagagagaaaagtagagaaaagatggataggaaacatgacaaagaaaagcctgaaaaagagaggcatctagcagaaagcaaagaaaagcacttgatggagaaaaaaaataaacaatcagataatagtgaatacagtaaatcagaaaaaggcaaaaataaagaaaaagacagggagctagataaaaaggaaaaatctagagataaagaaagtataaatataactaactccaaacacatacaggaagaaaaaaaatcaagtatagtagacggtaataaagcacaacatgaaaaacccttatcccttaaagaaaaaacaaaagatgaacctttgaaaactccagatggaaaagaaaaagataaaaaagataaagatatagatagatacaaagaacgagacaaacataaagataaaattcaaataaatagcttactcaaactaaaatctgaagcagataagcctaaacctaagtcatcaccagcatcaaaagatacccgacctaaagaaaagaggttagtgaatgatgatttaatgcagacaagttttgaacgaatgctaagccttaaagacctagaaatagaacagtggcacaaaaaacataaggaaaaaattaagcaaaaagaaaaggaacggttgagaaaccgaaactgtttagaacttaaaataaaagataaagaaaaaacaaagcatacaccaactgaatccaaaaataaagaacttactaggtcaaagagttcagaagtgactgatgcatataccaaggagaaacaacctaaagatgctgtaagtaacagatcacaatctgttgacaccaaaaatgtaatgactttagggaagtcatcttttgtttcagataatagcttaaacaggtctcctagatcagaaaatgaaaagccgggtctcagctccagatctgtatccatgatttctgttgctagttcagaagattcctgccatactacagtgacaaccccaaggcctccagttgagtatgactctgactttatgttagagagttcagaatcccaaatgtccttttcccagtcaccttttttgtcaattgccaaatctcctgctcttcatgaaagggaattggacagcctggctgacttgccggagcggattaaaccaccatatgcaaacagactttcaacatcccatcttaggtcatcttctgtagaagatgttaaactaattataagcgaggggagacctaccatagaagttcgaagatgtagcatgccttctgtcatttgtgaacataccaaacaattccaaacaatatcagaagagagcaatcaaggtagcttattaactgtgccaggagatactagtccttctcccaaacctgaggtattctcaaatgtgcctgaaagagacctttcaaatgtatctaacatacattccagttttgcaacttctccaactggagcttcaaacagcaagtatgtttcagctgatagaaatctcatcaagaatactgccccagtgaacactgtaatggacagtccagtgcatttagagccatctagtcaggttggtgtgatccagaataaatcatgggagatgcctgttgatagactagagacattaagcaccagagactttatctgcccaaattctaacatacctgatcaagaatcctctcttcagagtttttgtaattctgaaaataaggtattgaaagaaaatgctgattttttatccctgcgccagactgaactgccaggaaactcttgtgctcaggatccggcatcctttatgcctccacagcagccttgctctttccccagccaatcactttcagatgctgaatcgatttctaaacatatgtctttgtcatatgttgctaatcaagagccaggtattttacaacaaaaaaatgcagttcagattattagttctgctttagatactgataatgaatctacaaaagatacagaaaatacttttgtcctaggagatgttcaaaaaacagatgcctttgtcccagtgtactctgacagcactattcaagaagcatcaccaaactttgagaaagcttatactttacctgtgttaccatcagaaaaggactttaatggaagtgatgcctctacccagctaaatacacattatgcatttagcaaactaacttacaagtcttccagtggccatgaagttgagaatagcacaactgatactcaggtcatttcacatgaaaaagaaaacaaactggagagtttggttttaactcatttgagtaggtgtgattctgatttatgtgaaatgaatgcagggatgccaaaaggaaacctaaatgaacaagatccaaaacattgtcctgaaagtgaaaagtgtttgctttccatagaagatgaggaatctcaacaaagcattttatcaagtctggaaaaccattcacagcagtcaactcaaccagaaatgcataaatatggtcagttagttaaagtagaattagaagaaaatgccgaagatgataaaactgaaaaccaaatccctcaaagaatgactagaaacaaagcaaatacaatggcaaatcaaagcaaacagattcttgctagctgtacactattatcagaaaaagacagtgaatcctcatctcctagaggaagaataagattaactgaagatgacgatcctcaaattcaccatccacggaaaaggaaagtgtcacgtgtacctcagcctgtgcaagtgagtccctctttactacaagcaaaagagaaaactcagcaatctctggcagccattgtagattctctaaaactagatgagattcagccatacagttcagagagagcaaatccatattttgaatacttgcacataaggaaaaaaatagaagaaaaacgcaaattactgtgtagtgtgattcctcaagcacctcagtactatgacgaatatgtaacatttaacggatcatatctcctggatggaaaccccttaagcaagatttgtattcccacaattacaccaccaccttcactgtcagatccacttaaagagctttttcgacaacaggaagttgtaaggatgaaactacgtttgcaacacagtattgaaagggaaaaactcattgtatccaacgaacaagaagttttgcgagttcattacagagctgcaagaacattggcaaatcaaacactgccatttagtgcttgtactgttttgctggatgccgaagtatacaatgtaccattggactctcagtctgatgacagtaaaacttctgtgagggatcgctttaatgcaagacaattcatgtcttggttacaagatgtggatgataaatttgacaaattaaagacctgtcttttaatgaggcaacaacatgaagctgcggctttaaatgctgtccagaggttagaatggcagctcaaactccaggaacttgatcctgccacctataaatctatcagcatttacgaaatccaggagttttatgttccccttgttgatgttaacgacgactttgaattgactcctatatagcagtcagtacttcctgatggtattgtcctaaactggtgatgctcaagcattatactgtggaatactgccttttgacaaaaatactcatgcctttacaattgttagtaaagttcgattatagttggttatgtagtaaacactgtcattttataaaaaatgagaattattttggatcttagatccaaacacagtttctaatagaaaactattatttatattgggaaaggtaactattgcattagagcatgttggcagactggtaggtatttaaaaagttgagaatctgctaacagcgctggaagttgttagcgctctaagtaataagataaccactagtattcaaatctctttcaggttttattaaaaaatatatatcaataaactaaaaggttcaattcctaccaaatagtttctaatgtgggagaaaaacttggcacaaaatttcttcagtttattatctgtaaattgtacagttttctttttgaaagttttaatattgtcttcctttttaataacttattttatacatattgtgcagatgtaaatcttgtaattaatggtcaaactgtataaagggattggtagtcaaaacatgtacaaagaaatacctgtaaaactgttttgtctcatgttttattggaccaaagttgtggtttgtatggagtgtagtagtagtgtgtacaggtagaaaacttttaaatacagcatgcaggtgtttcagttagcttgttttcatcaccataactgcaaagatgtggcttagttgtattgcatgcttcctataatttaactctccataattgatgcctgcagtagtgtaaggcatttcatactagtctcctctagtagacctgtgacttactgtgttggacatattatttagacttagtcatacaaagaaacttagctcttttttcatctcacagtaaagcctatttccccaggaaaaaaataaatgcctttgaatgaaaattctgaaattgtaaatgtctattttaatattcacctatgaaagaatctgtgaatatatgtaaatacgtttaataaattttattggtcatgttaaatcattgtaaaacttttttacattgcttaatgttttaagcttaatagcctttgcacttttaaaataaaaaccaagtatgcaaatcaaagatatttggtagtcaaaataagtaaaagaaatataggaatattccagtcaatctctgaaatgtttatgaaaaacaggttaatatgttgtatttttttccttgtatcaagatgcaaaacataatttgcaaaattttataattgaaataaaacttggtatgctgttttataataaattagcaatatactttaaaaaaaatccagtttctcctataacatgatgtaaattaaatattcaggaatatttcaggtctgaaatctgctgctgaacttgttagacatttttgaaaggaaaattaggttagcgtacaatttatcataaatatatgaggtaaaatttgcaaaactttccacagtactttcttgaattataatactgaatgttttctgttccgatagagaaaagtgaagcaaatatgtgaggaatgaagtgatctagtgcaagttggtaattccagctaatgggagagaatgtaaatgtgcaaaggtacatattaagcttagggatttttgaatttttacgtcagtttatattttaattcttactgtacttggcatgcgcaataaagcagcacatgtaaaaaaaaaatacacagtgcaaggactttattataaaggttggatgtagttttccttagaaatttaggtgagagattttggccttttttattggataaattgggccagaaaggcagggtagatttcgaagcactggttctgttgaagttaagtttattaagcctgggaacattaaaagctaatttataaaagcaatactttttaatatgaaaacttactgcaaagtttgtttatacttttgcctaaaaaggaaattggatgggatactgtggcaaatcataaaaaaccagataattgaactttgaagttatagaaaatcagagaggggtaagtttatagggcattttgttctgatggttcaaccagaggtctgggaaatagcactgttggcccaaacagaacaggcttttagaagataaaagcgacaagaaggaatctggtgaattttagtcatcccagctttttagtcttaaccacagttctcactctcttaaatggtacctcaaaaagctggagcctctctgccatgattatgcttctacaaatttcttttataaagagactcaaagctaatgatagcttaaaagaaaagttaatgccttctcattggaaatgtataatcaaataagtagttaagggcttttggtattaaagatattctgaagctctgaaatgctagaaaaaaatttggaatggagtatatgcctgaaaaggttttggattcagaaagaaaaaggatggttagtttaatcagtgattctttttaaactcttcaaatatcatgaacaagatactaaattgtacctaaggatttgtatttctttacaatttgttctaaatatctgtttaatgactagttgatatttgtgcatgttatttaataaagagttatatttttatagaaaaaaaagtgaaa

SEQ ID NO: 448878 - DNA, 8849 bp, Homo sapiens
gggggcgacgctgtcctgggagcgaggaggctgtggtgagagacggaccgagaccggagatgttttcaagcccggctccggcggctttacaggcggctgcagcggcgacgaagacaacgacagcgacggctacgccgaagcactcgttccgggggtgaagcctcctgcgccggccttgcctcggatccaggatgagaagactgataaaagaagaagctagctgaacagctgtaaaatgcccaaatctgggttcacaaaaccaattcagagtgaaaattctgacagtgacagcaatatggtagagaaaccatatggaagaaagagtaaagacaagattgcatcctacagcaaaactccaaaaattgaacgaagtgatgtgagcaaggagatgaaagagaaatcatccatgaaacgtaaacttccttttactattagcccatcaagaaatgaagaacgagattcagacacagagaaagaaggtccagaaaagaagaagacaaaaaaggaagctggaaataagaaatccacaccagttagcattctttttggttatccactctctgagcgaaaacagatggcacttcttatgcagatgacagcaagagacaacagtccagattccacaccaaatcatccatcacaaacaacgcctgcccaaaagaaaactcccagttcttcatctcgacagaaagataaagttaataaaagaaatgaacgtggtgaaactcctttacacatggctgctattcgaggagatgtgaaacaagttaaagaattaataagtttaggggcaaatgtgaatgtgaaagattttgcaggttggacaccactgcatgaagcttgcaatgttggatattacgatgttgctaagatacttatagcagctggagcagatgttaacacacaaggattagatgatgacactccactccatgattctgctagtagtgggcacagagatatagtaaagctgttacttcgtcacggtggaaatccatttcaagctaataaacatggggagcgtccagtggatgtagcagaaacagaggagttggagttgctactaaaaagagaggtgcctttatctgatgatgatgaaagttacacagattccgaagaggctcaatctgtaaatccttctagtgttgatgaaaatattgactctgaaacagagaaagactctctcatctgtgaaagtaaacagatacttcccagtaaaacacctcttccatctgcccttgatgagtatgagttcaaagatgatgatgatgaagaaattaataagatgattgatgataggcatattcttaggaaagaacaacgaaaagaaaatgaacctgaagcagaaaaaactcatttatttgcaaaacaggagaaagccttctatcctaaatcatttaaaagtaaaaaacaaaagccatctagggtcttatattcaagtactgaaagttctgatgaagaagctcttcagaataaaaagatttctacttcatgttccgtcatccctgaaacatcaaattctgatatgcaaaccaaaaaggaatatgtagtttcaggtgaacacaaacagaaaggcaaagttaaaagaaaattgaaaaatcagaataaaaataaagagaaccaagagctaaagcaagaaaaggaaggaaaagaaaatacaagaataacaaacttgacagtaaatactggactagattgttcagaaaagaccagagaggaggggaactttaggaaatcttttagcccaaaagatgatacttcattacatttatttcatatttccactggtaaatctcccaaacattcttgtggattaagtgaaaaacagtcaacaccactaaaacaagaacatactaaaacatgtttatcaccaggaagttctgaaatgtcattacagcctgatcttgttcggtatgataatacagaatctgaattcttgccagaaagttcaagtgtaaaatcttgtaagcataaggaaaaaagcaaacatcagaaagatttccacttagaatttggtgaaaaatcaaatgccaaaataaaggatgaagatcatagtccaacatttgaaaattcagattgcacactgaaaaaaatggataaagaaggtaaaacattaaaaaaacataaattgaagcataaagagagggaaaaagaaaagcataaaaaagaaattgaaggtgaaaaggaaaaatacaaaactaaggatagtgccaaagaactgcagaggagtgtggaatttgatagagaattttggaaagagaatttttttaaaagtgatgaaactgaagatctctttttaaatatggaacatgaatccttaacattagaaaaaaaatcaaaattggaaaaaaacatcaaagatgataaatcaaccaaggaaaagcatgtgtcaaaagagaggaactttaaagaggaacgagacaagattaaaaaggaaagcgagaatttacttctttgggtatgagtgccattgaggaatctatagggcttcatttagtggaaaaggaaatagacattgaaaaacaagaaaagcatataaaggaaagtaaagaaaaacctgagaagcgatctcaaattaaagaaaaggacattgagaagatggaaagaaaaacctttgaaaaaggacaagctatattcgcatcacacagaaaaatgccataaagaaggtgagaagagcaaaaatactgctgctattaaaaaaactgacgacagagagaaaagtagagaaaagatggataggaaacatgacaaagaaaagcctgaaaaagagaggcatctagcagaaagcaaagaaaagcacttgatggagaaaaaaaataaacaatcagataatagtgaatacagtaaatcagaaaaaggcaaaaataaagaaaaagacagggagctagataaaaaggaaaaatctagagataaagaaagtataaatataactaactccaaacacatacaggaagaaaaaaaatcaagtatagtagacggtaataaagcacaacatgaaaaacccttatcccttaaagaaaaaacaaaagatgaacctttgaaaactccagatggaaaagaaaaagataaaaaagataaagatatagatagatacaaagaacgagacaaacataaagataaaattcaaataaatagcttactcaaactaaaatctgaagcagataagcctaaacctaagtcatcaccagcatcaaaagatacccgacctaaagaaaagaggttagtgaatgatgatttaatgcagacaagttttgaacgaatgctaagccttaaagacctagaaatagaacagtggcacaaaaaacataaggaaaaaattaagcaaaaagaaaaggaacggttgagaaaccgaaactgtttagaacttaaaataaaagataaagaaaaaacaaagcatacaccaactgaatccaaaaataaagaacttactaggtcaaagagttcagaagtgactgatgcatataccaaggagaaacaacctaaagatgctgtaagtaacagatcacaatctgttgacaccaaaaatgtaatgactttagggaagtcatcttttgtttcagataatagcttaaacaggtctcctagatcagaaaatgaaaagccgggtctcagctccagatctgtatccatgatttctgttgctagttcagaagattcctgccatactacagtgacaaccccaaggcctccagttgagtatgactctgactttatgttagagagttcagaatcccaaatgtccttttcccagtcaccttttttgtcaattgccaaatctcctgctcttcatgaaagggaattggacagcctggctgacttgccggagcggattaaaccaccatatgcaaacagactttcaacatcccatcttaggtcatcttctgtagaagatgttaaactaattataagcgaggggagacctaccatagaagttcgaagatgtagcatgccttctgtcatttgtgaacataccaaacaattccaaacaatatcagaagagagcaatcaaggtagcttattaactgtgccaggagatactagtccttctcccaaacctgaggtattctcaaatgtgcctgaaagagacctttcaaatgtatctaacatacattccagttttgcaacttctccaactggagcttcaaacagcaagtatgtttcagctgatagaaatctcatcaagaatactgccccagtgaacactgtaatggacagtccagtgcatttagagccatctagtcaggttggtgtgatccagaataaatcatgggagatgcctgttgatagactagagacattaagcaccagagactttatctgcccaaattctaacatacctgatcaagaatcctctcttcagagtttttgtaattctgaaaataaggtattgaaagaaaatgctgattttttatccctgcgccagactgaactgccaggaaactcttgtgctcaggatccggcatcctttatgcctccacagcagccttgctctttccccagccaatcactttcagatgctgaatcgatttctaaacatatgtctttgtcatatgttgctaatcaagagccaggtattttacaacaaaaaaatgcagttcagattattagttctgctttagatactgataatgaatctacaaaagatacagaaaatacttttgtcctaggagatgttcaaaaaacagatgcctttgtcccagtgtactctgacagcactattcaagaagcatcaccaaactttgagaaagcttatactttacctgtgttaccatcagaaaaggactttaatggaagtgatgcctctacccagctaaatacacattatgcatttagcaaactaacttacaagtcttccagtggccatgaagttgagaatagcacaactgatactcaggtcatttcacatgaaaaagaaaacaaactggagagtttggttttaactcatttgagtaggtgtgattctgatttatgtgaaatgaatgcagggatgccaaaaggaaacctaaatgaacaagatccaaaacattgtcctgaaagtgaaaagtgtttgctttccatagaagatgaggaatctcaacaaagcattttatcaagtctggaaaaccattcacagcagtcaactcaaccagaaatgcataaatatggtcagttagttaaagtagaattagaagaaaatgccgaagatgataaaactgaaaaccaaatccctcaaagaatgactagaaacaaagcaaatacaatggcaaatcaaagcaaacagattcttgctagctgtacactattatcagaaaaagacagtgaatcctcatctcctagaggaagaataagattaactgaagatgacgatcctcaaattcaccatccacggaaaaggaaagtgtcacgtgtacctcagcctgtgcaagtgagtccctctttactacaagcaaaagagaaaactcagcaatctctggcagccattgtagattctctaaaactagatgagattcagccatacagttcagagagagcaaatccatattttgaatacttgcacataaggaaaaaaatagaagaaaaacgcaaattactgtgtagtgtgattcctcaagcacctcagtactatgacgaatatgtaacatttaacggatcatatctcctggatggaaaccccttaagcaagatttgtattcccacaattacaccaccaccttcactgtcagatccacttaaagagctttttcgacaacaggaagttgtaaggatgaaactacgtttgcaacacagtattgaaagggaaaaactcattgtatccaacgaacaagaagttttgcgagttcattacagagctgcaagaacattggcaaatcaaacactgccatttagtgcttgtactgttttgctggatgccgaagtatacaatgtaccattggactctcagtctgatgacagtaaaacttctgtgagggatcgctttaatgcaagacaattcatgtcttggttacaagatgtggatgataaatttgacaaattaaagacctgtcttttaatgaggcaacaacatgaagctgcggctttaaatgctgtccagaggttagaatggcagctcaaactccaggaacttgatcctgccacctataaatctatcagcatttacgaaatccaggagttttatgttccccttgttgatgttaacgacgactttgaattgactcctatatagcagtcagtacttcctgatggtattgtcctaaactggtgatgctcaagcattatactgtggaatactgccttttgacaaaaatactcatgcctttacaattgttagtaaagttcgattatagttggttatgtagtaaacactgtcattttataaaaaatgagaattattttggatcttagatccaaacacagtttctaatagaaaactattatttatattgggaaaggtaactattgcattagagcatgttggcagactggtaggtatttaaaaagttgagaatctgctaacagcgctggaagttgttagcgctctaagtaataagataaccactagtattcaaatctctttcaggttttattaaaaaatatatatcaataaactaaaaggttcaattcctaccaaatagtttctaatgtgggagaaaaacttggcacaaaatttcttcagtttattatctgtaaattgtacagttttctttttgaaagttttaatattgtcttcctttttaataacttattttatacatattgtgcagatgtaaatcttgtaattaatggtcaaactgtataaagggattggtagtcaaaacatgtacaaagaaatacctgtaaaactgttttgtctcatgttttattggaccaaagttgtggtttgtatggagtgtagtagtagtgtgtacaggtagaaaacttttaaatacagcatgcaggtgtttcagttagcttgttttcatcaccataactgcaaagatgtggcttagttgtattgcatgcttcctataatttaactctccataattgatgcctgcagtagtgtaaggcatttcatactagtctcctctagtagacctgtgacttactgtgttggacatattatttagacttagtcatacaaagaaacttagctcttttttcatctcacagtaaagcctatttccccaggaaaaaaataaatgcctttgaatgaaaattctgaaattgtaaatgtctattttaatattcacctatgaaagaatctgtgaatatatgtaaatacgtttaataaattttattggtcatgttaaatcattgtaaaacttttttacattgcttaatgttttaagcttaatagcctttgcacttttaaaataaaaaccaagtatgcaaatcaaagatatttggtagtcaaaataagtaaaagaaatataggaatattccagtcaatctctgaaatgtttatgaaaaacaggttaatatgttgtatttttttccttgtatcaagatgcaaaacataatttgcaaaattttataattgaaataaaacttggtatgctgttttataataaattagcaatatactttaaaaaaaatccagtttctcctataacatgatgtaaattaaatattcaggaatatttcaggtctgaaatctgctgctgaacttgttagacatttttgaaaggaaaattaggttagcgtacaatttatcataaatatatgaggtaaaatttgcaaaactttccacagtactttcttgaattataatactgaatgttttctgttccgatagagaaaagtgaagcaaatatgtgaggaatgaagtgatctagtgcaagttggtaattccagctaatgggagagaatgtaaatgtgcaaaggtacatattaagcttagggatttttgaatttttacgtcagtttatattttaattcttactgtacttggcatgcgcaataaagcagcacatgtaaaaaaaaaatacacagtgcaaggactttattataaaggttggatgtagttttccttagaaatttaggtgagagattttggccttttttattggataaattgggccagaaaggcagggtagatttcgaagcactggttctgttgaagttaagtttattaagcctgggaacattaaaagctaatttataaaagcaatactttttaatatgaaaacttactgcaaagtttgtttatacttttgcctaaaaaggaaattggatgggatactgtggcaaatcataaaaaaccagataattgaactttgaagttatagaaaatcagagaggggtaagtttatagggcattttgttctgatggttcaaccagaggtctgggaaatagcactgttggcccaaacagaacaggcttttagaagataaaagcgacaagaaggaatctggtgaattttagtcatcccagctttttagtcttaaccacagttctcactctcttaaatggtacctcaaaaagctggagcctctctgccatgattatgcttctacaaatttcttttataaagagactcaaagctaatgatagcttaaaagaaaagttaatgccttctcattggaaatgtataatcaaataagtagttaagggcttttggtattaaagatattctgaagctctgaaatgctagaaaaaaatttggaatggagtatatgcctgaaaaggttttggattcagaaagaaaaaggatggttagtttaatcagtgattctttttaaactcttcaaatatcatgaacaagatactaaattgtacctaaggatttgtatttctttacaatttgttctaaatatctgtttaatgactagttgatatttgtgcatgttatttaataaagagttatatttttatagaaaaaaaagtgaaa

SEQ ID NO: 448879 - DNA, 6367 bp, Homo sapiens
atgatgtgattgtggttttaatgaaaacagcattcttgggacaatggatatctcaaactctgcagatgacctgagatgcttgtttaccaaaaaaaagacaaattagatcttagtgaatgtgttgataaaataaaagaaaaggacaagctatattcgcatcacacagaaaaatgccataaagaaggtgagaagagcaaaaatactgctgctattaaaaaaactgacgacagagagaaaagtagagaaaagatggataggaaacatgacaaagaaaagcctgaaaaagagaggcatctagcagaaagcaaagaaaagcacttgatggagaaaaaaaataaacaatcagataatagtgaatacagtaaatcagaaaaaggcaaaaataaagaaaaagacagggagctagataaaaaggaaaaatctagagataaagaaagtataaatataactaactccaaacacatacaggaagaaaaaaaatcaagtatagtagacggtaataaagcacaacatgaaaaacccttatcccttaaagaaaaaacaaaagatgaacctttgaaaactccagatggaaaagaaaaagataaaaaagataaagatatagatagatacaaagaacgagacaaacataaagataaaattcaaataaatagcttactcaaactaaaatctgaagcagataagcctaaacctaagtcatcaccagcatcaaaagatacccgacctaaagaaaagaggttagtgaatgatgatttaatgcagacaagttttgaacgaatgctaagccttaaagacctagaaatagaacagtggcacaaaaaacataaggaaaaaattaagcaaaaagaaaaggaacggttgagaaaccgaaactgtttagaacttaaaataaaagataaagaaaaaacaaagcatacaccaactgaatccaaaaataaagaacttactaggtcaaagagttcagaagtgactgatgcatataccaaggagaaacaacctaaagatgctgtaagtaacagatcacaatctgttgacaccaaaaatgtaatgactttagggaagtcatcttttgtttcagataatagcttaaacaggtctcctagatcagaaaatgaaaagccgggtctcagctccagatctgtatccatgatttctgttgctagttcagaagattcctgccatactacagtgacaaccccaaggcctccagttgagtatgactctgactttatgttagagagttcagaatcccaaatgtccttttcccagtcaccttttttgtcaattgccaaatctcctgctcttcatgaaagggaattggacagcctggctgacttgccggagcggattaaaccaccatatgcaaacagactttcaacatcccatcttaggtcatcttctgtagaagatgttaaactaattataagcgaggggagacctaccatagaagttcgaagatgtagcatgccttctgtcatttgtgaacataccaaacaattccaaacaatatcagaagagagcaatcaaggtagcttattaactgtgccaggagatactagtccttctcccaaacctgaggtattctcaaatgtgcctgaaagagacctttcaaatgtatctaacatacattccagttttgcaacttctccaactggagcttcaaacagcaagtatgtttcagctgatagaaatctcatcaagaatactgccccagtgaacactgtaatggacagtccagtgcatttagagccatctagtcaggttggtgtgatccagaataaatcatgggagatgcctgttgatagactagagacattaagcaccagagactttatctgcccaaattctaacatacctgatcaagaatcctctcttcagagtttttgtaattctgaaaataaggtattgaaagaaaatgctgattttttatccctgcgccagactgaactgccaggaaactcttgtgctcaggatccggcatcctttatgcctccacagcagccttgctctttccccagccaatcactttcagatgctgaatcgatttctaaacatatgtctttgtcatatgttgctaatcaagagccaggtattttacaacaaaaaaatgcagttcagattattagttctgctttagatactgataatgaatctacaaaagatacagaaaatacttttgtcctaggagatgttcaaaaaacagatgcctttgtcccagtgtactctgacagcactattcaagaagcatcaccaaactttgagaaagcttatactttacctgtgttaccatcagaaaaggactttaatggaagtgatgcctctacccagctaaatacacattatgcatttagcaaactaacttacaagtcttccagtggccatgaagttgagaatagcacaactgatactcaggtcatttcacatgaaaaagaaaacaaactggagagtttggttttaactcatttgagtaggtgtgattctgatttatgtgaaatgaatgcagggatgccaaaaggaaacctaaatgaacaagatccaaaacattgtcctgaaagtgaaaagtgtttgctttccatagaagatgaggaatctcaacaaagcattttatcaagtctggaaaaccattcacagcagtcaactcaaccagaaatgcataaatatggtcagttagttaaagtagaattagaagaaaatgccgaagatgataaaactgaaaaccaaatccctcaaagaatgactagaaacaaagcaaatacaatggcaaatcaaagcaaacagattcttgctagctgtacactattatcagaaaaagacagtgaatcctcatctcctagaggaagaataagattaactgaagatgacgatcctcaaattcaccatccacggaaaaggaaagtgtcacgtgtacctcagcctgtgcaagtgagtccctctttactacaagcaaaagagaaaactcagcaatctctggcagccattgtagattctctaaaactagatgagattcagccatacagttcagagagagcaaatccatattttgaatacttgcacataaggaaaaaaatagaagaaaaacgcaaattactgtgtagtgtgattcctcaagcacctcagtactatgacgaatatgtaacatttaacggatcatatctcctggatggaaaccccttaagcaagatttgtattcccacaattacaccaccaccttcactgtcagatccacttaaagagctttttcgacaacaggaagttgtaaggatgaaactacgtttgcaacacagtattgaaagggaaaaactcattgtatccaacgaacaagaagttttgcgagttcattacagagctgcaagaacattggcaaatcaaacactgccatttagtgcttgtactgttttgctggatgccgaagtatacaatgtaccattggactctcagtctgatgacagtaaaacttctgtgagggatcgctttaatgcaagacaattcatgtcttggttacaagatgtggatgataaatttgacaaattaaagacctgtcttttaatgaggcaacaacatgaagctgcggctttaaatgctgtccagaggttagaatggcagctcaaactccaggaacttgatcctgccacctataaatctatcagcatttacgaaatccaggagttttatgttccccttgttgatgttaacgacgactttgaattgactcctatatagcagtcagtacttcctgatggtattgtcctaaactggtgatgctcaagcattatactgtggaatactgccttttgacaaaaatactcatgcctttacaattgttagtaaagttcgattatagttggttatgtagtaaacactgtcattttataaaaaatgagaattattttggatcttagatccaaacacagtttctaatagaaaactattatttatattgggaaaggtaactattgcattagagcatgttggcagactggtaggtatttaaaaagttgagaatctgctaacagcgctggaagttgttagcgctctaagtaataagataaccactagtattcaaatctctttcaggttttattaaaaaatatatatcaataaactaaaaggttcaattcctaccaaatagtttctaatgtgggagaaaaacttggcacaaaatttcttcagtttattatctgtaaattgtacagttttctttttgaaagttttaatattgtcttcctttttaataacttattttatacatattgtgcagatgtaaatcttgtaattaatggtcaaactgtataaagggattggtagtcaaaacatgtacaaagaaatacctgtaaaactgttttgtctcatgttttattggaccaaagttgtggtttgtatggagtgtagtagtagtgtgtacaggtagaaaacttttaaatacagcatgcaggtgtttcagttagcttgttttcatcaccataactgcaaagatgtggcttagttgtattgcatgcttcctataatttaactctccataattgatgcctgcagtagtgtaaggcatttcatactagtctcctctagtagacctgtgacttactgtgttggacatattatttagacttagtcatacaaagaaacttagctcttttttcatctcacagtaaagcctatttccccaggaaaaaaataaatgcctttgaatgaaaattctgaaattgtaaatgtctattttaatattcacctatgaaagaatctgtgaatatatgtaaatacgtttaataaattttattggtcatgttaaatcattgtaaaacttttttacattgcttaatgttttaagcttaatagcctttgcacttttaaaataaaaaccaagtatgcaaatcaaagatatttggtagtcaaaataagtaaaagaaatataggaatattccagtcaatctctgaaatgtttatgaaaaacaggttaatatgttgtatttttttccttgtatcaagatgcaaaacataatttgcaaaattttataattgaaataaaacttggtatgctgttttataataaattagcaatatactttaaaaaaaatccagtttctcctataacatgatgtaaattaaatattcaggaatatttcaggtctgaaatctgctgctgaacttgttagacatttttgaaaggaaaattaggttagcgtacaatttatcataaatatatgaggtaaaatttgcaaaactttccacagtactttcttgaattataatactgaatgttttctgttccgatagagaaaagtgaagcaaatatgtgaggaatgaagtgatctagtgcaagttggtaattccagctaatgggagagaatgtaaatgtgcaaaggtacatattaagcttagggatttttgaatttttacgtcagtttatattttaattcttactgtacttggcatgcgcaataaagcagcacatgtaaaaaaaaaatacacagtgcaaggactttattataaaggttggatgtagttttccttagaaatttaggtgagagattttggccttttttattggataaattgggccagaaaggcagggtagatttcgaagcactggttctgttgaagttaagtttattaagcctgggaacattaaaagctaatttataaaagcaatactttttaatatgaaaacttactgcaaagtttgtttatacttttgcctaaaaaggaaattggatgggatactgtggcaaatcataaaaaaccagataattgaactttgaagttatagaaaatcagagaggggtaagtttatagggcattttgttctgatggttcaaccagaggtctgggaaatagcactgttggcccaaacagaacaggcttttagaagataaaagcgacaagaaggaatctggtgaattttagtcatcccagctttttagtcttaaccacagttctcactctcttaaatggtacctcaaaaagctggagcctctctgccatgattatgcttctacaaatttcttttataaagagactcaaagctaatgatagcttaaaagaaaagttaatgccttctcattggaaatgtataatcaaataagtagttaagggcttttggtattaaagatattctgaagctctgaaatgctagaaaaaaatttggaatggagtatatgcctgaaaaggttttggattcagaaagaaaaaggatggttagtttaatcagtgattctttttaaactcttcaaatatcatgaacaagatactaaattgtacctaaggatttgtatttctttacaatttgttctaaatatctgtttaatgactagttgatatttgtgcatgttatttaataaagagttatatttttatagaaaaaaaagtgaaa

SEQ ID NO: 448880 - DNA, 5901 bp, Homo sapiens
gggggcgacgctgtcctgggagcgaggaggctgtggtgagagacggaccgagaccggagatgttttcaagcccggctccggcggctttacaggcggctgcagcggcgacgaagacaacgacagcgacggctacgccgaagcactcgttccgggggtgaagcctcctgcgccggccttgcctcggatccaggatgagaagactgataaaagaagaagctagctgaacagctgtaaaatgcccaaatctgggttcacaaaaccaattcagagtgaaaattctgacagtgacagcaatatggtagagaaaccatatggaagaaagagtaaagacaagattgcatcctacagcaaaactccaaaaattgaacgaagtgatgtgagcaaggagatgaaagagaaatcatccatgaaacgtaaacttccttttactattagcccatcaagaaatgaagaacgagattcagacacagagaaagaaggtccagaaaagaagaagacaaaaaaggaagctggaaataagaaatccacaccagttagcattctttttggttatccactctctgagcgaaaacagatggcacttcttatgcagatgacagcaagagacaacagtccagattccacaccaaatcatccatcacaaacaacgcctgcccaaaagaaaactcccagttcttcatctcgacagaaagataaagttaataaaagaaatgaacgtggtgaaactcctttacacatggctgctattcgaggagatgtgaaacaagttaaagaattaataagtttaggggcaaatgtgaatgtgaaagattttgcaggttggacaccactgcatgaagcttgcaatgttggatattacgatgttgctaagatacttatagcagctggagcagatgttaacacacaaggattagatgatgacactccactccatgattctgctagtagtgggcacagagatatagtaaagctgttacttcgtcacggtggaaatccatttcaagctaataaacatggggagcgtccagtggatgtagcagaaacagaggagttggagttgctactaaaaagagaggtgcctttatctgatgatgatgaaagttacacagattccgaagaggctcaatctgtaaatccttctagtgttgatgaaaatattgactctgaaacagagaaagactctctcatctgtgaaagtaaacagatacttcccagtaaaacacctcttccatctgcccttgatgagtatgagttcaaagatgatgatgatgaagaaattaataagatgattgatgataggcatattcttaggaaagaacaacgaaaagaaaatgaacctgaagcagaaaaaactcatttatttgcaaaacaggagaaagccttctatcctaaatcatttaaaagtaaaaaacaaaagccatctagggtcttatattcaagtactgaaagttctgatgaagaagctcttcagaataaaaagatttctacttcatgttccgtcatccctgaaacatcaaattctgatatgcaaaccaaaaaggaatatgtagtttcaggtgaacacaaacagaaaggcaaagttaaaagaaaattgaaaaatcagaataaaaataaagagaaccaagagctaaagcaagaaaaggaaggaaaagaaaatacaagaataacaaacttgacagtaaatactggactagattgttcagaaaagaccagagaggaggggaactttaggaaatcttttagcccaaaagatgatacttcattacatttatttcatatttccactggtaaatctcccaaacattcttgtggattaagtgaaaaacagtcaacaccactaaaacaagaacatactaaaacatgtttatcaccaggaagttctgaaatgtcattacagcctgatcttgttcggtatgataatacagaatctgaattcttgccagaaagttcaagtgtaaaatcttgtaagcataaggaaaaaagcaaacatcagaaagatttccacttagaatttggtgaaaaatcaaatgccaaaataaaggatgaagatcatagtccaacatttgaaaattcagattgcacactgaaaaaaatggataaagaaggtaaaacattaaaaaaacataaattgaagcataaagagagggaaaaagaaaagcataaaaaagaaattgaaggtgaaaaggaaaaatacaaaactaaggatagtgccaaagaactgcagaggagtgtggaatttgatagagaattttggaaagagaatttttttaaaagtgatgaaactgaagatctctttttaaatatggaacatgaatccttaacattagaaaaaaaatcaaaattggaaaaaaacatcaaagatgataaatcaaccaaggaaaagcatgtgtcaaaagagaggaactttaaagaggaacgagacaagattaaaaaggaaagcgagaaatcttttagggaggaaaaaataaaagatctaaaagaagagagagaaaacatacccacagataaagactcagaatttacttctttgggtatgagtgccattgaggaatctatagggcttcatttagtggaaaaggaaatagacattgaaaaacaagaaaagcatataaaggaaagtaaagaaaaacctgagaagcgatctcaaattaaagaaaaggacattgagaagatggaaagaaaaacctttgaaaaagaaaagaagataaaacatgagcataagtcagaaaaagacaaattagatcttagtgaatgtgttgataaaataaaagaaaaggacaagctatattcgcatcacacagaaaaatgccataaagaaggtgagaagagcaaaaatactgctgctattaaaaaaactgacgacagagagaaaagtagagaaaagatggataggaaacatgacaaagaaaagcctgaaaaagagaggcatctagcagaaagcaaagaaaagcacttgatggagaaaaaaaataaacaatcagataatagtgaatacagtaaatcagaaaaaggcaaaaataaagaaaaagacagggagctagataaaaaggaaaaatctagagataaagaaagtataaatataactaactccaaacacatacaggaagaaaaaaaatcaagtatagtagacggtaataaagcacaacatgaaaaacccttatcccttaaagaaaaaacaaaagatgaacctttgaaaactccagatggaaaagaaaaagataaaaaagataaagatatagatagatacaaagaacgagacaaacataaagataaaattcaaataaatagcttactcaaactaaaatctgaagcagataagcctaaacctaagtcatcaccagcatcaaaagatacccgacctaaagaaaagaggttagtgaatgatgatttaatgcagacaagttttgaacgaatgctaagccttaaagacctagaaatagaacagtggcacaaaaaacataaggaaaaaattaagcaaaaagaaaaggaacggttgagaaaccgaaactgtttagaacttaaaataaaagataaagaaaaaacaaagcatacaccaactgaatccaaaaataaagaacttactaggtcaaagagttcagaagtgactgatgcatataccaaggagaaacaacctaaagatgctgtaagtaacagatcacaatctgttgacaccaaaaatgtaatgactttagggaagtcatcttttgtttcagataatagcttaaacaggtctcctagatcagaaaatgaaaagccgggtctcagctccagatctgtatccatgatttctgttgctagttcagaagattcctgccatactacagtgacaaccccaaggcctccagttgagtatgactctgactttatgttagagagttcagaatcccaaatgtccttttcccagtcaccttttttgtcaattgccaaatctcctgctcttcatgaaagggaattggacagcctggctgacttgccggagcggattaaaccaccatatgcaaacagactttcaacatcccatcttaggtcatcttctgtagaagatgttaaactaattataagcgaggggagacctaccatagaagttcgaagatgtagcatgccttctgtcatttgtgaacataccaaacaattccaaacaatatcagaagagagcaatcaaggtagcttattaactgtgccaggagatactagtccttctcccaaacctgaggtattctcaaatgtgcctgaaagagacctttcaaatgtatctaacatacattccagttttgcaacttctccaactggagcttcaaacagcaagtatgtttcagctgatagaaatctcatcaagaatactgccccagtgaacactgtaatggacagtccagtgcatttagagccatctagtcaggttggtgtgatccagaataaatcatgggagatgcctgttgatagactagagacattaagcaccagagactttatctgcccaaattctaacatacctgatcaagaatcctctcttcagagtttttgtaattctgaaaataaggtattgaaagaaaatgctgattttttatccctgcgccagactgaactgccaggaaactcttgtgctcaggatccggcatcctttatgcctccacagcagccttgctctttccccagccaatcactttcagatgctgaatcgatttctaaacatatgtctttgtcatatgttgctaatcaagagccaggtattttacaacaaaaaaatgcagttcagattattagttctgctttagatactgataatgaatctacaaaagatacagaaaatacttttgtcctaggagatgttcaaaaaacagatgcctttgtcccagtgtactctgacagcactattcaagaagcatcaccaaactttgagaaagcttatactttacctgtgttaccatcagaaaaggactttaatggaagtgatgcctctacccagctaaatacacattatgcatttagcaaactaacttacaagtcttccagtggccatgaagttgagaatagcacaactgatactcaggtcatttcacatgaaaaagaaaacaaactggagagtttggttttaactcatttgagtaggtgtgattctgatttatgtgaaatgaatgcagggatgccaaaaggaaacctaaatgaacaagatccaaaacattgtcctgaaagtgaaaagtgtttgctttccatagaagatgaggaatctcaacaaagcattttatcaagtctggaaaaccattcacagcagtcaactcaaccagaaatgcataaatatggtcagttagttaaagtagaattagaagaaaatgccgaagatgataaaactgaaaaccaaatccctcaaagaatgactagaaacaaagcaaatacaatggcaaatcaaagcaaacagattcttgctagctgtacactattatcagaaaaagacagtgaatcctcatctcctagaggaagaataagattaactgaagatgacgatcctcaaattcaccatccacggaaaaggaaagtgtcacgtgtacctcagcctgtgcaagtgagtccctctttactacaagcaaaagagaaaactcagcaatctctggcagccattgtagattctctaaaactagatgagattcagccatacagttcagagagagcaaatccatattttgaatacttgcacataaggaaaaaaatagaagaaaaacgcaaattactgtgtagtgtgattcctcaagcacctcagtactatgacgaatatgtaacatttaacggatcatatctcctggatggaaaccccttaagcaagatttgtattcccacagtaagtaacatcatcacttgctatacacctgtaacactgcccaatagaagtataatgctagccacatacgt

SEQ ID NO: 448881 - DNA, 3013 bp, Homo sapiens
gggggcgacgctgtcctgggagcgaggaggctgtggtgagagacggaccgagaccggagatgttttcaagcccggctccggcggctttacaggcggctgcagcggcgacgaagacaacgacagcgacggctacgccgaagcactcgttccgggggtgaagcctcctgcgccggccttgcctcggatccaggatgagaagactgataaaagaagaagctagctgaacagctgtaaaatgcccaaatctgggttcacaaaaccaattcagagtgaaaattctgacagtgacagcaatatggtagagaaaccatatggaagaaagagtaaagacaagattgcatcctacagcaaaactccaaaaattgaacgaagtgatgtgagcaaggagatgaaagagaaatcatccatgaaacgtaaacttccttttactattagcccatcaagaaatgaagaacgagattcagacacagagaaagaaggtccagaaaagaagaagacaaaaaaggaagctggaaataagaaatccacaccagttagcattctttttggttatccactctctgagcgaaaacagatggcacttcttatgcagatgacagcaagagacaacagtccagattccacaccaaatcatccatcacaaacaacgcctgcccaaaagaaaactcccagttcttcatctcgacagaaagataaagttaataaaagaaatgaacgtggtgaaactcctttacacatggctgctattcgaggagatgtgaaacaagttaaagaattaataagtttaggggcaaatgtgaatgtgaaagattttgcaggttggacaccactgcatgaagcttgcaatgttggatattacgatgttgctaagatacttatagcagctggagcagatgttaacacacaaggattagatgatgacactccactccatgattctgctagtagtgggcacagagatatagtaaagctgttacttcgtcacggtggaaatccatttcaagctaataaacatggggagcgtccagtggatgtagcagaaacagaggagttggagttgctactaaaaagagaggtgcctttatctgatgatgatgaaagttacacagattccgaagaggctcaatctgtaaatccttctagtgttgatgaaaatattgactctgaaacagagaaagactctctcatctgtgaaagtaaacagatacttcccagtaaaacacctcttccatctgcccttgatgagtatgagttcaaagatgatgatgatgaagaaattaataagatgattgatgataggcatattcttaggaaagaacaacgaaaagaaaatgaacctgaagcagaaaaaactcatttatttgcaaaacaggagaaagccttctatcctaaatcatttaaaagtaaaaaacaaaagccatctagggtcttatattcaagtactgaaagttctgatgaagaagctcttcagaataaaaagatttctacttcatgttccgtcatccctgaaacatcaaattctgatatgcaaaccaaaaaggaatatgtagtttcaggtgaacacaaacagaaaggcaaagttaaaagaaaattgaaaaatcagaataaaaataaagagaaccaagagctaaagcaagaaaaggaaggaaaagaaaatacaagaataacaaacttgacagtaaatactggactagattgttcagaaaagaccagagaggaggggaactttaggaaatcttttagcccaaaagatgatacttcattacatttatttcatatttccactggtaaatctcccaaacattcttgtggattaagtgaaaaacagtcaacaccactaaaacaagaacatactaaaacatgtttatcaccaggaagttctgaaatgtcattacagcctgatcttgttcggtatgataatacagaatctgaattcttgccagaaagttcaagtgtaaaatcttgtaagcataaggaaaaaagcaaacatcagaaagatttccacttagaatttggtgaaaaatcaaatgccaaaataaaggatgaagatcatagtccaacatttgaaaattcagattgcacactgaaaaaaatggataaagaaggtaaaacattaaaaaaacataaattgaagcataaagagagggaaaaagaaaagcataaaaaagaaattgaaggtgaaaaggaaaaatacaaaactaaggatagtgccaaagaactgcagaggagtgtggaatttgatagagaattttggaaagagaatttttttaaaagtgatgaaactgaagatctctttttaaatatggaacatgaatccttaacattagaaaaaaaatcaaaattggaaaaaaacatcaaagatgataaatcaaccaaggaaaagcatgtgtcaaaagagaggaactttaaagaggaacgagacaagattaaaaaggaaagcgagaaatcttttagggaggaaaaaataaaagatctaaaagaagagagagaaaacatacccacagataaagactcagaatttacttctttgggtatgagtgccattgaggaatctatagggcttcatttagtggaaaaggaaatagacattgaaaaacaagaaaagcatataaaggaaagtaaagaaaaacctgagaagcgatctcaaattaaagaaaaggacattgagaagatggaaagaaaaacctttgaaaaagaaaagaagataaaacatgagcataagtcagaaaaagacaaattagatcttagtgaatgtgttgataaaataaaagaaaaggacaagctatattcgcatcacacagaaaaatgccataaagaaggtgagaagagcaaaaatactgctgctattaaaaaaactgacgacagagagaaaagtagagaaaagatggataggaaacatgacaaagaaaagcctgaaaaagagaggcatctagcagaaagcaaagaaaagcacttgatggagaaaaaaaataaacaatcagataatagtgaatacagtaaatcagaaaaaggc

SEQ ID NO: 448882 - DNA, 1264 bp, Homo sapiens
  misc_feature (1131)..(1131): n is a, c, g, or t
  misc_feature (1154)..(1154): n is a, c, g, or t
  misc_feature (1164)..(1164): n is a, c, g, or t
gggggcgacgctgtcctgggagcgaggaggctgtggtgagagacggaccgagaccggagatgttttcaagcccggctccggcggctttacaggcggctgcagcggcgacgaagacaacgacagcgacggctacgccgaagcactcgttccgggggtgaagcctcctgcgccggccttgcctcggatccaggatgagaagactgataaaagaagaagctagctgaacagctgtaaaatgcccaaatctgggttcacaaaaccaattcagagtgaaaattctgacagtgacagcaatatggtagagaaaccatatggaagaaagagtaaagacaagattgcatcctacagcaaaactccaaaaattgaacgaagtgatgtgagcaaggagatgaaagagaaatcatccatgaaacgtaaacttccttttactattagcccatcaagaaatgaagaacgagattcagacacagagaaagaaggtccagaaaagaagaagacaaaaaaggaagctggaaataagaaatccacaccagttagcattctttttggttatccactctctgagcgaaaacagatggcacttcttatgcagatgacagcaagagacaacagtccagattccacaccaaatcatccatcacaaacaacgcctgcccaaaagaaaactcccagttcttcatctcgacagaaagataaagttaataaaagaaatgaacgtggtgaaactcctttacacatggctgctattcgaggagatgtgaaacaagttaaagaattaataagtttaggggcaaatgtgaatgtgaaagattttgcaggttggacaccactgcatgaagcttgcaatgttggatattacgatgttgctaagatacttatagcagctggagcagatgttaacacacaaggattagatgatgacactccactccatgattctgctagtagtgggcacagagatatagtaaagctgttacttcgtcacggtggaaatccatttcaagctaataaacatggggagcgtccagtggatgtagcagaaacagaggagttggagttgctactaaaaagagaggtgcctttatctgatgatgatgaaagttacacagatccaggatgagaagactgatnaaagaagaagctagctgaacagntgtaaaatgnccaaatctgggttcacaaaacaattcagagtgaaaattctgacagtgacagcatatggtagagaaaccatttggaagaaagagtaagacaagatggatcg

SEQ ID NO: 448883 - DNA, 742 bp, Homo sapiens
gagcgaaaacagatggcacttcttatgcagatgacagcaagagacaacagtccaggtgatacctaccatcattgagttaatgtgtatccctagttttcctcaggcaactgtagtctcgtcttaacaattattttaactacttttaatttttattctttcttggatttaatcagaattacttgtaagtcagtggtaattttatgattatttgtgtgacagtttatcatctgtatcctctgctaaagtagaagctatacaagagtagggctctttacaccatgtgtaatccatgttttattaagatctaaatttttttataaggaaaaatgtcagcagtatattaacagtcattttatatttcatgtcacatttccagctaaggtgttgtgccacatgtatgtatgtttatttatatactgtgttctccaaaaataattgatgatgacttaccagcaggacaaaaacaaaaagggaacaaaccaaacaacatggtaatttataaaagggagctaaaaaggtagataaaatccaggcaactggcctgagatagttattactattcacatcctggcagctaaaagtacaaaagaaaatttttgagttacatagttctcattgactgattcaagaaagtaaatcacttttgtctggagaaaatttcttttggccctgaattcaaagcaattttatgtaagactctgggttacgtaacagtccatgttgaaatgcattgaaaaagata

SEQ ID NO: 448884 - DNA, 555 bp, Homo sapiens
tatgtattgtataagctatatctttttctcagaaaaaaaaattatttttctggcagttgtgttttgtttgacccacaccacattttcttttttttattctagattccgaagaggctcaatctgtaaatccttctagtgttgatgaaaatattgactctgaaacagagaaagactctctcatctgtgaaagtaaacagatacttcccagtaaaacacctcttccatctgcccttgatgagtatgagttcaaagatgatgatgatgaagaaattaataagatgattgatgataggcatattcttaggaaagaacaacgaaaagaaaatgaacctgaagcagaaaaaactcatttatttgcaaaacaggagaaagccttctatcctaaatcatttaaaagtaaaaaacaaaagccatctagggtcttatattcaagtactgaaagttctgatgaagaagctcttcagaataaaaagatttctacttcatgttccgtcatccctgaaacatcaaattctgatatgcaaaccaaaaaggaatatgtagtttcaggtgaac

SEQ ID NO: 448885 - DNA, 9071 bp, Homo sapiens
gggggcgacgctgtcctgggagcgaggaggctgtggtgagagacggaccgagaccggagatgttttcaagcccggctccggcggctttacaggcggctgcagcggcgacgaagacaacgacagcgacggctacgccgaagcactcgttccgggggtgaagcctcctgcgccggccttgcctcggatccaggatgagaagactgataaaagaagaagctagctgaacagctgtaaaatgcccaaatctgggttcacaaaaccaattcagagtgaaaattctgacagtgacagcaatatggtagagaaaccatatggaagaaagagtaaagacaagattgcatcctacagcaaaactccaaaaattgaacgaagtgatgtgagcaaggagatgaaagagaaatcatccatgaaacgtaaacttccttttactattagcccatcaagaaatgaagaacgagattcagacacagattcagatccaggacatacaagtgaaaattggggggagagacttatatcttcttacaggacatactcagagaaagaaggtccagaaaagaagaagacaaaaaaggaagctggaaataagaaatccacaccagttagcattctttttggttatccactctctgagcgaaaacagatggcacttcttatgcagatgacagcaagagacaacagtccagattccacaccaaatcatccatcacaaacaacgcctgcccaaaagaaaactcccagttcttcatctcgacagaaagataaagttaataaaagaaatgaacgtggtgaaactcctttacacatggctgctattcgaggagatgtgaaacaagttaaagaattaataagtttaggggcaaatgtgaatgtgaaagattttgcaggttggacaccactgcatgaagcttgcaatgttggatattacgatgttgctaagatacttatagcagctggagcagatgttaacacacaaggattagatgatgacactccactccatgattctgctagtagtgggcacagagatatagtaaagctgttacttcgtcacggtggaaatccatttcaagctaataaacatggggagcgtccagtggatgtagcagaaacagaggagttggagttgctactaaaaagagaggtgcctttatctgatgatgatgaaagttacacagattccgaagaggctcaatctgtaaatccttctagtgttgatgaaaatattgactctgaaacagagaaagactctctcatctgtgaaagtaaacagatacttcccagtaaaacacctcttccatctgcccttgatgagtatgagttcaaagatgatgatgatgaagaaattaataagatgattgatgataggcatattcttaggaaagaacaacgaaaagaaaatgaacctgaagcagaaaaaactcatttatttgcaaaacaggagaaagccttctatcctaaatcatttaaaagtaaaaaacaaaagccatctagggtcttatattcaagtactgaaagttctgatgaagaagctcttcagaataaaaagatttctacttcatgttccgtcatccctgaaacatcaaattctgatatgcaaaccaaaaaggaatatgtagtttcaggtgaacacaaacagaaaggcaaagttaaaagaaaattgaaaaatcagaataaaaataaagagaaccaagagctaaagcaagaaaaggaaggaaaagaaaatacaagaataacaaacttgacagtaaatactggactagattgttcagaaaagaccagagaggaggggaactttaggaaatcttttagcccaaaagatgatacttcattacatttatttcatatttccactggtaaatctcccaaacattcttgtggattaagtgaaaaacagtcaacaccactaaaacaagaacatactaaaacatgtttatcaccaggaagttctgaaatgtcattacagcctgatcttgttcggtatgataatacagaatctgaattcttgccagaaagttcaagtgtaaaatcttgtaagcataaggaaaaaagcaaacatcagaaagatttccacttagaatttggtgaaaaatcaaatgccaaaataaaggatgaagatcatagtccaacatttgaaaattcagattgcacactgaaaaaaatggataaagaaggtaaaacattaaaaaaacataaattgaagcataaagagagggaaaaagaaaagcataaaaaagaaattgaaggtgaaaaggaaaaatacaaaactaaggatagtgccaaagaactgcagaggagtgtggaatttgatagagaattttggaaagagaatttttttaaaagtgatgaaactgaagatctctttttaaatatggaacatgaatccttaacattagaaaaaaaatcaaaattggaaaaaaacatcaaagatgataaatcaaccaaggaaaagcatgtgtcaaaagagaggaactttaaagaggaacgagacaagattaaaaaggaaagcgagaaatcttttagggaggaaaaaataaaagatctaaaagaagagagagaaaacatacccacagataaagactcagaatttacttctttgggtatgagtgccattgaggaatctatagggcttcatttagtggaaaaggaaatagacattgaaaaacaagaaaagcatataaaggaaagtaaagaaaaacctgagaagcgatctcaaattaaagaaaaggacattgagaagatggaaagaaaaacctttgaaaaagaaaagaagataaaacatgagcataagtcagaaaaagacaaattagatcttagtgaatgtgttgataaaataaaagaaaaggacaagctatattcgcatcacacagaaaaatgccataaagaaggtgagaagagcaaaaatactgctgctattaaaaaaactgacgacagagagaaaagtagagaaaagatggataggaaacatgacaaagaaaagcctgaaaaagagaggcatctagcagaaagcaaagaaaagcacttgatggagaaaaaaaataaacaatcagataatagtgaatacagtaaatcagaaaaaggcaaaaataaagaaaaagacagggagctagataaaaaggaaaaatctagagataaagaaagtataaatataactaactccaaacacatacaggaagaaaaaaaatcaagtatagtagacggtaataaagcacaacatgaaaaacccttatcccttaaagaaaaaacaaaagatgaacctttgaaaactccagatggaaaagaaaaagataaaaaagataaagatatagatagatacaaagaacgagacaaacataaagataaaattcaaataaatagcttactcaaactaaaatctgaagcagataagcctaaacctaagtcatcaccagcatcaaaagatacccgacctaaagaaaagaggttagtgaatgatgatttaatgcagacaagttttgaacgaatgctaagccttaaagacctagaaatagaacagtggcacaaaaaacataaggaaaaaattaagcaaaaagaaaaggaacggttgagaaaccgaaactgtttagaacttaaaataaaagataaagaaaaaacaaagcatacaccaactgaatccaaaaataaagaacttactaggtcaaagagttcagaagtgactgatgcatataccaaggagaaacaacctaaagatgctgtaagtaacagatcacaatctgttgacaccaaaaatgtaatgactttagggaagtcatcttttgtttcagataatagcttaaacaggtctcctagatcagaaaatgaaaagccgggtctcagctccagatctgtatccatgatttctgttgctagttcagaagattcctgccatactacagtgacaaccccaaggcctccagttgagtatgactctgactttatgttagagagttcagaatcccaaatgtccttttcccagtcaccttttttgtcaattgccaaatctcctgctcttcatgaaagggaattggacagcctggctgacttgccggagcggattaaaccaccatatgcaaacagactttcaacatcccatcttaggtcatcttctgtagaagatgttaaactaattataagcgaggggagacctaccatagaagttcgaagatgtagcatgccttctgtcatttgtgaacataccaaacaattccaaacaatatcagaagagagcaatcaaggtagcttattaactgtgccaggagatactagtccttctcccaaacctgaggtattctcaaatgtgcctgaaagagacctttcaaatgtatctaacatacattccagttttgcaacttctccaactggagcttcaaacagcaagtatgtttcagctgatagaaatctcatcaagaatactgccccagtgaacactgtaatggacagtccagtgcatttagagccatctagtcaggttggtgtgatccagaataaatcatgggagatgcctgttgatagactagagacattaagcaccagagactttatctgcccaaattctaacatacctgatcaagaatcctctcttcagagtttttgtaattctgaaaataaggtattgaaagaaaatgctgattttttatccctgcgccagactgaactgccaggaaactcttgtgctcaggatccggcatcctttatgcctccacagcagccttgctctttccccagccaatcactttcagatgctgaatcgatttctaaacatatgtctttgtcatatgttgctaatcaagagccaggtattttacaacaaaaaaatgcagttcagattattagttctgctttagatactgataatgaatctacaaaagatacagaaaatacttttgtcctaggagatgttcaaaaaacagatgcctttgtcccagtgtactctgacagcactattcaagaagcatcaccaaactttgagaaagcttatactttacctgtgttaccatcagaaaaggactttaatggaagtgatgcctctacccagctaaatacacattatgcatttagcaaactaacttacaagtcttccagtggccatgaagttgagaatagcacaactgatactcaggtcatttcacatgaaaaagaaaacaaactggagagtttggttttaactcatttgagtaggtgtgattctgatttatgtgaaatgaatgcagggatgccaaaaggaaacctaaatgaacaagatccaaaacattgtcctgaaagtgaaaagtgtttgctttccatagaagatgaggaatctcaacaaagcattttatcaagtctggaaaaccattcacagcagtcaactcaaccagaaatgcataaatatggtcagttagttaaagtagaattagaagaaaatgccgaagatgataaaactgaaaaccaaatccctcaaagaatgactagaaacaaagcaaatacaatggcaaatcaaagcaaacagattcttgctagctgtacactattatcagaaaaagacagtgaatcctcatctcctagaggaagaataagattaactgaagatgacgatcctcaaattcaccatccacggaaaaggaaagtgtcacgtgtacctcagcctgtgcaagtgagtccctctttactacaagcaaaagagaaaactcagcaatctctggcagccattgtagattctctaaaactagatgagattcagccatacagttcagagagagcaaatccatattttgaatacttgcacataaggaaaaaaatagaagaaaaacgcaaattactgtgtagtgtgattcctcaagcacctcagtactatgacgaatatgtaacatttaacggatcatatctcctggatggaaaccccttaagcaagatttgtattcccacaattacaccaccaccttcactgtcagatccacttaaagagctttttcgacaacaggaagttgtaaggatgaaactacgtttgcaacacagtattgaaagggaaaaactcattgtatccaacgaacaagaagttttgcgagttcattacagagctgcaagaacattggcaaatcaaacactgccatttagtgcttgtactgttttgctggatgccgaagtatacaatgtaccattggactctcagtctgatgacagtaaaacttctgtgagggatcgctttaatgcaagacaattcatgtcttggttacaagatgtggatgataaatttgacaaattaaagacctgtcttttaatgaggcaacaacatgaagctgcggctttaaatgctgtccagaggttagaatggcagctcaaactccaggaacttgatcctgccacctataaatctatcagcatttacgaaatccaggagttttatgttccccttgttgatgttaacgacgactttgaattgactcctatatagcagtcagtacttcctgatggtattgtcctaaactggtgatgctcaagcattatactgtggaatactgccttttgacaaaaatactcatgcctttacaattgttagtaaagttcgattatagttggttatgtagtaaacactgtcattttataaaaaatgagaattattttggatcttagatccaaacacagtttctaatagaaaactattatttatattgggaaaggtaactattgcattagagcatgttggcagactggtaggtatttaaaaagttgagaatctgctaacagcgctggaagttgttagcgctctaagtaataagataaccactagtattcaaatctctttcaggttttattaaaaaatatatatcaataaactaaaaggttcaattcctaccaaatagtttctaatgtgggagaaaaacttggcacaaaatttcttcagtttattatctgtaaattgtacagttttctttttgaaagttttaatattgtcttcctttttaataacttattttatacatattgtgcagatgtaaatcttgtaattaatggtcaaactgtataaagggattggtagtcaaaacatgtacaaagaaatacctgtaaaactgttttgtctcatgttttattggaccaaagttgtggtttgtatggagtgtagtagtagtgtgtacaggtagaaaacttttaaatacagcatgcaggtgtttcagttagcttgttttcatcaccataactgcaaagatgtggcttagttgtattgcatgcttcctataatttaactctccataattgatgcctgcagtagtgtaaggcatttcatactagtctcctctagtagacctgtgacttactgtgttggacatattatttagacttagtcatacaaagaaacttagctcttttttcatctcacagtaaagcctatttccccaggaaaaaaataaatgcctttgaatgaaaattctgaaattgtaaatgtctattttaatattcacctatgaaagaatctgtgaatatatgtaaatacgtttaataaattttattggtcatgttaaatcattgtaaaacttttttacattgcttaatgttttaagcttaatagcctttgcacttttaaaataaaaaccaagtatgcaaatcaaagatatttggtagtcaaaataagtaaaagaaatataggaatattccagtcaatctctgaaatgtttatgaaaaacaggttaatatgttgtatttttttccttgtatcaagatgcaaaacataatttgcaaaattttataattgaaataaaacttggtatgctgttttataataaattagcaatatactttaaaaaaaatccagtttctcctataacatgatgtaaattaaatattcaggaatatttcaggtctgaaatctgctgctgaacttgttagacatttttgaaaggaaaattaggttagcgtacaatttatcataaatatatgaggtaaaatttgcaaaactttccacagtactttcttgaattataatactgaatgttttctgttccgatagagaaaagtgaagcaaatatgtgaggaatgaagtgatctagtgcaagttggtaattccagctaatgggagagaatgtaaatgtgcaaaggtacatattaagcttagggatttttgaatttttacgtcagtttatattttaattcttactgtacttggcatgcgcaataaagcagcacatgtaaaaaaaaaatacacagtgcaaggactttattataaaggttggatgtagttttccttagaaatttaggtgagagattttggccttttttattggataaattgggccagaaaggcagggtagatttcgaagcactggttctgttgaagttaagtttattaagcctgggaacattaaaagctaatttataaaagcaatactttttaatatgaaaacttactgcaaagtttgtttatacttttgcctaaaaaggaaattggatgggatactgtggcaaatcataaaaaaccagataattgaactttgaagttatagaaaatcagagaggggtaagtttatagggcattttgttctgatggttcaaccagaggtctgggaaatagcactgttggcccaaacagaacaggcttttagaagataaaagcgacaagaaggaatctggtgaattttagtcatcccagctttttagtcttaaccacagttctcactctcttaaatggtacctcaaaaagctggagcctctctgccatgattatgcttctacaaatttcttttataaagagactcaaagctaatgatagcttaaaagaaaagttaatgccttctcattggaaatgtataatcaaataagtagttaagggcttttggtattaaagatattctgaagctctgaaatgctagaaaaaaatttggaatggagtatatgcctgaaaaggttttggattcagaaagaaaaaggatggttagtttaatcagtgattctttttaaactcttcaaatatcatgaacaagatactaaattgtacctaaggatttgtatttctttacaatttgttctaaatatctgtttaatgactagttgatatttgtgcatgttatttaataaagagttatatttttatagaaaaaaaagtgaaa

SEQ ID NO: 448886 - DNA, 8519 bp, Homo sapiens
  misc_feature (77)..(77): n is a, c, g, or t
  misc_feature (92)..(92): n is a, c, g, or t
  misc_feature (105)..(105): n is a, c, g, or t
cctgaatagaagtgcatctgttttcgctcagagagtggataccaaaaagaatgctaactggtgtggatttcttattnccagcttcctttttngtcttcttctttngcaaatgacagcaagagacaacagtccagattccacaccaaatcatccatcacaaacaacgcctgcccaaaagaaaactcccagttcttcatctcgacagaaagataaagttaataaaagaaatgaacgtggtgaaactcctttacacatggctgctattcgaggagatgtgaaacaagttaaagaattaataagtttaggggcaaatgtgaatgtgaaagattttgcaggttggacaccactgcatgaagcttgcaatgttggatattacgatgttgctaagatacttatagcagctggagcagatgttaacacacaaggattagatgatgacactccactccatgattctgctagtagtgggcacagagatatagtaaagctgttacttcgtcacggtggaaatccatttcaagctaataaacatggggagcgtccagtggatgtagcagaaacagaggagttggagttgctactaaaaagagaggtgcctttatctgatgatgatgaaagttacacagattccgaagaggctcaatctgtaaatccttctagtgttgatgaaaatattgactctgaaacagagaaagactctctcatctgtgaaagtaaacagatacttcccagtaaaacacctcttccatctgcccttgatgagtatgagttcaaagatgatgatgatgaagaaattaataagatgattgatgataggcatattcttaggaaagaacaacgaaaagaaaatgaacctgaagcagaaaaaactcatttatttgcaaaacaggagaaagccttctatcctaaatcatttaaaagtaaaaaacaaaagccatctagggtcttatattcaagtactgaaagttctgatgaagaagctcttcagaataaaaagatttctacttcatgttccgtcatccctgaaacatcaaattctgatatgcaaaccaaaaaggaatatgtagtttcaggtgaacacaaacagaaaggcaaagttaaaagaaaattgaaaaatcagaataaaaataaagagaaccaagagctaaagcaagaaaaggaaggaaaagaaaatacaagaataacaaacttgacagtaaatactggactagattgttcagaaaagaccagagaggaggggaactttaggaaatcttttagcccaaaagatgatacttcattacatttatttcatatttccactggtaaatctcccaaacattcttgtggattaagtgaaaaacagtcaacaccactaaaacaagaacatactaaaacatgtttatcaccaggaagttctgaaatgtcattacagcctgatcttgttcggtatgataatacagaatctgaattcttgccagaaagttcaagtgtaaaatcttgtaagcataaggaaaaaagcaaacatcagaaagatttccacttagaatttggtgaaaaatcaaatgccaaaataaaggatgaagatcatagtccaacatttgaaaattcagattgcacactgaaaaaaatggataaagaaggtaaaacattaaaaaaacataaattgaagcataaagagagggaaaaagaaaagcataaaaaagaaattgaaggtgaaaaggaaaaatacaaaactaaggatagtgccaaagaactgcagaggagtgtggaatttgatagagaattttggaaagagaatttttttaaaagtgatgaaactgaagatctctttttaaatatggaacatgaatccttaacattagaaaaaaaatcaaaattggaaaaaaacatcaaagatgataaatcaaccaaggaaaagcatgtgtcaaaagagaggaactttaaagaggaacgagacaagattaaaaaggaaagcgagaaatcttttagggaggaaaaaataaaagatctaaaagaagagagagaaaacatacccacagataaagactcagaatttacttctttgggtatgagtgccattgaggaatctatagggcttcatttagtggaaaaggaaatagacattgaaaaacaagaaaagcatataaaggaaagtaaagaaaaacctgagaagcgatctcaaattaaagaaaaggacattgagaagatggaaagaaaaacctttgaaaaagaaaagaagataaaacatgagcataagtcagaaaaagacaaattagatcttagtgaatgtgttgataaaataaaagaaaaggacaagctatattcgcatcacacagaaaaatgccataaagaaggtgagaagagcaaaaatactgctgctattaaaaaaactgacgacagagagaaaagtagagaaaagatggataggaaacatgacaaagaaaagcctgaaaaagagaggcatctagcagaaagcaaagaaaagcacttgatggagaaaaaaaataaacaatcagataatagtgaatacagtaaatcagaaaaaggcaaaaataaagaaaaagacagggagctagataaaaaggaaaaatctagagataaagaaagtataaatataactaactccaaacacatacaggaagaaaaaaaatcaagtatagtagacggtaataaagcacaacatgaaaaacccttatcccttaaagaaaaaacaaaagatgaacctttgaaaactccagatggaaaagaaaaagataaaaaagataaagatatagatagatacaaagaacgagacaaacataaagataaaattcaaataaatagcttactcaaactaaaatctgaagcagataagcctaaacctaagtcatcaccagcatcaaaagatacccgacctaaagaaaagaggttagtgaatgatgatttaatgcagacaagttttgaacgaatgctaagccttaaagacctagaaatagaacagtggcacaaaaaacataaggaaaaaattaagcaaaaagaaaaggaacggttgagaaaccgaaactgtttagaacttaaaataaaagataaagaaaaaacaaagcatacaccaactgaatccaaaaataaagaacttactaggtcaaagagttcagaagtgactgatgcatataccaaggagaaacaacctaaagatgctgtaagtaacagatcacaatctgttgacaccaaaaatgtaatgactttagggaagtcatcttttgtttcagataatagcttaaacaggtctcctagatcagaaaatgaaaagccgggtctcagctccagatctgtatccatgatttctgttgctagttcagaagattcctgccatactacagtgacaaccccaaggcctccagttgagtatgactctgactttatgttagagagttcagaatcccaaatgtccttttcccagtcaccttttttgtcaattgccaaatctcctgctcttcatgaaagggaattggacagcctggctgacttgccggagcggattaaaccaccatatgcaaacagactttcaacatcccatcttaggtcatcttctgtagaagatgttaaactaattataagcgaggggagacctaccatagaagttcgaagatgtagcatgccttctgtcatttgtgaacataccaaacaattccaaacaatatcagaagagagcaatcaaggtagcttattaactgtgccaggagatactagtccttctcccaaacctgaggtattctcaaatgtgcctgaaagagacctttcaaatgtatctaacatacattccagttttgcaacttctccaactggagcttcaaacagcaagtatgtttcagctgatagaaatctcatcaagaatactgccccagtgaacactgtaatggacagtccagtgcatttagagccatctagtcaggttggtgtgatccagaataaatcatgggagatgcctgttgatagactagagacattaagcaccagagactttatctgcccaaattctaacatacctgatcaagaatcctctcttcagagtttttgtaattctgaaaataaggtattgaaagaaaatgctgattttttatccctgcgccagactgaactgccaggaaactcttgtgctcaggatccggcatcctttatgcctccacagcagccttgctctttccccagccaatcactttcagatgctgaatcgatttctaaacatatgtctttgtcatatgttgctaatcaagagccaggtattttacaacaaaaaaatgcagttcagattattagttctgctttagatactgataatgaatctacaaaagatacagaaaatacttttgtcctaggagatgttcaaaaaacagatgcctttgtcccagtgtactctgacagcactattcaagaagcatcaccaaactttgagaaagcttatactttacctgtgttaccatcagaaaaggactttaatggaagtgatgcctctacccagctaaatacacattatgcatttagcaaactaacttacaagtcttccagtggccatgaagttgagaatagcacaactgatactcaggtcatttcacatgaaaaagaaaacaaactggagagtttggttttaactcatttgagtaggtgtgattctgatttatgtgaaatgaatgcagggatgccaaaaggaaacctaaatgaacaagatccaaaacattgtcctgaaagtgaaaagtgtttgctttccatagaagatgaggaatctcaacaaagcattttatcaagtctggaaaaccattcacagcagtcaactcaaccagaaatgcataaatatggtcagttagttaaagtagaattagaagaaaatgccgaagatgataaaactgaaaaccaaatccctcaaagaatgactagaaacaaagcaaatacaatggcaaatcaaagcaaacagattcttgctagctgtacactattatcagaaaaagacagtgaatcctcatctcctagaggaagaataagattaactgaagatgacgatcctcaaattcaccatccacggaaaaggaaagtgtcacgtgtacctcagcctgtgcaagtgagtccctctttactacaagcaaaagagaaaactcagcaatctctggcagccattgtagattctctaaaactagatgagattcagccatacagttcagagagagcaaatccatattttgaatacttgcacataaggaaaaaaatagaagaaaaacgcaaattactgtgtagtgtgattcctcaagcacctcagtactatgacgaatatgtaacatttaacggatcatatctcctggatggaaaccccttaagcaagatttgtattcccacaattacaccaccaccttcactgtcagatccacttaaagagctttttcgacaacaggaagttgtaaggatgaaactacgtttgcaacacagtattgaaagggaaaaactcattgtatccaacgaacaagaagttttgcgagttcattacagagctgcaagaacattggcaaatcaaacactgccatttagtgcttgtactgttttgctggatgccgaagtatacaatgtaccattggactctcagtctgatgacagtaaaacttctgtgagggatcgctttaatgcaagacaattcatgtcttggttacaagatgtggatgataaatttgacaaattaaagacctgtcttttaatgaggcaacaacatgaagctgcggctttaaatgctgtccagaggttagaatggcagctcaaactccaggaacttgatcctgccacctataaatctatcagcatttacgaaatccaggagttttatgttccccttgttgatgttaacgacgactttgaattgactcctatatagcagtcagtacttcctgatggtattgtcctaaactggtgatgctcaagcattatactgtggaatactgccttttgacaaaaatactcatgcctttacaattgttagtaaagttcgattatagttggttatgtagtaaacactgtcattttataaaaaatgagaattattttggatcttagatccaaacacagtttctaatagaaaactattatttatattgggaaaggtaactattgcattagagcatgttggcagactggtaggtatttaaaaagttgagaatctgctaacagcgctggaagttgttagcgctctaagtaataagataaccactagtattcaaatctctttcaggttttattaaaaaatatatatcaataaactaaaaggttcaattcctaccaaatagtttctaatgtgggagaaaaacttggcacaaaatttcttcagtttattatctgtaaattgtacagttttctttttgaaagttttaatattgtcttcctttttaataacttattttatacatattgtgcagatgtaaatcttgtaattaatggtcaaactgtataaagggattggtagtcaaaacatgtacaaagaaatacctgtaaaactgttttgtctcatgttttattggaccaaagttgtggtttgtatggagtgtagtagtagtgtgtacaggtagaaaacttttaaatacagcatgcaggtgtttcagttagcttgttttcatcaccataactgcaaagatgtggcttagttgtattgcatgcttcctataatttaactctccataattgatgcctgcagtagtgtaaggcatttcatactagtctcctctagtagacctgtgacttactgtgttggacatattatttagacttagtcatacaaagaaacttagctcttttttcatctcacagtaaagcctatttccccaggaaaaaaataaatgcctttgaatgaaaattctgaaattgtaaatgtctattttaatattcacctatgaaagaatctgtgaatatatgtaaatacgtttaataaattttattggtcatgttaaatcattgtaaaacttttttacattgcttaatgttttaagcttaatagcctttgcacttttaaaataaaaaccaagtatgcaaatcaaagatatttggtagtcaaaataagtaaaagaaatataggaatattccagtcaatctctgaaatgtttatgaaaaacaggttaatatgttgtatttttttccttgtatcaagatgcaaaacataatttgcaaaattttataattgaaataaaacttggtatgctgttttataataaattagcaatatactttaaaaaaaatccagtttctcctataacatgatgtaaattaaatattcaggaatatttcaggtctgaaatctgctgctgaacttgttagacatttttgaaaggaaaattaggttagcgtacaatttatcataaatatatgaggtaaaatttgcaaaactttccacagtactttcttgaattataatactgaatgttttctgttccgatagagaaaagtgaagcaaatatgtgaggaatgaagtgatctagtgcaagttggtaattccagctaatgggagagaatgtaaatgtgcaaaggtacatattaagcttagggatttttgaatttttacgtcagtttatattttaattcttactgtacttggcatgcgcaataaagcagcacatgtaaaaaaaaaatacacagtgcaaggactttattataaaggttggatgtagttttccttagaaatttaggtgagagattttggccttttttattggataaattgggccagaaaggcagggtagatttcgaagcactggttctgttgaagttaagtttattaagcctgggaacattaaaagctaatttataaaagcaatactttttaatatgaaaacttactgcaaagtttgtttatacttttgcctaaaaaggaaattggatgggatactgtggcaaatcataaaaaaccagataattgaactttgaagttatagaaaatcagagaggggtaagtttatagggcattttgttctgatggttcaaccagaggtctgggaaatagcactgttggcccaaacagaacaggcttttagaagataaaagcgacaagaaggaatctggtgaattttagtcatcccagctttttagtcttaaccacagttctcactctcttaaatggtacctcaaaaagctggagcctctctgccatgattatgcttctacaaatttcttttataaagagactcaaagctaatgatagcttaaaagaaaagttaatgccttctcattggaaatgtataatcaaataagtagttaagggcttttggtattaaagatattctgaagctctgaaatgctagaaaaaaatttggaatggagtatatgcctgaaaaggttttggattcagaaagaaaaaggatggttagtttaatcagtgattctttttaaactcttcaaatatcatgaacaagatactaaattgtacctaaggatttgtatttctttacaatttgttctaaatatctgtttaatgactagttgatatttgtgcatgttatttaataaagagttatatttttatagaaaaaaaagtgaaa

SEQ ID NO: 448887 - DNA, 6259 bp, Homo sapiens
caaaagtgcctcttctatatctacacaacacccgacaagctatattcgcatcacacagaaaaatgccataaagaaggtgagaagagcaaaaatactgctgctattaaaaaaactgacgacagagagaaaagtagagaaaagatggataggaaacatgacaaagaaaagcctgaaaaagagaggcatctagcagaaagcaaagaaaagcacttgatggagaaaaaaaataaacaatcagataatagtgaatacagtaaatcagaaaaaggcaaaaataaagaaaaagacagggagctagataaaaaggaaaaatctagagataaagaaagtataaatataactaactccaaacacatacaggaagaaaaaaaatcaagtatagtagacggtaataaagcacaacatgaaaaacccttatcccttaaagaaaaaacaaaagatgaacctttgaaaactccagatggaaaagaaaaagataaaaaagataaagatatagatagatacaaagaacgagacaaacataaagataaaattcaaataaatagcttactcaaactaaaatctgaagcagataagcctaaacctaagtcatcaccagcatcaaaagatacccgacctaaagaaaagaggttagtgaatgatgatttaatgcagacaagttttgaacgaatgctaagccttaaagacctagaaatagaacagtggcacaaaaaacataaggaaaaaattaagcaaaaagaaaaggaacggttgagaaaccgaaactgtttagaacttaaaataaaagataaagaaaaaacaaagcatacaccaactgaatccaaaaataaagaacttactaggtcaaagagttcagaagtgactgatgcatataccaaggagaaacaacctaaagatgctgtaagtaacagatcacaatctgttgacaccaaaaatgtaatgactttagggaagtcatcttttgtttcagataatagcttaaacaggtctcctagatcagaaaatgaaaagccgggtctcagctccagatctgtatccatgatttctgttgctagttcagaagattcctgccatactacagtgacaaccccaaggcctccagttgagtatgactctgactttatgttagagagttcagaatcccaaatgtccttttcccagtcaccttttttgtcaattgccaaatctcctgctcttcatgaaagggaattggacagcctggctgacttgccggagcggattaaaccaccatatgcaaacagactttcaacatcccatcttaggtcatcttctgtagaagatgttaaactaattataagcgaggggagacctaccatagaagttcgaagatgtagcatgccttctgtcatttgtgaacataccaaacaattccaaacaatatcagaagagagcaatcaaggtagcttattaactgtgccaggagatactagtccttctcccaaacctgaggtattctcaaatgtgcctgaaagagacctttcaaatgtatctaacatacattccagttttgcaacttctccaactggagcttcaaacagcaagtatgtttcagctgatagaaatctcatcaagaatactgccccagtgaacactgtaatggacagtccagtgcatttagagccatctagtcaggttggtgtgatccagaataaatcatgggagatgcctgttgatagactagagacattaagcaccagagactttatctgcccaaattctaacatacctgatcaagaatcctctcttcagagtttttgtaattctgaaaataaggtattgaaagaaaatgctgattttttatccctgcgccagactgaactgccaggaaactcttgtgctcaggatccggcatcctttatgcctccacagcagccttgctctttccccagccaatcactttcagatgctgaatcgatttctaaacatatgtctttgtcatatgttgctaatcaagagccaggtattttacaacaaaaaaatgcagttcagattattagttctgctttagatactgataatgaatctacaaaagatacagaaaatacttttgtcctaggagatgttcaaaaaacagatgcctttgtcccagtgtactctgacagcactattcaagaagcatcaccaaactttgagaaagcttatactttacctgtgttaccatcagaaaaggactttaatggaagtgatgcctctacccagctaaatacacattatgcatttagcaaactaacttacaagtcttccagtggccatgaagttgagaatagcacaactgatactcaggtcatttcacatgaaaaagaaaacaaactggagagtttggttttaactcatttgagtaggtgtgattctgatttatgtgaaatgaatgcagggatgccaaaaggaaacctaaatgaacaagatccaaaacattgtcctgaaagtgaaaagtgtttgctttccatagaagatgaggaatctcaacaaagcattttatcaagtctggaaaaccattcacagcagtcaactcaaccagaaatgcataaatatggtcagttagttaaagtagaattagaagaaaatgccgaagatgataaaactgaaaaccaaatccctcaaagaatgactagaaacaaagcaaatacaatggcaaatcaaagcaaacagattcttgctagctgtacactattatcagaaaaagacagtgaatcctcatctcctagaggaagaataagattaactgaagatgacgatcctcaaattcaccatccacggaaaaggaaagtgtcacgtgtacctcagcctgtgcaagtgagtccctctttactacaagcaaaagagaaaactcagcaatctctggcagccattgtagattctctaaaactagatgagattcagccatacagttcagagagagcaaatccatattttgaatacttgcacataaggaaaaaaatagaagaaaaacgcaaattactgtgtagtgtgattcctcaagcacctcagtactatgacgaatatgtaacatttaacggatcatatctcctggatggaaaccccttaagcaagatttgtattcccacaattacaccaccaccttcactgtcagatccacttaaagagctttttcgacaacaggaagttgtaaggatgaaactacgtttgcaacacagtattgaaagggaaaaactcattgtatccaacgaacaagaagttttgcgagttcattacagagctgcaagaacattggcaaatcaaacactgccatttagtgcttgtactgttttgctggatgccgaagtatacaatgtaccattggactctcagtctgatgacagtaaaacttctgtgagggatcgctttaatgcaagacaattcatgtcttggttacaagatgtggatgataaatttgacaaattaaagacctgtcttttaatgaggcaacaacatgaagctgcggctttaaatgctgtccagaggttagaatggcagctcaaactccaggaacttgatcctgccacctataaatctatcagcatttacgaaatccaggagttttatgttccccttgttgatgttaacgacgactttgaattgactcctatatagcagtcagtacttcctgatggtattgtcctaaactggtgatgctcaagcattatactgtggaatactgccttttgacaaaaatactcatgcctttacaattgttagtaaagttcgattatagttggttatgtagtaaacactgtcattttataaaaaatgagaattattttggatcttagatccaaacacagtttctaatagaaaactattatttatattgggaaaggtaactattgcattagagcatgttggcagactggtaggtatttaaaaagttgagaatctgctaacagcgctggaagttgttagcgctctaagtaataagataaccactagtattcaaatctctttcaggttttattaaaaaatatatatcaataaactaaaaggttcaattcctaccaaatagtttctaatgtgggagaaaaacttggcacaaaatttcttcagtttattatctgtaaattgtacagttttctttttgaaagttttaatattgtcttcctttttaataacttattttatacatattgtgcagatgtaaatcttgtaattaatggtcaaactgtataaagggattggtagtcaaaacatgtacaaagaaatacctgtaaaactgttttgtctcatgttttattggaccaaagttgtggtttgtatggagtgtagtagtagtgtgtacaggtagaaaacttttaaatacagcatgcaggtgtttcagttagcttgttttcatcaccataactgcaaagatgtggcttagttgtattgcatgcttcctataatttaactctccataattgatgcctgcagtagtgtaaggcatttcatactagtctcctctagtagacctgtgacttactgtgttggacatattatttagacttagtcatacaaagaaacttagctcttttttcatctcacagtaaagcctatttccccaggaaaaaaataaatgcctttgaatgaaaattctgaaattgtaaatgtctattttaatattcacctatgaaagaatctgtgaatatatgtaaatacgtttaataaattttattggtcatgttaaatcattgtaaaacttttttacattgcttaatgttttaagcttaatagcctttgcacttttaaaataaaaaccaagtatgcaaatcaaagatatttggtagtcaaaataagtaaaagaaatataggaatattccagtcaatctctgaaatgtttatgaaaaacaggttaatatgttgtatttttttccttgtatcaagatgcaaaacataatttgcaaaattttataattgaaataaaacttggtatgctgttttataataaattagcaatatactttaaaaaaaatccagtttctcctataacatgatgtaaattaaatattcaggaatatttcaggtctgaaatctgctgctgaacttgttagacatttttgaaaggaaaattaggttagcgtacaatttatcataaatatatgaggtaaaatttgcaaaactttccacagtactttcttgaattataatactgaatgttttctgttccgatagagaaaagtgaagcaaatatgtgaggaatgaagtgatctagtgcaagttggtaattccagctaatgggagagaatgtaaatgtgcaaaggtacatattaagcttagggatttttgaatttttacgtcagtttatattttaattcttactgtacttggcatgcgcaataaagcagcacatgtaaaaaaaaaatacacagtgcaaggactttattataaaggttggatgtagttttccttagaaatttaggtgagagattttggccttttttattggataaattgggccagaaaggcagggtagatttcgaagcactggttctgttgaagttaagtttattaagcctgggaacattaaaagctaatttataaaagcaatactttttaatatgaaaacttactgcaaagtttgtttatacttttgcctaaaaaggaaattggatgggatactgtggcaaatcataaaaaaccagataattgaactttgaagttatagaaaatcagagaggggtaagtttatagggcattttgttctgatggttcaaccagaggtctgggaaatagcactgttggcccaaacagaacaggcttttagaagataaaagcgacaagaaggaatctggtgaattttagtcatcccagctttttagtcttaaccacagttctcactctcttaaatggtacctcaaaaagctggagcctctctgccatgattatgcttctacaaatttcttttataaagagactcaaagctaatgatagcttaaaagaaaagttaatgccttctcattggaaatgtataatcaaataagtagttaagggcttttggtattaaagatattctgaagctctgaaatgctagaaaaaaatttggaatggagtatatgcctgaaaaggttttggattcagaaagaaaaaggatggttagtttaatcagtgattctttttaaactcttcaaatatcatgaacaagatactaaattgtacctaaggatttgtatttctttacaatttgttctaaatatctgtttaatgactagttgatatttgtgcatgttatttaataaagagttatatttttatagaaaaaaaagtgaaa

SEQ ID NO: 448888 - DNA, 2610 bp, Homo sapiens
gggggcgacgctgtcctgggagcgaggaggctgtggtgagagacggaccgagaccggagatgttttcaagcccggctccggcggctttacaggcggctgcagcggcgacgaagacaacgacagcgacggctacgccgaagcactcgttccgggggtgaagcctcctgcgccggccttgcctcggatccaggatgagaagactgataaaagaagaagctagctgaacagctgtaaaatgcccaaatctgggttcacaaaaccaattcagagtgaaaattctgacagtgacagcaatatggtagagaaaccatatggaagaaagagtaaagacaagattgcatcctacagcaaaactccaaaaattgaacgaagtgatgtgagcaaggagatgaaagagaaatcatccatgaaacgtaaacttccttttactattagcccatcaagaaatgaagaacgagattcagacacagagaaagaaggtccagaaaagaagaagacaaaaaaggaagctggaaataagaaatccacaccagttagcattctttttggttatccactctctgagcgaaaacagatggcacttcttatgcagatgacagcaagagacaacagtccagattccacaccaaatcatccatcacaaacaacgcctgcccaaaagaaaactcccagttcttcatctcgacagaaagataaagttaataaaagaaatgaacgtggtgaaactcctttacacatggctgctattcgaggagatgtgaaacaagttaaagaattaataagtttaggggcaaatgtgaatgtgaaagattttgcaggttggacaccactgcatgaagcttgcaatgttggatattacgatgttgctaagatacttatagcagctggagcagatgttaacacacaaggattagatgatgacactccactccatgattctgctagtagtgggcacagagatatagtaaagctgttacttcgtcacggtggaaatccatttcaagctaataaacatggggagcgtccagtggatgtagcagaaacagaggagttggagttgctactaaaaagagaggtgcctttatctgatgatgatgaaagttacacagattccgaagaggctcaatctgtaaatccttctagtgttgatgaaaatattgactctgaaacagagaaagactctctcatctgtgaaagtaaacagatacttcccagtaaaacacctcttccatctgcccttgatgagtatgagttcaaagatgatgatgatgaagaaattaataagatgattgatgataggcatattcttaggaaagaacaacgaaaagaaaatgaacctgaagcagaaaaaactcatttatttgcaaaacaggagaaagccttctatcctaaatcatttaaaagtaaaaaacaaaagccatctagggtcttatattcaagtactgaaagttctgatgaagaagctcttcagaataaaaagatttctacttcatgttccgtcatccctgaaacatcaaattctgatatgcaaaccaaaaaggaatatgtagtttcaggtgaacacaaacagaaaggcaaagttaaaagaaaattgaaaaatcagaataaaaataaagagaaccaagagctaaagcaagaaaaggaaggaaaagaaaatacaagaataacaaacttgacagtaaatactggactagattgttcagaaaagaccagagaggaggggaactttaggaaatcttttagcccaaaagatgatacttcattacatttatttcatatttccactggtaaatctcccaaacattcttgtggattaagtgaaaaacagtcaacaccactaaaacaagaacatactaaaacatgtttatcaccaggaagttctgaaatgtcattacagcctgatcttgttcggtatgataatacagaatctgaattcttgccagaaagttcaagtgtaaaatcttgtaagcataaggaaaaaagcaaacatcagaaagatttccacttagaatttggtgaaaaatcaaatgccaaaataaaggatgaagatcatagtccaacatttgaaaattcagattgcacactgaaaaaaatggataaagaaggtaaaacattaaaaaaacataaattgaagcataaagagagggaaaaagaaaagcataaaaaagaaattgaaggtgaaaaggaaaaatacaaaactaaggatagtgccaaagaactgcagaggagtgtggaatttgatagagaattttggaaagagaatttttttaaaagtgatgaaactgaagatctctttttaaatatggaacatgaatccttaacattagaaaaaaaatcaaaattggaaaaaaacatcaaagatgataaatcaaccaaggaaaagcatgtgtcaaaagagaggaactttaaagaggaacgagacaagattaaaaaggaaagcgagaaatcttttagggaggaaaaaataaaagatctaaaagaagagagagaaaacatacccacagataaagactcagaatttacttctttgggtatgagtgccattgaggaatctatagggcttcatttagtggaaaaggaaatagacattgaaaaacaagaaaagcatat

SEQ ID NO: 448889 - DNA, 2933 bp, Homo sapiens
tcctggcctcgggacagcctgcacagctgcctagcctgtggagacgggacagccctgtcccactcactctttcccctgccgctcctgccggcagctccaaccatgggaggccgcgtctttctcgcattctgtgtctggctgactctgccgggagctgaaacccaggactccaggggctgtgcccggtggtgccctcagaactcctcgtgtgtcaatgccaccgcctgtcgctgcaatccagggttcagctctttttctgagatcatcaccaccccgacggagacttgtgacgacatcaacgagtgtgcaacaccgtcgaaagtgtcatgcggaaaattctcggactgctggaacacagaggggagctacgactgcgtgtgcagcccgggatatgagcctgtttctggggcaaaaacattcaagaatgagagcgagaacacctgtcaagatgtggacgagtgcagctccgggcagcatcagtgtgacagctccaccgtctgcttcaacaccgtgggttcatacagctgccgctgccgcccaggctggaagcccagacacggaatcccgaataaccaaaaggacactgtctgtgaagatatgactttctccacctggaccccgccccctggagtccacagccagacgctttcccgattcttcgacaaagtccaggacctgggcagagactccaagacaagctcagccgaggtcaccatccagaatgtcatcaaattggtggatgaactgatggaagctcctggagacgtagaggccctggcgccacctgtccggcacctcatagccacccagctgctctcaaaccttgaagatatcatgaggatcctggccaagagcctgcctaaaggccccttcacctacatttccccttcgaacacagagctgaccctgatgatccaggagcggggggacaagaacgtcactatgggtcagagcagcgcacgcatgaagctgaattgggctgtggcagctggagccgaggatccaggccccgccgtggcgggcatcctctccatccagaacatgacgacattgctggccaatgcctccttgaacctgcattccaagaagcaagccgaactggaggagatatatgaaagcagcatccgtggtgtccaactcagacgcctctctgccgtcaactccatctttctgagccacaacaacaccaaggaactcaactcccccatccttttcgccttctcccaccttgagtcctccgatggggaggcgggaagagaccctcctgccaaggacgtgatgcctgggccacggcaggagctgctctgtgccttctggaagagtgacagcgacaggggagggcactgggccaccgagggctgccaggtgctgggcagcaagaacggcagcaccacctgccaatgcagccacctgagcagctttgcgatccttatggctcattatgacgtggaggactggaagctgaccctgatcaccagggtgggactggcgctgtcactcttctgcctgctgctgtgcatcctcactttcctgctggtgcggcccatccagggctcgcgcaccaccatacacctgcacctctgcatctgcctcttcgtgggctccaccatcttcctggccggcatcgagaacgaaggcggccaggtggggctgcgctgccgcctggtggccgggctgctgcactactgtttcctggccgccttctgctggatgagcctcgaaggcctggagctctactttcttgtggtgcgcgtgttccaaggccagggcctgagtacgcgctggctctgcctgatcggctatggcgtgcccctgctcatcgtgggcgtctcggctgccatctacagcaagggctacggccgccccagatactgctggttggactttgagcagggcttcctctggagcttcttgggacctgtgaccttcatcattttgtgcaatgctgtcattttcgtgactaccgtctggaagctcactcagaagttttctgaaatcaatccagacatgaagaaattaaagaaggcgagggcgctgaccatcacggccatcgcgcagctcttcctgttgggctgcacctgggtctttggcctgttcatcttcgacgatcggagcttggtgctgacctatgtgtttaccatcctcaactgcctgcagggcgccttcctctacctgctgcactgcctgctcaacaagaaggttcgggaagaataccggaagtgggcctgcctagttgctggggggagcaagtactcagaattcacctccaccacgtctggcactggccacaatcagacccgggccctcagggcatcagagtccggcatatgaaggcgcatggttctggacggcccagcagctcctgtggccacagcagctttgtacacgaagaccatccatcctcccttcgtccaccactctactccctccaccctccctccctgatcccgtgtgccaccaggagggagtggcagctatagtctggcaccaaagtccaggacacccagtggggtggagtcggagccactggtcctgctgctggctgcctctctgctccaccttgtgacccagggtggggacaggggctggcccagggctgcaatgcagcatgttgccctggcacctgtggccagtactcgggacagactaagggcgcttgtcccatcctggacttttcctctcatgtctttgctgcagaactgaagagactaggcgctggggctcagcttccctcttaagctaagactgatgtcagaggccccatggcgaggccccttggggccactgcctgaggctcacggtacagaggcctgccctgcctggccgggcaggaggttctcactgttgtgaaggttgtagacgttgtgtaatgtgtttttatctgttaaaatttttcagtgttgacacttaaaattaaacacatgcatacagaa

SEQ ID NO: 448890 - DNA, 376 bp, Homo sapiens
aaaagctacccgcctgagttgagtgtgtccagatgtagtctcgtaacttctcatctgacacatctttgccaacttccttctgcagctgtgttcgccagacaaacgctttcccgattcttcgacaaagtccaggacctgggcagagactccaagacaagctcagccgaggtcaccatccaggtaagggcaggatgctgggggaccccaggacagtgtagaatcagctagcggaggcttccatgtggccagagagagtgcccaacccaagcaggggcctctagtcagagacacacatgcgcataacatacacacaccacatacagtatgtgcacaaacatacacacccggacacgtgaagacacacgcatgcacacac

SEQ ID NO: 448891 - DNA, 510 bp, Homo sapiens
gctcagggggaccccaggcaacagctgatgactcactgggaggaaggcgtttcaccatattcataacctgctcatctgcacggggcccacctgctgtgcccaggcctctccacgcttccataacccagcgtccaccactccaaggggggcactaatgccaggaggaatgagctgggggcacagacaggagacaggaccctctccaggctgggacaggacctgacccccttcttcctgtcctcagatgtggacgagtgcagctccgggcagcatcagtgtgacagctccaccgtctgcttcaacaccgtgggttcatacagctgccgctgccgcccaggctggaagcccagacacggaatcccgaataaccaaaaggacactgtctgtgaagatatgactttctccacctggaccccgccccctggagtccacagccaggtgagtggcccccacagggacgaggcggcgggaactccatccacacagcactgcatccgtctccttgttcta

SEQ ID NO: 448892 - DNA, 401 bp, Homo sapiens
ttttttttttttttttttttttgagagtcttgctctgttgcccaggctggcgtgcagtggcgggatctcagctcactgcaacctctgccttctgtgttcaagcgattctcctgcctcagcctcccaaagtgctgggattacaggcatgagccactatgcctggccacctctcccactcttatgtcaacctcacaagggtaggtacttgtgtgtgccctgttcactgctgtgtctccaaacctgttacattcagtaggcgctcggtcaatactcatctagtaaaaagcagccctcttagactcagcccaagcccaggaccactcaaggacagagatggaagcttgaaccccattcagcagggcccacaggtctctgtccctggtggaaggacaagggatgag

SEQ ID NO: 448893 - DNA, 3418 bp, Homo sapiens
tcctggcctcgggacagcctgcacagctgcctagcctgtggagacgggacagccctgtcccactcactctttcccctgccgctcctgccggcagctccaaccatgggaggccgcgtctttctcgcattctgtgtctggctgactctgccgggagctgaaacccaggactccaggggctgtgcccggtggtgccctcagaactcctcgtgtgtcaatgccaccgcctgtcgctgcaatccagggttcagctctttttctgagatcatcaccaccccgacggagacttgtgacgacatcaacgagtgtgcaacaccgtcgaaagtgtcatgcggaaaattctcggactgctggaacacagaggggagctacgactgcgtgtgcagcccgggatatgagcctgtttctggggcaaaaacattcaagaatgagagcgagaacacctgtcaagatgtggacgaatgtcagcagaacccaaggctctgtaaaagctacggcacctgcgtcaacacccttggcagctatacctgccagtgcctgcctggcttcaagttcatacctgaggatccgaaggtctgcacagatgtggacgagtgcagctccgggcagcatcagtgtgacagctccaccgtctgcttcaacaccgtgggttcatacagctgccgctgccgcccaggctggaagcccagacacggaatcccgaataaccaaaaggacactgtctgtgaagatatgactttctccacctggaccccgccccctggagtccacagccagacgctttcccgattcttcgacaaagtccaggacctgggcagagactccaagacaagctcagccgaggtcaccatccagaatgtcatcaaattggtggatgaactgatggaagctcctggagacgtagaggccctggcgccacctgtccggcacctcatagccacccagctgctctcaaaccttgaagatatcatgaggatcctggccaagagcctgcctaaaggccccttcacctacatttccccttcgaacacagagctgaccctgatgatccaggagcggggggacaagaacgtcactatgggtcagagcagcgcacgcatgaagctgaattgggctgtggcagctggagccgaggatccaggccccgccgtggcgggcatcctctccatccagaacatgacgacattgctggccaatgcctccttgaacctgcattccaagaagcaagccgaactggaggagatatatgaaagcagcatccgtggtgtccaactcagacgcctctctgccgtcaactccatctttctgagccacaacaacaccaaggaactcaactcccccatccttttcgccttctcccaccttgagtcctccgatggggaggcgggaagagaccctcctgccaaggacgtgatgcctgggccacggcaggagctgctctgtgccttctggaagagtgacagcgacaggggagggcactgggccaccgagggctgccaggtgctgggcagcaagaacggcagcaccacctgccaatgcagccacctgagcagctttgcgatccttatggctcattatgacgtggaggactggaagctgaccctgatcaccagggtgggactggcgctgtcactcttctgcctgctgctgtgcatcctcactttcctgctggtgcggcccatccagggctcgcgcaccaccatacacctgcacctctgcatctgcctcttcgtgggctccaccatcttcctggccggcatcgagaacgaaggcggccaggtggggctgcgctgccgcctggtggccgggctgctgcactactgtttcctggccgccttctgctggatgagcctcgaaggcctggagctctactttcttgtggtgcgcgtgttccaaggccagggcctgagtacgcgctggctctgcctgatcggctatggcgtgcccctgctcatcgtgggcgtctcggctgccatctacagcaagggctacggccgccccagatactgctggttggactttgagcagggcttcctctggagcttcttgggacctgtgaccttcatcattttgtgcaatgctgtcattttcgtgactaccgtctggaagctcactcagaagttttctgaaatcaatccagacatgaagaaattaaagaaggcgagggcgctgaccatcacggccatcgcgcagctcttcctgttgggctgcacctgggtctttggcctgttcatcttcgacgatcggagcttggtgctgacctatgtgtttaccatcctcaactgcctgcagggcgccttcctctacctgctgcactgcctgctcaacaagaaggttcgggaagaataccggaagtgggcctgcctagttgctggggggagcaagtactcagaattcacctccaccacgtctggcactggccacaatcagacccgggccctcagggcatcagagtccggcatatgaaggcgcatggttctggacggcccagcagctcctgtggccacagcagctttgtacacgaagaccatccatcctcccttcgtccaccactctactccctccaccctccctccctgatcccgtgtgccaccaggagggagtggcagctatagtctggcaccaaagtccaggacacccagtggggtggagtcggagccactggtcctgctgctggctgcctctctgctccaccttgtgacccagggtggggacaggggctggcccagggctgcaatgcagcatgttgccctggcacctgtggccagtactcgggacagactaagggcgcttgtcccatcctggacttttcctctcatgtctttgctgcagaactgaagagactaggcgctggggctcagcttccctcttaagctaagactgatgtcagaggccccatggcgaggccccttggggccactgcctgaggctcacggtacagaggcctgccctgcctggccgggcaggaggttctcactgttgtgaaggttgtagacgttgtgtaatgtgtttttatctgttaaaatttttcagtgttgacacttaaaattaaacacatgcatacagaaaaaaaaaaaaaaaaacaaccaaaaaaaaaaaaaaaaaaaaaaaaaaaaaaaaaaaaaaaaaaaaaaaaaaaggggggggggggaaaaaaaaaatcccccgaggggggcgccaacaatatagccaggaccccggttttttttgaaaagagggggccccaataaggggagcgggattatataaacagcacaggacgggggcgagaggataaacacaggcgggtggagcagaaacactgggtacttgggcattcttggggaagaacacaacatctgtcgggcggggacattggcggcaacactctcacagaatataagggcgggggaaacaaaaacttaggcgcgtagcgcggacc

SEQ ID NO: 448894 - DNA, 3082 bp, Homo sapiens
gctcagggggaccccaggcaacagctgatgactcactgggaggaaggcgtttcaccatattcataacctgctcatctgcacggggcccacctgctgtgcccaggcctctccacgcttccataacccagcgtccaccactccaaggggggcactaatgccaggaggaatgagctgggggcacagacaggagacaggaccctctccaggctgggacaggacctgacccccttcttcctgtcctcagatgtggacgagtgcagctccgggcagcatcagtgtgacagctccaccgtctgcttcaacaccgtgggttcatacagctgccgctgccgcccaggctggaagcccagacacggaatcccgaataaccaaaaggacactgtctgtgaagatatgactttctccacctggaccccgccccctggagtccacagccagacgctttcccgattcttcgacaaagtccaggacctgggcagagactccaagacaagctcagccgaggtcaccatccagaatgtcatcaaattggtggatgaactgatggaagctcctggagacgtagaggccctggcgccacctgtccggcacctcatagccacccagctgctctcaaaccttgaagatatcatgaggatcctggccaagagcctgcctaaaggccccttcacctacatttccccttcgaacacagagctgaccctgatgatccaggagcggggggacaagaacgtcactatgggtcagagcagcgcacgcatgaagctgaattgggctgtggcagctggagccgaggatccaggccccgccgtggcgggcatcctctccatccagaacatgacgacattgctggccaatgcctccttgaacctgcattccaagaagcaagccgaactggaggagatatatgaaagcagcatccgtggtgtccaactcagacgcctctctgccgtcaactccatctttctgagccacaacaacaccaaggaactcaactcccccatccttttcgccttctcccaccttgagtcctccgatggggaggcgggaagagaccctcctgccaaggacgtgatgcctgggccacggcaggagctgctctgtgccttctggaagagtgacagcgacaggggagggcactgggccaccgagggctgccaggtgctgggcagcaagaacggcagcaccacctgccaatgcagccacctgagcagctttgcgatccttatggctcattatgacgtggaggactggaagctgaccctgatcaccagggtgggactggcgctgtcactcttctgcctgctgctgtgcatcctcactttcctgctggtgcggcccatccagggctcgcgcaccaccatacacctgcacctctgcatctgcctcttcgtgggctccaccatcttcctggccggcatcgagaacgaaggcggccaggtggggctgcgctgccgcctggtggccgggctgctgcactactgtttcctggccgccttctgctggatgagcctcgaaggcctggagctctactttcttgtggtgcgcgtgttccaaggccagggcctgagtacgcgctggctctgcctgatcggctatggcgtgcccctgctcatcgtgggcgtctcggctgccatctacagcaagggctacggccgccccagatactgctggttggactttgagcagggcttcctctggagcttcttgggacctgtgaccttcatcattttgtgcaatgctgtcattttcgtgactaccgtctggaagctcactcagaagttttctgaaatcaatccagacatgaagaaattaaagaaggcgagggcgctgaccatcacggccatcgcgcagctcttcctgttgggctgcacctgggtctttggcctgttcatcttcgacgatcggagcttggtgctgacctatgtgtttaccatcctcaactgcctgcagggcgccttcctctacctgctgcactgcctgctcaacaagaaggttcgggaagaataccggaagtgggcctgcctagttgctggggggagcaagtactcagaattcacctccaccacgtctggcactggccacaatcagacccgggccctcagggcatcagagtccggcatatgaaggcgcatggttctggacggcccagcagctcctgtggccacagcagctttgtacacgaagaccatccatcctcccttcgtccaccactctactccctccaccctccctccctgatcccgtgtgccaccaggagggagtggcagctatagtctggcaccaaagtccaggacacccagtggggtggagtcggagccactggtcctgctgctggctgcctctctgctccaccttgtgacccagggtggggacaggggctggcccagggctgcaatgcagcatgttgccctggcacctgtggccagtactcgggacagactaagggcgcttgtcccatcctggacttttcctctcatgtctttgctgcagaactgaagagactaggcgctggggctcagcttccctcttaagctaagactgatgtcagaggccccatggcgaggccccttggggccactgcctgaggctcacggtacagaggcctgccctgcctggccgggcaggaggttctcactgttgtgaaggttgtagacgttgtgtaatgtgtttttatctgttaaaatttttcagtgttgacacttaaaattaaacacatgcatacagaaaaaaaaaaaaaaaaacaaccaaaaaaaaaaaaaaaaaaaaaaaaaaaaaaaaaaaaaaaaaaaaaaaaaaaggggggggggggaaaaaaaaaatcccccgaggggggcgccaacaatatagccaggaccccggttttttttgaaaagagggggccccaataaggggagcgggattatataaacagcacaggacgggggcgagaggataaacacaggcgggtggagcagaaacactgggtacttgggcattcttggggaagaacacaacatctgtcgggcggggacattggcggcaacactctcacagaatataagggcgggggaaacaaaaacttaggcgcgtagcgcggacc

SEQ ID NO: 448895 - DNA, 2547 bp, Homo sapiens
atttccttactttatttatttaatttaattaattaatttatttattttaagacagagtctcactctgtcgtccaggctggagtgcagtggcacgttctcggctcactgcaatctctgcctcccaggttcaagtgattctcctgcctcagcctcccaagtagatgggattacaggcatgcgccaccacacctcgctgattttgtatttttagtagagacggggtttctccatgttggtcaggttggtctcaaactcccgacctcaggtgatctgcccgccttggcctctcaaagtactgcgattacaggcatgagccactatgcctggccacctctcccactcttatgtcaacctcacaagggtaggtacttgtgtgtgccctgttcactgctgtgtctccaaacctgttacattcagtaggcgctcggtcaatactcatctagtaaaaagcagccctcttagactcagcccaagcccaggacctaagagtgagctccaggccaacctttctgaccacccccatctgcccacaggacgtgatgcctgggccacggcaggagctgctctgtgccttctggaagagtgacagcgacaggggagggcactgggccaccgagggctgccaggtgctgggcagcaagaacggcagcaccacctgccaatgcagccacctgagcagctttgcgatccttatggctcattatgacgtggaggactggaagctgaccctgatcaccagggtgggactggcgctgtcactcttctgcctgctgctgtgcatcctcactttcctgctggtgcggcccatccagggctcgcgcaccaccatacacctgcacctctgcatctgcctcttcgtgggctccaccatcttcctggccggcatcgagaacgaaggcggccaggtggggctgcgctgccgcctggtggccgggctgctgcactactgtttcctggccgccttctgctggatgagcctcgaaggcctggagctctactttcttgtggtgcgcgtgttccaaggccagggcctgagtacgcgctggctctgcctgatcggctatggcgtgcccctgctcatcgtgggcgtctcggctgccatctacagcaagggctacggccgccccagatactgctggttggactttgagcagggcttcctctggagcttcttgggacctgtgaccttcatcattttgtgcaatgctgtcattttcgtgactaccgtctggaagctcactcagaagttttctgaaatcaatccagacatgaagaaattaaagaaggcgagggcgctgaccatcacggccatcgcgcagctcttcctgttgggctgcacctgggtctttggcctgttcatcttcgacgatcggagcttggtgctgacctatgtgtttaccatcctcaactgcctgcagggcgccttcctctacctgctgcactgcctgctcaacaagaaggttcgggaagaataccggaagtgggcctgcctagttgctggggggagcaagtactcagaattcacctccaccacgtctggcactggccacaatcagacccgggccctcagggcatcagagtccggcatatgaaggcgcatggttctggacggcccagcagctcctgtggccacagcagctttgtacacgaagaccatccatcctcccttcgtccaccactctactccctccaccctccctccctgatcccgtgtgccaccaggagggagtggcagctatagtctggcaccaaagtccaggacacccagtggggtggagtcggagccactggtcctgctgctggctgcctctctgctccaccttgtgacccagggtggggacaggggctggcccagggctgcaatgcagcatgttgccctggcacctgtggccagtactcgggacagactaagggcgcttgtcccatcctggacttttcctctcatgtctttgctgcagaactgaagagactaggcgctggggctcagcttccctcttaagctaagactgatgtcagaggccccatggcgaggccccttggggccactgcctgaggctcacggtacagaggcctgccctgcctggccgggcaggaggttctcactgttgtgaaggttgtagacgttgtgtaatgtgtttttatctgttaaaatttttcagtgttgacacttaaaattaaacacatgcatacagaaaaaaaaaaaaaaaaacaaccaaaaaaaaaaaaaaaaaaaaaaaaaaaaaaaaaaaaaaaaaaaaaaaaaaaggggggggggggaaaaaaaaaatcccccgaggggggcgccaacaatatagccaggaccccggttttttttgaaaagagggggccccaataaggggagcgggattatataaacagcacaggacgggggcgagaggataaacacaggcgggtggagcagaaacactgggtacttgggcattcttggggaagaacacaacatctgtcgggcggggacattggcggcaacactctcacagaatataagggcgggggaaacaaaaacttaggcgcgtagcgcggacc

SEQ ID NO: 448896 - DNA, 1128 bp, Homo sapiens
  misc_feature (17)..(18): n is a, c, g, or t
  misc_feature (39)..(39): n is a, c, g, or t
ggagaggtctagagganncccctacatgctcgtacatgnaggttcgggaagaataccggaagtgggcctgcctagttgctggggggagcaagtactcagaattcacctccaccacgtctggcactggccacaatcagacccgggccctcagggcatcagagtccggcatatgaaggcgcatggttctggacggcccagcagctcctgtggccacagcagctttgtacacgaagaccatccatcctcccttcgtccaccactctactccctccaccctccctccctgatcccgtgtgccaccaggagggagtggcagctatagtctggcaccaaagtccaggacacccagtggggtggagtcggagccactggtcctgctgctggctgcctctctgctccaccttgtgacccagggtggggacaggggctggcccagggctgcaatgcagcatgttgccctggcacctgtggccagtactcgggacagactaagggcgcttgtcccatcctggacttttcctctcatgtctttgctgcagaactgaagagactaggcgctggggctcagcttccctcttaagctaagactgatgtcagaggccccatggcgaggccccttggggccactgcctgaggctcacggtacagaggcctgccctgcctggccgggcaggaggttctcactgttgtgaaggttgtagacgttgtgtaatgtgtttttatctgttaaaatttttcagtgttgacacttaaaattaaacacatgcatacagaaaaaaaaaaaaaaaaacaaccaaaaaaaaaaaaaaaaaaaaaaaaaaaaaaaaaaaaaaaaaaaaaaaaaaaggggggggggggaaaaaaaaaatcccccgaggggggcgccaacaatatagccaggaccccggttttttttgaaaagagggggccccaataaggggagcgggattatataaacagcacaggacgggggcgagaggataaacacaggcgggtggagcagaaacactgggtacttgggcattcttggggaagaacacaacatctgtcgggcggggacattggcggcaacactctcacagaatataagggcgggggaaacaaaaacttaggcgcgtagcgcggacc

SEQ ID NO: 448897 - DNA, 1218 bp, Homo sapiens
ccttgatctccctgtgtccccttcctgctttgagctagggggctgactctgcctcccaggacacaagtctccaaagtgcctgtgagggcgggccctccgcaccctctgccctctgcctgctcaacaagaaggttcgggaagaataccggaagtgggcctgcctagttgctggggggagcaagtactcagaattcacctccaccacgtctggcactggccacaatcagacccgggccctcagggcatcagagtccggcatatgaaggcgcatggttctggacggcccagcagctcctgtggccacagcagctttgtacacgaagaccatccatcctcccttcgtccaccactctactccctccaccctccctccctgatcccgtgtgccaccaggagggagtggcagctatagtctggcaccaaagtccaggacacccagtggggtggagtcggagccactggtcctgctgctggctgcctctctgctccaccttgtgacccagggtggggacaggggctggcccagggctgcaatgcagcatgttgccctggcacctgtggccagtactcgggacagactaagggcgcttgtcccatcctggacttttcctctcatgtctttgctgcagaactgaagagactaggcgctggggctcagcttccctcttaagctaagactgatgtcagaggccccatggcgaggccccttggggccactgcctgaggctcacggtacagaggcctgccctgcctggccgggcaggaggttctcactgttgtgaaggttgtagacgttgtgtaatgtgtttttatctgttaaaatttttcagtgttgacacttaaaattaaacacatgcatacagaaaaaaaaaaaaaaaaacaaccaaaaaaaaaaaaaaaaaaaaaaaaaaaaaaaaaaaaaaaaaaaaaaaaaaaggggggggggggaaaaaaaaaatcccccgaggggggcgccaacaatatagccaggaccccggttttttttgaaaagagggggccccaataaggggagcgggattatataaacagcacaggacgggggcgagaggataaacacaggcgggtggagcagaaacactgggtacttgggcattcttggggaagaacacaacatctgtcgggcggggacattggcggcaacactctcacagaatataagggcgggggaaacaaaaacttaggcgcgtagcgcggacc

SEQ ID NO: 448898 - DNA, 1195 bp, Homo sapiens
tcctggcctcgggacagcctgcacagctgcctagcctgtggagacgggacagccctgtcccactcactctttcccctgccgctcctgccggcagctccaaccatgggaggccgcgtctttctcgcattctgtgtctggctgactctgccgggagctgaaacccaggactccaggggctgtgcccggtggtgccctcagaactcctcgtgtgtcaatgccaccgcctgtcgctgcaatccagggttcagctctttttctgagatcatcaccaccccgacggagacttgtgacgacatcaacgagtgtgcaacaccgtcgaaagtgtcatgcggaaaattctcggactgctggaacacagaggggagctacgactgcgtgtgcagcccgggatatgagcctgtttctggggcaaaaacattcaagaatgagagcgagaacacctgtcaagatgtggacgaatgtcagcagaacccaaggctctgtaaaagctacggcacctgcgtcaacacccttggcagctatacctgccagtgcctgcctggcttcaagttcatacctgaggatccgaaggtctgcacagatgtgaatgaatgcacctccggacaaaacccgtgccacagctccacccactgcctcaacaacgtgggcagctatcagtgccgctgccgcccgggctggcaaccgattccggggtcccccaatggcccaaacaataccgtctgtgaagatgtggacgagtgcagctccgggcagcatcagtgtgacagctccaccgtctgcttcaacaccgtgggttcatacagctgccgctgccgcccaggctggaagcccagacacggaatcccgaataaccaaaaggacactgtctgtgaagatatgactttctccacctggaccccgccccctggagtccacagccagacgctttcccgattcttcgacaaagtccaggacctgggcagagactccaagacaagctcagccgaggtcaccatccaggtaagggcaggatgctgggggaccccaggacagtgtagaatcagctagcggaggcttccatgtggccagagagagtgcccaacccaagcaggggcctctagtcagagacacacatgcgcataacatacacacaccacatacagtatgtgcacaaacatacacacccggacacgtgaagacacacgcatgcacacac

SEQ ID NO: 448899 - DNA, 1279 bp, Homo sapiens
tcctggcctcgggacagcctgcacagctgcctagcctgtggagacgggacagccctgtcccactcactctttcccctgccgctcctgccggcagctccaaccatgggaggccgcgtctttctcgcattctgtgtctggctgactctgccgggagctgaaacccaggactccaggggctgtgcccggtggtgccctcagaactcctcgtgtgtcaatgccaccgcctgtcgctgcaatccagggttcagctctttttctgagatcatcaccaccccgacggagacttgtgacgacatcaacgagtgtgcaacaccgtcgaaagtgtcatgcggaaaattctcggactgctggaacacagaggggagctacgactgcgtgtgcagcccgggatatgagcctgtttctggggcaaaaacattcaagaatgagagcgagaacacctgtcaagatgtggacgaatgtcagcagaacccaaggctctgtaaaagctacggcacctgcgtcaacacccttggcagctatacctgccagtgcctgcctggcttcaagttcatacctgaggatccgaaggtctgcacagatgtgaatgaatgcacctccggacaaaacccgtgccacagctccacccactgcctcaacaacgtgggcagctatcagtgccgctgccgcccgggctggcaaccgattccggggtcccccaatggcccaaacaataccgtctgtgaagatgtggacgagtgcagctccgggcagcatcagtgtgacagctccaccgtctgcttcaacaccgtgggttcatacagctgccgctgccgcccaggctggaagcccagacacggaatcccgaataaccaaaaggacactgtctgtgaaggtatgacctggccctagaagctccccacccccagcacacacactgacaagcggcctaatgagccgcttgtcttgttccctacagatatgactttctccacctggaccccgccccctggagtccacagccagacgctttcccgattcttcgacaaagtccaggacctgggcagagactccaagacaagctcagccgaggtcaccatccaggtaagggcaggatgctgggggaccccaggacagtgtagaatcagctagcggaggcttccatgtggccagagagagtgcccaacccaagcaggggcctctagtcagagacacacatgcgcataacatacacacaccacatacagtatgtgcacaaacatacacacccggacacgtgaagacacacgcatgcacacac

SEQ ID NO: 448900 - DNA, 1077 bp, Homo sapiens
tcctggcctcgggacagcctgcacagctgcctagcctgtggagacgggacagccctgtcccactcactctttcccctgccgctcctgccggcagctccaaccatgggaggccgcgtctttctcgcattctgtgtctggctgactctgccgggagctgaaacccaggactccaggggctgtgcccggtggtgccctcagaactcctcgtgtgtcaatgccaccgcctgtcgctgcaatccagggttcagctctttttctgagatcatcaccaccccgacggagacttgtgacgacatcaacgagtgtgcaacaccgtcgaaagtgtcatgcggaaaattctcggactgctggaacacagaggggagctacgactgcgtgtgcagcccgggatatgagcctgtttctggggcaaaaacattcaagaatgagagcgagaacacctgtcaagatgtggacgaatgtcagcagaacccaaggctctgtaaaagctacggcacctgcgtcaacacccttggcagctatacctgccagtgcctgcctggcttcaagttcatacctgaggatccgaaggtctgcacagatgtgaatgaatgcacctccggacaaaacccgtgccacagctccacccactgcctcaacaacgtgggcagctatcagtgccgctgccgcccgggctggcaaccgattccggggtcccccaatggcccaaacaataccgtctgtgaagatgtggacgagtgcagctccgggcagcatcagtgtgacagctccaccgtctgcttcaacaccgtgggttcatacagctgccgctgccgcccaggctggaagcccagacacggaatcccgaataaccaaaaggacactgtctgtgaaggtatgacctggccctagaagctccccacccccagcacacacactgacaagcggcctaatgagccgcttgtcttgttccctacagatatgactttctccacctggaccccgccccctggagtccacagccaggtgagtggcccccacagggacgaggcggcgggaactccatccacacagcactgcatccgtctccttgttcta

SEQ ID NO: 448901 - DNA, 287 bp, Homo sapiens
cccagggaaagagagggctcgcgcacgagaaactcagcgccctgccccatctcccccagtgccccctttttgtgtattcccttacccctcaccttctgaccgtgctccctgctcttgcaggctgtgcccggtggtgccctcagaactcctcgtgtgtcaatgccaccgcctgtcgctgcaatccagggttcagctctttttctgagatcatcaccaccccgacggagacttgtgacggtacagaggcttgagggcagcgcaggggacatccgcgattatgaggcatt

SEQ ID NO: 448902 - DNA, 638 bp, Homo sapiens
gtgaggggcatgaagctggaggtgaggtgggggcccacgctgcaaccccgctcctcgcagggcgctgaccatcacggccatcgcgcagctcttcctgttgggctgcacctgggtctttggcctgttcatcttcgacgatcggagcttggtgctgacctatgtgtttaccatcctcaactgcctgcagggcgccttcctctacctgctgcactgcctgctcaacaagaaggtgggggcctgggcacagtggcgcacgcctgtcatcctcccacctatttgggaggctgaggtgggaggattgcttgagcccagaagttggagaccagcctgggcaacataaccagatgctgtctttacaaaaaaattcaaagatagccagggtgaggcgcctgtaatcccaacagtttgggaggccgaggtgggcagatcacctgaggtcagtaattcaagaccagcctggccaacatggtgaaaccctgtctctactaaaaatacaaaaattagccaggcatggtggcacacgcctgtagtcccagctacttgggaggctgaggcaggagaatcatttgaaccaggagtgcagtgggccaagatggcaccattgcactccagcctgggtgacagtgagacttgtctcc

SEQ ID NO: 448903 - DNA, 3212 bp, Homo sapiens
tcctggcctcgggacagcctgcacagctgcctagcctgtggagacgggacagccctgtcccactcactctttcccctgccgctcctgccggcagctccaaccatgggaggccgcgtctttctcgcattctgtgtctggctgactctgccgggagctgaaacccaggactccaggggctgtgcccggtggtgccctcagaactcctcgtgtgtcaatgccaccgcctgtcgctgcaatccagggttcagctctttttctgagatcatcaccaccccgacggagacttgtgacgacatcaacgagtgtgcaacaccgtcgaaagtgtcatgcggaaaattctcggactgctggaacacagaggggagctacgactgcgtgtgcagcccgggatatgagcctgtttctggggcaaaaacattcaagaatgagagcgagaacacctgtcaagatgtggacgaatgtcagcagaacccaaggctctgtaaaagctacggcacctgcgtcaacacccttggcagctatacctgccagtgcctgcctggcttcaagttcatacctgaggatccgaaggtctgcacagatgtgaatgaatgcacctccggacaaaacccgtgccacagctccacccactgcctcaacaacgtgggcagctatcagtgccgctgccgcccgggctggcaaccgattccggggtcccccaatggcccaaacaataccgtctgtgaagatgtggacgagtgcagctccgggcagcatcagtgtgacagctccaccgtctgcttcaacaccgtgggttcatacagctgccgctgccgcccaggctggaagcccagacacggaatcccgaataaccaaaaggacactgtctgtgaagatatgactttctccacctggaccccgccccctggagtccacagccagacgctttcccgattcttcgacaaagtccaggacctgggcagagactccaagacaagctcagccgaggtcaccatccagaatgtcatcaaattggtggatgaactgatggaagctcctggagacgtagaggccctggcgccacctgtccggcacctcatagccacccagctgctctcaaaccttgaagatatcatgaggatcctggccaagagcctgcctaaaggccccttcacctacatttccccttcgaacacagagctgaccctgatgatccaggagcggggggacaagaacgtcactatgggtcagagcagcgcacgcatgaagctgaattgggctgtggcagctggagccgaggatccaggccccgccgtggcgggcatcctctccatccagaacatgacgacattgctggccaatgcctccttgaacctgcattccaagaagcaagccgaactggaggagatatatgaaagcagcatccgtggtgtccaactcagacgcctctctgccgtcaactccatctttctgagccacaacaacaccaaggaactcaactcccccatccttttcgccttctcccaccttgagtcctccgatggggaggcgggaagagaccctcctgccaaggacgtgatgcctgggccacggcaggagctgctctgtgccttctggaagagtgacagcgacaggggagggcactgggccaccgagggctgccaggtgctgggcagcaagaacggcagcaccacctgccaatgcagccacctgagcagctttgcgatccttatggctcattatgacgtggaggactggaagctgaccctgatcaccagggtgggactggcgctgtcactcttctgcctgctgctgtgcatcctcactttcctgctggtgcggcccatccagggctcgcgcaccaccatacacctgcacctctgcatctgcctcttcgtgggctccaccatcttcctggccggcatcgagaacgaaggcggccaggtggggctgcgctgccgcctggtggccgggctgctgcactactgtttcctggccgccttctgctggatgagcctcgaaggcctggagctctactttcttgtggtgcgcgtgttccaaggccagggcctgagtacgcgctggctctgcctgatcggctatggcgtgcccctgctcatcgtgggcgtctcggctgccatctacagcaagggctacggccgccccagatactgctggttggactttgagcagggcttcctctggagcttcttgggacctgtgaccttcatcattttgtgcaatgctgtcattttcgtgactaccgtctggaagctcactcagaagttttctgaaatcaatccagacatgaagaaattaaagaaggcgagggcgctgaccatcacggccatcgcgcagctcttcctgttgggctgcacctgggtctttggcctgttcatcttcgacgatcggagcttggtgctgacctatgtgtttaccatcctcaactgcctgcagggcgccttcctctacctgctgcactgcctgctcaacaagaaggttcgggaagaataccggaagtgggcctgcctagttgctggggggagcaagtactcagaattcacctccaccacgtctggcactggccacaatcagacccgggccctcagggcatcagagtccggcatatgaaggcgcatggttctggacggcccagcagctcctgtggccacagcagctttgtacacgaagaccatccatcctcccttcgtccaccactctactccctccaccctccctccctgatcccgtgtgccaccaggagggagtggcagctatagtctggcaccaaagtccaggacacccagtggggtggagtcggagccactggtcctgctgctggctgcctctctgctccaccttgtgacccagggtggggacaggggctggcccagggctgcaatgcagcatgttgccctggcacctgtggccagtactcgggacagactaagggcgcttgtcccatcctggacttttcctctcatgtctttgctgcagaactgaagagactaggcgctggggctcagcttccctcttaagctaagactgatgtcagaggccccatggcgaggccccttggggccactgcctgaggctcacggtacagaggcctgccctgcctggccgggcaggaggttctcactgttgtgaaggttgtagacgttgtgtaatgtgtttttatctgttaaaatttttcagtgttgacacttaaaattaaacacatgcatacagaa

SEQ ID NO: 448904 - DNA, 3286 bp, Homo sapiens
tcctggcctcgggacagcctgcacagctgcctagcctgtggagacgggacagccctgtcccactcactctttcccctgccgctcctgccggcagctccaaccatgggaggccgcgtctttctcgcattctgtgtctggctgactctgccgggagctgaaacccaggactccaggggctgtgcccggtggtgccctcagaactcctcgtgtgtcaatgccaccgcctgtcgctgcaatccagggttcagctctttttctgagatcatcaccaccccgacggagacttgtgacgacatcaacgagtgtgcaacaccgtcgaaagtgtcatgcggaaaattctcggactgctggaacacagaggggagctacgactgcgtgtgcagcccgggatatgagcctgtttctggggcaaaaacattcaagaatgagagcgagaacacctgtcaagatgtggacgagtgcagctccgggcagcatcagtgtgacagctccaccgtctgcttcaacaccgtgggttcatacagctgccgctgccgcccaggctggaagcccagacacggaatcccgaataaccaaaaggacactgtctgtgaagatatgactttctccacctggaccccgccccctggagtccacagccagacgctttcccgattcttcgacaaagtccaggacctgggcagagactccaagacaagctcagccgaggtcaccatccagaatgtcatcaaattggtggatgaactgatggaagctcctggagacgtagaggccctggcgccacctgtccggcacctcatagccacccagctgctctcaaaccttgaagatatcatgaggatcctggccaagagcctgcctaaaggccccttcacctacatttccccttcgaacacagagctgaccctgatgatccaggagcggggggacaagaacgtcactatgggtcagagcagcgcacgcatgaagctgaattgggctgtggcagctggagccgaggatccaggccccgccgtggcgggcatcctctccatccagaacatgacgacattgctggccaatgcctccttgaacctgcattccaagaagcaagccgaactggaggagatatatgaaagcagcatccgtggtgtccaactcagacgcctctctgccgtcaactccatctttctgagccacaacaacaccaaggaactcaactcccccatccttttcgccttctcccaccttgagtcctccgatggggaggcgggaagagaccctcctgccaaggacgtgatgcctgggccacggcaggagctgctctgtgccttctggaagagtgacagcgacaggggagggcactgggccaccgagggctgccaggtgctgggcagcaagaacggcagcaccacctgccaatgcagccacctgagcagctttgcgatccttatggctcattatgacgtggaggactggaagctgaccctgatcaccagggtgggactggcgctgtcactcttctgcctgctgctgtgcatcctcactttcctgctggtgcggcccatccagggctcgcgcaccaccatacacctgcacctctgcatctgcctcttcgtgggctccaccatcttcctggccggcatcgagaacgaaggcggccaggtggggctgcgctgccgcctggtggccgggctgctgcactactgtttcctggccgccttctgctggatgagcctcgaaggcctggagctctactttcttgtggtgcgcgtgttccaaggccagggcctgagtacgcgctggctctgcctgatcggctatggcgtgcccctgctcatcgtgggcgtctcggctgccatctacagcaagggctacggccgccccagatactgctggttggactttgagcagggcttcctctggagcttcttgggacctgtgaccttcatcattttgtgcaatgctgtcattttcgtgactaccgtctggaagctcactcagaagttttctgaaatcaatccagacatgaagaaattaaagaaggcgagggcgctgaccatcacggccatcgcgcagctcttcctgttgggctgcacctgggtctttggcctgttcatcttcgacgatcggagcttggtgctgacctatgtgtttaccatcctcaactgcctgcagggcgccttcctctacctgctgcactgcctgctcaacaagaaggttcgggaagaataccggaagtgggcctgcctagttgctggggggagcaagtactcagaattcacctccaccacgtctggcactggccacaatcagacccgggccctcagggcatcagagtccggcatatgaaggcgcatggttctggacggcccagcagctcctgtggccacagcagctttgtacacgaagaccatccatcctcccttcgtccaccactctactccctccaccctccctccctgatcccgtgtgccaccaggagggagtggcagctatagtctggcaccaaagtccaggacacccagtggggtggagtcggagccactggtcctgctgctggctgcctctctgctccaccttgtgacccagggtggggacaggggctggcccagggctgcaatgcagcatgttgccctggcacctgtggccagtactcgggacagactaagggcgcttgtcccatcctggacttttcctctcatgtctttgctgcagaactgaagagactaggcgctggggctcagcttccctcttaagctaagactgatgtcagaggccccatggcgaggccccttggggccactgcctgaggctcacggtacagaggcctgccctgcctggccgggcaggaggttctcactgttgtgaaggttgtagacgttgtgtaatgtgtttttatctgttaaaatttttcagtgttgacacttaaaattaaacacatgcatacagaaaaaaaaaaaaaaaaacaaccaaaaaaaaaaaaaaaaaaaaaaaaaaaaaaaaaaaaaaaaaaaaaaaaaaaggggggggggggaaaaaaaaaatcccccgaggggggcgccaacaatatagccaggaccccggttttttttgaaaagagggggccccaataaggggagcgggattatataaacagcacaggacgggggcgagaggataaacacaggcgggtggagcagaaacactgggtacttgggcattcttggggaagaacacaacatctgtcgggcggggacattggcggcaacactctcacagaatataagggcgggggaaacaaaaacttaggcgcgtagcgcggacc

SEQ ID NO: 448905 - DNA, 3615 bp, Homo sapiens
ccaaaatgctgggattacaggcgtgagccactgcacccggccgccatggggtttaaatttctacaaagagactggggatggggatgtggagcttcctgtccatccctcacctcagcactgttcactgtgtccaaatctaagatgccagccagagaactaagatcaagtgtggtcttcaggaatggcttgctccagctgcagcatagcctgtgcagtgcaacttaagattttttccaaaagatactaagcagcaggccccatgttggggagtcaggatgggggtctctgccctgacagaactcacatctttgggaggtgactccctgtcctgttgtgttccagacatcaacgagtgtgcaacaccgtcgaaagtgtcatgcggaaaattctcggactgctggaacacagaggggagctacgactgcgtgtgcagcccgggatatgagcctgtttctggggcaaaaacattcaagaatgagagcgagaacacctgtcaagatgtggacgaatgtcagcagaacccaaggctctgtaaaagctacggcacctgcgtcaacacccttggcagctatacctgccagtgcctgcctggcttcaagttcatacctgaggatccgaaggtctgcacagatgtgaatgaatgcacctccggacaaaacccgtgccacagctccacccactgcctcaacaacgtgggcagctatcagtgccgctgccgcccgggctggcaaccgattccggggtcccccaatggcccaaacaataccgtctgtgaagatgtggacgagtgcagctccgggcagcatcagtgtgacagctccaccgtctgcttcaacaccgtgggttcatacagctgccgctgccgcccaggctggaagcccagacacggaatcccgaataaccaaaaggacactgtctgtgaagatatgactttctccacctggaccccgccccctggagtccacagccagacgctttcccgattcttcgacaaagtccaggacctgggcagagactccaagacaagctcagccgaggtcaccatccagaatgtcatcaaattggtggatgaactgatggaagctcctggagacgtagaggccctggcgccacctgtccggcacctcatagccacccagctgctctcaaaccttgaagatatcatgaggatcctggccaagagcctgcctaaaggccccttcacctacatttccccttcgaacacagagctgaccctgatgatccaggagcggggggacaagaacgtcactatgggtcagagcagcgcacgcatgaagctgaattgggctgtggcagctggagccgaggatccaggccccgccgtggcgggcatcctctccatccagaacatgacgacattgctggccaatgcctccttgaacctgcattccaagaagcaagccgaactggaggagatatatgaaagcagcatccgtggtgtccaactcagacgcctctctgccgtcaactccatctttctgagccacaacaacaccaaggaactcaactcccccatccttttcgccttctcccaccttgagtcctccgatggggaggcgggaagagaccctcctgccaaggacgtgatgcctgggccacggcaggagctgctctgtgccttctggaagagtgacagcgacaggggagggcactgggccaccgagggctgccaggtgctgggcagcaagaacggcagcaccacctgccaatgcagccacctgagcagctttgcgatccttatggctcattatgacgtggaggactggaagctgaccctgatcaccagggtgggactggcgctgtcactcttctgcctgctgctgtgcatcctcactttcctgctggtgcggcccatccagggctcgcgcaccaccatacacctgcacctctgcatctgcctcttcgtgggctccaccatcttcctggccggcatcgagaacgaaggcggccaggtggggctgcgctgccgcctggtggccgggctgctgcactactgtttcctggccgccttctgctggatgagcctcgaaggcctggagctctactttcttgtggtgcgcgtgttccaaggccagggcctgagtacgcgctggctctgcctgatcggctatggcgtgcccctgctcatcgtgggcgtctcggctgccatctacagcaagggctacggccgccccagatactgctggttggactttgagcagggcttcctctggagcttcttgggacctgtgaccttcatcattttgtgcaatgctgtcattttcgtgactaccgtctggaagctcactcagaagttttctgaaatcaatccagacatgaagaaattaaagaaggcgagggcgctgaccatcacggccatcgcgcagctcttcctgttgggctgcacctgggtctttggcctgttcatcttcgacgatcggagcttggtgctgacctatgtgtttaccatcctcaactgcctgcagggcgccttcctctacctgctgcactgcctgctcaacaagaaggttcgggaagaataccggaagtgggcctgcctagttgctggggggagcaagtactcagaattcacctccaccacgtctggcactggccacaatcagacccgggccctcagggcatcagagtccggcatatgaaggcgcatggttctggacggcccagcagctcctgtggccacagcagctttgtacacgaagaccatccatcctcccttcgtccaccactctactccctccaccctccctccctgatcccgtgtgccaccaggagggagtggcagctatagtctggcaccaaagtccaggacacccagtggggtggagtcggagccactggtcctgctgctggctgcctctctgctccaccttgtgacccagggtggggacaggggctggcccagggctgcaatgcagcatgttgccctggcacctgtggccagtactcgggacagactaagggcgcttgtcccatcctggacttttcctctcatgtctttgctgcagaactgaagagactaggcgctggggctcagcttccctcttaagctaagactgatgtcagaggccccatggcgaggccccttggggccactgcctgaggctcacggtacagaggcctgccctgcctggccgggcaggaggttctcactgttgtgaaggttgtagacgttgtgtaatgtgtttttatctgttaaaatttttcagtgttgacacttaaaattaaacacatgcatacagaaaaaaaaaaaaaaaaacaaccaaaaaaaaaaaaaaaaaaaaaaaaaaaaaaaaaaaaaaaaaaaaaaaaaaaggggggggggggaaaaaaaaaatcccccgaggggggcgccaacaatatagccaggaccccggttttttttgaaaagagggggccccaataaggggagcgggattatataaacagcacaggacgggggcgagaggataaacacaggcgggtggagcagaaacactgggtacttgggcattcttggggaagaacacaacatctgtcgggcggggacattggcggcaacactctcacagaatataagggcgggggaaacaaaaacttaggcgcgtagcgcggacc

SEQ ID NO: 448906 - DNA, 2948 bp, Homo sapiens
gtcccagctactcagaaagctgaggtgggaggatcgcttgagtctgggaggtggaggttgcagtgagctgattatgccactgcactcaagcctgggcaacagactgagaccctgtctcaaaaaaagaaagaaaaaagaacaggaaatcaaaacagagcctggcaggcagcccgtgcccaaccagtgttaagcgctgtgattcatacgtgcatgcaggcaaatactcaatccgtcgcttgttttctggttactgcatcatctcagtgattcccttgtgcctgtgggtctccagtgtgtcccctggtagggggtgacatccaggtccttcaggcaacccctgtggtctgatgctccagcgattctgtcacccgccaccccctagaatgtcatcaaattggtggatgaactgatggaagctcctggagacgtagaggccctggcgccacctgtccggcacctcatagccacccagctgctctcaaaccttgaagatatcatgaggatcctggccaagagcctgcctaaaggccccttcacctacatttccccttcgaacacagagctgaccctgatgatccaggagcggggggacaagaacgtcactatgggtcagagcagcgcacgcatgaagctgaattgggctgtggcagctggagccgaggatccaggccccgccgtggcgggcatcctctccatccagaacatgacgacattgctggccaatgcctccttgaacctgcattccaagaagcaagccgaactggaggagatatatgaaagcagcatccgtggtgtccaactcagacgcctctctgccgtcaactccatctttctgagccacaacaacaccaaggaactcaactcccccatccttttcgccttctcccaccttgagtcctccgatggggaggcgggaagagaccctcctgccaaggacgtgatgcctgggccacggcaggagctgctctgtgccttctggaagagtgacagcgacaggggagggcactgggccaccgagggctgccaggtgctgggcagcaagaacggcagcaccacctgccaatgcagccacctgagcagctttgcgatccttatggctcattatgacgtggaggactggaagctgaccctgatcaccagggtgggactggcgctgtcactcttctgcctgctgctgtgcatcctcactttcctgctggtgcggcccatccagggctcgcgcaccaccatacacctgcacctctgcatctgcctcttcgtgggctccaccatcttcctggccggcatcgagaacgaaggcggccaggtggggctgcgctgccgcctggtggccgggctgctgcactactgtttcctggccgccttctgctggatgagcctcgaaggcctggagctctactttcttgtggtgcgcgtgttccaaggccagggcctgagtacgcgctggctctgcctgatcggctatggcgtgcccctgctcatcgtgggcgtctcggctgccatctacagcaagggctacggccgccccagatactgctggttggactttgagcagggcttcctctggagcttcttgggacctgtgaccttcatcattttgtgcaatgctgtcattttcgtgactaccgtctggaagctcactcagaagttttctgaaatcaatccagacatgaagaaattaaagaaggcgagggcgctgaccatcacggccatcgcgcagctcttcctgttgggctgcacctgggtctttggcctgttcatcttcgacgatcggagcttggtgctgacctatgtgtttaccatcctcaactgcctgcagggcgccttcctctacctgctgcactgcctgctcaacaagaaggttcgggaagaataccggaagtgggcctgcctagttgctggggggagcaagtactcagaattcacctccaccacgtctggcactggccacaatcagacccgggccctcagggcatcagagtccggcatatgaaggcgcatggttctggacggcccagcagctcctgtggccacagcagctttgtacacgaagaccatccatcctcccttcgtccaccactctactccctccaccctccctccctgatcccgtgtgccaccaggagggagtggcagctatagtctggcaccaaagtccaggacacccagtggggtggagtcggagccactggtcctgctgctggctgcctctctgctccaccttgtgacccagggtggggacaggggctggcccagggctgcaatgcagcatgttgccctggcacctgtggccagtactcgggacagactaagggcgcttgtcccatcctggacttttcctctcatgtctttgctgcagaactgaagagactaggcgctggggctcagcttccctcttaagctaagactgatgtcagaggccccatggcgaggccccttggggccactgcctgaggctcacggtacagaggcctgccctgcctggccgggcaggaggttctcactgttgtgaaggttgtagacgttgtgtaatgtgtttttatctgttaaaatttttcagtgttgacacttaaaattaaacacatgcatacagaaaaaaaaaaaaaaaaacaaccaaaaaaaaaaaaaaaaaaaaaaaaaaaaaaaaaaaaaaaaaaaaaaaaaaaggggggggggggaaaaaaaaaatcccccgaggggggcgccaacaatatagccaggaccccggttttttttgaaaagagggggccccaataaggggagcgggattatataaacagcacaggacgggggcgagaggataaacacaggcgggtggagcagaaacactgggtacttgggcattcttggggaagaacacaacatctgtcgggcggggacattggcggcaacactctcacagaatataagggcgggggaaacaaaaacttaggcgcgtagcgcggacc

SEQ ID NO: 448907 - DNA, 1349 bp, Homo sapiens
tcctggcctcgggacagcctgcacagctgcctagcctgtggagacgggacagccctgtcccactcactctttcccctgccgctcctgccggcagctccaaccatgggaggccgcgtctttctcgcattctgtgtctggctgactctgccgggagctgaaacccaggactccaggggctgtgcccggtggtgccctcagaactcctcgtgtgtcaatgccaccgcctgtcgctgcaatccagggttcagctctttttctgagatcatcaccaccccgacggagacttgtgacgacatcaacgagtgtgcaacaccgtcgaaagtgtcatgcggaaaattctcggactgctggaacacagaggggagctacgactgcgtgtgcagcccgggatatgagcctgtttctggggcaaaaacattcaagaatgagagcgagaacacctgtcaagatgtggacgagtgcagctccgggcagcatcagtgtgacagctccaccgtctgcttcaacaccgtgggttcatacagctgccgctgccgcccaggctggaagcccagacacggaatcccgaataaccaaaaggacactgtctgtgaagatatgactttctccacctggaccccgccccctggagtccacagccagacgctttcccgattcttcgacaaagtccaggacctgggcagagactccaagacaagctcagccgaggtcaccatccagaatgtcatcaaattggtggatgaactgatggaagctcctggagacgtagaggccctggcgccacctgtccggcacctcatagccacccagctgctctcaaaccttgaagatatcatgaggatcctggccaagagcctgcctaaaggccccttcacctacatttccccttcgaacacagagctgaccctgatgatccaggagcggggggacaagaacgtcactatgggtcagagcagcgcacgcatgaagctgaattgggctgtggcagctggagccgaggatccaggccccgccgtggcgggcatcctctccatccagaacatgacgacattgctggccaatgcctccttgaacctgcattccaagaagcaagccgaactggaggagatatatgaaagcagcatccgtggtgtccaactcagacgcctctctgccgtcaactccatctttctgagccacaacaacaccaaggaactcaactcccccatccttttcgccttctcccaccttgagtcctccgatggggaggcgggaagagaccctcctgccaaggacgtgatgcctgggccacggcaggagctgctctgtgccttctggaagagtacgtcctcatcccgggtcctctaagt

SEQ ID NO: 448908 - DNA, 1386 bp, Homo sapiens
tcctggcctcgggacagcctgcacagctgcctagcctgtggagacgggacagccctgtcccactcactctttcccctgccgctcctgccggcagctccaaccatgggaggccgcgtctttctcgcattctgtgtctggctgactctgccgggagctgaaacccaggactccaggggctgtgcccggtggtgccctcagaactcctcgtgtgtcaatgccaccgcctgtcgctgcaatccagggttcagctctttttctgagatcatcaccaccccgacggagacttgtgacgacatcaacgagtgtgcaacaccgtcgaaagtgtcatgcggaaaattctcggactgctggaacacagaggggagctacgactgcgtgtgcagcccgggatatgagcctgtttctggggcaaaaacattcaagaatgagagcgagaacacctgtcaagatgtggacgagtgcagctccgggcagcatcagtgtgacagctccaccgtctgcttcaacaccgtgggttcatacagctgccgctgccgcccaggctggaagcccagacacggaatcccgaataaccaaaaggacactgtctgtgaagatatgactttctccacctggaccccgccccctggagtccacagccagacgctttcccgattcttcgacaaagtccaggacctgggcagagactccaagacaagctcagccgaggtcaccatccagaatgtcatcaaattggtggatgaactgatggaagctcctggagacgtagaggccctggcgccacctgtccggcacctcatagccacccagctgctctcaaaccttgaagatatcatgaggatcctggccaagagcctgcctaaaggccccttcacctacatttccccttcgaacacagagctgaccctgatgatccaggagcggggggacaagaacgtcactatgggtcagagcagcgcacgcatgaagctgaattgggctgtggcagctggagccgaggatccaggccccgccgtggcgggcatcctctccatccagaacatgacgacattgctggccaatgcctccttgaacctgcattccaagaagcaagccgaactggaggagatatatgaaagcagcatccgtggtgtccaactcagacgcctctctgccgtcaactccatctttctgagccacaacaacaccaaggaactcaactcccccatccttttcgccttctcccaccttgagtcctccgatggggaggcgggaagagaccctcctgccaagctggccgggcaggaggttctcactgttgtgaaggttgtagacgttgtgtaatgtgtttttatctgttaaaatttttcagtgttgacacttaaaattaaacacatgcatacagaa

SEQ ID NO: 448909 - DNA, 1148 bp, Homo sapiens
tcctggcctcgggacagcctgcacagctgcctagcctgtggagacgggacagccctgtcccactcactctttcccctgccgctcctgccggcagctccaaccatgggaggccgcgtctttctcgcattctgtgtctggctgactctgccgggagctgaaacccaggactccaggggctgtgcccggtggtgccctcagaactcctcgtgtgtcaatgccaccgcctgtcgctgcaatccagggttcagctctttttctgagatcatcaccaccccgacggagacttgtgacgacatcaacgagtgtgcaacaccgtcgaaagtgtcatgcggaaaattctcggactgctggaacacagaggggagctacgactgcgtgtgcagcccgggatatgagcctgtttctggggcaaaaacattcaagaatgagagcgagaacacctgtcaagatgtggacgaatgtcagcagaacccaaggctctgtaaaagctacggcacctgcgtcaacacccttggcagctatacctgccagtgcctgcctggcttcaagttcatacctgaggatccgaaggtctgcacagatgtgaatgaatgcacctccggacaaaacccgtgccacagctccacccactgcctcaacaacgtgggcagctatcagtgccgctgccgcccgggctggcaaccgattccggggtcccccaatggcccaaacaataccgtctgtgaagatgtggacgagtgcagctccgggcagcatcagtgtgacagctccaccgtctgcttcaacaccgtgggttcatacagctgccgctgccgcccaggctggaagcccagacacggaatcccgaataaccaaaaggacactgtctgtgaagacgctttcccgattcttcgacaaagtccaggacctgggcagagactccaagacaagctcagccgaggtcaccatccaggtaagggcaggatgctgggggaccccaggacagtgtagaatcagctagcggaggcttccatgtggccagagagagtgcccaacccaagcaggggcctctagtcagagacacacatgcgcataacatacacacaccacatacagtatgtgcacaaacatacacacccggacacgtgaagacacacgcatgcacacac

SEQ ID NO: 448910 - DNA, 428 bp, Homo sapiens
cctggtagggggtgacatccaggtccttcaggcaacccctgtggtctgatgctccagcgattctgtcacccgccaccccctagaatgtcatcaaattggtggatgaactgatggaagctcctggagacgtagaggccctggcgccacctgtccggcacctcatagccacccagctgctctcaaaccttgaagatatcatgaggatcctggccaagagcctgcctaaaggccccttcacctacatttccccttcgaacacaggtgaggccttggcctggcctgccctgccccaaccctgggccccacctggtacctggggtccctaatcacaactgcccctctcccctcagagctgaccctgatgatccaggagcggggggacaagaacgtcactatgggtcagagcagcgcacgcatgaagctgaatt

SEQ ID NO: 448911 - DNA, 444 bp, Homo sapiens
aaccgaatgggcggaggcgggggcgtgccgacgggagggcggccgcggcgcggggctcccttcctcgtgctcggcgttgagctcctgcagccgccgccgctgcagtggtcgtccctgccctccccggccccggggtgcaccccgcaaggtgaggccacccctctgctccctgcctcccggttccttcccgttcgccgaggtcccctcccggtcccggccctgtcctgagcagtcagtgcctgggaccccagcggccgtgatggcagggctggggtggggggctccgctgtcggggccgggcctggaggactccccagcacctgaactagagtgatgtcaggttcccggggcgcagtgaccgttagctggtgcagctggggtgttttccgcgaagcgattgtccgggggcatgagtgcggtagtgagggcgggggcgtaatgggg

SEQ ID NO: 448912 - DNA, 1330 bp, Homo sapiens
aaccgaatgggcggaggcgggggcgtgccgacgggagggcggccgcggcgcggggctcccttcctcgtgctcggcgttgagctcctgcagccgccgccgctgcagtggtcgtccctgccctccccggccccggggtgcaccccgcaaggcaacaagcccagagtccggagtatccgctttgcggcaggccacgatgcagaaggatcccacagccacgtccactttgatgagaagctgcatgactcggtggtcatggtcacccaggagagtgacagcagctttctggtcaaggttggcttcctgaagatcctgcacaggtatgagattaccttcactctgcccccagtgcacaggctgagcaaggatgtccgcgaggcacctgtccccagcctgcacctcaagctcctcagcgtggtgcccgtccctgaaggttatagtgtcaagtgtgagtactcggcgcacaaagagggcgtcctcaaagaggagatactgctagcctgcgaaggtggcactggcacctgtgtgcgcgtgacggtgcaggcccgcgtcatgggtgagagcgtgaggctcctggttggaggagggatgcacaagctcgactgcgagggtttctgtcctcctcagggaaccaaggctgaacaagggatccttgcccggctcaggggttctcaacctccttggcagaccggcaccacggcacgcccatgctgctggatggtgtcaagtgtgtgggcgccgagctggaatacgactcagagcacagcgactggcacggctttgactgaggcccgaggccccgcctgccccgggcccctcagccttaaaccccgccttgtccccccgacatgctgcgtgatggtgtggcttcctcgcccctctctggggtgggtgtgggggtggagtggccttgcccacgcctctcacctctgccttcatttgtgctgccaccctgcccctccctcgtcctcctctcccacttcctcctctctgtgtgcctcagtctcctgccggaagaaatgggttgagcccgaaaggaggctgtctgaggaagggagagggagggcctggggtgggtcccccactccccaccccaagccacagggactcccaccagggtctgggagaggacggagctggctctgtggcgtcgtggccccattactgctgccttgcttcagccacctctcctgcccctccctagtccccactgctgtccaccatgagtaggagggaggtgcagtccccagcccccacccctcaggtctgtgttacttggtttttaagcgactggttgggatagaaccctaaagaaataaacttccagtggata

SEQ ID NO: 448913 - DNA, 1304 bp, Homo sapiens
aaccgaatgggcggaggcgggggcgtgccgacgggagggcggccgcggcgcggggctcccttcctcgtgctcggcgttgagctcctgcagccgccgccgctgcagtggtcgtccctgccctccccggccccggggtgcaccccgcaaggctcccgctggtgtccctggagcatgggaggctgctgagcgtgagtggcggtgtctggcaggagctgcgtggcagggagggcgtccatggctgcagccaacaagggcaacaagcccagagtccggagtatccgctttgcggcaggccacgatgcagaaggatcccacagccacgtccactttgatgagaagctgcatgactcggtggtcatggtcacccaggagagtgacagcagctttctggtcaaggttggcttcctgaagatcctgcacaggtatgagattaccttcactctgcccccagtgcacaggctgagcaaggatgtccgcgaggcacctgtccccagcctgcacctcaagctcctcagcgtggtgcccgtccctgaaggttatagtgtcaagtgtgagtactcggcgcacaaagagggcgtcctcaaagaggagatactgctagcctgcgaaggtggcactggcacctgtgtgcgcgtgacggtgcaggcccgcgtcatggaccggcaccacggcacgcccatgctgctggatggtgtcaagtgtgtgggcgccgagctggaatacgactcagagcacagcgactggcacggctttgactgaggcccgaggccccgcctgccccgggcccctcagccttaaaccccgccttgtccccccgacatgctgcgtgatggtgtggcttcctcgcccctctctggggtgggtgtgggggtggagtggccttgcccacgcctctcacctctgccttcatttgtgctgccaccctgcccctccctcgtcctcctctcccacttcctcctctctgtgtgcctcagtctcctgccggaagaaatgggttgagcccgaaaggaggctgtctgaggaagggagagggagggcctggggtgggtcccccactccccaccccaagccacagggactcccaccagggtctgggagaggacggagctggctctgtggcgtcgtggccccattactgctgccttgcttcagccacctctcctgcccctccctagtccccactgctgtccaccatgagtaggagggaggtgcagtccccagcccccacccctcaggtctgtgttacttggtttttaagcgactggttgggatagaaccctaaagaaataaacttccagtggata

SEQ ID NO: 448914 - DNA, 1379 bp, Homo sapiens
aaccgaatgggcggaggcgggggcgtgccgacgggagggcggccgcggcgcggggctcccttcctcgtgctcggcgttgagctcctgcagccgccgccgctgcagtggtcgtccctgccctccccggccccggggtgcaccccgcaaggctcccgctggtgtccctggagcatgggaggctgctgagcgtgagtggcggtgtctggcaggagctgcgtggcagggagggcgtccatggctgcagccaacaagggtaagtgccttcctggcgtggtaggacttgcacaagctcttccggtgggccctggtaggagggccattgctgcaggcaacaagcccagagtccggagtatccgctttgcggcaggccacgatgcagaaggatcccacagccacgtccactttgatgagaagctgcatgactcggtggtcatggtcacccaggagagtgacagcagctttctggtcaaggttggcttcctgaagatcctgcacaggtatgagattaccttcactctgcccccagtgcacaggctgagcaaggatgtccgcgaggcacctgtccccagcctgcacctcaagctcctcagcgtggtgcccgtccctgaaggttatagtgtcaagtgtgagtactcggcgcacaaagagggcgtcctcaaagaggagatactgctagcctgcgaaggtggcactggcacctgtgtgcgcgtgacggtgcaggcccgcgtcatggaccggcaccacggcacgcccatgctgctggatggtgtcaagtgtgtgggcgccgagctggaatacgactcagagcacagcgactggcacggctttgactgaggcccgaggccccgcctgccccgggcccctcagccttaaaccccgccttgtccccccgacatgctgcgtgatggtgtggcttcctcgcccctctctggggtgggtgtgggggtggagtggccttgcccacgcctctcacctctgccttcatttgtgctgccaccctgcccctccctcgtcctcctctcccacttcctcctctctgtgtgcctcagtctcctgccggaagaaatgggttgagcccgaaaggaggctgtctgaggaagggagagggagggcctggggtgggtcccccactccccaccccaagccacagggactcccaccagggtctgggagaggacggagctggctctgtggcgtcgtggccccattactgctgccttgcttcagccacctctcctgcccctccctagtccccactgctgtccaccatgagtaggagggaggtgcagtccccagcccccacccctcaggtctgtgttacttggtttttaagcgactggttgggatagaaccctaaagaaataaacttccagtggata

SEQ ID NO: 448915 - DNA, 1022 bp, Homo sapiens
  misc_feature (26)..(26): n is a, c, g, or t
  misc_feature (33)..(33): n is a, c, g, or t
  misc_feature (943)..(943): n is a, c, g, or t
  misc_feature (947)..(947): n is a, c, g, or t
  misc_feature (954)..(954): n is a, c, g, or t
  misc_feature (961)..(961): n is a, c, g, or t
  misc_feature (964)..(964): n is a, c, g, or t
  misc_feature (971)..(971): n is a, c, g, or t
  misc_feature (975)..(975): n is a, c, g, or t
cccaacccaaccttacggctaggtangaggctnggtgttgaatcggccgaggctctgaccagcaccatggcggttggcaagaacaagcgccttacgaaaggcggcaaaaagggagccaagaagaaagtggttgatccattttctaagaaagattggtatgatgtgaaagcacctgctatgttcaatataagaaatattggaaagacgctcgtcaccaggacccaaggaaccaaaattgcatctgatggtctcaagggtcgtgtgtttgaagtgagtcttgctgatttgcagaatgatgaagttgcatttagaaaattcaagctgattactgaagatgttcagggtaaaaactgcctgactaacttccatggcatggatcttacccgtgacaaaatgtgttccatggtcaaaaaatggcagacaatgattgaagctcacgttgatgtcaagactaccgatggttacttgcttcgtctgttctgtgttggttttactaaaaaacgcaacaatcagatacggaagacctcttatgctcagcaccaacaggtccgccaaatccggaagaagatgatggaaatcatgacccgagaggtgcagacaaatgacttgaaagaagtggtcaataaattgattccagacagcattggaaaagacatagaaaaggcttgccaatctatttatcctctccatgatgtcttcgttagaaaagtaaaaatgctgaagaagcccaagtttgaattgggaaagctcatggagcttcatggtgaaggcagtagttctgggaaaagccactggggacgagacaggtgctaaagttgaacgagctgatggatattgaaccaccaggtccaagaatctgtttaaagttcagacttcaaatagtggcaataaaagggtattgtggaaactcgggacctaattcgggggcggacaaaagagtctnacangccaggncaaacgngtntgaccantttnttcaggggaaactgcggtcccaaagaggggaaactcaaaccgtcgta

SEQ ID NO: 448916 - DNA, 1095 bp, Homo sapiens
  misc_feature (898)..(898): n is a, c, g, or t
ttaacgggctaggtgcgaggcctggtggtgctgaccagcaccatggcggttggcaagaacaagcgccttacgaaaggcggcaaaaagggagccaagaagaaagtggttgatccattttctaagaaagattggtatgatgtgaaagcacctgctatgttcaatataagaaatattggaaagacgctcgtcaccaggacccaaggaaccaaaattgcatctgatggtctcaagggtcgtgtgtttgaagtgagtcttgctgatttgcagaatgatgaagttgcatttagaaaattcaagctgattactgaagatgttcagggtaaaaactgcctgactaacttccatggcatggatcttacccgtgacaaaatgtgttccatggtcaaaaaatggcagacaatgattgaagctcacgttgatgtcaagactaccgatggttacttgcttcgtctgttctgtgttggttttactaaaaaacgcaacaatcagatacggaagacctcttatgctcagcaccaacaggtccgccaaatccggaagaagatgatggaaatcatgacccgagaggtgcagacaaatgacttgaaagaagtggtcaataaattgattccagacagcattggaaaagacatagaaaaggcttgccaatctatttatcctctccatgatgtcttcgttagaaaagtaaaaatgctgaagaagcccaagtttgaattgggaaagctcatggagcttcatggtgaaggcagtagttctgggaaaagccactggggacgagacaggtgctaaagttgaacgagctgatggatattgaaccaccaggtccaagaatctgtttaaagttcagacttcaaatagtggcaataaaagggtattgtggaaattacagggcgactgngcgaaaacaaaaaaaaagaaaaaccggagaattacagagggaaaaagataaaagggaagagcaaggcagccactttcaagggaataggcacatggagcaaaacacgacgtaaaaagacgacgacaacaagagaaaaaaaaaagagatacaggagagacaaacaaagcgatacagaaaacaaccaatacccactaaga

SEQ ID NO: 448917 - DNA, 881 bp, Homo sapiens
cggacgcgtgggtcgacccacgcgtccgctgaccagcaccatggcggttggcaagaacaagcgccttacgaaaggcggcaaaaagggagccaagaagaaagtggttgatccattttctaagaaagattggtatgatgtgaaagcacctgctatgttcaatataagaaatattggaaagacgctcgtcaccaggacccaaggaaccaaaattgcatctgatggtctcaagggtcgtgtgtttgaagtgagtcttgctgatttgcagaatgatgaagttgcatttagaaaattcaagctgattactgaagatgttcagggtaaaaactgcctgactaacttccatggcatggatcttacccgtgacaaaatgtgttccatggtcaaaaaatggcagacaatgattgaagctcacgttgatgtcaagactaccgatggttacttgcttcgtctgttctgtgttggttttactaaaaaacgcaacaatcagatacggaagacctcttatgctcagcaccaacaggtccgccaaatccggaagaagatgatggaaatcatgacccgagaggtgcagacaaatgacttgaaagaagtggtcaataaattgattccagacagcattggaaaagacatagaaaaggcttgccaatctatttatcctctccatgatgtcttcgttagaaaagtaaaaatgctgaagaagcccaagtttgaattgggaaagctcatggagcttcatggtgaaggcagtagttctgggaaaagccactggggacgagacaggtgctaaagttgaacgagctgatggatattgaaccaccaggtccaagaatctgtttaaagttcagacttcaaatagtggcaataaaagggtattgtggaaa

SEQ ID NO: 448918 - DNA, 1188 bp, Homo sapiens
cggacgcgtgggtcgacccacgcgtccgctgaccagcaccatggcggttggcaagaacaagcgccttacgaaaggcggcaaaaagggagccaagaagaaagtggttgatccattttctaagaaagattggtatgatgtgaaagcacctgctatgttcaatataagaaatattggaaagacgctcgtcaccaggacccaaggaaccaaaattgcatctgatggtctcaagggtcgtgtgtttgaagtgagtcttgctgatttgcagaatgatgaagttgcatttagaaaattcaagctgattactgaagatgttcagggtaaaaactgcctgactaacttccatggcatggatcttacccgtgacaaaatgtgttccatggtcaaaaaatggcagacaatgattgaagctcacgttgatgtcaagactaccgatggttacttgcttcgtctgttctgtgttggttttactaaaaaacgcaacaatcagatacggaagacctcttatgctcagcaccaacaggtccgccaaatccggaagaagatgatggaaatcatgacccgagaggtgcagacaaatgacttgaaagaagtggtcaataaattgattccagacagcattggaaaagacatagaaaaggcttgccaatctatttatcctctccatgatgtcttcgttagaaaagtaaaaatgctgaagaagcccaagtttgaattgggaaagctcatggagcttcatggtgaaggcagtagttctgggaaaagccactggggacgagacaggtgctaaagttgaacgagctgatggatattgaaccaccaggtccaagaatctgtttaaagttcagacttcaaatagtggcaataaaagggtattgtggaaagacacccaccaacacaaaaacaacacaaaaacccgcgggcgacaacaattctggcgggcggcgaaaagaagatatacacaaggcacggagcgtgaaacaggttcatgcacccccctttgttcaacagcggggaatcgcgcgcccccctagaggggggtcacaaatagaagacgggcatcagaatattgagaacactaatgcagacacaacacgacacagcaccggacaccacagccaacgcgacaagcacagacgcgacgcataccagaccagcatcacgacacgcacagaccactaccgtcccaac

SEQ ID NO: 448919 - DNA, 1024 bp, Homo sapiens
  misc_feature (916)..(916): n is a, c, g, or t
  misc_feature (936)..(937): n is a, c, g, or t
tcccccccccaccgcgccaacccatagcgctaaggtactgaggcctcgagtgttgatcgacagcaccatggcggttggcaagaacaagcgccttacgaaaggcggcaaaaagggagccaagaagaaagtggttgatccattttctaagaaagattggtatgatgtgaaagcacctgctatgttcaatataagaaatattggaaagacgctcgtcaccaggacccaaggaaccaaaattgcatctgatggtctcaagggtcgtgtgtttgaagtgagtcttgctgatttgcagaatgatgaagttgcatttagaaaattcaagctgattactgaagatgttcagggtaaaaactgcctgactaacttccatggcatggatcttacccgtgacaaaatgtgttccatggtcaaaaaatggcagacaatgattgaagctcacgttgatgtcaagactaccgatggttacttgcttcgtctgttctgtgttggttttactaaaaaacgcaacaatcagatacggaagacctcttatgctcagcaccaacaggtccgccaaatccggaagaagatgatggaaatcatgacccgagaggtgcagacaaatgacttgaaagaagtggtcaataaattgattccagacagcattggaaaagacatagaaaaggcttgccaatctatttatcctctccatgatgtcttcgttagaaaagtaaaaatgctgaagaagcccaagtttgaattgggaaagctcatggagcttcatggtgaaggcagtagttctgggaaaagccactggggacgagacaggtgctaaagttgaacgagctgatggatattgaaccaccaggtccaagaatctgtttaaagttcagacttcaaatagtggcaataaaagggtattgtggaaatagtgganaagggtttgggacaaaaaannggggctaattccgggggcataggtactttgaggcaggggataaagagggggaaagagggaagtgtgagtttgggtgacactaaagtg

SEQ ID NO: 448920 - DNA, 1068 bp, Homo sapiens
  misc_feature (26)..(26): n is a, c, g, or t
  misc_feature (33)..(33): n is a, c, g, or t
cccaacccaaccttacggctaggtangaggctnggtgttgaatcggccgaggctctgaccagcaccatggcggttggcaagaacaagcgccttacgaaaggcggcaaaaagggagccaagaagaaagtggttgatccattttctaagaaagattggtatgatgtgaaagcacctgctatgttcaatataagaaatattggaaagacgctcgtcaccaggacccaaggaaccaaaattgcatctgatggtctcaagggtcgtgtgtttgaagtgagtcttgctgatttgcagaatgatgaagttgcatttagaaaattcaagctgattactgaagatgttcagggtaaaaactgcctgactaacttccatggcatggatcttacccgtgacaaaatgtgttccatggtcaaaaaatggcagacaatgattgaagctcacgttgatgtcaagactaccgatggttacttgcttcgtctgttctgtgttggttttactaaaaaacgcaacaatcagatacggaagacctcttatgctcagcaccaacaggtccgccaaatccggaagaagatgatggaaatcatgacccgagaggtgcagacaaatgacttgaaagaagtggtcaataaattgattccagacagcattggaaaagacatagaaaaggcttgccaatctatttatcctctccatgatgtcttcgttagaaaagtaaaaatgctgaagaagcccaagtttgaattgggaaagctcatggagcttcatggtgaaggcagtagttctgggaaaagccactggggacgagacaggtgctaaagttgaacgagctgatggatattgaaccaccaggtccaagaatctgtttaaagttcagacttcaaatagtggcaataaaagggtattgtggaaagtgaatggtaacaacaaaacacaacagcccacggcatctatgacgggctggggcaaagcgacagcaagggcaagggcacaacggacgcgcaccgatctgcgcgaacggcgcgaaccacgcaggccaaaggagggacacaccaacgaccgaaacagagacag

SEQ ID NO: 448921 - DNA, 1007 bp, Homo sapiens
  misc_feature (26)..(26): n is a, c, g, or t
  misc_feature (33)..(33): n is a, c, g, or t
cccaacccaaccttacggctaggtangaggctnggtgttgaatcggccgaggctctgaccagcaccatggcggttggcaagaacaagcgccttacgaaaggcggcaaaaagggagccaagaagaaagtggttgatccattttctaagaaagattggtatgatgtgaaagcacctgctatgttcaatataagaaatattggaaagacgctcgtcaccaggacccaaggaaccaaaattgcatctgatggtctcaagggtcgtgtgtttgaagtgagtcttgctgatttgcagaatgatgaagttgcatttagaaaattcaagctgattactgaagatgttcagggtaaaaactgcctgactaacttccatggcatggatcttacccgtgacaaaatgtgttccatggtcaaaaaatggcagacaatgattgaagctcacgttgatgtcaagactaccgatggttacttgcttcgtctgttctgtgttggttttactaaaaaacgcaacaatcagatacggaagacctcttatgctcagcaccaacaggtccgccaaatccggaagaagatgatggaaatcatgacccgagaggtgcagacaaatgacttgaaagaagtggtcaataaattgattccagacagcattggaaaagacatagaaaaggcttgccaatctatttatcctctccatgatgtcttcgttagaaaagtaaaaatgctgaagaagcccaagtttgaattgggaaagctcatggagcttcatggtgaaggcagtagttctgggaaaagccactggggacgagacaggtgctaaagttgaacgagctgatggatattgaaccaccaggtccaagaatctgtttaaagttcagacttcaaatagtggcaataaaagggtattgtggaaattaaaaggccttgcgcacacacaaaaaaacccgggctctttcgggcggaaagaaaaggcggagtccgccctttgagggaagggcctaggattgacaaata

SEQ ID NO: 448922 - DNA, 1023 bp, Homo sapiens
  misc_feature (26)..(26): n is a, c, g, or t
  misc_feature (33)..(33): n is a, c, g, or t
  misc_feature (915)..(915): n is a, c, g, or t
  misc_feature (935)..(936): n is a, c, g, or t
cccaacccaaccttacggctaggtangaggctnggtgttgaatcggccgaggctctgaccagcaccatggcggttggcaagaacaagcgccttacgaaaggcggcaaaaagggagccaagaagaaagtggttgatccattttctaagaaagattggtatgatgtgaaagcacctgctatgttcaatataagaaatattggaaagacgctcgtcaccaggacccaaggaaccaaaattgcatctgatggtctcaagggtcgtgtgtttgaagtgagtcttgctgatttgcagaatgatgaagttgcatttagaaaattcaagctgattactgaagatgttcagggtaaaaactgcctgactaacttccatggcatggatcttacccgtgacaaaatgtgttccatggtcaaaaaatggcagacaatgattgaagctcacgttgatgtcaagactaccgatggttacttgcttcgtctgttctgtgttggttttactaaaaaacgcaacaatcagatacggaagacctcttatgctcagcaccaacaggtccgccaaatccggaagaagatgatggaaatcatgacccgagaggtgcagacaaatgacttgaaagaagtggtcaataaattgattccagacagcattggaaaagacatagaaaaggcttgccaatctatttatcctctccatgatgtcttcgttagaaaagtaaaaatgctgaagaagcccaagtttgaattgggaaagctcatggagcttcatggtgaaggcagtagttctgggaaaagccactggggacgagacaggtgctaaagttgaacgagctgatggatattgaaccaccaggtccaagaatctgtttaaagttcagacttcaaatagtggcaataaaagggtattgtggaaatagtgganaagggtttgggacaaaaaannggggctaattccgggggcataggtactttgaggcaggggataaagagggggaaagagggaagtgtgagtttgggtgacactaaagtg

SEQ ID NO: 448923 - DNA, 1037 bp, Homo sapiens
  misc_feature (26)..(26): n is a, c, g, or t
  misc_feature (33)..(33): n is a, c, g, or t
  misc_feature (922)..(922): n is a, c, g, or t
  misc_feature (929)..(929): n is a, c, g, or t
  misc_feature (934)..(934): n is a, c, g, or t
  misc_feature (942)..(942): n is a, c, g, or t
  misc_feature (944)..(944): n is a, c, g, or t
  misc_feature (948)..(948): n is a, c, g, or t
  misc_feature (951)..(951): n is a, c, g, or t
  misc_feature (962)..(962): n is a, c, g, or t
  misc_feature (968)..(968): n is a, c, g, or t
cccaacccaaccttacggctaggtangaggctnggtgttgaatcggccgaggctctgaccagcaccatggcggttggcaagaacaagcgccttacgaaaggcggcaaaaagggagccaagaagaaagtggttgatccattttctaagaaagattggtatgatgtgaaagcacctgctatgttcaatataagaaatattggaaagacgctcgtcaccaggacccaaggaaccaaaattgcatctgatggtctcaagggtcgtgtgtttgaagtgagtcttgctgatttgcagaatgatgaagttgcatttagaaaattcaagctgattactgaagatgttcagggtaaaaactgcctgactaacttccatggcatggatcttacccgtgacaaaatgtgttccatggtcaaaaaatggcagacaatgattgaagctcacgttgatgtcaagactaccgatggttacttgcttcgtctgttctgtgttggttttactaaaaaacgcaacaatcagatacggaagacctcttatgctcagcaccaacaggtccgccaaatccggaagaagatgatggaaatcatgacccgagaggtgcagacaaatgacttgaaagaagtggtcaataaattgattccagacagcattggaaaagacatagaaaaggcttgccaatctatttatcctctccatgatgtcttcgttagaaaagtaaaaatgctgaagaagcccaagtttgaattgggaaagctcatggagcttcatggtgaaggcagtagttctgggaaaagccactggggacgagacaggtgctaaagttgaacgagctgatggatattgaaccaccaggtccaagaatctgtttaaagttcagacttcaaatagtggcaataaaagggtattgtggaaaccggggctttttcgngcggaanggttnagggctgntntttnccngccctttgtcnaggganccggcccataagggatatgaacgattaattcacacaataaaaacaaaaaggtaaaaaaaaagaaaaaat

SEQ ID NO: 448924 - DNA, 883 bp, Homo sapiens
ttaacgggctaggtgcgaggcctggtggtgctgaccagcaccatggcggttggcaagaacaagcgccttacgaaaggcggcaaaaagggagccaagaagaaagtggttgatccattttctaagaaagattggtatgatgtgaaagcacctgctatgttcaatataagaaatattggaaagacgctcgtcaccaggacccaaggaaccaaaattgcatctgatggtctcaagggtcgtgtgtttgaagtgagtcttgctgatttgcagaatgatgaagttgcatttagaaaattcaagctgattactgaagatgttcagggtaaaaactgcctgactaacttccatggcatggatcttacccgtgacaaaatgtgttccatggtcaaaaaatggcagacaatgattgaagctcacgttgatgtcaagactaccgatggttacttgcttcgtctgttctgtgttggttttactaaaaaacgcaacaatcagatacggaagacctcttatgctcagcaccaacaggtccgccaaatccggaagaagatgatggaaatcatgacccgagaggtgcagacaaatgacttgaaagaagtggtcaataaattgattccagacagcattggaaaagacatagaaaaggcttgccaatctatttatcctctccatgatgtcttcgttagaaaagtaaaaatgctgaagaagcccaagtttgaattgggaaagctcatggagcttcatggtgaaggcagtagttctgggaaaagccactggggacgagacaggtgctaaagttgaacgagctgatggatattgaaccaccaggtccaagaatctgtttaaagttcagacttcaaatagtggcaataaaagggtattgtggaaa

SEQ ID NO: 448925 - DNA, 897 bp, Homo sapiens
tgttaatgaaagtatgaatcgctttttggctctctgaccagcaccatggcagcaccatggcggttggcaagaacaagcgccttacgaaaggcggcaaaaagggagccaagaagaaagtggttgatccattttctaagaaagattggtatgatgtgaaagcacctgctatgttcaatataagaaatattggaaagacgctcgtcaccaggacccaaggaaccaaaattgcatctgatggtctcaagggtcgtgtgtttgaagtgagtcttgctgatttgcagaatgatgaagttgcatttagaaaattcaagctgattactgaagatgttcagggtaaaaactgcctgactaacttccatggcatggatcttacccgtgacaaaatgtgttccatggtcaaaaaatggcagacaatgattgaagctcacgttgatgtcaagactaccgatggttacttgcttcgtctgttctgtgttggttttactaaaaaacgcaacaatcagatacggaagacctcttatgctcagcaccaacaggtccgccaaatccggaagaagatgatggaaatcatgacccgagaggtgcagacaaatgacttgaaagaagtggtcaataaattgattccagacagcattggaaaagacatagaaaaggcttgccaatctatttatcctctccatgatgtcttcgttagaaaagtaaaaatgctgaagaagcccaagtttgaattgggaaagctcatggagcttcatggtgaaggcagtagttctgggaaaagccactggggacgagacaggtgctaaagttgaacgagctgatggatattgaaccaccaggtccaagaatctgtttaaagttcagacttcaaatagtggcaataaaagggtattgtggaaa

SEQ ID NO: 448926 - DNA, 908 bp, Homo sapiens
tcccccccccaccgcgccaacccatagcgctaaggtactgaggcctcgagtgttgatcgacagcaccatggcggttggcaagaacaagcgccttacgaaaggcggcaaaaagggagccaagaagaaagtggttgatccattttctaagaaagattggtatgatgtgaaagcacctgctatgttcaatataagaaatattggaaagacgctcgtcaccaggacccaaggaaccaaaattgcatctgatggtctcaagggtcgtgtgtttgaagtgagtcttgctgatttgcagaatgatgaagttgcatttagaaaattcaagctgattactgaagatgttcagggtaaaaactgcctgactaacttccatggcatggatcttacccgtgacaaaatgtgttccatggtcaaaaaatggcagacaatgattgaagctcacgttgatgtcaagactaccgatggttacttgcttcgtctgttctgtgttggttttactaaaaaacgcaacaatcagatacggaagacctcttatgctcagcaccaacaggtccgccaaatccggaagaagatgatggaaatcatgacccgagaggtgcagacaaatgacttgaaagaagtggtcaataaattgattccagacagcattggaaaagacatagaaaaggcttgccaatctatttatcctctccatgatgtcttcgttagaaaagtaaaaatgctgaagaagcccaagtttgaattgggaaagctcatggagcttcatggtgaaggcagtagttctgggaaaagccactggggacgagacaggtgctaaagttgaacgagctgatggatattgaaccaccaggtccaagaatctgtttaaagttcagacttcaaatagtggcaataaaagggtattgtggaaa

SEQ ID NO: 448927 - DNA, 944 bp, Homo sapiens
  misc_feature (26)..(26): n is a, c, g, or t
  misc_feature (33)..(33): n is a, c, g, or t
  misc_feature (877)..(877): n is a, c, g, or t
cccaacccaaccttacggctaggtangaggctnggtgttgaatcggccgaggctctgaccagcaccatggcggttggcaagaacaagcgccttacgaaaggcggcaaaaagggagccaagaagaaagtggttgatccattttctaagaaagattggtatgatgtgaaagcacctgctatgttcaatataagaaatattggaaagacgctcgtcaccaggacccaaggaaccaaaattgcatctgatggtctcaagggtcgtgtgtttgaagtgagtcttgctgatttgcagaatgatgaagttgcatttagaaaattcaagctgattactgaagatgttcagggtaaaaactgcctgactaacttccatggcatggatcttacccgtgacaaaatgtgttccatggtcaaaaaatggcagacaatgattgaagctcacgttgatgtcaagactaccgatggttacttgcttcgtctgttctgtgttggttttactaaaaaacgcaacaatcagatacggaagacctcttatgctcagcaccaacaggtccgccaaatccggaagaagatgatggaaatcatgacccgagaggtgcagacaaatgacttgaaagaagtggtcaataaattgattccagacagcattggaaaagacatagaaaaggcttgccaatctatttatcctctccatgatgtcttcgttagaaaagtaaaaatgctgaagaagcccaagtttgaattgggaaagctcatggagcttcatggtgaaggcagtagttctgggaaaagccactggggacgagacaggtgctaaagttgagtgacgagtgtggttgaccccgccaattgttagtcactccatggggaaaggttggganaaaaactcgggttttgggggaggtgaggtgcattggcctgtagggtggctaaggttggggaatgaat

SEQ ID NO: 448928 - DNA, 883 bp, Homo sapiens
  misc_feature (26)..(26): n is a, c, g, or t
  misc_feature (33)..(33): n is a, c, g, or t
cccaacccaaccttacggctaggtangaggctnggtgttgaatcggccgaggctctgaccagcaccatggcggttggcaagaacaagcgccttacgaaaggcggcaaaaagggagccaagaagaaagtggttgatccattttctaagaaagattggtatgatgtgaaagcacctgctatgttcaatataagaaatattggaaagacgctcgtcaccaggacccaaggaaccaaaattgcatctgatggtctcaagggtcgtgtgtttgaagtgagtcttgctgatttgcagaatgatgaagttgcatttagaaaattcaagctgattactgaagatgttcagggtaaaaactgcctgactaacttccatggcatggatcttacccgtgacaaaatgtgttccatggtcaaaaaatggcagacaatgattgaagctcacgttgatgtcaagactaccgatggttacttgcttcgtctgttctgtgttggttttactaaaaaacgcaacaatcagatacggaagacctcttatgctcagcaccaacaggtccgccaaatccggaagaagatgatggaaatcatgacccgagaggtgcagacaaatgacttgaaagaagtggtcaataaattgattccagacagcattggaaaagacatagaaaaggcttgccaatctatttatcctctccatgatgtcttcgttagaaaagtaaaaatgctgaagaagcccaagtttgaattgggaaagctcatggagcttcatggtgaaggcagtagttctgggaaaagccactggggacgagacaggtgctaaagttgatgtggtttaacaccgtcagaattcgttagttcgattatgtggcttaagggtttggggaaacaag

SEQ ID NO: 448929 - DNA, 840 bp, Homo sapiens
  misc_feature (26)..(26): n is a, c, g, or t
  misc_feature (33)..(33): n is a, c, g, or t
  misc_feature (793)..(793): n is a, c, g, or t
  misc_feature (803)..(803): n is a, c, g, or t
cccaacccaaccttacggctaggtangaggctnggtgttgaatcggccgaggctctgaccagcaccatggcggttggcaagaacaagcgccttacgaaaggcggcaaaaagggagccaagaagaaagtggttgatccattttctaagaaagattggtatgatgtgaaagcacctgctatgttcaatataagaaatattggaaagacgctcgtcaccaggacccaaggaaccaaaattgcatctgatggtctcaagggtcgtgtgtttgaagtgagtcttgctgatttgcagaatgatgaagttgcatttagaaaattcaagctgattactgaagatgttcagggtaaaaactgcctgactaacttccatggcatggatcttacccgtgacaaaatgtgttccatggtcaaaaaatggcagacaatgattgaagctcacgttgatgtcaagactaccgatggttacttgcttcgtctgttctgtgttggttttactaaaaaacgcaacaatcagatacggaagacctcttatgctcagcaccaacaggtccgccaaatccggaagaagatgatggaaatcatgacccgagaggtgcagacaaatgacttgaaagaagtggtcaataaattgattccagacagcattggaaaagacatagaaaaggcttgccaatctatttatcctctccatgatgtcttcgttagaaaagtaaaaatgctgaagaagcccaagtttgaattgggaaagctcatggagcttcatgggaatctggaaacccggggcgaacagggcnagtacggcgnggttaccccccattgttgtccatccttggaaaaggtg

SEQ ID NO: 448930 - DNA, 959 bp, Homo sapiens
  misc_feature (880)..(880): n is a, c, g, or t
  misc_feature (884)..(884): n is a, c, g, or t
  misc_feature (891)..(891): n is a, c, g, or t
  misc_feature (898)..(898): n is a, c, g, or t
  misc_feature (901)..(901): n is a, c, g, or t
  misc_feature (908)..(908): n is a, c, g, or t
  misc_feature (912)..(912): n is a, c, g, or t
aactaggctaggtacgaggcggtgggtaatcggccgagccacttccgccccagcaccatggcggttggcaagaacaagcgccttacgaaaggcggcaaaaagggagccaagaagaaagtggttgatccattttctaagaaagattggtatgatgtgaaagcacctgctatgttcaatataagaaatattggaaagacgctcgtcaccaggacccaaggaaccaaaattgcatctgatggtctcaagggtcgtgtgtttgaagtgagtcttgctgatttgcagaatgatgaagttgcatttagaaaattcaagctgattactgaagatgttcagggtaaaaactgcctgactaacttccatggcatggatcttacccgtgacaaaatgtgttccatggtcaaaaaatggcagacaatgattgaagctcacgttgatgtcaagactaccgatggttacttgcttcgtctgttctgtgttggttttactaaccaaatccggaagaagatgatggaaatcatgacccgagaggtgcagacaaatgacttgaaagaagtggtcaataaattgattccagacagcattggaaaagacatagaaaaggcttgccaatctatttatcctctccatgatgtcttcgttagaaaagtaaaaatgctgaagaagcccaagtttgaattgggaaagctcatggagcttcatggtgaaggcagtagttctgggaaaagccactggggacgagacaggtgctaaagttgaacgagctgatggatattgaaccaccaggtccaagaatctgtttaaagttcagacttcaaatagtggcaataaaagggtattgtggaaactcgggacctaattcgggggcggacaaaagagtctnacangccaggncaaacgngtntgaccantttnttcaggggaaactgcggtcccaaagaggggaaactcaaaccgtcgta

SEQ ID NO: 448931 - DNA, 907 bp, Homo sapiens
  misc_feature (26)..(26): n is a, c, g, or t
  misc_feature (33)..(33): n is a, c, g, or t
cccaacccaaccttacggctaggtangaggctnggtgttgaatcggccgaggctctgaccagcaccatggcggttggcaagaacaagcgccttacgaaaggcggcaaaaagggagccaagaagaaagtggttgatccattttctaagaaagattggtatgatgtgaaagcacctgctatgttcaatataagaaatattggaaagacgctcgtcaccaggacccaaggaaccaaaattgcatctgatggtctcaagggtcgtgtgtttgaagtgagtcttgctgatttgcagaatgatgaagttgcatttagaaaattcaagctgattactgaagatgttcagggtaaaaactgcctgactaacttccatggcatggatcttacccgtgacaaaatgtgttccatggtcaaaaaatggcagacaatgattgaagctcacgttgatgtcaagactaccgatggttacttgcttcgtctgttctgtgttggttttactaaaaaacgcaacaatcagatacggaagacctcttatgctcagcaccaacaggtccgccaaatccggaagaagatgatggaaatcatgacccgagaggtgcagacaaatgacttgaaagaagtggtcaataaattgattccagacagcattggaaaagacatagaaaaggcttgccaatctatttatcctctccatgatgtcttcgttagaaaagtaaaaatgctgaagaagcccaagtttgaattgggaaagctcatggagcttcatggtgaaggcagtagttctgggaaaagccactggggacgagacaggtgctaaagttgaacgagctgatggatattgaaccaccaggtccaagaatctgtttaaagttcagacttcaaatagtggcaataaaagggtattgtggaaa

SEQ ID NO: 448932 - DNA, 898 bp, Homo sapiens
aactaggctaggtacgaggcggtgggtaatcggccgagccacttccgccccagcaccatggcggttggcaagaacaagcgccttacgaaaggcggcaaaaagggagccaagaagaaagtggttgatccattttctaagaaagattggtatgatgtgaaagcacctgctatgttcaatataagaaatattggaaagacgctcgtcaccaggacccaaggaaccaaaattgcatctgatggtctcaagggtcgtgtgtttgaagtgagtcttgctgatttgcagaatgatgaagttgcatttagaaaattcaagctgattactgaagatgttcagggtaaaaactgcctgactaacttccatggcatggatcttacccgtgacaaaatgtgttccatggtcaaaaaatggcagacaatgattgaagctcacgttgatgtcaagactaccgatggttacttgcttcgtctgttctgtgttggttttactaaaaaacgcaacaatcagatacggaagacctcttatgctcagcaccaacaggtccgccaaatccggaagaagatgatggaaatcatgacccgagaggtgcagacaaatgacttgaaagaagtggtcaataaattgattccagacagcattggaaaagacatagaaaaggcttgccaatctatttatcctctccatgatgtcttcgttagaaaagtaaaaatgctgaagaagcccaagtttgaattgggaaagctcatggagcttcatggtgaaggcagtagttctgggaaaagccactggggacgagacaggtgctaaagttgaacgagctgatggatattgaaccaccaggtccaagaatctgtttaaagttcagacttcaaatagtggcaataaaagggtattgtggaaa

SEQ ID NO: 448933 - DNA, 1059 bp, Homo sapiens
aactaggctaggtacgaggcggtgggtaatcggccgagccacttccgccccagcaccatggcggttggcaagaacaagcgccttacgaaaggcggcaaaaagggagccaagaagaaagtggttgatccattttctaagaaagattggtatgatgtgaaagcacctgctatgttcaatataagaaatattggaaagacgctcgtcaccaggacccaaggaaccaaaattgcatctgatggtctcaagggtcgtgtgtttgaagtgagtcttgctgatttgcagaatgatgaagttgcatttagaaaattcaagctgattactgaagatgttcagggtaaaaactgcctgactaacttccatggcatggatcttacccgtgacaaaatgtgttccatggtcaaaaaatggcagacaatgattgaagctcacgttgatgtcaagactaccgatggttacttgcttcgtctgttctgtgttggttttactaaaaaacgcaacaatcagatacggaagacctcttatgctcagcaccaacaggtccgccaaatccggaagaagatgatggaaatcatgacccgagaggtgcagacaaatgacttgaaagaagtggtcaataaattgattccagacagcattggaaaagacatagaaaaggcttgccaatctatttatcctctccatgatgtcttcgttagaaaagtaaaaatgctgaagaagcccaagtttgaattgggaaagctcatggagcttcatggtgaaggcagtagttctgggaaaagccactggggacgagacaggtgctaaagttgaacgagctgatggatattgaaccaccaggtccaagaatctgtttaaagttcagacttcaaatagtggcaataaaagggtattgtggaaagtgaatggtaacaacaaaacacaacagcccacggcatctatgacgggctggggcaaagcgacagcaagggcaagggcacaacggacgcgcaccgatctgcgcgaacggcgcgaaccacgcaggccaaaggagggacacaccaacgaccgaaacagagacag

SEQ ID NO: 448934 - DNA, 1029 bp, Homo sapiens
  misc_feature (916)..(916): n is a, c, g, or t
ccacagcacgctcaggccgaggttaaatcgagcacgaggggcggcagcaccatggcggttggcaagaacaagcgccttacgaaaggcggcaaaaagggagccaagaagaaagtggttgatccattttctaagaaagattggtatgatgtgaaagcacctgctatgttcaatataagaaatattggaaagacgctcgtcaccaggacccaaggaaccaaaattgcatctgatggtctcaagggtcgtgtgtttgaagtgagtcttgctgatttgcagaatgatgaagttgcatttagaaaattcaagctgattactgaagatgttcagggtaaaaactgcctgactaacttccatggcatggatcttacccgtgacaaaatgtgttccatggtcaaaaaatggcagacaatgattgaagctcacgttgatgtcaagactaccgatggttacttgcttcgtctgttctgtgttggttttactaaaaaacgcaacaatcagatacggaagacctcttatgctcagcaccaacaggtccgccaaatccggaagaagatgatggaaatcatgacccgagaggtgcagacaaatgacttgaaagaagtggtcaataaattgattccagacagcattggaaaagacatagaaaaggcttgccaatctatttatcctctccatgatgtcttcgttagaaaagtaaaaatgctgaagaagcccaagtttgaattgggaaagctcatggagcttcatggtgaaggcagtagttctgggaaaagccactggggacgagacaggtgctaaagttgaacgagctgatggatattgaaccaccaggtccaagaatctgtttaaagttcagacttcaaatagtggcaataaaagggtattgtggaaagcacatacaaggggccttggcganacacaacacaaaaacaagagaacaacgagaaaaaaaaaaaaggggcggggaaaaaaatacacagaagggggcaaaaaaaccccaccgaatgaagaaagggccccaagggcaga

SEQ ID NO: 448935 - DNA, 934 bp, Homo sapiens
  misc_feature (867)..(867): n is a, c, g, or t
tgttaatgaaagtatgaatcgctttttggctctctgaccagcaccatggcagcaccatggcggttggcaagaacaagcgccttacgaaaggcggcaaaaagggagccaagaagaaagtggttgatccattttctaagaaagattggtatgatgtgaaagcacctgctatgttcaatataagaaatattggaaagacgctcgtcaccaggacccaaggaaccaaaattgcatctgatggtctcaagggtcgtgtgtttgaagtgagtcttgctgatttgcagaatgatgaagttgcatttagaaaattcaagctgattactgaagatgttcagggtaaaaactgcctgactaacttccatggcatggatcttacccgtgacaaaatgtgttccatggtcaaaaaatggcagacaatgattgaagctcacgttgatgtcaagactaccgatggttacttgcttcgtctgttctgtgttggttttactaaaaaacgcaacaatcagatacggaagacctcttatgctcagcaccaacaggtccgccaaatccggaagaagatgatggaaatcatgacccgagaggtgcagacaaatgacttgaaagaagtggtcaataaattgattccagacagcattggaaaagacatagaaaaggcttgccaatctatttatcctctccatgatgtcttcgttagaaaagtaaaaatgctgaagaagcccaagtttgaattgggaaagctcatggagcttcatggtgaaggcagtagttctgggaaaagccactggggacgagacaggtgctaaagttgagtgacgagtgtggttgaccccgccaattgttagtcactccatggggaaaggttggganaaaaactcgggttttgggggaggtgaggtgcattggcctgtagggtggctaaggttggggaatgaat

SEQ ID NO: 448936 - DNA, 1214 bp, Homo sapiens
  misc_feature (26)..(26): n is a, c, g, or t
  misc_feature (33)..(33): n is a, c, g, or t
cccaacccaaccttacggctaggtangaggctnggtgttgaatcggccgaggctctgaccagcaccatggcggttggcaagaacaagcgccttacgaaaggcggcaaaaagggagccaagaagaaagtggttgatccattttctaagaaagattggtatgatgtgaaagcacctgctatgttcaatataagaaatattggaaagacgctcgtcaccaggacccaaggaaccaaaattgcatctgatggtctcaagggtcgtgtgtttgaagtgagtcttgctgatttgcagaatgatgaagttgcatttagaaaattcaagctgattactgaagatgttcagggtaaaaactgcctgactaacttccatggcatggatcttacccgtgacaaaatgtgttccatggtcaaaaaatggcagacaatgattgaagctcacgttgatgtcaagactaccgatggttacttgcttcgtctgttctgtgttggttttactaaaaaacgcaacaatcagatacggaagacctcttatgctcagcaccaacaggtccgccaaatccggaagaagatgatggaaatcatgacccgagaggtgcagacaaatgacttgaaagaagtggtcaataaattgattccagacagcattggaaaagacatagaaaaggcttgccaatctatttatcctctccatgatgtcttcgttagaaaagtaaaaatgctgaagaagcccaagtttgaattgggaaagctcatggagcttcatggtgaaggcagtagttctgggaaaagccactggggacgagacaggtgctaaagttgaacgagctgatggatattgaaccaccaggtccaagaatctgtttaaagttcagacttcaaatagtggcaataaaagggtattgtggaaagacacccaccaacacaaaaacaacacaaaaacccgcgggcgacaacaattctggcgggcggcgaaaagaagatatacacaaggcacggagcgtgaaacaggttcatgcacccccctttgttcaacagcggggaatcgcgcgcccccctagaggggggtcacaaatagaagacgggcatcagaatattgagaacactaatgcagacacaacacgacacagcaccggacaccacagccaacgcgacaagcacagacgcgacgcataccagaccagcatcacgacacgcacagaccactaccgtcccaac

SEQ ID NO: 448937 - DNA, 1044 bp, Homo sapiens
  misc_feature (26)..(26): n is a, c, g, or t
  misc_feature (33)..(33): n is a, c, g, or t
  misc_feature (931)..(931): n is a, c, g, or t
cccaacccaaccttacggctaggtangaggctnggtgttgaatcggccgaggctctgaccagcaccatggcggttggcaagaacaagcgccttacgaaaggcggcaaaaagggagccaagaagaaagtggttgatccattttctaagaaagattggtatgatgtgaaagcacctgctatgttcaatataagaaatattggaaagacgctcgtcaccaggacccaaggaaccaaaattgcatctgatggtctcaagggtcgtgtgtttgaagtgagtcttgctgatttgcagaatgatgaagttgcatttagaaaattcaagctgattactgaagatgttcagggtaaaaactgcctgactaacttccatggcatggatcttacccgtgacaaaatgtgttccatggtcaaaaaatggcagacaatgattgaagctcacgttgatgtcaagactaccgatggttacttgcttcgtctgttctgtgttggttttactaaaaaacgcaacaatcagatacggaagacctcttatgctcagcaccaacaggtccgccaaatccggaagaagatgatggaaatcatgacccgagaggtgcagacaaatgacttgaaagaagtggtcaataaattgattccagacagcattggaaaagacatagaaaaggcttgccaatctatttatcctctccatgatgtcttcgttagaaaagtaaaaatgctgaagaagcccaagtttgaattgggaaagctcatggagcttcatggtgaaggcagtagttctgggaaaagccactggggacgagacaggtgctaaagttgaacgagctgatggatattgaaccaccaggtccaagaatctgtttaaagttcagacttcaaatagtggcaataaaagggtattgtggaaagcacatacaaggggccttggcganacacaacacaaaaacaagagaacaacgagaaaaaaaaaaaaggggcggggaaaaaaatacacagaagggggcaaaaaaaccccaccgaatgaagaaagggccccaagggcaga

SEQ ID NO: 448938 - DNA, 1119 bp, Homo sapiens
  misc_feature (26)..(26): n is a, c, g, or t
  misc_feature (33)..(33): n is a, c, g, or t
  misc_feature (922)..(922): n is a, c, g, or t
cccaacccaaccttacggctaggtangaggctnggtgttgaatcggccgaggctctgaccagcaccatggcggttggcaagaacaagcgccttacgaaaggcggcaaaaagggagccaagaagaaagtggttgatccattttctaagaaagattggtatgatgtgaaagcacctgctatgttcaatataagaaatattggaaagacgctcgtcaccaggacccaaggaaccaaaattgcatctgatggtctcaagggtcgtgtgtttgaagtgagtcttgctgatttgcagaatgatgaagttgcatttagaaaattcaagctgattactgaagatgttcagggtaaaaactgcctgactaacttccatggcatggatcttacccgtgacaaaatgtgttccatggtcaaaaaatggcagacaatgattgaagctcacgttgatgtcaagactaccgatggttacttgcttcgtctgttctgtgttggttttactaaaaaacgcaacaatcagatacggaagacctcttatgctcagcaccaacaggtccgccaaatccggaagaagatgatggaaatcatgacccgagaggtgcagacaaatgacttgaaagaagtggtcaataaattgattccagacagcattggaaaagacatagaaaaggcttgccaatctatttatcctctccatgatgtcttcgttagaaaagtaaaaatgctgaagaagcccaagtttgaattgggaaagctcatggagcttcatggtgaaggcagtagttctgggaaaagccactggggacgagacaggtgctaaagttgaacgagctgatggatattgaaccaccaggtccaagaatctgtttaaagttcagacttcaaatagtggcaataaaagggtattgtggaaattacagggcgactgngcgaaaacaaaaaaaaagaaaaaccggagaattacagagggaaaaagataaaagggaagagcaaggcagccactttcaagggaataggcacatggagcaaaacacgacgtaaaaagacgacgacaacaagagaaaaaaaaaagagatacaggagagacaaacaaagcgatacagaaaacaaccaatacccactaaga

SEQ ID NO: 448939 - DNA, 892 bp, Homo sapiens
ccacagcacgctcaggccgaggttaaatcgagcacgaggggcggcagcaccatggcggttggcaagaacaagcgccttacgaaaggcggcaaaaagggagccaagaagaaagtggttgatccattttctaagaaagattggtatgatgtgaaagcacctgctatgttcaatataagaaatattggaaagacgctcgtcaccaggacccaaggaaccaaaattgcatctgatggtctcaagggtcgtgtgtttgaagtgagtcttgctgatttgcagaatgatgaagttgcatttagaaaattcaagctgattactgaagatgttcagggtaaaaactgcctgactaacttccatggcatggatcttacccgtgacaaaatgtgttccatggtcaaaaaatggcagacaatgattgaagctcacgttgatgtcaagactaccgatggttacttgcttcgtctgttctgtgttggttttactaaaaaacgcaacaatcagatacggaagacctcttatgctcagcaccaacaggtccgccaaatccggaagaagatgatggaaatcatgacccgagaggtgcagacaaatgacttgaaagaagtggtcaataaattgattccagacagcattggaaaagacatagaaaaggcttgccaatctatttatcctctccatgatgtcttcgttagaaaagtaaaaatgctgaagaagcccaagtttgaattgggaaagctcatggagcttcatggtgaaggcagtagttctgggaaaagccactggggacgagacaggtgctaaagttgaacgagctgatggatattgaaccaccaggtccaagaatctgtttaaagttcagacttcaaatagtggcaataaaagggtattgtggaaa

SEQ ID NO: 448940 - DNA, 929 bp, Homo sapiens
aagtattagtaggtcggcaccgcgttgtaatttcagtactgatggatgagcatgtgcttgtacagtttgtcttgacatggccagcaccatggcggttggcaagaacaagcgccttacgaaaggcggcaaaaagggagccaagaagaaagtggttgatccattttctaagaaagattggtatgatgtgaaagcacctgctatgttcaatataagaaatattggaaagacgctcgtcaccaggacccaaggaaccaaaattgcatctgatggtctcaagggtcgtgtgtttgaagtgagtcttgctgatttgcagaatgatgaagttgcatttagaaaattcaagctgattactgaagatgttcagggtaaaaactgcctgactaacttccatggcatggatcttacccgtgacaaaatgtgttccatggtcaaaaaatggcagacaatgattgaagctcacgttgatgtcaagactaccgatggttacttgcttcgtctgttctgtgttggttttactaaaaaacgcaacaatcagatacggaagacctcttatgctcagcaccaacaggtccgccaaatccggaagaagatgatggaaatcatgacccgagaggtgcagacaaatgacttgaaagaagtggtcaataaattgattccagacagcattggaaaagacatagaaaaggcttgccaatctatttatcctctccatgatgtcttcgttagaaaagtaaaaatgctgaagaagcccaagtttgaattgggaaagctcatggagcttcatggtgaaggcagtagttctgggaaaagccactggggacgagacaggtgctaaagttgaacgagctgatggatattgaaccaccaggtccaagaatctgtttaaagttcagacttcaaatagtggcaataaaagggtattgtggaaa

SEQ ID NO: 448941 - DNA, 882 bp, Homo sapiens
  misc_feature (26)..(26): n is a, c, g, or t
  misc_feature (33)..(33): n is a, c, g, or t
  misc_feature (824)..(824): n is a, c, g, or t
  misc_feature (831)..(831): n is a, c, g, or t
  misc_feature (835)..(835): n is a, c, g, or t
  misc_feature (840)..(840): n is a, c, g, or t
  misc_feature (845)..(845): n is a, c, g, or t
cccaacccaaccttacggctaggtangaggctnggtgttgaatcggccgaggctctgaccagcaccatggcggttggcaagaacaagcgccttacgaaaggcggcaaaaagggagccaagaagaaagtggttgatccattttctaagaaagattggtatgatgtgaaagcacctgctatgttcaatataagaaatattggaaagacgctcgtcaccaggacccaaggaaccaaaattgcatctgatggtctcaagggtcgtgtgtttgaagtgagtcttgctgatttgcagaatgatgaagttgcatttagaaaattcaagctgattactgaagatgttcagggtaaaaactgcctgactaacttccatggcatggatcttacccgtgacaaaatgtgttccatggtcaaaaaatggcagacaatgattgaagctcacgttgatgtcaagactaccgatggttacttgcttcgtctgttctgtgttggttttactaaaaaacgcaacaatcagatacggaagacctcttatgctcagcaccaacaggtccgccaaatccggaagaagatgatggaaatcatgacccgagaggtgcagacaaatgacttgaaagaagtggtcaataaattgattccagacagcattggaaaagacatagaaaaggcttgccaatctatttatcctctccatgatgtcttcgttagaaaagtaaaaatgctgaagaagcccaagtttgaattgggaaagctcatggagcttcatggtgaaggcagtagttctgggaaaagccactggggacgagacaggtgctaaagttgaagcgngggttancccntccanattgntagtccgcttctgtgcgtcgggcttgggcaaaaaatg

SEQ ID NO: 448942 - DNA, 984 bp, Homo sapiens
  misc_feature (26)..(26): n is a, c, g, or t
  misc_feature (33)..(33): n is a, c, g, or t
  misc_feature (905)..(905): n is a, c, g, or t
  misc_feature (909)..(909): n is a, c, g, or t
  misc_feature (916)..(916): n is a, c, g, or t
  misc_feature (923)..(923): n is a, c, g, or t
  misc_feature (926)..(926): n is a, c, g, or t
  misc_feature (933)..(933): n is a, c, g, or t
  misc_feature (937)..(937): n is a, c, g, or t
cccaacccaaccttacggctaggtangaggctnggtgttgaatcggccgaggctctgaccagcaccatggcggttggcaagaacaagcgccttacgaaaggcggcaaaaagggagccaagaagaaagtggttgatccattttctaagaaagattggtatgatgtgaaagcacctgctatgttcaatataagaaatattggaaagacgctcgtcaccaggacccaaggaaccaaaattgcatctgatggtctcaagggtcgtgtgtttgaagtgagtcttgctgatttgcagaatgatgaagttgcatttagaaaattcaagctgattactgaagatgttcagggtaaaaactgcctgactaacttccatggcatggatcttacccgtgacaaaatgtgttccatggtcaaaaaatggcagacaatgattgaagctcacgttgatgtcaagactaccgatggttacttgcttcgtctgttctgtgttggttttactaaaaaacgcaacaatcagatacggaagacctcttatgctcagcaccaacaggtccgccaaatccggaagaagatgatggaaatcatgacccgagaggattccagacagcattggaaaagacatagaaaaggcttgccaatctatttatcctctccatgatgtcttcgttagaaaagtaaaaatgctgaagaagcccaagtttgaattgggaaagctcatggagcttcatggtgaaggcagtagttctgggaaaagccactggggacgagacaggtgctaaagttgaacgagctgatggatattgaaccaccaggtccaagaatctgtttaaagttcagacttcaaatagtggcaataaaagggtattgtggaaactcgggacctaattcgggggcggacaaaagagtctnacangccaggncaaacgngtntgaccantttnttcaggggaaactgcggtcccaaagaggggaaactcaaaccgtcgta

SEQ ID NO: 448943 - DNA, 817 bp, Homo sapiens
  misc_feature (26)..(26): n is a, c, g, or t
  misc_feature (33)..(33): n is a, c, g, or t
cccaacccaaccttacggctaggtangaggctnggtgttgaatcggccgaggctctgaccagcaccatggcggttggcaagaacaagcgccttacgaaaggcggcaaaaagggagccaagaagaaagtggttgatccattttctaagaaagattggtatgatgtgaaagcacctgctatgttcaatataagaaatattggaaagacgctcgtcaccaggacccaaggaaccaaaattgcatctgatggtctcaagggtcgtgtgtttgaagtgagtcttgctgatttgcagaatgatgaagttgcatttagaaaattcaagctgattactgaagatgttcagggtaaaaactgcctgactaacttccatggcatggatcttacccgtgacaaaatgtgttccatggtcaaaaaatggcagacaatgattgaaacctcttatgctcagcaccaacaggtccgccaaatccggaagaagatgatggaaatcatgacccgagaggtgcagacaaatgacttgaaagaagtggtcaataaattgattccagacagcattggaaaagacatagaaaaggcttgccaatctatttatcctctccatgatgtcttcgttagaaaagtaaaaatgctgaagaagcccaagtttgaattgggaaagctcatggagcttcatggtgaaggcagtagttctgggaaaagccactggggacgagacaggtgctaaagttgaacgagctgatggatattgaaccaccaggtccaagaatctgtttaaagttcagacttcaaatagtggcaataaaagggtattgtggaaa

SEQ ID NO: 448944 - DNA, 5925 bp, Homo sapiens
cccaaagttcgaaaccaacagaacgaaaagcaacgaagcacacttaaagtgaggaacccggcaagcggcgaaattcttgctgaagagaagaaaaagcgaaaggttttccgctgcaaccaatcagatgagaggattcttggcacgcccctttctatctaccaatcaacatctagctcaatggggcagtccattgccacagggaaagggcttggtgcagcttccctcacaacacacacgtcattctaggccattccacgaactgtgctcaaaagaggaaaacagtgcaacagttccaaagctgatcagtctcgtggtgagcagcgaaactatagacttctctaacaaaaccatggattctaggagggactgggaaagagaaaaacgaattctggaaggcaaactacaactcccaaaggcccttgcgcggactcagcgcgcgagggacgaagggcgggcgtggacgagccggtggctgcagcggcggcggtccccggagtcctgtgaagcgcccctgtccgcgcctctgtggggccctcagagagggctgccaggacgcgagccactgaggagccgctcagccagcgccatagcccttaggactatcggtcacattctcgcgctcctgctccggctcctccatcttggcctcggcagtggcggctgccgggaggatgtgccgccttctggcagggggaagaaggaggagaagatgaagaagcaccggcgggccttggccctggtctcctgcctctttctgtgctctctggtctggcttcccagctggcgtgtatgttgtaaagagagttcttcagcttcagcgtcatcatattactctcaagatgacaactgcgcactagaaaatgaagatgtacaattccagaaaaagaatacagagtcaaaaaagttaagtccaccggtggtggagacactccctacagttgatttgcatgaagagtcttccaatgcagttgtggacagtgaaactgttgaaaatatttccagctcatctacctcagaaatcactccaatctcaaagcttgatgaaatagaaaaatctggtactattccgatagccaaaccaagtgaaactgagcagtctgaaactgattgtgatgttggtgaggcccttgatgctagtgctccaattgaacaaccttcctttgtcagtccacctgacagccttgttggccagcatatagaaaatgtatcatcttcacatggtaaaggaaagataacaaaatcagaatttgaatcaaaagtttcagcaagtgaacagggcggtggtgatccaaaatctgcattgaatgcttcagataatttaaaaaatgagagctctgattatacaaaaccaggagacattgaccctacatcagtagcaagtcccaaagatccagaagatataccaacatttgatgaatggaagaagaaagttatggaagtagaaaaagaaaaaagtcagtcgatgcatgcatcttctaatggaggttcacatgccaccaaaaaggtccagaaaaatcgaaataattatgcctcagtagaatgtggtgccaaaattctagcagctaatccagaagccaagagcacatctgctattcttatagaaaatatggatctttacatgttgaatccttgcagcactaaaatttggtttgttattgaactttgtgaaccaattcaagtaaaacagcttgatattgcaaattatgaattattttcttctactcctaaagattttctggtttctatcagtgacagatatccaacaaataagtggattaagctgggtacttttcatggtagagatgagcggaatgtacagagtttccctttagatgaacagatgtatgcaaaatatgtcaaggttgagttgctatcacattttggatcagagcacttttgtccattaagccttataagggtatttggcactagcatggtggaagaatatgaagaaattgctgattcccagtatcactcagaacgccaggaactatttgatgaggactatgattatccactggattataatactggagaggataaatcctcaaaaaatcttcttggttctgctacaaatgccattctaaatatggtgaatattgctgctaatattctgggagcaaaaactgaagacctgacagaaggaaataaaagtatatctgagaatgccactgccacagctgcacctaaaatgcctgaatcaactcctgtttcaactcctgttccatctcctgagtatgtaaccactgaagtacacacacatgacatggagccgtcaacaccagatactccaaaagagagtcccattgtacagttagttcaagaggaggaagaggaggcaagtccatctacagtgacccttctgggcagcggtgaacaggaagatgaatcatcaccctggtttgagtcagagacacaaatattttgcagtgaactgaccacaatttgttgtatttctagtttttcagaatacatatataaatggtgttcagttagagttgctctttatcggcagcgcagccgaactgctttgagtaaaggaaaagattatcttgtgttagctcaaccacccttactacttcctgcggaatcagtagatgtttcagtattgcaacctctgagtggagaattggaaaatacgaatatagaaagggaagctgaaactgttgttctgggtgatttaagtagtagtatgcaccaggatgacttggtgaatcacactgtagatgcagttgaacttgaaccaagccattctcaaactctttctcagtctcttcttttagatattaccccagaaatcaatcccttgcctaaaatagaagtatctgagtctgttgaatatgaggcaggacatataccatcaccagtgattccccaagagagttctgttgagatcgataatgaaacagaacaaaagtctgagagctttagttctatagagaaaccatctattacctatgaaacaaataaagttaatgagttaatggataatattataaaagaagatgtgaactccatgcaaattttcacaaagctgtctgaaacaatagtgccaccaataaatacagccactgtacccgacaatgaagatggggaagccaaaatgaatatagctgacacagcaaagcaaactttgatttctgttgtggattcttcttcattacctgaagtaaaagaagaagaacagtctccagaagatgcccttttgagagggttacagaggacagctacagatttttatgctgaattgcaaaattctacagatctaggatatgctaatggaaatcttgtacatggatcaaaccaaaaggagtcagtatttatgagacttaataatcgtattaaagccttagaagttaacatgtctctcagtggtcgctatctggaggagcttagccaaaggtaccgaaaacaaatggaagaaatgcaaaaggctttcaataaaacaatcgtgaaacttcagaatacttcaagaatagcagaggagcaggatcagcggcaaactgaagccatccagttgctacaggcacagctgaccaacatgacacagcttgtttcaaatttatcagcaacagtagcagaattgaaacgggaggtttcagatcgacaaagctatcttgtcatatctttggttctttgtgttgtcttgggactgatgctttgtatgcagcgttgtcgaaatacttctcaatttgatggagattatatttcaaaacttcctaaaagtaatcagtatccaagccctaaaaggtgtttctcttcctatgatgatatgaatttgaaaagaagaacttcattcccactcatgagatccaagtctctacagttaactggcaaagaagtagacccaaatgatttgtacattgtagaacccctcaagttttctccagaaaagaagaagaagcgctgcaagtacaaaattgaaaaaattgagaccataaagcctgaagaaccattgcaccccatagccaatggcgacataaaaggaagaaagccctttacgaaccagagagatttttctaatatgggagaagtttatcactcttcttataaaggtcctccatctgaaggaagctcagaaacttcatcacagtcagaagagtcctatttttgtggcatttcagcttgcacaagtctgtgcaatggacagtctcaaaagacaaaaactgagaagagggctttaaaacgaagacgatctaaagtccaagaccaaggaaaattgataaaaactctaatacagactaagtcgggatcattgccgagcctgcatgacataatcaaaggaaacaaagagatcaccgtgggaacatttggtgttacagcagtctcgggacatatctaaaattaattgaacttttcatacagaagacttttttgttgttgttctttgaagaacagtctgtagtatttgaagggtttgggggagggagaaaatattaatgggaaaggcattcagaaattatggtttctacctttttaaaaagtagatgggattgtgtcaatcttggttaatgagctacagttttacaaagctgatcacttcctataaggacaatggtagacattttataaagatgttttttcacaagattaattactgggacaaaagtaatttggaagcccagttccttaggtgggataggaatgaaagcctaaacctcttcctttagctttgttcctatttcttgcaccttcccatatttatgtgccttttgtctatttataatgccactggaagaggagggataactttttctgttatttgatttcttttataactttgttaggtttttgaagctgcaaacactacaatgctttgagggggtctgtgcctgaagctcaggagtgtggatcagacagtctaaagatcctaaaaacttgccaactggatctttgtttagcaaactcactggaaatgaacacttaatggaatttttaagtctgttctgttaggtagatggtgatgctcttgttattttcacttattcagactggattacttcttacttagttactaactcaatgaggaaaaatccctacaggatctttttttgcaaacaactgatatatgcagacaaatttttgacaaattcaccttttaaacacacttaaccatttgtgaaggttttctttagcttacattttaaacatacacaataaacactaatcctccaaactttcactgtttttattagtatgaatataaaatttgaaggtttggccaattagtacaagtctcatgatataatcactgcctgcatacatatgcacagatccagttagtgagtttgtcaagcttaatctaattggttaagtctaaagagattattattccttgatgtttgctttgtattggctacaaatgtgcagaggtaatacatatgtgatgtcgatgtctctgtctttttttttgtctttaaaaaataattggcagcaactgtatttgaataaaatgatttcttagtatgattgtacagtaatgaatgaaagtggaacatgtttctttttgaaagggagagaattgaccatttattgttgtgatgtttaagttataacttattgagcacttttagtagtgataactgtttttaaacttgcctaatacctttcttgggtattgtttgtaatgtgacttatttaacgccttttttgtttgtttaagttgctgctttaggttaacagcgtgttttagaagatttaaatttctttcctgtctgcacaattagctattcagagcaagagggcctgattttatagaagccccttgaaaagaggtccagatgagagcagagatacagtgagaaattatgtgatctgtgtgttgtgggaagagaattttcaatatgtaactacggagctgtagtgccattagaaactgtgaatttccaaataaatctgaacacttgtctttattaaaaaaaaaat

SEQ ID NO: 448945 - DNA, 2886 bp, Homo sapiens
ggaaatttttaaaacttggttttgggcctactttataacccaaaaaattcttccgaaaattttccatttgtctttgcgcccactgctttgctttaaaaaccctgacttcttaaatatttctggttatatgctagtttatatatatggaacacatgttaatttgaaaagtaatttacccaattctgttatacagtatttcacattgtagccgtgggtgaccaaaataaataaataataattcttgttggggagggttagacacggtcccagatacttcgtgttttgtttatttctaaaatttctgttccaagtttacttactcattgagattcctattaatacatttgttttggaataacttaatggttttttttagattatttgacttccatttataatgttaatagtttgtagttaatattccaaaaaaaatatattcctcttatcataggatcagcggcaaactgaagccatccagttgctacaggcacagctgaccaacatgacacagcttgtttcaaatttatcagcaacagtagcagaattgaaacgggaggtttcagatcgacaaagctatcttgtcatatctttggttctttgtgttgtcttgggactgatgctttgtatgcagcgttgtcgaaatacttctcaatttgatggagattatatttcaaaacttcctaaaagtaatcagtatccaagccctaaaaggtgtttctcttcctatgatgatatgaatttgaaaagaagaacttcattcccactcatgagatccaagtctctacagttaactggcaaagaagtagacccaaatgatttgtacattgtagaacccctcaagttttctccagaaaagaagaagaagcgctgcaagtacaaaattgaaaaaattgagaccataaagcctgaagaaccattgcaccccatagccaatggcgacataaaaggaagaaagccctttacgaaccagagagatttttctaatatgggagaagtttatcactcttcttataaaggtcctccatctgaaggaagctcagaaacttcatcacagtcagaagagtcctatttttgtggcatttcagcttgcacaagtctgtgcaatggacagtctcaaaagacaaaaactgagaagagggctttaaaacgaagacgatctaaagtccaagaccaaggaaaattgataaaaactctaatacagactaagtcgggatcattgccgagcctgcatgacataatcaaaggaaacaaagagatcaccgtgggaacatttggtgttacagcagtctcgggacatatctaaaattaattgaacttttcatacagaagacttttttgttgttgttctttgaagaacagtctgtagtatttgaagggtttgggggagggagaaaatattaatgggaaaggcattcagaaattatggtttctacctttttaaaaagtagatgggattgtgtcaatcttggttaatgagctacagttttacaaagctgatcacttcctataaggacaatggtagacattttataaagatgttttttcacaagattaattactgggacaaaagtaatttggaagcccagttccttaggtgggataggaatgaaagcctaaacctcttcctttagctttgttcctatttcttgcaccttcccatatttatgtgccttttgtctatttataatgccactggaagaggagggataactttttctgttatttgatttcttttataactttgttaggtttttgaagctgcaaacactacaatgctttgagggggtctgtgcctgaagctcaggagtgtggatcagacagtctaaagatcctaaaaacttgccaactggatctttgtttagcaaactcactggaaatgaacacttaatggaatttttaagtctgttctgttaggtagatggtgatgctcttgttattttcacttattcagactggattacttcttacttagttactaactcaatgaggaaaaatccctacaggatctttttttgcaaacaactgatatatgcagacaaatttttgacaaattcaccttttaaacacacttaaccatttgtgaaggttttctttagcttacattttaaacatacacaataaacactaatcctccaaactttcactgtttttattagtatgaatataaaatttgaaggtttggccaattagtacaagtctcatgatataatcactgcctgcatacatatgcacagatccagttagtgagtttgtcaagcttaatctaattggttaagtctaaagagattattattccttgatgtttgctttgtattggctacaaatgtgcagaggtaatacatatgtgatgtcgatgtctctgtctttttttttgtctttaaaaaataattggcagcaactgtatttgaataaaatgatttcttagtatgattgtacagtaatgaatgaaagtggaacatgtttctttttgaaagggagagaattgaccatttattgttgtgatgtttaagttataacttattgagcacttttagtagtgataactgtttttaaacttgcctaatacctttcttgggtattgtttgtaatgtgacttatttaacgccttttttgtttgtttaagttgctgctttaggttaacagcgtgttttagaagatttaaatttctttcctgtctgcacaattagctattcagagcaagagggcctgattttatagaagccccttgaaaagaggtccagatgagagcagagatacagtgagaaattatgtgatctgtgtgttgtgggaagagaattttcaatatgtaactacggagctgtagtgccattagaaactgtgaatttccaaataaatctgaacacttgtctttattaaaaaaaaaat

SEQ ID NO: 448946 - DNA, 908 bp, Homo sapiens
taagtctaaagagattattattccttgatgtttgcttgtatggctacaaatgtgcagacaaatttttgacaaattcaccttttaaacacacttaaccatttgtgaaggttttctttagcttacattttaaacatacacaataaacactaatcctccaaactttcactgtttttattagtatgaatataaaatttgaaggtttggccaattagtacaagtctcatgatataatcactgcctgcatacatatgcacagatccagttagtgagtttgtcaagcttaatctaattggttaagtctaaagagattattattccttgatgtttgctttgtattggctacaaatgtgcagaggtaatacatatgtgatgtcgatgtctctgtctttttttttgtctttaaaaaataattggcagcaactgtatttgaataaaatgatttcttagtatgattgtacagtaatgaatgaaagtggaacatgtttctttttgaaagggagagaattgaccatttattgttgtgatgtttaagttataacttattgagcacttttagtagtgataactgtttttaaacttgcctaatacctttcttgggtattgtttgtaatgtgacttatttaacgccttttttgtttgtttaagttgctgctttaggttaacagcgtgttttagaagatttaaatttctttcctgtctgcacaattagctattcagagcaagagggcctgattttatagaagccccttgaaaagaggtccagatgagagcagagatacagtgagaaattatgtgatctgtgtgttgtgggaagagaattttcaatatgtaactacggagctgtagtgccattagaaactgtgaatttccaaataaatctgaacacttgtctttattaaaaaaaaaat

SEQ ID NO: 448947 - DNA, 5496 bp, Homo sapiens
tgggcgggacctggggcgggcggagcggcgaaagcatctgctcctgcgctttgtggtctcctgcctccggcttctccgcctgcgacgtcgaagggggcgtggcctgcgcagaggctggtgggggtgcgggcgccgcgggacttgggtgacgcgtccctttccagctcagcggtgtgtgaggtgtcgcggccccgccggcgattggctgttgagaggcgagtacgcggcggccgttggtcgctggcctcacggagcaaggcccccggcgggcggggaggatatggggcggcagtggcggctgcaggaggcgggcgtggacgagccggtggctgcagcggcggcggtccccggagtcctgtgaagcgcccctgtccgcgcctctgtggggccctcagagagggctgccaggacgcgagccactgaggagccgctcagccagcgccatagcccttaggactatcggtcacattctcgcgctcctgctccggctcctccatcttggcctcggcagtggcggctgccgggaggatgtgccgccttctggcagggggaagaaggaggagaagatgaagaagcaccggcgggccttggccctggtctcctgcctctttctgtgctctctggtctggcttcccagctggcgtgtatgttgtaaagagagttcttcagcttcagcgtcatcatattactctcaagatgacaactgcgcactagaaaatgaagatgtacaattccagaaaaagaatacagagtcaaaaaagttaagtccaccggtggtggagacactccctacagttgatttgcatgaagagtcttccaatgcagttgtggacagtgaaactgttgaaaatatttccagctcatctacctcagaaatcactccaatctcaaagcttgatgaaatagaaaaatctggtactattccgatagccaaaccaagtgaaactgagcagtctgaaactgattgtgatgttggtgaggcccttgatgctagtgctccaattgaacaaccttcctttgtcagtccacctgacagccttgttggccagcatatagaaaatgtatcatcttcacatggtaaaggaaagataacaaaatcagaatttgaatcaaaagtttcagcaagtgaacagggcggtggtgatccaaaatctgcattgaatgcttcagataatttaaaaaatgagagctctgattatacaaaaccaggagacattgaccctacatcagtagcaagtcccaaagatccagaagatataccaacatttgatgaatggaagaagaaagttatggaagtagaaaaagaaaaaagtcagtcgatgcatgcatcttctaatggaggttcacatgccaccaaaaaggtccagaaaaatcgaaataattatgcctcagtagaatgtggtgccaaaattctagcagctaatccagaagccaagagcacatctgctattcttatagaaaatatggatctttacatgttgaatccttgcagcactaaaatttggtttgttattgaactttgtgaaccaattcaagtaaaacagcttgatattgcaaattatgaattattttcttctactcctaaagattttctggtttctatcagtgacagatatccaacaaataagtggattaagctgggtacttttcatggtagagatgagcggaatgtacagagtttccctttagatgaacagatgtatgcaaaatatgtcaaggttgagttgctatcacattttggatcagagcacttttgtccattaagccttataagggtatttggcactagcatggtggaagaatatgaagaaattgctgattcccagtatcactcagaacgccaggaactatttgatgaggactatgattatccactggattataatactggagaggataaatcctcaaaaaatcttcttggttctgctacaaatgccattctaaatatggtgaatattgctgctaatattctgggagcaaaaactgaagacctgacagaaggaaataaaagtatatctgagaatgccactgccacagctgcacctaaaatgcctgaatcaactcctgtttcaactcctgttccatctcctgagtatgtaaccactgaagtacacacacatgacatggagccgtcaacaccagatactccaaaagagagtcccattgtacagttagttcaagaggaggaagaggaggcaagtccatctacagtgacccttctgggcagcggtgaacaggaagatgaatcatcaccctggtttgagtcagagacacaaatattttgcagtgaactgaccacaatttgttgtatttctagtttttcagaatacatatataaatggtgttcagttagagttgctctttatcggcagcgcagccgaactgctttgagtaaaggaaaagattatcttgtgttagctcaaccacccttactacttcctgcggaatcagtagatgtttcagtattgcaacctctgagtggagaattggaaaatacgaatatagaaagggaagctgaaactgttgttctgggtgatttaagtagtagtatgcaccaggatgacttggtgaatcacactgtagatgcagttgaacttgaaccaagccattctcaaactctttctcagtctcttcttttagatattaccccagaaatcaatcccttgcctaaaatagaagtatctgagtctgttgaatatgaggcaggacatataccatcaccagtgattccccaagagagttctgttgagatcgataatgaaacagaacaaaagtctgagagctttagttctatagagaaaccatctattacctatgaaacaaataaagttaatgagttaatggataatattataaaagaagatgtgaactccatgcaaattttcacaaagctgtctgaaacaatagtgccaccaataaatacagccactgtacccgacaatgaagatggggaagccaaaatgaatatagctgacacagcaaagcaaactttgatttctgttgtggattcttcttcattacctgaagtaaaagaagaagaacagtctccagaagatgcccttttgagagggttacagaggacagctacagatttttatgctgaattgcaaaattctacagatctaggatatgctaatggaaatcttgtacatggatcaaaccaaaaggagtcagtatttatgagacttaataatcgtattaaagccttagaagttaacatgtctctcagtggtcgctatctggaggagcttagccaaaggtaccgaaaacaaatggaagaaatgcaaaaggctttcaataaaacaatcgtgaaacttcagaatacttcaagaatagcagaggagcaggatcagcggcaaactgaagccatccagttgctacaggcacagctgaccaacatgacacagcttgtttcaaatttatcagcaacagtagcagaattgaaacgggaggtttcagatcgacaaagctatcttgtcatatctttggttctttgtgttgtcttgggactgatgctttgtatgcagcgttgtcgaaatacttctcaatttgatggagattatatttcaaaacttcctaaaagtaatcagtatccaagccctaaaaggtgtttctcttcctatgatgatatgaatttgaaaagaagaacttcattcccactcatgagatccaagtctctacagttaactggcaaagaagtagacccaaatgatttgtacattgtagaacccctcaagttttctccagaaaagaagaagaagcgctgcaagtacaaaattgaaaaaattgagaccataaagcctgaagaaccattgcaccccatagccaatggcgacataaaaggaagaaagccctttacgaaccagagagatttttctaatatgggagaagtttatcactcttcttataaaggtcctccatctgaaggaagctcagaaacttcatcacagtcagaagagtcctatttttgtggcatttcagcttgcacaagtctgtgcaatggacagtctcaaaagacaaaaactgagaagagggctttaaaacgaagacgatctaaagtccaagaccaaggaaaattgataaaaactctaatacagactaagtcgggatcattgccgagcctgcatgacataatcaaaggaaacaaagagatcaccgtgggaacatttggtgttacagcagtctcgggacatatctaaaattaattgaacttttcatacagaagacttttttgttgttgttctttgaagaacagtctgtagtatttgaagggtttgggggagggagaaaatattaatgggaaaggcattcagaaattatggtttctacctttttaaaaagtagatgggattgtgtcaatcttggttaatgagctacagttttacaaagctgatcacttcctataaggacaatggtagacattttataaagatgttttttcacaagattaattactgggacaaaagtaatttggaagcccagttccttaggtgggataggaatgaaagcctaaacctcttcctttagctttgttcctatttcttgcaccttcccatatttatgtgccttttgtctatttataatgccactggaagaggagggataactttttctgttatttgatttcttttataactttgttaggtttttgaagctgcaaacactacaatgctttgagggggtctgtgcctgaagctcaggagtgtggatcagacagtctaaagatcctaaaaacttgccaactggatctttgtttagcaaactcactggaaatgaacacttaatggaatttttaagtctgttctgttaggtagatggtgatgctcttgttattttcacttattcagactggattacttcttacttagttactaactcaatgaggaaaaatccctacaggatctttttttgcaaacaactgatatatgcagacaaatttttgacaaattcaccttttaaacacacttaaccatttgtgaaggttttctttagcttacattttaaacatacacaataaacactaatcctccaaactttcactgtttttattagtatgaatataaaatttgaaggtttggccaattagtacaagtctcatgatataatcactgcctgcatacatatgcacagatccagttagtgagtttgtcaagcttaatctaattggttaagtctaaagagattattattccttgatgtttgctttgtattggctacaaatgtgcagaggtaatacatatgtgatgtcgatgtctctgtctttttttttgtctttaaaaaataattggcagcaactgtatttgaataaaatgatttcttagtatgattgtacagtaatgaatgaaagtggaaccattacaatcaacacatttttgccaatgagaaataagtttgtttactcctgtagcataaaaatccatgcttccaaatttgacgaactcttggaaagcattttctgtgtctgctagttgtggagcaatttcctgcacaatctct

SEQ ID NO: 448948 - DNA, 628 bp, Homo sapiens
ccccttttgatgaagcattttgcaaacaaatgtcataaaagtgaatttaagcaaagcattaagggggaaagcatgttctttcagtaaacatttagatacctagtatgagctagataggctcaggtaaacaaagattgaatatgaacttttatgaaaattacactctagaaggcataaaggtattagaaattctaacttgaatgtatgtcaaaaaagagatgaaagaaagagctttatgtatcttcatttgtcaggtattcattggagttttactaggtgcttacaacggtgctggatggtaagactaaaatgcttattaagaaatcaaatgaagttcttgaactggtgtattgcacattttaaatgttgtagcaatgaggggattcaaggaaatagacaataatcttgtatacaaatgaaattaattagagtcaaataaacaaggcagttttttggttttaaagtatggaaaaaaaccatcttcgtattgctttataactgttttgtaaaacagttttatcaggtgatttttgttgttgttgttatataggatgaaagagagggacctatcaatgccgaatcattgggaaaatcaggttcaaatttacctatttctccaaaagaacat

SEQ ID NO: 448949 - DNA, 5914 bp, Homo sapiens
tgggcgggacctggggcgggcggagcggcgaaagcatctgctcctgcgctttgtggtctcctgcctccggcttctccgcctgcgacgtcgaagggggcgtggcctgcgcagaggctggtgggggtgcgggcgccgcgggacttgggtgacgcgtccctttccagctcagcggtgtgtgaggtgtcgcggccccgccggcgattggctgttgagaggcgagtacgcggcggccgttggtcgctggcctcacggagcaaggcccccggcgggcggggaggatatggggcggcagtggcggctgcaggaggcgggcgtggacgagccggtggctgcagcggcggcggtccccggagtcctgtgaagcgcccctgtccgcgcctctgtggggccctcagagagggctgccaggacgcgagccactgaggagccgctcagccagcgccatagcccttaggactatcggtcacattctcgcgctcctgctccggctcctccatcttggcctcggcagtggcggctgccgggaggatgtgccgccttctggcagggggaagaaggaggagaagatgaagaagcaccggcgggccttggccctggtctcctgcctctttctgtgctctctggtctggcttcccagctggcgtgtatgttgtaaagagagttcttcagcttcagcgtcatcatattactctcaagatgacaactgcgcactagaaaatgaagatgtacaattccagaaaaaggatgaaagagagggacctatcaatgccgaatcattgggaaaatcaggttcaaatttacctatttctccaaaagaacataaattaaaagatgattctattgtggatgtacaaaatacagagtcaaaaaagttaagtccaccggtggtggagacactccctacagttgatttgcatgaagagtcttccaatgcagttgtggacagtgaaactgttgaaaatatttccagctcatctacctcagaaatcactccaatctcaaagcttgatgaaatagaaaaatctggtactattccgatagccaaaccaagtgaaactgagcagtctgaaactgattgtgatgttggtgaggcccttgatgctagtgctccaattgaacaaccttcctttgtcagtccacctgacagccttgttggccagcatatagaaaatgtatcatcttcacatggtaaaggaaagataacaaaatcagaatttgaatcaaaagtttcagcaagtgaacagggcggtggtgatccaaaatctgcattgaatgcttcagataatttaaaaaatgagagctctgattatacaaaaccaggagacattgaccctacatcagtagcaagtcccaaagatccagaagatataccaacatttgatgaatggaagaagaaagttatggaagtagaaaaagaaaaaagtcagtcgatgcatgcatcttctaatggaggttcacatgccaccaaaaaggtccagaaaaatcgaaataattatgcctcagtagaatgtggtgccaaaattctagcagctaatccagaagccaagagcacatctgctattcttatagaaaatatggatctttacatgttgaatccttgcagcactaaaatttggtttgttattgaactttgtgaaccaattcaagtaaaacagcttgatattgcaaattatgaattattttcttctactcctaaagattttctggtttctatcagtgacagatatccaacaaataagtggattaagctgggtacttttcatggtagagatgagcggaatgtacagagtttccctttagatgaacagatgtatgcaaaatatgtcaagatgttcatcaagtacataaaggttgagttgctatcacattttggatcagagcacttttgtccattaagccttataagggtatttggcactagcatggtggaagaatatgaagaaattgctgattcccagtatcactcagaacgccaggaactatttgatgaggactatgattatccactggattataatactggagaggataaatcctcaaaaaatcttcttggttctgctacaaatgccattctaaatatggtgaatattgctgctaatattctgggagcaaaaactgaagacctgacagaaggaaataaaagtatatctgagaatgccactgccacagctgcacctaaaatgcctgaatcaactcctgtttcaactcctgttccatctcctgagtatgtaaccactgaagtacacacacatgacatggagccgtcaacaccagatactccaaaagagagtcccattgtacagttagttcaagaggaggaagaggaggcaagtccatctacagtgacccttctgggcagcggtgaacaggaagatgaatcatcaccctggtttgagtcagagacacaaatattttgcagtgaactgaccacaatttgttgtatttctagtttttcagaatacatatataaatggtgttcagttagagttgctctttatcggcagcgcagccgaactgctttgagtaaaggaaaagattatcttgtgttagctcaaccacccttactacttcctgcggaatcagtagatgtttcagtattgcaacctctgagtggagaattggaaaatacgaatatagaaagggaagctgaaactgttgttctgggtgatttaagtagtagtatgcaccaggatgacttggtgaatcacactgtagatgcagttgaacttgaaccaagccattctcaaactctttctcagtctcttcttttagatattaccccagaaatcaatcccttgcctaaaatagaagtatctgagtctgttgaatatgaggcaggacatataccatcaccagtgattccccaagagagttctgttgagatcgataatgaaacagaacaaaagtctgagagctttagttctatagagaaaccatctattacctatgaaacaaataaagttaatgagttaatggataatattataaaagaagatgtgaactccatgcaaattttcacaaagctgtctgaaacaatagtgccaccaataaatacagccactgtacccgacaatgaagatggggaagccaaaatgaatatagctgacacagcaaagcaaactttgatttctgttgtggattcttcttcattacctgaagtaaaagaagaagaacagtctccagaagatgcccttttgagagggttacagaggacagctacagatttttatgctgaattgcaaaattctacagatctaggatatgctaatggaaatcttgtacatggatcaaaccaaaaggagtcagtatttatgagacttaataatcgtattaaagccttagaagttaacatgtctctcagtggtcgctatctggaggagcttagccaaaggtaccgaaaacaaatggaagaaatgcaaaaggctttcaataaaacaatcgtgaaacttcagaatacttcaagaatagcagaggagcaggatcagcggcaaactgaagccatccagttgctacaggcacagctgaccaacatgacacagcttgtttcaaatttatcagcaacagtagcagaattgaaacgggaggtttcagatcgacaaagctatcttgtcatatctttggttctttgtgttgtcttgggactgatgctttgtatgcagcgttgtcgaaatacttctcaatttgatggagattatatttcaaaacttcctaaaagtaatcagtatccaagccctaaaaggtgtttctcttcctatgatgatatgaatttgaaaagaagaacttcattcccactcatgagatccaagtctctacagttaactggcaaagaagtagacccaaatgatttgtacattgtagaacccctcaagttttctccagaaaagaagaagaagcgctgcaagtacaaaattgaaaaaattgagaccataaagcctgaagaaccattgcaccccatagccaatggcgacataaaaggaagaaagccctttacgaaccagagagatttttctaatatgggagaagtttatcactcttcttataaaggtcctccatctgaaggaagctcagaaacttcatcacagtcagaagagtcctatttttgtggcatttcagcttgcacaagtctgtgcaatggacagtctcaaaagacaaaaactgagaagagggctttaaaacgaagacgatctaaagtccaagaccaaggaaaattgataaaaactctaatacagactaagtcgggatcattgccgagcctgcatgacataatcaaaggaaacaaagagatcaccgtgggaacatttggtgttacagcagtctcgggacatatctaaaattaattgaacttttcatacagaagacttttttgttgttgttctttgaagaacagtctgtagtatttgaagggtttgggggagggagaaaatattaatgggaaaggcattcagaaattatggtttctacctttttaaaaagtagatgggattgtgtcaatcttggttaatgagctacagttttacaaagctgatcacttcctataaggacaatggtagacattttataaagatgttttttcacaagattaattactgggacaaaagtaatttggaagcccagttccttaggtgggataggaatgaaagcctaaacctcttcctttagctttgttcctatttcttgcaccttcccatatttatgtgccttttgtctatttataatgccactggaagaggagggataactttttctgttatttgatttcttttataactttgttaggtttttgaagctgcaaacactacaatgctttgagggggtctgtgcctgaagctcaggagtgtggatcagacagtctaaagatcctaaaaacttgccaactggatctttgtttagcaaactcactggaaatgaacacttaatggaatttttaagtctgttctgttaggtagatggtgatgctcttgttattttcacttattcagactggattacttcttacttagttactaactcaatgaggaaaaatccctacaggatctttttttgcaaacaactgatatatgcagacaaatttttgacaaattcaccttttaaacacacttaaccatttgtgaaggttttctttagcttacattttaaacatacacaataaacactaatcctccaaactttcactgtttttattagtatgaatataaaatttgaaggtttggccaattagtacaagtctcatgatataatcactgcctgcatacatatgcacagatccagttagtgagtttgtcaagcttaatctaattggttaagtctaaagagattattattccttgatgtttgctttgtattggctacaaatgtgcagaggtaatacatatgtgatgtcgatgtctctgtctttttttttgtctttaaaaaataattggcagcaactgtatttgaataaaatgatttcttagtatgattgtacagtaatgaatgaaagtggaacatgtttctttttgaaagggagagaattgaccatttattgttgtgatgtttaagttataacttattgagcacttttagtagtgataactgtttttaaacttgcctaatacctttcttgggtattgtttgtaatgtgacttatttaacgccttttttgtttgtttaagttgctgctttaggttaacagcgtgttttagaagatttaaatttctttcctgtctgcacaattagctattcagagcaagagggcctgattttatagaagccccttgaaaagaggtccagatgagagcagagatacagtgagaaattatgtgatctgtgtgttgtgggaagagaattttcaatatgtaactacggagctgtagtgccattagaaactgtgaatttccaaataaatctgaacacttgtctttattaaaaaaaaaat

SEQ ID NO: 448950 - DNA, 5728 bp, Homo sapiens
tgggcgggacctggggcgggcggagcggcgaaagcatctgctcctgcgctttgtggtctcctgcctccggcttctccgcctgcgacgtcgaagggggcgtggcctgcgcagaggctggtgggggtgcgggcgccgcgggacttgggtgacgcgtccctttccagctcagcggtgtgtgaggtgtcgcggccccgccggcgattggctgttgagaggcgagtacgcggcggccgttggtcgctggcctcacggagcaaggcccccggcgggcggggaggatatggggcggcagtggcggctgcaggaggcgggcgtggacgagccggtggctgcagcggcggcggtccccggagtcctgtgaagcgcccctgtccgcgcctctgtggggccctcagagagggctgccaggacgcgagccactgaggagccgctcagccagcgccatagcccttaggactatcggtcacattctcgcgctcctgctccggctcctccatcttggcctcggcagtggcggctgccgggaggatgtgccgccttctggcagggggaagaaggaggagaagatgaagaagcaccggcgggccttggccctggtctcctgcctctttctgtgctctctggtctggcttcccagctggcgtgtatgttgtaaagagagttcttcagcttcagcgtcatcatattactctcaagatgacaactgcgcactagaaaatgaagatgtacaattccagaaaaagaatacagagtcaaaaaagttaagtccaccggtggtggagacactccctacagttgatttgcatgaagagtcttccaatgcagttgtggacagtgaaactgttgaaaatatttccagctcatctacctcagaaatcactccaatctcaaagcttgatgaaatagaaaaatctggtactattccgatagccaaaccaagtgaaactgagcagtctgaaactgattgtgatgttggtgaggcccttgatgctagtgctccaattgaacaaccttcctttgtcagtccacctgacagccttgttggccagcatatagaaaatgtatcatcttcacatggtaaaggaaagataacaaaatcagaatttgaatcaaaagtttcagcaagtgaacagggcggtggtgatccaaaatctgcattgaatgcttcagataatttaaaaaatgagagctctgattatacaaaaccaggagacattgaccctacatcagtagcaagtcccaaagatccagaagatataccaacatttgatgaatggaagaagaaagttatggaagtagaaaaagaaaaaagtcagtcgatgcatgcatcttctaatggaggttcacatgccaccaaaaaggtccagaaaaatcgaaataattatgcctcagtagaatgtggtgccaaaattctagcagctaatccagaagccaagagcacatctgctattcttatagaaaatatggatctttacatgttgaatccttgcagcactaaaatttggtttgttattgaactttgtgaaccaattcaagtaaaacagcttgatattgcaaattatgaattattttcttctactcctaaagattttctggtttctatcagtgacagatatccaacaaataagtggattaagctgggtacttttcatggtagagatgagcggaatgtacagagtttccctttagatgaacagatgtatgcaaaatatgtcaaggttgagttgctatcacattttggatcagagcacttttgtccattaagccttataagggtatttggcactagcatggtggaagaatatgaagaaattgctgattcccagtatcactcagaacgccaggaactatttgatgaggactatgattatccactggattataatactggagaggataaatcctcaaaaaatcttcttggttctgctacaaatgccattctaaatatggtgaatattgctgctaatattctgggagcaaaaactgaagacctgacagaaggaaataaaagtatatctgagaatgccactgccacagctgcacctaaaatgcctgaatcaactcctgtttcaactcctgttccatctcctgagtatgtaaccactgaagtacacacacatgacatggagccgtcaacaccagatactccaaaagagagtcccattgtacagttagttcaagaggaggaagaggaggcaagtccatctacagtgacccttctgggcagcggtgaacaggaagatgaatcatcaccctggtttgagtcagagacacaaatattttgcagtgaactgaccacaatttgttgtatttctagtttttcagaatacatatataaatggtgttcagttagagttgctctttatcggcagcgcagccgaactgctttgagtaaaggaaaagattatcttgtgttagctcaaccacccttactacttcctgcggaatcagtagatgtttcagtattgcaacctctgagtggagaattggaaaatacgaatatagaaagggaagctgaaactgttgttctgggtgatttaagtagtagtatgcaccaggatgacttggtgaatcacactgtagatgcagttgaacttgaaccaagccattctcaaactctttctcagtctcttcttttagatattaccccagaaatcaatcccttgcctaaaatagaagtatctgagtctgttgaatatgaggcaggacatataccatcaccagtgattccccaagagagttctgttgagatcgataatgaaacagaacaaaagtctgagagctttagttctatagagaaaccatctattacctatgaaacaaataaagttaatgagttaatggataatattataaaagaagatgtgaactccatgcaaattttcacaaagctgtctgaaacaatagtgccaccaataaatacagccactgtacccgacaatgaagatggggaagccaaaatgaatatagctgacacagcaaagcaaactttgatttctgttgtggattcttcttcattacctgaagtaaaagaagaagaacagtctccagaagatgcccttttgagagggttacagaggacagctacagatttttatgctgaattgcaaaattctacagatctaggatatgctaatggaaatcttgtacatggatcaaaccaaaaggagtcagtatttatgagacttaataatcgtattaaagccttagaagttaacatgtctctcagtggtcgctatctggaggagcttagccaaaggtaccgaaaacaaatggaagaaatgcaaaaggctttcaataaaacaatcgtgaaacttcagaatacttcaagaatagcagaggagcaggatcagcggcaaactgaagccatccagttgctacaggcacagctgaccaacatgacacagcttgtttcaaatttatcagcaacagtagcagaattgaaacgggaggtttcagatcgacaaagctatcttgtcatatctttggttctttgtgttgtcttgggactgatgctttgtatgcagcgttgtcgaaatacttctcaatttgatggagattatatttcaaaacttcctaaaagtaatcagtatccaagccctaaaaggtgtttctcttcctatgatgatatgaatttgaaaagaagaacttcattcccactcatgagatccaagtctctacagttaactggcaaagaagtagacccaaatgatttgtacattgtagaacccctcaagttttctccagaaaagaagaagaagcgctgcaagtacaaaattgaaaaaattgagaccataaagcctgaagaaccattgcaccccatagccaatggcgacataaaaggaagaaagccctttacgaaccagagagatttttctaatatgggagaagtttatcactcttcttataaaggtcctccatctgaaggaagctcagaaacttcatcacagtcagaagagtcctatttttgtggcatttcagcttgcacaagtctgtgcaatggacagtctcaaaagacaaaaactgagaagagggctttaaaacgaagacgatctaaagtccaagaccaaggaaaattgataaaaactctaatacagactaagtcgggatcattgccgagcctgcatgacataatcaaaggaaacaaagagatcaccgtgggaacatttggtgttacagcagtctcgggacatatctaaaattaattgaacttttcatacagaagacttttttgttgttgttctttgaagaacagtctgtagtatttgaagggtttgggggagggagaaaatattaatgggaaaggcattcagaaattatggtttctacctttttatgatcacttcctataaggacaatggtagacattttataaagatgttttttcacaagattaattactgggacaaaagtaatttggaagcccagttccttaggtgggataggaatgaaagcctaaacctcttcctttagctttgttcctatttcttgcaccttcccatatttatgtgccttttgtctatttataatgccactggaagaggagggataactttttctgttatttgatttcttttataactttgttaggtttttgaagctgcaaacactacaatgctttgagggggtctgtgcctgaagctcaggagtgtggatcagacagtctaaagatcctaaaaacttgccaactggatctttgtttagcaaactcactggaaatgaacacttaatggaatttttaagtctgttctgttaggtagatggtgatgctcttgttattttcacttattcagactggattacttcttacttagttactaactcaatgaggaaaaatccctacaggatctttttttgcaaacaactgatatatgcagacaaatttttgacaaattcaccttttaaacacacttaaccatttgtgaaggttttctttagcttacattttaaacatacacaataaacactaatcctccaaactttcactgtttttattagtatgaatataaaatttgaaggtttggccaattagtacaagtctcatgatataatcactgcctgcatacatatgcacagatccagttagtgagtttgtcaagcttaatctaattggttaagtctaaagagattattattccttgatgtttgctttgtattggctacaaatgtgcagaggtaatacatatgtgatgtcgatgtctctgtctttttttttgtctttaaaaaataattggcagcaactgtatttgaataaaatgatttcttagtatgattgtacagtaatgaatgaaagtggaacatgtttctttttgaaagggagagaattgaccatttattgttgtgatgtttaagttataacttattgagcacttttagtagtgataactgtttttaaacttgcctaatacctttcttgggtattgtttgtaatgtgacttatttaacgccttttttgtttgtttaagttgctgctttaggttaacagcgtgttttagaagatttaaatttctttcctgtctgcacaattagctattcagagcaagagggcctgattttatagaagccccttgaaaagaggtccagatgagagcagagatacagtgagaaattatgtgatctgtgtgttgtgggaagagaattttcaatatgtaactacggagctgtagtgccattagaaactgtgaatttccaaataaatctgaacacttgtctttattaaaaaaaaaat

SEQ ID NO: 448951 - DNA, 4117 bp, Homo sapiens
tgggcgggacctggggcgggcggagcggcgaaagcatctgctcctgcgctttgtggtctcctgcctccggcttctccgcctgcgacgtcgaagggggcgtggcctgcgcagaggctggtgggggtgcgggcgccgcgggacttgggtgacgcgtccctttccagctcagcggtgtgtgaggtgtcgcggccccgccggcgattggctgttgagaggcgagtacgcggcggccgttggtcgctggcctcacggagcaaggcccccggcgggcggggaggatatggggcggcagtggcggctgcaggaggcgggcgtggacgagccggtggctgcagcggcggcggtccccggagtcctgtgaagcgcccctgtccgcgcctctgtggggccctcagagagggctgccaggacgcgagccactgaggagccgctcagccagcgccatagcccttaggactatcggtcacattctcgcgctcctgctccggctcctccatcttggcctcggcagtggcggctgccgggaggatgtgccgccttctggcagggggaagaaggaggagaagatgaagaagcaccggcgggccttggccctggtctcctgcctctttctgtgctctctggtctggcttcccagctggcgtgtatgttgtaaagagagttcttcagcttcagcgtcatcatattactctcaagatgacaactgcgcactagaaaatgaagatgtacaattccagaaaaagaatacagagtcaaaaaagttaagtccaccggtggtggagacactccctacagttgatttgcatgaagagtcttccaatgcagttgtggacagtgaaactgttgaaaatatttccagctcatctacctcagaaatcactccaatctcaaagcttgatgaaatagaaaaatctggtactattccgatagccaaaccaagtgaaactgagcagtctgaaactgattgtgatgttggtgaggcccttgatgctagtgctccaattgaacaaccttcctttgtcagtccacctgacagccttgttggccagcatatagaaaatgtatcatcttcacatggtaaaggaaagataacaaaatcagaatttgaatcaaaagtttcagcaagtgaacagggcggtggtgatccaaaatctgcattgaatgcttcagataatttaaaaaatgagagctctgattatacaaaaccaggagacattgaccctacatcagtagcaagtcccaaagatccagaagatataccaacatttgatgaatggaagaagaaagttatggaagtagaaaaagaaaaaagtcagtcgatgcatgcatcttctaatggaggttcacatgccaccaaaaaggtccagaaaaatcgaaataattatgcctcagtagaatgtggtgccaaaattctagcagctaatccagaagccaagagcacatctgctattcttatagaaaatatggatctttacatgttgaatccttgcagcactaaaatttggtttgttattgaactttgtgaaccaattcaagtaaaacagcttgatattgcaaattatgaattattttcttctactcctaaagattttctggtttctatcagtgacagatatccaacaaataagtggattaagctgggtacttttcatggtagagatgagcggaatgtacagagtttccctttagatgaacagatgtatgcaaaatatgtcaaggttgagttgctatcacattttggatcagagcacttttgtccattaagccttataagggtatttggcactagcatggtggaagaatatgaagaaattgctgattcccagtatcactcagaacgccaggaactatttgatgaggactatgattatccactggattataatactggagaggataaatcctcaaaaaatcttcttggttctgctacaaatgccattctaaatatggtgaatattgctgctaatattctgggagcaaaaactgaagacctgacagaaggaaataaaagtatatctgagaatgccactgccacagctgcacctaaaatgcctgaatcaactcctgtttcaactcctgttccatctcctgagtatgtaaccactgaagtacacacacatgacatggagccgtcaacaccagatactccaaaagagagtcccattgtacagttagttcaagaggaggaagaggaggcaagtccatctacagtgacccttctgggcagcggtgaacaggaagatgaatcatcaccctggtttgagtcagagacacaaatattttgcagtgaactgaccacaatttgttgtatttctagtttttcagaatacatatataaatggtgttcagttagagttgctctttatcggcagcgcagccgaactgctttgagtaaaggaaaagattatcttgtgttagctcaaccacccttactacttcctgcggaatcagtagatgtttcagtattgcaacctctgagtggagaattggaaaatacgaatatagaaagggaagctgaaactgttgttctgggtgatttaagtagtagtatgcaccaggatgacttggtgaatcacactgtagatgcagttgaacttgaaccaagccattctcaaactctttctcagtctcttcttttagatattaccccagaaatcaatcccttgcctaaaatagaagtatctgagtctgttgaatatgaggcaggacatataccatcaccagtgattccccaagagagttctgttgagatcgataatgaaacagaacaaaagtctgagagctttagttctatagagaaaccatctattacctatgaaacaaataaagttaatgagttaatggataatattataaaagaagatgtgaactccatgcaaattttcacaaagctgtctgaaacaatagtgccaccaataaatacagccactgtacccgacaatgaagatggggaagccaaaatgaatatagctgacacagcaaagcaaactttgatttctgttgtggattcttcttcattacctgaagtaaaagaagaagaacagtctccagaagatgcccttttgagagggttacagaggacagctacagatttttatgctgaattgcaaaattctacagatctaggatatgctaatggaaatcttgtacatggatcaaaccaaaaggagtcagtatttatgagacttaataatcgtattaaagccttagaagttaacatgtctctcagtggtcgctatctggaggagcttagccaaaggtaccgaaaacaaatggaagaaatgcaaaaggctttcaataaaacaatcgtgaaacttcagaatacttcaagaatagcagaggagcaggatcagcggcaaactgaagccatccagttgctacaggcacagctgaccaacatgacacagcttgtttcaaatttatcagcaacagtagcagaattgaaacgggaggtttcagatcgacaaagctatcttgtcatatctttggttctttgtgttgtcttgggactgatgctttgtatgcagcgttgtcgaaatacttctcaatttgatggagattatatttcaaaacttcctaaaagtaatcagtatccaagccctaaaaggtgtttctcttcctatgatgatatgaatttgaaaagaagaacttcattcccactcatgagatccaagtctctacagttaactggcaaagaaggtagatttctgtggatatataatatgtatatataaacatgaaactagcttctggcataaatataatgtcagtgttgtgttcatgaccatctgcaacaaaaaatggatacaagtagcctttgtctttgtgctgtgtcaagccactttatcattttcacattttatatctgtctttgttcctaaaagcccagagggtagggaggggggcttagtttaattagcagttggtagctttgtttgcacatgctcctgtttagaagtatttctttttagaaagggatgtttgagaaagttcaacagatatggaaaacctgaatgtgctcccatagcatcctgtgcttttctgcctcctcttcttatacaggtaggaccccttttgtctctagtttaggactatgaggcactttctgaacaaaaat

SEQ ID NO: 448952 - DNA, 1644 bp, Homo sapiens
tacaaattgcatcaccctcctcctctgcccagacctgggggctccaacacctttcgctaggtctggctctggcctctgagcgaaccttccgtacagtatggcggctcccgaagccccgcccctggacagagttttccgtacaacatggctgtctacagagtgcgattcccacccacttccgcctagctaccggaagtttctatttgaaacccaggcggccgacttagccggtggcacgacagttgctgcagggaatcttttaaacgagagcgagaaggactgcgggcaggaccggcgggctcctggggttcagccgtgccgcctcgttacgatgaccagtgtggttaagacagtgtatagcctgcagcccccctctgcgctgagcggcggccagccggcagacacacaaactcgggccacttctaagagtctcttacctgttaggtccaaagaagtcgatgtttccaaacagcttcattcaggaggtccagagaatgatgttacaaaaatcaccaaactgagacgagagaatgggcaaatgaaagctactgacactgccaccagaaggaatgtcagaaaaggctacaaaccactgagtaagcaaaaatcagaggaagagctcaaggacaagaaccagctgttagaagccgtcaacaagcagttgcaccagaagttgactgaaactcagggagagctgaaggacctgacccagaaggtagagctgctggagaagtttcgggacaactgtttggcaattttggagagcaagggccttgatccagctttaggcagtgagaccctggcatcacgacaagaatccactactgatcacatggactctatgttgctgttagaaactttgcaagaggagctgaagctttttaacgaaacagccaaaaagcagatggaggagttacaggccttaaaggtaaagctggagatgaaagaggaaagagtccgattcctagaacagcaaaccttatgtaacaatcaagtaaatgatttaacaacagcccttaaggaaatggagcagctattagaaatgtaagaagaagcaagtggccagatggctccctcttgggcataaaatctcagaggaagctacttaggacatcatcttggccatgatcttctgggactcaccatctccagaatgaaaacaatttctacagtagacttaaggacagtttatgctgaaatggcaattcctcatttaagcaagttttcccaaccttcaggttggtcagccctcctgagcctcacaggtggataattgaggcctacaagagaggggagcctaggagcttggattgaccttctagtcaaccacctgacttcagcacaccattacaatcgggagactaaaccaacaaccagaggatctaaaatgtcacattcagattttcaggaagaaaatcttcattacagtggagcacaaatgttccatacaagacatcattgaggagccatgctgtccccttctaacctgaaacacattctttcccatcctggttgggcttctgtacctccttattaatttatgaacctgaagttgcttgaagtgttttgggcttaataaatggggtgaaagtataggtagcagtaacacctacatgaaacaatacaccttggatcttttaatct

SEQ ID NO: 448953 - DNA, 762 bp, Homo sapiens
taagttcataccaataatacctgtcttgctgggtggttataaaagagaattatgtccagtacctaacccagtgcctggcaaaggtactcaaatcctggtggtgatattattaaagtttaaaacttatcctggcaaaagattcccttcataaattcaccccaaacttctattccagtgcccccttctccccaccccaaaacacagtcgctgatcttaccatgcctttgcaggcctcagttattcaacttccttctgacttgggaactctcaactttgactcttaagttcaaattgcaaccatcttaaaacataaagccaaaaccccacccttatcccctccagctaccacatatactatattcacagccaaatatctcaagaagctatttccttaccatttttctttctctgccaatctggcttcaaagtacacagaaacactaatgtgatgtagctacagtaggcaaatccatccaaagtagaatatagattaccagggactgagcaggaggggaggggagtttctctttgggatgatgacattctggaaatggaaagtggtggtggttgcataacattgtgcatatacctaatgccactgaattgtacactttaaaatggttgaggccgggtgcggtggctcacacctgtaatcccagcactttgggaggccaaggtgggtggattacctgaggtcaggagtttgagcggcctggccaacatggtgaaaccctgtctctactaaaaatacaaaaattagcc

SEQ ID NO: 448954 - DNA, 721 bp, Homo sapiens
cccggaattcggccattatggccgggggagagcgagattgactgcgggcaggaccgccgggctcctggggttcagccgtgccgcctcgttacgatgaccagtgtggttaagacagtgtatagcctgcagcccccctctgcgctgagcggcggccagccggcagacacacaaactcgggccacttctaagagtctcttacctgttaggtccaaagaagtcgatgtttccaaacagcttcattcaggaggtccagagaatgatgttacaaaaatcaccaaactgagacgagagaatgggcaaatgaaagctactgacactgccaccagaaggaatgtcagaaaaggctacaaaccactgagtaagcaaaaatcagaggaagagctcaaggacaagaaccagctgttagaagccgtcaacaagcagttgcaccagaagttgactgaaactcagggagagctgaaggacctgacccagaaggtagagctgctggagaagtttcgggacaactgtttggcaattttggagagcaagggccttgatccagctttaggcagtgagaccctggcatcacgacaagaatccactactgatcacatggactctatgttgctgttagaaactttgcaagaggagctgaagctttttaacgaaacagccaatagagtccgtttcctagaacgcataccttatttacaattaatgaatgttttacaacacgctt

SEQ ID NO: 448955 - DNA, 1696 bp, Homo sapiens
tacaaattgcatcaccctcctcctctgcccagacctgggggctccaacacctttcgctaggtctggctctggcctctgagcgaaccttccgtacagtatggcggctcccgaagccccgcccctggacagagttttccgtacaacatggctgtctacagagtgcgattcccacccacttccgcctagctaccggaagtttctatttgaaacccaggcggccgacttagccggtggcacgacagttgctgcagggaatcttttaaacgagagcgagaaggactgcgggcaggaccggcgggctcctggggttcagccgtgccgcctcgttacgatgaccagtgtggttaagacagtgtatagcctgcagcccccctctgcgctgagcggcggccagccggcagacacacaaactcgggccacttctaagagtctcttacctgttaggtccaaagaagtcgatgtttccaaacagcttcattcaggaggtccagagaatgatgttacaaaaatcaccaaactgagacgagagaatgggcaaatgaaagctactgacactgccaccagaaggaatgtcagaaaaggctacaaaccactgagtaagcaaaaatcagaggaagagctcaaggacaagaaccagctgttagaagccgtcaacaagcagttgcaccagaagttgactgaaactcagggagagctgaaggacctgacccagaaggtagagctgctggagaagtttcgggacaactgtttggcaattttggagagcaagggccttgatccagctttaggcagtgagaccctggcatcacgacaagaatccactactgatcacatggactctatgttgctgttagaaactttgcaagaggagctgaagctttttaacgaaacagccaaaaagcagatggaggagttacaggccttaaaggtaaagctggagatgaaagaggaaagagtccgattcctagaacagcaaaccttatgtaacaatcaagtaaatgatttaacaacagcccttaaggaaatggagcagctattagaaatgtaagaagaagcaagtggccagatggctccctcttgggcataaaatctcagaggaagctacttaggacatcatcttggccatgatcttctgggactcaccatctccagaatgaaaacaatttctacagtagacttaaggacagtttatgctgaaatggcaattcctcatttaagcaagttttcccaaccttcaggttggtcagccctcctgagcctcacaggtggataattgaggcctacaagagaggggagcctaggagcttggattgaccttctagtcaaccacctgacttcagcacaccattacaatcgggagactaaaccaacaaccagaggatctaaaatgtcacattcagattttcaggaagaaaatcttcattacagtggagcacaaatgttccatacaagacatcattgaggagccatgctgtccccttctaacctgaaacacattctttcccatcctggttgggcttctgtacctccttattaatttatgaacctgaagttgcttgaagtgttttgggcttaataaatggggtgaaagtataggtagcagtaacacctacatgaaacaatacaccttggatcttttaatctaaattacttttcttttttaagtctacttttaaaataaatacttctgtaaata

SEQ ID NO: 448956 - DNA, 2049 bp, Homo sapiens
tacaaattgcatcaccctcctcctctgcccagacctgggggctccaacacctttcgctaggtctggctctggcctctgagcgaaccttccgtacagtatggcggctcccgaagccccgcccctggacagagttttccgtacaacatggctgtctacagagtgcgattcccacccacttccgcctagctaccggaagtttctatttgaaacccaggcggccgacttagccggtggcacgacagttgctgcagggaatcttttaaacgagagcgagaaggactgcgggcaggaccggcgggctcctggggttcagccgtgccgcctcgttacgatgaccagtgtggttaagacagtgtatagcctgcagcccccctctgcgctgagcggcggccagccggcagacacacaaactcgggccacttctaagagtctcttacctgttaggtccaaagaagtcgatgtttccaaacagcttcattcaggaggtccagagaatgatgttacaaaaatcaccaaactgagacgagagaatgggcaaatgaaagctactgacactgccaccagaaggaatgtcagaaaaggctacaaaccactgagtaagcaaaaatcagaggaagagctcaaggacaagaaccagctgttagaagccgtcaacaagcagttgcaccagaagttgactgaaactcagggagagctgaaggacctgacccagaaggtagagctgctggagaagtttcgggacaactgtttggcaattttggagagcaagggccttgatccagctttaggcagtgagaccctggcatcacgacaagaatccactactgatcacatggactctatgttgctgttagaaactttgcaagaggagctgaagctttttaacgaaacagccaaaaagcagatggaggagttacaggccttaaaggtaaagctggagatgaaagaggaaagagtccgattcctagaacagcaaaccttatgtaacaatcaagtaaatgatttaacaacagcccttaaggaaatggagcagctattagaaatgtaagaagaagcaagtggccagatggctccctcttgggcataaaatctcagaggaagctacttaggacatcatcttggccatgatcttctgggactcaccatctccagaatgaaaacaatttctacagtagacttaaggacagtttatgctgaaatggcaattcctcatttaagcaagttttcccaaccttcaggttggtcagccctcctgagcctcacaggtggataattgaggcctacaagagaggggagcctaggagcttggattgaccttctagtcaaccacctgacttcagcacaccattacaatcgggagactaaaccaacaaccagaggatctaaaatgtcacattcagattttcaggaagaaaatcttcattacagtggagcacaaatgttccatacaagacatcattgaggagccatgctgtccccttctaacctgaaacacattctttcccatcctggttgggcttctgtacctccttattaatttatgaacctgaagttgcttgaagtgttttgggcttaataaatggggtgaaagtataggtagcagtaacacctacatgaaacaatacaccttggatcttttaatctaaattacttttcttttttaagtctacttttaaaataaatacttctgtaaatattctgactgtaacattgaggaatgaaaatagccttttaacctagatatgtcagttgatcattattgaactaatttagttaacaagtccaagatattctgacttaatctagaatatttttctgctactctttaagagtcctgtggctagtccctctgtctcccaagagcattggctagtctcctgagggtgttgcccatttgtagcagtggtttcaccaggtctgtggccacttgctgcccatgttttccctgcacttccagcctgggtgacaagagcaagactccatctctaaataaataaataaataaataaataaataaataaataaaatagttgaaatggcaaactttaa

SEQ ID NO: 448957 - DNA, 1656 bp, Homo sapiens
tacaaattgcatcaccctcctcctctgcccagacctgggggctccaacacctttcgctaggtctggctctggcctctgagcgaaccttccgtacagtatggcggctcccgaagccccgcccctggacagagttttccgtacaacatggctgtctacagagtgcgattcccacccacttccgcctagctaccggaagtttctatttgaaacccaggcggccgacttagccggtggcacgacagttgctgcagggaatcttttaaacgagagcgagaaggactgcgggcaggaccggcgggctcctggggttcagccgtgccgcctcgttacgatgaccagtgtggttaagacagtgtatagcctgcagcccccctctgcgctgagcggcggccagccggcagacacacaaactcgggccacttctaagagtctcttacctgttaggtccaaagaagtcgatgtttccaaacagcttcattcaggaggtccagagaatgatgttacaaaaatcaccaaactgagacgagagaatgggcaaatgaaagctactgacactgccaccagaaggaatgtcagaaaaggctacaaaccactgagtaagcaaaaatcagaggaagagctcaaggacaagaaccagctgttagaagccgtcaacaagcagttgcaccagaagttgactgaaactcagggagagctgaaggacctgacccagaaggtagagctgctggagaagtttcgggacaactgtttggcaattttggagagcaagggccttgatccagctttaggcagtgagaccctggcatcacgacaagaatccactactgatcacatggactctatgttgctgttagaaactttgcaagaggagctgaagctttttaacgaaacagccaaaaagcagatggaggagttacaggccttaaaggtaaagctggagatgaaagaggaaagagtccgattcctagaacagcaaaccttatgtaacaatcaagtaaatgatttaacaacagcccttaaggaaatggagcagctattagaaatgtaagaagaagcaagtggccagatggctccctcttgggcataaaatctcagaggaagctacttaggacatcatcttggccatgatcttctgggactcaccatctccagaatgaaaacaatttctacagtagacttaaggacagtttatgctgaaatggcaattcctcatttaagcaagttttcccaaccttcaggttggtcagccctcctgagcctcacagttggattgaccttctagtcaaccacctgacttcagcacaccattacaatcgggagactaaaccaacaaccagaggatctaaaatgtcacattcagattttcaggaagaaaatcttcattacagtggagcacaaatgttccatacaagacatcattgaggagccatgctgtccccttctaacctgaaacacattctttcccatcctggttgggcttctgtacctccttattaatttatgaacctgaagttgcttgaagtgttttgggcttaataaatggggtgaaagtataggtagcagtaacacctacatgaaacaatacaccttggatcttttaatctaaattacttttcttttttaagtctacttttaaaataaatacttctgtaaata

SEQ ID NO: 448958 - DNA, 2361 bp, Homo sapiens
tacaaattgcatcaccctcctcctctgcccagacctgggggctccaacacctttcgctaggtctggctctggcctctgagcgaaccttccgtacagtatggcggctcccgaagccccgcccctggacagagttttccgtacaacatggctgtctacagagtgcgattcccacccacttccgcctagctaccggaagtttctatttgaaacccaggcggccgacttagccggtggcacgacagttgctgcagggaatcttttaaacgagagcgagaaggactgcgggcaggaccggcgggctcctggggttcagccgtgccgcctcgttacgatgaccagtgtggttaagacagtgtatagcctgcagcccccctctgcgctgagcggcggccagccggcagacacacaaactcgggccacttctaagagtctcttacctgttaggtccaaagaagtcgatgtttccaaacagcttcattcaggaggtccagagaatgatgttacaaaaatcaccaaactgagacgagagaatgggcaaatgaaagctactgacactgccaccagaaggaatgtcagaaaaggctacaaaccactgagtaagcaaaaatcagaggaagagctcaaggacaagaaccagctgttagaagccgtcaacaagcagttgcaccagaagttgactgaaactcagggagagctgaaggacctgacccagaaggtagagctgctggagaagtttcgggacaactgtttggcaattttggagagcaagggccttgatccagctttaggcagtgagaccctggcatcacgacaagaatccactactgatcacatggactctatgttgctgttagaaactttgcaagaggagctgaagctttttaacgaaacagccaaaaagcagatggaggagttacagattgcttggatgaatcatgggatattgcaccaaatgtagaggatttcatcgttccagtttagatacaggagtctagtccctctctactactagagggacaattcctaaaaccagtgcatagaaataaaatctaaaatagaagatacagtctgttgatactccagtggtcttccttagtggaataggagcataatgttctgatgtgggaattgtgtttcctgttagtcaagagttttgtgtatgtgttgttttcttttggaatgtctttccatgcaggccttaaaggtaaagctggagatgaaagaggaaagagtccgattcctagaacagcaaaccttatgtaacaatcaagtaaatgatttaacaacagcccttaaggaaatggagcagctattagaaatgtaagaagaagcaagtggccagatggctccctcttgggcataaaatctcagaggaagctacttaggacatcatcttggccatgatcttctgggactcaccatctccagaatgaaaacaatttctacagtagacttaaggacagtttatgctgaaatggcaattcctcatttaagcaagttttcccaaccttcaggttggtcagccctcctgagcctcacaggtggataattgaggcctacaagagaggggagcctaggagcttggattgaccttctagtcaaccacctgacttcagcacaccattacaatcgggagactaaaccaacaaccagaggatctaaaatgtcacattcagattttcaggaagaaaatcttcattacagtggagcacaaatgttccatacaagacatcattgaggagccatgctgtccccttctaacctgaaacacattctttcccatcctggttgggcttctgtacctccttattaatttatgaacctgaagttgcttgaagtgttttgggcttaataaatggggtgaaagtataggtagcagtaacacctacatgaaacaatacaccttggatcttttaatctaaattacttttcttttttaagtctacttttaaaataaatacttctgtaaatattctgactgtaacattgaggaatgaaaatagccttttaacctagatatgtcagttgatcattattgaactaatttagttaacaagtccaagatattctgacttaatctagaatatttttctgctactctttaagagtcctgtggctagtccctctgtctcccaagagcattggctagtctcctgagggtgttgcccatttgtagcagtggtttcaccaggtctgtggccacttgctgcccatgttttccctgcactctttttttttttttttttctgagacacagtctcacttccagcctgggtgacaagagcaagactccatctctaaataaataaataaataaataaataaataaataaataaaatagttgaaatggcaaactttaa

SEQ ID NO: 448959 - DNA, 1759 bp, Homo sapiens
tacaaattgcatcaccctcctcctctgcccagacctgggggctccaacacctttcgctaggtctggctctggcctctgagcgaaccttccgtacagtatggcggctcccgaagccccgcccctggacagagttttccgtacaacatggctgtctacagagtgcgattcccacccacttccgcctagctaccggaagtttctatttgaaacccaggcggccgacttagccggtggcacgacagttgctgcagggaatcttttaaacgagagcgagaaggactgcgggcaggaccggcgggctcctggggttcagccgtgccgcctcgttacgatgaccagtgtggttaagacagtgtatagcctgcagcccccctctgcgctgagcggcggccagccggcagaacacctgaatggtaatcctggcaccagcggggactaggagttgctggaagaactggagccagacacacaaactcgggccacttctaagagtctcttacctgttaggtccaaagaagtcgatgtttccaaacagcttcattcaggaggtccagagaatgatgttacaaaaatcaccaaactgagacgagagaatgggcaaatgaaagctactgacactgccaccagaaggaatgtcagaaaaggctacaaaccactgagtaagcaaaaatcagaggaagagctcaaggacaagaaccagctgttagaagccgtcaacaagcagttgcaccagaagttgactgaaactcagggagagctgaaggacctgacccagaaggtagagctgctggagaagtttcgggacaactgtttggcaattttggagagcaagggccttgatccagctttaggcagtgagaccctggcatcacgacaagaatccactactgatcacatggactctatgttgctgttagaaactttgcaagaggagctgaagctttttaacgaaacagccaaaaagcagatggaggagttacaggccttaaaggtaaagctggagatgaaagaggaaagagtccgattcctagaacagcaaaccttatgtaacaatcaagtaaatgatttaacaacagcccttaaggaaatggagcagctattagaaatgtaagaagaagcaagtggccagatggctccctcttgggcataaaatctcagaggaagctacttaggacatcatcttggccatgatcttctgggactcaccatctccagaatgaaaacaatttctacagtagacttaaggacagtttatgctgaaatggcaattcctcatttaagcaagttttcccaaccttcaggttggtcagccctcctgagcctcacaggtggataattgaggcctacaagagaggggagcctaggagcttggattgaccttctagtcaaccacctgacttcagcacaccattacaatcgggagactaaaccaacaaccagaggatctaaaatgtcacattcagattttcaggaagaaaatcttcattacagtggagcacaaatgttccatacaagacatcattgaggagccatgctgtccccttctaacctgaaacacattctttcccatcctggttgggcttctgtacctccttattaatttatgaacctgaagttgcttgaagtgttttgggcttaataaatggggtgaaagtataggtagcagtaacacctacatgaaacaatacaccttggatcttttaatctaaattacttttcttttttaagtctacttttaaaataaatacttctgtaaata

SEQ ID NO: 448960 - DNA, 1634 bp, Homo sapiens
tacaaattgcatcaccctcctcctctgcccagacctgggggctccaacacctttcgctaggtctggctctggcctctgagcgaaccttccgtacagtatggcggctcccgaagccccgcccctggacagagttttccgtacaacatggctgtctacagagtgcgattcccacccacttccgcctagctaccggaagtttctatttgaaacccaggcggccgacttagccggtggcacgacagttgctgcagggaatcttttaaacgagagcgagaaggactgcgggcaggaccggcgggctcctggggttcagccgtgccgcctcgttacgatgaccagtgtggttaagacagtgtatagcctgcagcccccctctgcgctgagcggcggccagccggcagacacacaaactcgggccacttctaagagtctcttacctgttaggtccaaagaagtcgatgtttccaaacagcttcattcaggaggtccagagaatgatgttacaaaaatcaccaaactgagacgagagaatgggcaaatgaaagctactgacactgccaccagaaggaatgtcagaaaaggctacaaaccactgagtaagcaaaaatcagaggaagagctcaaggacaagaaccagctgttagaagccgtcaacaagcagttgcaccagaagttgactgaaactcagggagagctgaaggacctgacccagaaggtagagctgctggagaagtttcgggacaactgtttggcaattttggagagcaagggccttgatccagttgctgttagaaactttgcaagaggagctgaagctttttaacgaaacagccaaaaagcagatggaggagttacaggccttaaaggtaaagctggagatgaaagaggaaagagtccgattcctagaacagcaaaccttatgtaacaatcaagtaaatgatttaacaacagcccttaaggaaatggagcagctattagaaatgtaagaagaagcaagtggccagatggctccctcttgggcataaaatctcagaggaagctacttaggacatcatcttggccatgatcttctgggactcaccatctccagaatgaaaacaatttctacagtagacttaaggacagtttatgctgaaatggcaattcctcatttaagcaagttttcccaaccttcaggttggtcagccctcctgagcctcacaggtggataattgaggcctacaagagaggggagcctaggagcttggattgaccttctagtcaaccacctgacttcagcacaccattacaatcgggagactaaaccaacaaccagaggatctaaaatgtcacattcagattttcaggaagaaaatcttcattacagtggagcacaaatgttccatacaagacatcattgaggagccatgctgtccccttctaacctgaaacacattctttcccatcctggttgggcttctgtacctccttattaatttatgaacctgaagttgcttgaagtgttttgggcttaataaatggggtgaaagtataggtagcagtaacacctacatgaaacaatacaccttggatcttttaatctaaattacttttcttttttaagtctacttttaaaataaatacttctgtaaata

SEQ ID NO: 448961 - DNA, 1706 bp, Homo sapiens
ctgatctgtctgtgctgtgctccaatagggagagctgaaggacctgacccagaaggtagagctgctggagaagtttcgggacaactgtttggcaattttggagagcaagggccttgatccagctttaggcagtgagaccctggcatcacgacaagaatccactactgatcacatggactctatggtgagggcatgggtgtgaaagggcgcaagggctgagtgactgtggggctctgtaaatctaagaaggtctctgctatatattccataaactccaagaaacagcctttgattatctgtgatgctagaaaagagaaatgggatgtgtactcaaaatagcatattttacttgaaaggtagctttgtgcttacaaatataagtgagtctgaattgaaaatttaaaacacataataggtaaacctgtagagagagctttctcgttcttctgttctatactttatcaaatttctctcctgactcctttgttgagaactgtgtggaaaggatgttagccatcatctaatgcaagtctggttttatatgaagatttgtttactacattgtgctttcctcttagttgctgttagaaactttgcaagaggagctgaagctttttaacgaaacagccaaaaagcagatggaggagttacagattgcttggatgaatcatgggatattgcaccaaatgtagaggatttcatcgttccagtttagatacaggagtctagtccctctctactactagagggacaattcctaaaaccagtgcatagaaataaaatctaaaatagaagatacagtctgttgatactccagtggtcttccttagtggaataggagcataatgttctgatgtgggaattgtgtttcctgttagtcaagagttttgtgtatgtgttgttttcttttggaatgtctttccatgcaggccttaaaggtaaagctggagatgaaagaggaaagagtccgattcctagaacagcaaaccttatgtaacaatcaagtaaatgatttaacaacagcccttaaggaaatggagcagctattagaaatgtaagaagaagcaagtggccagatggctccctcttgggcataaaatctcagaggaagctacttaggacatcatcttggccatgatcttctgggactcaccatctccagaatgaaaacaatttctacagtagacttaaggacagtttatgctgaaatggcaattcctcatttaagcaagttttcccaaccttcaggttggtcagccctcctgagcctcacaggtggataattgaggcctacaagagaggggagcctaggagcttggattgaccttctagtcaaccacctgacttcagcacaccattacaatcgggagactaaaccaacaaccagaggatctaaaatgtcacattcagattttcaggaagaaaatcttcattacagtggagcacaaatgttccatacaagacatcattgaggagccatgctgtccccttctaacctgaaacacattctttcccatcctggttgggcttctgtacctccttattaatttatgaacctgaagttgcttgaagtgttttgggcttaataaatggggtgaaagtataggtagcagtaacacctacatgaaacaatacaccttggatcttttaatctaaattacttttcttttttaagtctacttttaaaataaatacttctgtaaata

SEQ ID NO: 448962 - DNA, 650 bp, Homo sapiens
aactttgactcttaagttcaaattgcaaccatcttaaaacataaagccaaaaccccacccttatcccctccagctaccacatatactatattcacagccaaatatctcaagaagctatttccttaccatttttctttctctgccaatctggcttcaaagtacacagaaacactaatgtgatgtagctacagtaggcaaatccatccaaagtagaatatagattaccagggactgagcaggaggggaggggagtttctctttgggatgatgacattctggaaatggaaagtggtggtggttgcataacattgtgcatatacctaatgccactgaattgtacactttaaaatggttgaggccgggtgcggtggctcacacctgtaatcccagcactttgggaggccaaggtgggtggattacctgaggtcaggagtttgagcggcctggccaacatggtgaaaccctgtctctactaaaaatacaaaaattagccggttgtggtggcgggtgcctatagtcgcagctacttgggtggctgaggcaggagaatcgcttgaacccgggaggcggaggttgcagtgagccaagatcgtgccactgcactccagcctgggtgacaagagcaagactccatctctaaataaataaat

SEQ ID NO: 448963 - DNA, 687 bp, Homo sapiens
gagaaggactgcgggcaggaccggcgggctcctgggttcggctctcccggggcgagggactgggctggatgggaggaaggacggaatgagctgggaaaggaggattttctcttttccaaccccgagccggggcctgtcgggtcgcgctatccccgggccctccactctctcgggcccagtggcccagcgctgggtaacattcatcctgtaccttccagggttcagccgtgccgcctcgttacgatgaccagtgtggttaagacagtgtatagcctgcagcccccctctgcgctgagcggcggccagccggcaggtgagggtccaagccacgcccggggcactgcggcctggccggggatggtctcgggagtgtggagatcgaatgggtggcgcgggcacggggaagggcgtcccgtcggccctgaaaacctgtgagccccctataaccaggctatgtaggtttatgatgggagttaagggaaggaccatgtggtaggattttagacgtgctctgcacttttctgcccgcatgtgtactgtattcatcagttagattcaagttgttggttattgtacaatgttattcccattaagctaggaatccccttctaatcggttatcgtcttatttccagacttgggctatcttgagggattgggtttgttttcagggaggaaagaggagaat

SEQ ID NO: 448964 - DNA, 867 bp, Homo sapiens
tacaaattgcatcaccctcctcctctgcccagacctgggggctccaacacctttcgctaggtctggctctggcctctgagcgaaccttccgtacagtatggcggctcccgaagccccgcccctggacagagttttccgtacaacatggctgtctacagagtgcgattcccacccacttccgcctagctaccggaagtttctatttgaaacccaggcggccgacttagccggtggcacgacagttgctgcagggaatcttttaaacgagagcgagaaggactgcgggcaggaccggcgggctcctggggttcagccgtgccgcctcgttacgatgaccagtgtggttaagacagtgtatagcctgcagcccccctctgcgctgagcggcggccagccggcagaacacctgaatggtaatcctggcaccagcggggactaggagttgctggaagaactggagccaggtctctcagctgctgtgtctttcccttagatgcggtgcccctgagtcagtgggcagtgactagctctctcagccaagttggaagtgttcatctctttgatttctatctctgtcccagctttatgatcatatgtaactggaacagtttcaaatttttaggctgcctcccaggatttttgttttgattttgagcatgggctggataagtaatatatgcacatgtgaaaaaaaaaaaggtggaaaaccatatacaatgataaacaagtttccttcccttccttgacaccagccatccagttcctctcccagtgtctcccatttttaagagacagctttgttaaatcctactgaatttttcctacagtgcaatcctagattttagcaaatacaaattattggaacca

SEQ ID NO: 448965 - DNA, 2085 bp, Homo sapiens
tacaaattgcatcaccctcctcctctgcccagacctgggggctccaacacctttcgctaggtctggctctggcctctgagcgaaccttccgtacagtatggcggctcccgaagccccgcccctggacagagttttccgtacaacatggctgtctacagagtgcgattcccacccacttccgcctagctaccggaagtttctatttgaaacccaggcggccgacttagccggtggcacgacagttgctgcagggaatcttttaaacgagagcgagaaggactgcgggcaggaccggcgggctcctggggttcagccgtgccgcctcgttacgatgaccagtgtggttaagacagtgtatagcctgcagcccccctctgcgctgagcggcggccagccggcagacacacaaactcgggccacttctaagagtctcttacctgttaggtccaaagaagtcgatgtttccaaacagcttcattcaggaggtccagagaatgatgttacaaaaatcaccaaactgagacgagagaatgggcaaatgaaagctactgacactgccaccagaaggaatgtcagaaaaggctacaaaccactgagtaagcaaaaatcagaggaagagctcaaggacaagaaccagctgttagaagccgtcaacaagcagttgcaccagaagttgactgaaactcagggagagctgaaggacctgacccagaaggtagagctgctggagaagtttcgggacaactgtttggcaattttggagagcaagggccttgatccagctttaggcagtgagaccctggcatcacgacaagaatccactactgatcacatggactctatgttgctgttagaaactttgcaagaggagctgaagctttttaacgaaacagccaaaaagcagatggaggagttacaggccttaaaggtaaagctggagatgaaagaggaaagagtccgattcctagaacagcaaaccttatgtaacaatcaagtaaatgatttaacaacagcccttaaggaaatggagcagctattagaaatgtaagaagaagcaagtggccagatggctccctcttgggcataaaatctcagaggaagctacttaggacatcatcttggccatgatcttctgggactcaccatctccagaatgaaaacaatttctacagtagacttaaggacagtttatgctgaaatggcaattcctcatttaagcaagttttcccaaccttcaggttggtcagccctcctgagcctcacaggtggataattgaggcctacaagagaggggagcctaggagcttggattgaccttctagtcaaccacctgacttcagcacaccattacaatcgggagactaaaccaacaaccagaggatctaaaatgtcacattcagattttcaggaagaaaatcttcattacagtggagcacaaatgttccatacaagacatcattgaggagccatgctgtccccttctaacctgaaacacattctttcccatcctggttgggcttctgtacctccttattaatttatgaacctgaagttgcttgaagtgttttgggcttaataaatggggtgaaagtataggtagcagtaacacctacatgaaacaatacaccttggatcttttaatctaaattacttttcttttttaagtctacttttaaaataaatacttctgtaaatattctgactgtaacattgaggaatgaaaatagccttttaacctagatatgtcagttgatcattattgaactaatttagttaacaagtccaagatattctgacttaatctagaatatttttctgctactctttaagagtcctgtggctagtccctctgtctcccaagagcattggctagtctcctgagggtgttgcccatttgtagcagtggtttcaccaggtctgtggccacttgctgcccatgttttccctgcactctttttttttttttttttctgagacacagtctcacttccagcctgggtgacaagagcaagactccatctctaaataaataaataaataaataaataaataaataaataaaatagttgaaatggcaaactttaa

SEQ ID NO: 448966 - DNA, 1978 bp, Homo sapiens
tacaaattgcatcaccctcctcctctgcccagacctgggggctccaacacctttcgctaggtctggctctggcctctgagcgaaccttccgtacagtatggcggctcccgaagccccgcccctggacagagttttccgtacaacatggctgtctacagagtgcgattcccacccacttccgcctagctaccggaagtttctatttgaaacccaggcggccgacttagccggtggcacgacagttgctgcagggaatcttttaaacgagagcgagaaggactgcgggcaggaccggcgggctcctggggttcagccgtgccgcctcgttacgatgaccagtgtggttaagacagtgtatagcctgcagcccccctctgcgctgagcggcggccagccggcagacacacaaactcgggccacttctaagagtctcttacctgttaggtccaaagaagtcgatgtttccaaacagcttcattcaggaggtccagagaatgatgttacaaaaatcaccaaactgagacgagagaatgggcaaatgaaagctactgacactgccaccagaaggaatgtcagaaaaggctacaaaccactgagtaagcaaaaatcagaggaagagctcaaggacaagaaccagctgttagaagccgtcaacaagcagttgcaccagaagttgactgaaactcagggagagctgaaggacctgacccagaaggtagagctgctggagaagtttcgggacaactgtttggcaattttggagagcaagggccttgatccagctttaggcagtgagaccctggcatcacgacaagaatccactactgatcacatggactctatgttgctgttagaaactttgcaagaggagctgaagctttttaacgaaacagccaaaaagcagatggaggagttacaggccttaaaggtaaagctggagatgaaagaggaaagagtccgattcctagaacagcaaaccttatgtaacaatcaagtaaatgatttaacaacagcccttaaggaaatggagcagctattagaaatgtaagaagaagcaagtggccagatggctccctcttgggcataaaatctcagaggaagctacttaggacatcatcttggccatgatcttctgggactcaccatctccagaatgaaaacaatttctacagtagacttaaggacagtttatgctgaaatggcaattcctcatttaagcaagttttcccaaccttcaggttggtcagccctcctgagcctcacaggtggataattgaggcctacaagagaggggagcctaggagcttggattgaccttctagtcaaccacctgacttcagcacaccattacaatcgggagactaaaccaacaaccagaggatctaaaatgtcacattcagattttcaggaagaaaatcttcattacagtggagcacaaatgttccatacaagacatcattgaggagccatgctgtccccttctaacctgaaacacattctttcccatcctggttgggcttctgtacctccttattaatttatgaacctgaagttgcttgaaaaaaaaaaaaaaaaaaaaaaaaaaaaaaaaagggggggggggcctaaaaagttatctccccgggggggccacagtttcggggttccccggtttttgttggtccaaggggggccccatagggggggggtttaaatagcccaaggaccgggcgccgccgttttaacacccgctcgcggccgggggaaacgcggctacgctgtggggcgaccgttggggaagggaacccttatacctcggtggtggggtcgggacaccttgttggcgccaaactttcccttagggaaaatttaaacgcctcaaggcgtaactatttactacctttcacgcgtgctttcccggtgtttacccttcctgtgcagtagtgctgcctggctggaaaagtttgcgtccgggagattgctctgtgacacttttgtg

SEQ ID NO: 448967 - DNA, 1972 bp, Homo sapiens
tacaaattgcatcaccctcctcctctgcccagacctgggggctccaacacctttcgctaggtctggctctggcctctgagcgaaccttccgtacagtatggcggctcccgaagccccgcccctggacagagttttccgtacaacatggctgtctacagagtgcgattcccacccacttccgcctagctaccggaagtttctatttgaaacccaggcggccgacttagccggtggcacgacagttgctgcagggaatcttttaaacgagagcgagaaggactgcgggcaggaccggcgggctcctggggttcagccgtgccgcctcgttacgatgaccagtgtggttaagacagtgtatagcctgcagcccccctctgcgctgagcggcggccagccggcagacacacaaactcgggccacttctaagagtctcttacctgttaggtccaaagaagtcgatgtttccaaacagcttcattcaggaggtccagagaatgatgttacaaaaatcaccaaactgagacgagagaatgggcaaatgaaagctactgacactgccaccagaaggaatgtcagaaaaggctacaaaccactgagtaagcaaaaatcagaggaagagctcaaggacaagaaccagctgttagaagccgtcaacaagcagttgcaccagaagttgactgaaactcagggagagctgaaggacctgacccagaaggtagagctgctggagaagtttcgggacaactgtttggcaattttggagagcaagggccttgatccagctttaggcagtgagaccctggcatcacgacaagaatccactactgatcacatggactctatgttgctgttagaaactttgcaagaggagctgaagctttttaacgaaacagccaaaaagcagatggaggagttacagattgcttggatgaatcatgggatattgcaccaaatgtagaggatttcatcgttccagtttagatacaggagtctagtccctctctactactagagggacaattcctaaaaccagtgcatagaaataaaatctaaaatagaagatacagtctgttgatactccagtggtcttccttagtggaataggagcataatgttctgatgtgggaattgtgtttcctgttagtcaagagttttgtgtatgtgttgttttcttttggaatgtctttccatgcaggccttaaaggtaaagctggagatgaaagaggaaagagtccgattcctagaacagcaaaccttatgtaacaatcaagtaaatgatttaacaacagcccttaaggaaatggagcagctattagaaatgtaagaagaagcaagtggccagatggctccctcttgggcataaaatctcagaggaagctacttaggacatcatcttggccatgatcttctgggactcaccatctccagaatgaaaacaatttctacagtagacttaaggacagtttatgctgaaatggcaattcctcatttaagcaagttttcccaaccttcaggttggtcagccctcctgagcctcacaggtggataattgaggcctacaagagaggggagcctaggagcttggattgaccttctagtcaaccacctgacttcagcacaccattacaatcgggagactaaaccaacaaccagaggatctaaaatgtcacattcagattttcaggaagaaaatcttcattacagtggagcacaaatgttccatacaagacatcattgaggagccatgctgtccccttctaacctgaaacacattctttcccatcctggttgggcttctgtacctccttattaatttatgaacctgaagttgcttgaagtgttttgggcttaataaatggggtgaaagtataggtagcagtaacacctacatgaaacaatacaccttggatcttttaatctaaattacttttcttttttaagtctacttttaaaataaatacttctgtaaata

SEQ ID NO: 448968 - DNA, 1822 bp, Homo sapiens
tacaaattgcatcaccctcctcctctgcccagacctgggggctccaacacctttcgctaggtctggctctggcctctgagcgaaccttccgtacagtatggcggctcccgaagccccgcccctggacagagttttccgtacaacatggctgtctacagagtgcgattcccacccacttccgcctagctaccggaagtttctatttgaaacccaggcggccgacttagccggtggcacgacagttgctgcagggaatcttttaaacgagagcgagaaggactgcgggcaggaccggcgggctcctggggttcagccgtgccgcctcgttacgatgaccagtgtggttaagacagtgtatagcctgcagcccccctctgcgctgagcggcggccagccggcagacacacaaactcgggccacttctaagagtctcttacctgttaggtccaaagaagtcgatgtttccaaacagcttcattcaggaggtccagagaatgatgttacaaaaatcaccaaactgagacgagagaatgggcaaatgaaagctactgacactgccaccagaaggaatgtcagaaaaggacggagttttgctcttgttgccacccaggctggagtgcaatggcgcaatctcagctcaccacaacctccgcctcctgggttcaagcgattatcctgcctcagcctcccaaatacctgggattacagctacaaaccactgagtaagcaaaaatcagaggaagagctcaaggacaagaaccagctgttagaagccgtcaacaagcagttgcaccagaagttgactgaaactcagggagagctgaaggacctgacccagaaggtagagctgctggagaagtttcgggacaactgtttggcaattttggagagcaagggccttgatccagctttaggcagtgagaccctggcatcacgacaagaatccactactgatcacatggactctatgttgctgttagaaactttgcaagaggagctgaagctttttaacgaaacagccaaaaagcagatggaggagttacaggccttaaaggtaaagctggagatgaaagaggaaagagtccgattcctagaacagcaaaccttatgtaacaatcaagtaaatgatttaacaacagcccttaaggaaatggagcagctattagaaatgtaagaagaagcaagtggccagatggctccctcttgggcataaaatctcagaggaagctacttaggacatcatcttggccatgatcttctgggactcaccatctccagaatgaaaacaatttctacagtagacttaaggacagtttatgctgaaatggcaattcctcatttaagcaagttttcccaaccttcaggttggtcagccctcctgagcctcacaggtggataattgaggcctacaagagaggggagcctaggagcttggattgaccttctagtcaaccacctgacttcagcacaccattacaatcgggagactaaaccaacaaccagaggatctaaaatgtcacattcagattttcaggaagaaaatcttcattacagtggagcacaaatgttccatacaagacatcattgaggagccatgctgtccccttctaacctgaaacacattctttcccatcctggttgggcttctgtacctccttattaatttatgaacctgaagttgcttgaagtgttttgggcttaataaatggggtgaaagtataggtagcagtaacacctacatgaaacaatacaccttggatcttttaatctaaattacttttcttttttaagtctacttttaaaataaatacttctgtaaata

SEQ ID NO: 448969 - DNA, 1515 bp, Homo sapiens
tacaaattgcatcaccctcctcctctgcccagacctgggggctccaacacctttcgctaggtctggctctggcctctgagcgaaccttccgtacagtatggcggctcccgaagccccgcccctggacagagttttccgtacaacatggctgtctacagagtgcgattcccacccacttccgcctagctaccggaagtttctatttgaaacccaggcggccgacttagccggtggcacgacagttgctgcagggaatcttttaaacgagagcgagaaggactgcgggcaggaccggcgggctcctggggttcagccgtgccgcctcgttacgatgaccagtgtggttaagacagtgtatagcctgcagcccccctctgcgctgagcggcggccagccggcagctacaaaccactgagtaagcaaaaatcagaggaagagctcaaggacaagaaccagctgttagaagccgtcaacaagcagttgcaccagaagttgactgaaactcagggagagctgaaggacctgacccagaaggtagagctgctggagaagtttcgggacaactgtttggcaattttggagagcaagggccttgatccagctttaggcagtgagaccctggcatcacgacaagaatccactactgatcacatggactctatgttgctgttagaaactttgcaagaggagctgaagctttttaacgaaacagccaaaaagcagatggaggagttacaggccttaaaggtaaagctggagatgaaagaggaaagagtccgattcctagaacagcaaaccttatgtaacaatcaagtaaatgatttaacaacagcccttaaggaaatggagcagctattagaaatgtaagaagaagcaagtggccagatggctccctcttgggcataaaatctcagaggaagctacttaggacatcatcttggccatgatcttctgggactcaccatctccagaatgaaaacaatttctacagtagacttaaggacagtttatgctgaaatggcaattcctcatttaagcaagttttcccaaccttcaggttggtcagccctcctgagcctcacaggtggataattgaggcctacaagagaggggagcctaggagcttggattgaccttctagtcaaccacctgacttcagcacaccattacaatcgggagactaaaccaacaaccagaggatctaaaatgtcacattcagattttcaggaagaaaatcttcattacagtggagcacaaatgttccatacaagacatcattgaggagccatgctgtccccttctaacctgaaacacattctttcccatcctggttgggcttctgtacctccttattaatttatgaacctgaagttgcttgaagtgttttgggcttaataaatggggtgaaagtataggtagcagtaacacctacatgaaacaatacaccttggatcttttaatctaaattacttttcttttttaagtctacttttaaaataaatacttctgtaaata

SEQ ID NO: 448970 - DNA, 1060 bp, Homo sapiens
aaaaaacgctagaaatacacccccattcgcgagttataatagagaaagaggacgccaggttgtctaccttcataacaacaatatctctgtagttggatcaagtgacttctgcccacctggacacaacaccaaaaaggcttcttattcgggtgtgagtcttttcagcaacccggtccagtactgggagatacagccatccaccttcagatgtgtctacgtgcgctctgccattcaactcggaaactataagtaattctcaagaaagccctcatttttataacctggcaaaatcttgttaatgtcattgctaaaaaataaataaaagctagatactggaaacctaactgcaatgtggatgttttacccacatgacttattatgcataaagccaaatttccagtttaagtaattgcctacaataaaaagaaattttgcctgccattttcagaatcatcttttgaagctttctgttgatgttaactgagctactagagatattcttatttcactaaatgtaaaatttggagtaaatatatatgtcaatatttagtaaagcttttcttttttaatttccaggaaaaaataaaaagagtatgagtcttctgtaattcattgagcagttagctcatttgagataaagtcaaatgccaaacactagctctgtattaatccccatcattactggtaaagcctcatttgaatgtgtgaattcaatacaggctatgtaaaatttttactaatgtcattattttgaaaaaataaatttaaaaatacattcaaaatactattgtatacaagcttaattgttaatattccctaaacacaattttatgaagggagaagacattggtttgttgacaataacagtacatcttttcaagttctcagctatttcttctacctctccctatcttacatttgagtatggtaacttatgtcatctatgttgaatgtaagcttataaagcacaaagcatacatttcctgactggtctagagaactgatgtttcaatttacccctctgctaaataaatattaaaactatcatgtgacttcatgt

SEQ ID NO: 448971 - DNA, 780 bp, Homo sapiens
aaaaaacgctagaaatacacccccattcgcgagttataatagagaaagaggacgccaggttgtctaccttcataacaacaatatctctgtagttggatcaagtgacttctgcccacctggacacaacaccaaaaaggcttcttattcgggtgtgagtcttttcagcaacccggtccagtactgggagatacagccatccaccttcagatgtgtctacgtgcgctctgccattcaactcggaaactataagtaattctcaagaaagccctcatttttataacctggcaaaatcttgttaatgtcattgctaaaaaataaataaaagctagatactggaaacctaactgcaatgtggatgttttacccacatgacttattatgcataaagccaaatttccagtttaagtaattgcctacaataaaaagaaattttgcctgccattttcagaatcatcttttgaagctttctgttgatgttaactgagctactagagatattcttatttcactaaatgtaaaatttggagtaaatatatatgtcaatatttagtaaagcttttcttttttaatttccaggaaaaaataaaaagagtatgagtcttctgtaattcattgagcagttagctcatttgagataaagtcaaatgccaaacactagctctgtattaatccccatcattactggtaaagcctcatttgaatgtgtgaattcaatacaggctatgtaaaatttttactaatgtcattattttgaaaaaataaatttaaaaatacattcaa

SEQ ID NO: 448972 - DNA, 479 bp, Homo sapiens
taacctggggaccttataatatacagctagcctgaaaggactgaataatttggctaagttgggattgagtttcaacagcatctctgctgttgacaatggctctctggccaacacgcctcatctgagggagcttcacttggacaacaacaagcttaccagagtacctggtgggctggcagagcataagtacatccaggttgtctaccttcataacaacaatatctctgtagttggatcaagtgacttctgcccacctggacacaacaccaaaaaggcttcttattcgggtgtgagtcttttcagcaacccggtccagtactgggagatacagccatccaccttcagatgtgtctacgtgcgctctgccattcaactcggaaactataagtaattctcaagaaagccctcatttttataacctggcaaaatcttgttaatgtcattgctaaaaaataaataaaagctagatactggaaacc

SEQ ID NO: 448973 - DNA, 2151 bp, Homo sapiens
ttagattatgacataaatcttgtaaaaacctgtcagttattttcatctatgagagaagaggagcccaaactctcgcccacctgttcttaaccagaaaacccactgactttgaaaatctcacctctgccacccatctacttgcattcgtctttggcagacctcaagataaatatgggttaatgcctgcatgatgcctctgaattcaggaattgcagggaaaactcggggctttgtgccagtctctaagttggcaactttggctgaacaaatgagtagtggcttcagtgtccttgcgtacacattctgtggattgatttaatggagttgtcagcatgatcatcatcttctagccaggggcatagttgccaaggccatttacctctttctaagaagaaacagaattatgtgtatatatgagagaaagaaacaagaatgcgtgaatgaggatgaagaaacatttaccccatgtactcaagacatttcagttttaaaagtcactttcctattagacttcttgaaaaagattctcacatagcctctatgtaatcagacaaatgacatttgatttcaagagcagaggggtaaacatcctctgctaatcgacaggtagcaggtgtcagaggaggcataatattaatagcgccaccttctgttgggtcagtggagatgggtgaggagcagcacagagcagcagggatcatcacatgcagccaaacttggcctctgaagggggaaggtagtgggaataggtggtgagagaactcacatttttctcttgtcctggttttatatttcggagggaaaggattatttggccccattaagaattaagaggctgggtgcggtggctcacgtctgtaatcccagcaccttgggaggcccaggcaggcagatcacctgaggtcgggagttcgagaccagcgtgaccaacgtggagaaacccccgtctctactaaaaatacaaaaaattagctgggcatggtggtgcatgcctgtgattccagtttgcctccagctatgtgttttattggcgggattactttgaggaccagccccttctgtatcccccaggctttgacggaagagtcgtggtgtatcccagcaaccagactttaaaggactacctcagctggcgacaagcagattgtcacatcaataatctttataatacagttttctgggcacttatacaacaatctggactaacaccagtacaagcccaagggagattacagggaactcttgcagcagacaagaatgagattttgttttctgaattcaacatcaactataataatgagccgccgatgtataggaaagggactgtgttgatatggcagaaggtggatgaagtgatgacaaaagaaattaagctgccaacagaaatggaaggaaaaaagatggcagtgacccggaccaggacaaagccagtgcccttgcactgcgatatcatcggggatgctttctggaaggaacatccagagattctagatgaagacagctgacccttttgcgcttcagttctggtgtgcttaaccatgcaagccctcccacctcccagggctccttgccttaggtggctgtagcatccctaccacccaggacactggtgtgaatgacacaactcaagttgggaggggaacagggaaggaagggatggatgggggtggtgtatcttattctgtttaagcagaacaccttgtttgcggtgttggaacatggttcctttggcagaagtgctttttttttaatcgcagtactatttttataaagcaagaactattccatgccttggagaatgaatcaattttttaactgtgctatggagtagaagcaggaggttttcaacctagtcacagagcagcacctaccccctcctcctttccacacctgcaaactcttttacttgggctgaatatttagtgtaattacatctcagctttgagggctcctgtggcaaattcccggattaaaaggttccctggttgtgaaaatacatgagataaatcatgaaggccactatcatcctccttctgcttgcacaagtttcctgggctggaccgtttcaacagaactcaggaggcggaagttgcggtgagccaagattgtgccattgcactccagcctgggcaacgagcgaaactacatctc

SEQ ID NO: 448974 - DNA, 332 bp, Homo sapiens
gctgaaacagatactacagtgactagtaatatctgtttcagcaagcaacctatattactagtcactgtagtatctgtttctgcaagccacctatactacagtgactagtaatatcctaaaatttcctctaaaagccttgcacttattacatttgtagaaactgggcaccaatccgctgaagagctcaggaattgaaaatggggctttccagggaatgaagaagctctcctacatccgcattgctgataccaatatcaccagcattcctcaaggtgatagaagattctccaaaacattttgaaaaatttaaattcaaaggctttaattaaaaa

SEQ ID NO: 448975 - DNA, 846 bp, Homo sapiens
aaggaataataagacacgccctgaaggagtacatcgtctagtgagggacagaccaagcacgcaaaacaaattgcaatataatgtgataagttctttaaaagaggtaagagcaacgtgctttgggagcagagaagagggagaaagcagcatcttgcctggatgagccaggggacacagaagagaagcccactatctcatttaatctttacaactctcttgcaaggttccctggttgtgaaaatacatgagataaatcatgaaggccactatcatcctccttctgcttgcacaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtggtccagtgttctgatttgggtctggacaaagtgccaaaggatcttccccctgacacaactctgctagacctgcaaaacaacaaaataaccgaaatcaaagatggagactttaagaacctgaagaaccttcacgcattgattcttgtcaacaataaaattagcaaagttagtcctggagcatttacacctttggtgaagttggaacgactttatctgtccaagaatcagctgaaggaattgccagaaaaaatgcccaaaactcttcaggatataagagcattttgaaccagaagcgggaaccccaaaaaccctatgtacttaaaagtccccgccataggatggcggtggaccaggtggaacagagtcccttttaagaaatggaattaacgtaacgggga

SEQ ID NO: 448976 - DNA, 3896 bp, Homo sapiens
ttagattatgacataaatcttgtaaaaacctgtcagttattttcatctatgagagaagaggagcccaaactctcgcccacctgttcttaaccagaaaacccactgactttgaaaatctcacctctgccacccatctacttgcattcgtctttggcagacctcaagataaatatgggttaatgcctgcatgatgcctctgaattcaggaattgcagggaaaactcggggctttgtgccagtctctaagttggcaactttggctgaacaaatgagtagtggcttcagtgtccttgcgtacacattctgtggattgatttaatggagttgtcagcatgatcatcatcttctagccaggggcatagttgccaaggccatttacctctttctaagaagaaacagaattatgtgtatatatgagagaaagaaacaagaatgcgtgaatgaggatgaagaaacatttaccccatgtactcaagacatttcagttttaaaagtcactttcctattagacttcttgaaaaagattctcacatagcctctatgtaatcagacaaatgacatttgatttcaagagcagaggggtaaacatcctctgctaatcgacaggtagcaggtgtcagaggaggcataatattaatagcgccaccttctgttgggtcagtggagatgggtgaggagcagcacagagcagcagggatcatcacatgcagccaaacttggcctctgaagggggaaggtagtgggaataggtggtgagagaactcacatttttctcttgtcctggttttatatttcggagggaaaggattatttggccccattaagaattaagaggctgggtgcggtggctcacgtctgtaatcccagcaccttgggaggcccaggcaggcagatcacctgaggtcgggagttcgagaccagcgtgaccaacgtggagaaacccccgtctctactaaaaatacaaaaaattagctgggcatggtggtgcatgcctgtgattccagtttgcctccagctatgtgttttattggcgggattactttgaggaccagccccttctgtatcccccaggctttgacggaagagtcgtggtgtatcccagcaaccagactttaaaggactacctcagctggcgacaagcagattgtcacatcaataatctttataatacagttttctgggcacttatacaacaatctggactaacaccagtacaagcccaagggagattacagggaactcttgcagcagacaagaatgagattttgttttctgaattcaacatcaactataataatgagccgccgatgtataggaaagggactgtgttgatatggcagaaggtggatgaagtgatgacaaaagaaattaagctgccaacagaaatggaaggaaaaaagatggcagtgacccggaccaggacaaagccagtgcccttgcactgcgatatcatcggggatgctttctggaaggaacatccagagattctagatgaagacagctgacccttttgcgcttcagttctggtgtgcttaaccatgcaagccctcccacctcccagggctccttgccttaggtggctgtagcatccctaccacccaggacactggtgtgaatgacacaactcaagttgggaggggaacagggaaggaagggatggatgggggtggtgtatcttattctgtttaagcagaacaccttgtttgcggtgttggaacatggttcctttggcagaagtgctttttttttaatcgcagtactatttttataaagcaagaactattccatgccttggagaatgaatcaattttttaactgtgctatggagtagaagcaggaggttttcaacctagtcacagagcagcacctaccccctcctcctttccacacctgcaaactcttttacttgggctgaatatttagtgtaattacatctcagctttgagggctcctgtggcaaattcccggattaaaaggttccctggttgtgaaaatacatgagataaatcatgaaggccactatcatcctccttctgcttgcacaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtggtccagtgttctgatttgggtctggacaaagtgccaaaggatcttccccctgacacaactctgctagacctgcaaaacaacaaaataaccgaaatcaaagatggagactttaagaacctgaagaaccttcacgcattgattcttgtcaacaataaaattagcaaagttagtcctggagcatttacacctttggtgaagttggaacgactttatctgtccaagaatcagctgaaggaattgccagaaaaaatgcccaaaactcttcaggagctgcgtgcccatgagaatgagatcaccaaagtgcgaaaagttactttcaatggactgaaccagatgattgtcatagaactgggcaccaatccgctgaagagctcaggaattgaaaatggggctttccagggaatgaagaagctctcctacatccgcattgctgataccaatatcaccagcattcctcaaggtcttcctccttcccttacggaattacatcttgatggcaacaaaatcagcagagttgatgcagctagcctgaaaggactgaataatttggctaagttgggattgagtttcaacagcatctctgctgttgacaatggctctctggccaacacgcctcatctgagggagcttcacttggacaacaacaagcttaccagagtacctggtgggctggcagagcataagtacatccaggttgtctaccttcataacaacaatatctctgtagttggatcaagtgacttctgcccacctggacacaacaccaaaaaggcttcttattcgggtgtgagtcttttcagcaacccggtccagtactgggagatacagccatccaccttcagatgtgtctacgtgcgctctgccattcaactcggaaactataagtaattctcaagaaagccctcatttttataacctggcaaaatcttgttaatgtcattgctaaaaaataaataaaagctagatactggaaacctaactgcaatgtggatgttttacccacatgacttattatgcataaagccaaatttccagtttaagtaattgcctacaataaaaagaaattttgcctgccattttcagaatcatcttttgaagctttctgttgatgttaactgagctactagagatattcttatttcactaaatgtaaaatttggagtaaatatatatgtcaatatttagtaaagcttttcttttttaatttccaggaaaaaataaaaagagtatgagtcttctgtaattcattgagcagttagctcatttgagataaagtcaaatgccaaacactagctctgtattaatccccatcattactggtaaagcctcatttgaatgtgtgaattcaatacaggctatgtaaaatttttactaatgtcattattttgaaaaaataaatttaaaaatacattcaaaatactattgtatacaagcttaattgttaatattccctaaacacaattttatgaagggagaagacattggtttgttgacaataacagtacatcttttcaagttctcagctatttcttctacctctccctatcttacatttgagtatggtaacttatgtcatctatgttgaatgtaagcttataaagcacaaagcatacatttcctgactggtctagagaactgatgtttcaatttacccctctgctaaataaatattaaaactatcatgtgacttcatgt

SEQ ID NO: 448977 - DNA, 3682 bp, Homo sapiens
  misc_feature (3628)..(3628): n is a, c, g, or t
  misc_feature (3639)..(3639): n is a, c, g, or t
  misc_feature (3643)..(3644): n is a, c, g, or t
  misc_feature (3647)..(3647): n is a, c, g, or t
  misc_feature (3656)..(3656): n is a, c, g, or t
  misc_feature (3659)..(3660): n is a, c, g, or t
  misc_feature (3662)..(3662): n is a, c, g, or t
  misc_feature (3668)..(3668): n is a, c, g, or t
ttagattatgacataaatcttgtaaaaacctgtcagttattttcatctatgagagaagaggagcccaaactctcgcccacctgttcttaaccagaaaacccactgactttgaaaatctcacctctgccacccatctacttgcattcgtctttggcagacctcaagataaatatgggttaatgcctgcatgatgcctctgaattcaggaattgcagggaaaactcggggctttgtgccagtctctaagttggcaactttggctgaacaaatgagtagtggcttcagtgtccttgcgtacacattctgtggattgatttaatggagttgtcagcatgatcatcatcttctagccaggggcatagttgccaaggccatttacctctttctaagaagaaacagaattatgtgtatatatgagagaaagaaacaagaatgcgtgaatgaggatgaagaaacatttaccccatgtactcaagacatttcagttttaaaagtcactttcctattagacttcttgaaaaagattctcacatagcctctatgtaatcagacaaatgacatttgatttcaagagcagaggggtaaacatcctctgctaatcgacaggtagcaggtgtcagaggaggcataatattaatagcgccaccttctgttgggtcagtggagatgggtgaggagcagcacagagcagcagggatcatcacatgcagccaaacttggcctctgaagggggaaggtagtgggaataggtggtgagagaactcacatttttctcttgtcctggttttatatttcggagggaaaggattatttggccccattaagaattaagaggctgggtgcggtggctcacgtctgtaatcccagcaccttgggaggcccaggcaggcagatcacctgaggtcgggagttcgagaccagcgtgaccaacgtggagaaacccccgtctctactaaaaatacaaaaaattagctgggcatggtggtgcatgcctgtgattccagtttgcctccagctatgtgttttattggcgggattactttgaggaccagccccttctgtatcccccaggctttgacggaagagtcgtggtgtatcccagcaaccagactttaaaggactacctcagctggcgacaagcagattgtcacatcaataatctttataatacagttttctgggcacttatacaacaatctggactaacaccagtacaagcccaagggagattacagggaactcttgcagcagacaagaatgagattttgttttctgaattcaacatcaactataataatgagccgccgatgtataggaaagggactgtgttgatatggcagaaggtggatgaagtgatgacaaaagaaattaagctgccaacagaaatggaaggaaaaaagatggcagtgacccggaccaggacaaagccagtgcccttgcactgcgatatcatcggggatgctttctggaaggaacatccagagattctagatgaagacagctgacccttttgcgcttcagttctggtgtgcttaaccatgcaagccctcccacctcccagggctccttgccttaggtggctgtagcatccctaccacccaggacactggtgtgaatgacacaactcaagttgggaggggaacagggaaggaagggatggatgggggtggtgtatcttattctgtttaagcagaacaccttgtttgcggtgttggaacatggttcctttggcagaagtgctttttttttaatcgcagtactatttttataaagcaagaactattccatgccttggagaatgaatcaattttttaactgtgctatggagtagaagcaggaggttttcaacctagtcacagagcagcacctaccccctcctcctttccacacctgcaaactcttttacttgggctgaatatttagtgtaattacatctcagctttgagggctcctgtggcaaattcccggattaaaaggttccctggttgtgaaaatacatgagataaatcatgaaggccactatcatcctccttctgcttgcacaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtggtccagtgttctgatttgggtctggacaaagtgccaaaggatcttccccctgacacaactctgctagacctgcaaaacaacaaaataaccgaaatcaaagatggagactttaagaacctgaagaaccttcacgcattgattcttgtcaacaataaaattagcaaagttagtcctggagcatttacacctttggtgaagttggaacgactttatctgtccaagaatcagctgaaggaattgccagaaaaaatgcccaaaactcttcaggagctgcgtgcccatgagaatgagatcaccaaagtgcgaaaagttactttcaatggactgaaccagatgattgtcatagaactgggcaccaatccgctgaagagctcaggaattgaaaatggggctttccagggaatgaagaagctctcctacatccgcattgctgataccaatatcaccagcattcctcaaggtcttcctccttcccttacggaattacatcttgatggcaacaaaatcagcagagttgatgcagctagcctgaaaggactgaataatttggctaagttgggattgagtttcaacagcatctctgctgttgacaatggctctctggccaacacgcctcatctgagggagcttcacttggacaacaacaagcttaccagagtacctggtgggctggcagagcataagtacatccaggttgtctaccttcataacaacaatatctctgtagttggatcaagtgacttctgcccacctggacacaacaccaaaaaggcttcttattcgggtgtgagtcttttcagcaacccggtccagtactgggagatacagccatccaccttcagatgtgtctacgtgcgctctgccattcaactcggaaactataagtaattctcaagaaagccctcatttttataacctggcaaaatcttgttaatgtcattgctaaaaaataaataaaagctagatactggaaacctaactgcaatgtggatgttttacccacatgacttattatgcataaagccaaatttccagtttaagtaattgcctacaataaaaagaaattttgcctgccattttcagaatcatcttttgaagctttctgttgatgttaactgagctactagagatattcttatttcactaaatgtaaaatttggagtaaatatatatgtcaatatttagtaaagcttttcttttttaatttccaggaaaaaataaaaagagtatgagtcttctgtaattcattgagcagttagctcatttgagataaagtcaaatgccaaacactagctctgtattaatccccatcattactggtaaagcctcatttgaatgtgtgaattcaatacaggctatgtaaaatttttactaatgtcattattttgaaaaaataaatttaaaaatacattcaaaaaaaaaaaaantggcctccttnggcnncangggggagcnttnncnccgttncctttagtgagggg

SEQ ID NO: 448978 - DNA, 3975 bp, Homo sapiens
ttagattatgacataaatcttgtaaaaacctgtcagttattttcatctatgagagaagaggagcccaaactctcgcccacctgttcttaaccagaaaacccactgactttgaaaatctcacctctgccacccatctacttgcattcgtctttggcagacctcaagataaatatgggttaatgcctgcatgatgcctctgaattcaggaattgcagggaaaactcggggctttgtgccagtctctaagttggcaactttggctgaacaaatgagtagtggcttcagtgtccttgcgtacacattctgtggattgatttaatggagttgtcagcatgatcatcatcttctagccaggggcatagttgccaaggccatttacctctttctaagaagaaacagaattatgtgtatatatgagagaaagaaacaagaatgcgtgaatgaggatgaagaaacatttaccccatgtactcaagacatttcagttttaaaagtcactttcctattagacttcttgaaaaagattctcacatagcctctatgtaatcagacaaatgacatttgatttcaagagcagaggggtaaacatcctctgctaatcgacaggtagcaggtgtcagaggaggcataatattaatagcgccaccttctgttgggtcagtggagatgggtgaggagcagcacagagcagcagggatcatcacatgcagccaaacttggcctctgaagggggaaggtagtgggaataggtggtgagagaactcacatttttctcttgtcctggttttatatttcggagggaaaggattatttggccccattaagaattaagaggctgggtgcggtggctcacgtctgtaatcccagcaccttgggaggcccaggcaggcagatcacctgaggtcgggagttcgagaccagcgtgaccaacgtggagaaacccccgtctctactaaaaatacaaaaaattagctgggcatggtggtgcatgcctgtgattccagtttgcctccagctatgtgttttattggcgggattactttgaggaccagccccttctgtatcccccaggctttgacggaagagtcgtggtgtatcccagcaaccagactttaaaggactacctcagctggcgacaagcagattgtcacatcaataatctttataatacagttttctgggcacttatacaacaatctggactaacaccagtacaagcccaagggagattacagggaactcttgcagcagacaagaatgagattttgttttctgaattcaacatcaactataataatgagccgccgatgtataggaaagggactgtgttgatatggcagaaggtggatgaagtgatgacaaaagaaattaagctgccaacagaaatggaaggaaaaaagatggcagtgacccggaccaggacaaagccagtgcccttgcactgcgatatcatcggggatgctttctggaaggaacatccagagattctagatgaagacagctgacccttttgcgcttcagttctggtgtgcttaaccatgcaagccctcccacctcccagggctccttgccttaggtggctgtagcatccctaccacccaggacactggtgtgaatgacacaactcaagttgggaggggaacagggaaggaagggatggatgggggtggtgtatcttattctgtttaagcagaacaccttgtttgcggtgttggaacatggttcctttggcagaagtgctttttttttaatcgcagtactatttttataaagcaagaactattccatgccttggagaatgaatcaattttttaactgtgctatggagtagaagcaggaggttttcaacctagtcacagagcagcacctaccccctcctcctttccacacctgcaaactcttttacttgggctgaatatttagtgtaattacatctcagctttgagggctcctgtggcaaattcccggattaaaagatggttttcaataattgtcctgaactctgctacagactaataaaacttcggtcaagttgcgagcaaaagggattatttggttccctggttgtgaaaatacatgagataaatcatgaaggccactatcatcctccttctgcttgcacaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtggtccagtgttctgatttgggtctggacaaagtgccaaaggatcttccccctgacacaactctgctagacctgcaaaacaacaaaataaccgaaatcaaagatggagactttaagaacctgaagaaccttcacgcattgattcttgtcaacaataaaattagcaaagttagtcctggagcatttacacctttggtgaagttggaacgactttatctgtccaagaatcagctgaaggaattgccagaaaaaatgcccaaaactcttcaggagctgcgtgcccatgagaatgagatcaccaaagtgcgaaaagttactttcaatggactgaaccagatgattgtcatagaactgggcaccaatccgctgaagagctcaggaattgaaaatggggctttccagggaatgaagaagctctcctacatccgcattgctgataccaatatcaccagcattcctcaaggtcttcctccttcccttacggaattacatcttgatggcaacaaaatcagcagagttgatgcagctagcctgaaaggactgaataatttggctaagttgggattgagtttcaacagcatctctgctgttgacaatggctctctggccaacacgcctcatctgagggagcttcacttggacaacaacaagcttaccagagtacctggtgggctggcagagcataagtacatccaggttgtctaccttcataacaacaatatctctgtagttggatcaagtgacttctgcccacctggacacaacaccaaaaaggcttcttattcgggtgtgagtcttttcagcaacccggtccagtactgggagatacagccatccaccttcagatgtgtctacgtgcgctctgccattcaactcggaaactataagtaattctcaagaaagccctcatttttataacctggcaaaatcttgttaatgtcattgctaaaaaataaataaaagctagatactggaaacctaactgcaatgtggatgttttacccacatgacttattatgcataaagccaaatttccagtttaagtaattgcctacaataaaaagaaattttgcctgccattttcagaatcatcttttgaagctttctgttgatgttaactgagctactagagatattcttatttcactaaatgtaaaatttggagtaaatatatatgtcaatatttagtaaagcttttcttttttaatttccaggaaaaaataaaaagagtatgagtcttctgtaattcattgagcagttagctcatttgagataaagtcaaatgccaaacactagctctgtattaatccccatcattactggtaaagcctcatttgaatgtgtgaattcaatacaggctatgtaaaatttttactaatgtcattattttgaaaaaataaatttaaaaatacattcaaaatactattgtatacaagcttaattgttaatattccctaaacacaattttatgaagggagaagacattggtttgttgacaataacagtacatcttttcaagttctcagctatttcttctacctctccctatcttacatttgagtatggtaacttatgtcatctatgttgaatgtaagcttataaagcacaaagcatacatttcctgactggtctagagaactgatgtttcaatttacccctctgctaaataaatattaaaactatcatgtgacttcatgt

SEQ ID NO: 448979 - DNA, 2066 bp, Homo sapiens
actaggcagagccgtggaaccgacgccaggtcgctgatggaccacgccgtccgtcgcgccgtccgaccgctcagcgtccgccgtcgccatgggagtgcaggcggaaaccatctccccaggagacggtgagaggggcgcattaaaaggttccctggttgtgaaaatacatgagataaatcatgaaggccactatcatcctccttctgcttgcacaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtggtccagtgttctgatttgggtctggacaaagtgccaaaggatcttccccctgacacaactctgctagacctgcaaaacaacaaaataaccgaaatcaaagatggagactttaagaacctgaagaaccttcacgcattgattcttgtcaacaataaaattagcaaagttagtcctggagcatttacacctttggtgaagttggaacgactttatctgtccaagaatcagctgaaggaattgccagaaaaaatgcccaaaactcttcaggagctgcgtgcccatgagaatgagatcaccaaagtgcgaaaagttactttcaatggactgaaccagatgattgtcatagaactgggcaccaatccgctgaagagctcaggaattgaaaatggggctttccagggaatgaagaagctctcctacatccgcattgctgataccaatatcaccagcattcctcaaggtcttcctccttcccttacggaattacatcttgatggcaacaaaatcagcagagttgatgcagctagcctgaaaggactgaataatttggctaagttgggattgagtttcaacagcatctctgctgttgacaatggctctctggccaacacgcctcatctgagggagcttcacttggacaacaacaagcttaccagagtacctggtgggctggcagagcataagtacatccaggttgtctaccttcataacaacaatatctctgtagttggatcaagtgacttctgcccacctggacacaacaccaaaaaggcttcttattcgggtgtgagtcttttcagcaacccggtccagtactgggagatacagccatccaccttcagatgtgtctacgtgcgctctgccattcaactcggaaactataagtaattctcaagaaagccctcatttttataacctggcaaaatcttgttaatgtcattgctaaaaaataaataaaagctagatactggaaacctaactgcaatgtggatgttttacccacatgacttattatgcataaagccaaatttccagtttaagtaattgcctacaataaaaagaaattttgcctgccattttcagaatcatcttttgaagctttctgttgatgttaactgagctactagagatattcttatttcactaaatgtaaaatttggagtaaatatatatgtcaatatttagtaaagcttttcttttttaatttccaggaaaaaataaaaagagtatgagtcttctgtaattcattgagcagttagctcatttgagataaagtcaaatgccaaacactagctctgtattaatccccatcattactggtaaagcctcatttgaatgtgtgaattcaatacaggctatgtaaaatttttactaatgtcattattttgaaaaaataaatttaaaaatacattcaaaatactattgtatacaagcttaattgttaatattccctaaacacaattttatgaagggagaagacattggtttgttgacaataacagtacatcttttcaagttctcagctatttcttctacctctccctatcttacatttgagtatggtaacttatgtcatctatgttgaatgtaagcttataaagcacaaagcatacatttcctgactggtctagagaactgatgtttcaatttacccctctgctaaataaatattaaaactatcatgtgacttcatgt

SEQ ID NO: 448980 - DNA, 4110 bp, Homo sapiens
  misc_feature (2253)..(2253): n is a, c, g, or t
ttagattatgacataaatcttgtaaaaacctgtcagttattttcatctatgagagaagaggagcccaaactctcgcccacctgttcttaaccagaaaacccactgactttgaaaatctcacctctgccacccatctacttgcattcgtctttggcagacctcaagataaatatgggttaatgcctgcatgatgcctctgaattcaggaattgcagggaaaactcggggctttgtgccagtctctaagttggcaactttggctgaacaaatgagtagtggcttcagtgtccttgcgtacacattctgtggattgatttaatggagttgtcagcatgatcatcatcttctagccaggggcatagttgccaaggccatttacctctttctaagaagaaacagaattatgtgtatatatgagagaaagaaacaagaatgcgtgaatgaggatgaagaaacatttaccccatgtactcaagacatttcagttttaaaagtcactttcctattagacttcttgaaaaagattctcacatagcctctatgtaatcagacaaatgacatttgatttcaagagcagaggggtaaacatcctctgctaatcgacaggtagcaggtgtcagaggaggcataatattaatagcgccaccttctgttgggtcagtggagatgggtgaggagcagcacagagcagcagggatcatcacatgcagccaaacttggcctctgaagggggaaggtagtgggaataggtggtgagagaactcacatttttctcttgtcctggttttatatttcggagggaaaggattatttggccccattaagaattaagaggctgggtgcggtggctcacgtctgtaatcccagcaccttgggaggcccaggcaggcagatcacctgaggtcgggagttcgagaccagcgtgaccaacgtggagaaacccccgtctctactaaaaatacaaaaaattagctgggcatggtggtgcatgcctgtgattccagtttgcctccagctatgtgttttattggcgggattactttgaggaccagccccttctgtatcccccaggctttgacggaagagtcgtggtgtatcccagcaaccagactttaaaggactacctcagctggcgacaagcagattgtcacatcaataatctttataatacagttttctgggcacttatacaacaatctggactaacaccagtacaagcccaagggagattacagggaactcttgcagcagacaagaatgagattttgttttctgaattcaacatcaactataataatgagccgccgatgtataggaaagggactgtgttgatatggcagaaggtggatgaagtgatgacaaaagaaattaagctgccaacagaaatggaaggaaaaaagatggcagtgacccggaccaggacaaagccagtgcccttgcactgcgatatcatcggggatgctttctggaaggaacatccagagattctagatgaagacagctgacccttttgcgcttcagttctggtgtgcttaaccatgcaagccctcccacctcccagggctccttgccttaggtggctgtagcatccctaccacccaggacactggtgtgaatgacacaactcaagttgggaggggaacagggaaggaagggatggatgggggtggtgtatcttattctgtttaagcagaacaccttgtttgcggtgttggaacatggttcctttggcagaagtgctttttttttaatcgcagtactatttttataaagcaagaactattccatgccttggagaatgaatcaattttttaactgtgctatggagtagaagcaggaggttttcaacctagtcacagagcagcacctaccccctcctcctttccacacctgcaaactcttttacttgggctgaatatttagtgtaattacatctcagctttgagggctcctgtggcaaattcccggattaaaaggttccctggttgtgaaaatacatgagataaatcatgaaggccactatcatcctccttctgcttcttgcgacaaggagggatgatagtggccttcatgatttatctcatgtattttcacaaccagggaaccttttaatccgggaatttgccacaggagccctcaaagctgagatgtaattacactaaatattcagcccaagtaaaagagtttgcaggtgtggaaaggaggagggggtaggtgctgctctgtgactaggttgaaaacctcctgcttctngcacaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtggtccagtgttctgatttgggtctggacaaagtgccaaaggatcttccccctgacacaactctgctagacctgcaaaacaacaaaataaccgaaatcaaagatggagactttaagaacctgaagaaccttcacgcattgattcttgtcaacaataaaattagcaaagttagtcctggagcatttacacctttggtgaagttggaacgactttatctgtccaagaatcagctgaaggaattgccagaaaaaatgcccaaaactcttcaggagctgcgtgcccatgagaatgagatcaccaaagtgcgaaaagttactttcaatggactgaaccagatgattgtcatagaactgggcaccaatccgctgaagagctcaggaattgaaaatggggctttccagggaatgaagaagctctcctacatccgcattgctgataccaatatcaccagcattcctcaaggtcttcctccttcccttacggaattacatcttgatggcaacaaaatcagcagagttgatgcagctagcctgaaaggactgaataatttggctaagttgggattgagtttcaacagcatctctgctgttgacaatggctctctggccaacacgcctcatctgagggagcttcacttggacaacaacaagcttaccagagtacctggtgggctggcagagcataagtacatccaggttgtctaccttcataacaacaatatctctgtagttggatcaagtgacttctgcccacctggacacaacaccaaaaaggcttcttattcgggtgtgagtcttttcagcaacccggtccagtactgggagatacagccatccaccttcagatgtgtctacgtgcgctctgccattcaactcggaaactataagtaattctcaagaaagccctcatttttataacctggcaaaatcttgttaatgtcattgctaaaaaataaataaaagctagatactggaaacctaactgcaatgtggatgttttacccacatgacttattatgcataaagccaaatttccagtttaagtaattgcctacaataaaaagaaattttgcctgccattttcagaatcatcttttgaagctttctgttgatgttaactgagctactagagatattcttatttcactaaatgtaaaatttggagtaaatatatatgtcaatatttagtaaagcttttcttttttaatttccaggaaaaaataaaaagagtatgagtcttctgtaattcattgagcagttagctcatttgagataaagtcaaatgccaaacactagctctgtattaatccccatcattactggtaaagcctcatttgaatgtgtgaattcaatacaggctatgtaaaatttttactaatgtcattattttgaaaaaataaatttaaaaatacattcaaaatactattgtatacaagcttaattgttaatattccctaaacacaattttatgaagggagaagacattggtttgttgacaataacagtacatcttttcaagttctcagctatttcttctacctctccctatcttacatttgagtatggtaacttatgtcatctatgttgaatgtaagcttataaagcacaaagcatacatttcctgactggtctagagaactgatgtttcaatttacccctctgctaaataaatattaaaactatcatgtgacttcatgt

SEQ ID NO: 448981 - DNA, 3413 bp, Homo sapiens
ttagattatgacataaatcttgtaaaaacctgtcagttattttcatctatgagagaagaggagcccaaactctcgcccacctgttcttaaccagaaaacccactgactttgaaaatctcacctctgccacccatctacttgcattcgtctttggcagacctcaagataaatatgggttaatgcctgcatgatgcctctgaattcaggaattgcagggaaaactcggggctttgtgccagtctctaagttggcaactttggctgaacaaatgagtagtggcttcagtgtccttgcgtacacattctgtggattgatttaatggagttgtcagcatgatcatcatcttctagccaggggcatagttgccaaggccatttacctctttctaagaagaaacagaattatgtgtatatatgagagaaagaaacaagaatgcgtgaatgaggatgaagaaacatttaccccatgtactcaagacatttcagttttaaaagtcactttcctattagacttcttgaaaaagattctcacatagcctctatgtaatcagacaaatgacatttgatttcaagagcagaggggtaaacatcctctgctaatcgacaggtagcaggtgtcagaggaggcataatattaatagcgccaccttctgttgggtcagtggagatgggtgaggagcagcacagagcagcagggatcatcacatgcagccaaacttggcctctgaagggggaaggtagtgggaataggtggtgagagaactcacatttttctcttgtcctggttttatatttcggagggaaaggattatttggccccattaagaattaagaggctgggtgcggtggctcacgtctgtaatcccagcaccttgggaggcccaggcaggcagatcacctgaggtcgggagttcgagaccagcgtgaccaacgtggagaaacccccgtctctactaaaaatacaaaaaattagctgggcatggtggtgcatgcctgtgattccagtttgcctccagctatgtgttttattggcgggattactttgaggaccagccccttctgtatcccccaggctttgacggaagagtcgtggtgtatcccagcaaccagactttaaaggactacctcagctggcgacaagcagattgtcacatcaataatctttataatacagttttctgggcacttatacaacaatctggactaacaccagtacaagcccaagggagattacagggaactcttgcagcagacaagaatgagattttgttttctgaattcaacatcaactataataatgagccgccgatgtataggaaagggactgtgttgatatggcagaaggtggatgaagtgatgacaaaagaaattaagctgccaacagaaatggaaggaaaaaagatggcagtgacccggaccaggacaaagccagtgcccttgcactgcgatatcatcggggatgctttctggaaggaacatccagagattctagatgaagacagctgacccttttgcgcttcagttctggtgtgcttaaccatgcaagccctcccacctcccagggctccttgccttaggtggctgtagcatccctaccacccaggacactggtgtgaatgacacaactcaagttgggaggggaacagggaaggaagggatggatgggggtggtgtatcttattctgtttaagcagaacaccttgtttgcggtgttggaacatggttcctttggcagaagtgctttttttttaatcgcagtactatttttataaagcaagaactattccatgccttggagaatgaatcaattttttaactgtgctatggagtagaagcaggaggttttcaacctagtcacagagcagcacctaccccctcctcctttccacacctgcaaactcttttacttgggctgaatatttagtgtaattacatctcagctttgagggctcctgtggcaaattcccggattaaaaggttccctggttgtgaaaatacatgagataaatcatgaaggccactatcatcctccttctgcttgcacaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtggtccagtgttctgatttgggtctggacaaagtgccaaaggatcttccccctgacacaactctgctagacctgcaaaacaacaaaataaccgaaatcaaagatggagactttaagaacctgaagaaccttcacgcattgattcttgtcaacaataaaattagcaaagttagtcctggagcatttacacctttggtgaagttggaacgactttatctgtccaagaatcagctgaaggaattgccagaaaaaatgcccaaaactcttcaggagctgcgtgcccatgagaatgagatcaccaaagtgcgaaaagttactttcaatggactgaaccagatgattgtcatagaactgggcaccaatccgctgaagagctcaggaattgaaaatggggctttccagggaatgaagaagctctcctacatccgcattgctgataccaatatcaccagcattcctcaaggtcttcctccttcccttacggaattacatcttgatggcaacaaaatcagcagagttgatgcagctagcctgaaaggactgaataatttggctaagttgggattgagtttcaacagcatctctgctgttgacaatggctctctggccaacacgcctcatctgagggagcttcacttggacaacaacaagcttaccagagtacctggtgggctggcagagcataagtacatccaggttgtctaccttcataacaacaatatctctgtagttggatcaagtgacttctgcccacctggacacaacaccaaaaaggcttcttattcgggtgtgagtcttttcagcaacccggtccagtactgggagatacagccatccaccttcagatgtgtctacgtgcgctctgccattcaactcggaaactataagtaattctcaagaaagccctcatttttataacctggcaaaatcttgttaatgtcattgctaaaaaataaataaaagctagatactggaaacctaactgcaatgtggatgttttacccacatgacttattatgcataaagccaaatttccagtttaagtaattgcctacaataaaaagaaattttgcctgccattttcagaatcatcttttgaagctttctgttgatgttaactgagctactagagatattcttatttcactaaatgtaaaatttggagtaaatatatatgtcaatatttagtaaagcttttcttttttaatttccagg

SEQ ID NO: 448982 - DNA, 3845 bp, Homo sapiens
ttagattatgacataaatcttgtaaaaacctgtcagttattttcatctatgagagaagaggagcccaaactctcgcccacctgttcttaaccagaaaacccactgactttgaaaatctcacctctgccacccatctacttgcattcgtctttggcagacctcaagataaatatgggttaatgcctgcatgatgcctctgaattcaggaattgcagggaaaactcggggctttgtgccagtctctaagttggcaactttggctgaacaaatgagtagtggcttcagtgtccttgcgtacacattctgtggattgatttaatggagttgtcagcatgatcatcatcttctagccaggggcatagttgccaaggccatttacctctttctaagaagaaacagaattatgtgtatatatgagagaaagaaacaagaatgcgtgaatgaggatgaagaaacatttaccccatgtactcaagacatttcagttttaaaagtcactttcctattagacttcttgaaaaagattctcacatagcctctatgtaatcagacaaatgacatttgatttcaagagcagaggggtaaacatcctctgctaatcgacaggtagcaggtgtcagaggaggcataatattaatagcgccaccttctgttgggtcagtggagatgggtgaggagcagcacagagcagcagggatcatcacatgcagccaaacttggcctctgaagggggaaggtagtgggaataggtggtgagagaactcacatttttctcttgtcctggttttatatttcggagggaaaggattatttggccccattaagaattaagaggctgggtgcggtggctcacgtctgtaatcccagcaccttgggaggcccaggcaggcagatcacctgaggtcgggagttcgagaccagcgtgaccaacgtggagaaacccccgtctctactaaaaatacaaaaaattagctgggcatggtggtgcatgcctgtgattccagtttgcctccagctatgtgttttattggcgggattactttgaggaccagccccttctgtatcccccaggctttgacggaagagtcgtggtgtatcccagcaaccagactttaaaggactacctcagctggcgacaagcagattgtcacatcaataatctttataatacagttttctgggcacttatacaacaatctggactaacaccagtacaagcccaagggagattacagggaactcttgcagcagacaagaatgagattttgttttctgaattcaacatcaactataataatgagccgccgatgtataggaaagggactgtgttgatatggcagaaggtggatgaagtgatgacaaaagaaattaagctgccaacagaaatggaaggaaaaaagatggcagtgacccggaccaggacaaagccagtgcccttgcactgcgatatcatcggggatgctttctggaaggaacatccagagattctagatgaagacagctgacccttttgcgcttcagttctggtgtgcttaaccatgcaagccctcccacctcccagggctccttgccttaggtggctgtagcatccctaccacccaggacactggtgtgaatgacacaactcaagttgggaggggaacagggaaggaagggatggatgggggtggtgtatcttattctgtttaagcagaacaccttgtttgcggtgttggaacatggttcctttggcagaagtgctttttttttaatcgcagtactatttttataaagcaagaactattccatgccttggagaatgaatcaattttttaactgtgctatggagtagaagcaggaggttttcaacctagtcacagagcagcacctaccccctcctcctttccacacctgcaaactcttttacttgggctgaatatttagtgtaattacatctcagctttgagggctcctgtggcaaattcccggattaaaaggttccctggttgtgaaaatacatgagataaatcatgaaggccactatcatcctccttctgcttgcacaagtttcctgggctggaccgtttcaacagaaagttcctgatgaccgcgacttcgagccctccctaggcccagtgtgccccttccgctgtcaatgccatcttcgagtggtccagtgttctgatttgggtctggacaaagtgccaaaggatcttccccctgacacaactctgctagacctgcaaaacaacaaaataaccgaaatcaaagatggagactttaagaacctgaagaaccttcacgcattgattcttgtcaacaataaaattagcaaagttagtcctggagcatttacacctttggtgaagttggaacgactttatctgtccaagaatcagctgaaggaattgccagaaaaaatgcccaaaactcttcaggagctgcgtgcccatgagaatgagatcaccaaagtgcgaaaagttactttcaatggactgaaccagatgattgtcatagaactgggcaccaatccgctgaagagctcaggaattgaaaatggggctttccagggaatgaagaagctctcctacatccgcattgctgataccaatatcaccagcattcctcaaggtcttcctccttcccttacggaattacatcttgatggcaacaaaatcagcagagttgatgcagctagcctgaaaggactgaataatttggctaagttgggattgagtttcaacagcatctctgctgttgacaatggctctctggccaacacgcctcatctgagggagcttcacttggacaacaacaagcttaccagagtacctggtgggctggcagagcataagtacatccaggttgtctaccttcataacaacaatatctctgtagttggatcaagtgacttctgcccacctggacacaacaccaaaaaggcttcttattcgggtgtgagtcttttcagcaacccggtccagtactgggagatacagccatccaccttcagatgtgtctacgtgcgctctgccattcaactcggaaactataagtaattctcaagaaagccctcatttttataacctggcaaaatcttgttaatgtcattgctaaaaaataaataaaagctagatactggaaacctaactgcaatgtggatgttttacccacatgacttattatgcataaagccaaatttccagtttaagtaattgcctacaataaaaagaaattttgcctgccattttcagaatcatcttttgaagctttctgttgatgttaactgagctactagagatattcttatttcactaaatgtaaaatttggagtaaatatatatgtcaatatttagtaaagcttttcttttttaatttccaggaaaaaataaaaagagtatgagtcttctgtaattcattgagcagttagctcatttgagataaagtcaaatgccaaacactagctctgtattaatccccatcattactggtaaagcctcatttgaatgtgtgaattcaatacaggctatgtaaaatttttactaatgtcattattttgaaaaaataaatttaaaaatacattcaaaatactattgtatacaagcttaattgttaatattccctaaacacaattttatgaagggagaagacattggtttgttgacaataacagtacatcttttcaagttctcagctatttcttctacctctccctatcttacatttgagtatggtaacttatgtcatctatgttgaatgtaagcttataaagcacaaagcatacatttcctgactggtctagagaactgatgtttcaatttacccctctgctaaataaatattaaaactatcatgtgacttcatgt

SEQ ID NO: 448983 - DNA, 3783 bp, Homo sapiens
ttagattatgacataaatcttgtaaaaacctgtcagttattttcatctatgagagaagaggagcccaaactctcgcccacctgttcttaaccagaaaacccactgactttgaaaatctcacctctgccacccatctacttgcattcgtctttggcagacctcaagataaatatgggttaatgcctgcatgatgcctctgaattcaggaattgcagggaaaactcggggctttgtgccagtctctaagttggcaactttggctgaacaaatgagtagtggcttcagtgtccttgcgtacacattctgtggattgatttaatggagttgtcagcatgatcatcatcttctagccaggggcatagttgccaaggccatttacctctttctaagaagaaacagaattatgtgtatatatgagagaaagaaacaagaatgcgtgaatgaggatgaagaaacatttaccccatgtactcaagacatttcagttttaaaagtcactttcctattagacttcttgaaaaagattctcacatagcctctatgtaatcagacaaatgacatttgatttcaagagcagaggggtaaacatcctctgctaatcgacaggtagcaggtgtcagaggaggcataatattaatagcgccaccttctgttgggtcagtggagatgggtgaggagcagcacagagcagcagggatcatcacatgcagccaaacttggcctctgaagggggaaggtagtgggaataggtggtgagagaactcacatttttctcttgtcctggttttatatttcggagggaaaggattatttggccccattaagaattaagaggctgggtgcggtggctcacgtctgtaatcccagcaccttgggaggcccaggcaggcagatcacctgaggtcgggagttcgagaccagcgtgaccaacgtggagaaacccccgtctctactaaaaatacaaaaaattagctgggcatggtggtgcatgcctgtgattccagtttgcctccagctatgtgttttattggcgggattactttgaggaccagccccttctgtatcccccaggctttgacggaagagtcgtggtgtatcccagcaaccagactttaaaggactacctcagctggcgacaagcagattgtcacatcaataatctttataatacagttttctgggcacttatacaacaatctggactaacaccagtacaagcccaagggagattacagggaactcttgcagcagacaagaatgagattttgttttctgaattcaacatcaactataataatgagccgccgatgtataggaaagggactgtgttgatatggcagaaggtggatgaagtgatgacaaaagaaattaagctgccaacagaaatggaaggaaaaaagatggcagtgacccggaccaggacaaagccagtgcccttgcactgcgatatcatcggggatgctttctggaaggaacatccagagattctagatgaagacagctgacccttttgcgcttcagttctggtgtgcttaaccatgcaagccctcccacctcccagggctccttgccttaggtggctgtagcatccctaccacccaggacactggtgtgaatgacacaactcaagttgggaggggaacagggaaggaagggatggatgggggtggtgtatcttattctgtttaagcagaacaccttgtttgcggtgttggaacatggttcctttggcagaagtgctttttttttaatcgcagtactatttttataaagcaagaactattccatgccttggagaatgaatcaattttttaactgtgctatggagtagaagcaggaggttttcaacctagtcacagagcagcacctaccccctcctcctttccacacctgcaaactcttttacttgggctgaatatttagtgtaattacatctcagctttgagggctcctgtggcaaattcccggattaaaaggttccctggttgtgaaaatacatgagataaatcatgaaggccactatcatcctccttctgcttgcacaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtggtccagtgttctgatttgggcattgattcttgtcaacaataaaattagcaaagttagtcctggagcatttacacctttggtgaagttggaacgactttatctgtccaagaatcagctgaaggaattgccagaaaaaatgcccaaaactcttcaggagctgcgtgcccatgagaatgagatcaccaaagtgcgaaaagttactttcaatggactgaaccagatgattgtcatagaactgggcaccaatccgctgaagagctcaggaattgaaaatggggctttccagggaatgaagaagctctcctacatccgcattgctgataccaatatcaccagcattcctcaaggtcttcctccttcccttacggaattacatcttgatggcaacaaaatcagcagagttgatgcagctagcctgaaaggactgaataatttggctaagttgggattgagtttcaacagcatctctgctgttgacaatggctctctggccaacacgcctcatctgagggagcttcacttggacaacaacaagcttaccagagtacctggtgggctggcagagcataagtacatccaggttgtctaccttcataacaacaatatctctgtagttggatcaagtgacttctgcccacctggacacaacaccaaaaaggcttcttattcgggtgtgagtcttttcagcaacccggtccagtactgggagatacagccatccaccttcagatgtgtctacgtgcgctctgccattcaactcggaaactataagtaattctcaagaaagccctcatttttataacctggcaaaatcttgttaatgtcattgctaaaaaataaataaaagctagatactggaaacctaactgcaatgtggatgttttacccacatgacttattatgcataaagccaaatttccagtttaagtaattgcctacaataaaaagaaattttgcctgccattttcagaatcatcttttgaagctttctgttgatgttaactgagctactagagatattcttatttcactaaatgtaaaatttggagtaaatatatatgtcaatatttagtaaagcttttcttttttaatttccaggaaaaaataaaaagagtatgagtcttctgtaattcattgagcagttagctcatttgagataaagtcaaatgccaaacactagctctgtattaatccccatcattactggtaaagcctcatttgaatgtgtgaattcaatacaggctatgtaaaatttttactaatgtcattattttgaaaaaataaatttaaaaatacattcaaaatactattgtatacaagcttaattgttaatattccctaaacacaattttatgaagggagaagacattggtttgttgacaataacagtacatcttttcaagttctcagctatttcttctacctctccctatcttacatttgagtatggtaacttatgtcatctatgttgaatgtaagcttataaagcacaaagcatacatttcctgactggtctagagaactgatgtttcaatttacccctctgctaaataaatattaaaactatcatgtgacttcatgt

SEQ ID NO: 448984 - DNA, 3843 bp, Homo sapiens
ttagattatgacataaatcttgtaaaaacctgtcagttattttcatctatgagagaagaggagcccaaactctcgcccacctgttcttaaccagaaaacccactgactttgaaaatctcacctctgccacccatctacttgcattcgtctttggcagacctcaagataaatatgggttaatgcctgcatgatgcctctgaattcaggaattgcagggaaaactcggggctttgtgccagtctctaagttggcaactttggctgaacaaatgagtagtggcttcagtgtccttgcgtacacattctgtggattgatttaatggagttgtcagcatgatcatcatcttctagccaggggcatagttgccaaggccatttacctctttctaagaagaaacagaattatgtgtatatatgagagaaagaaacaagaatgcgtgaatgaggatgaagaaacatttaccccatgtactcaagacatttcagttttaaaagtcactttcctattagacttcttgaaaaagattctcacatagcctctatgtaatcagacaaatgacatttgatttcaagagcagaggggtaaacatcctctgctaatcgacaggtagcaggtgtcagaggaggcataatattaatagcgccaccttctgttgggtcagtggagatgggtgaggagcagcacagagcagcagggatcatcacatgcagccaaacttggcctctgaagggggaaggtagtgggaataggtggtgagagaactcacatttttctcttgtcctggttttatatttcggagggaaaggattatttggccccattaagaattaagaggctgggtgcggtggctcacgtctgtaatcccagcaccttgggaggcccaggcaggcagatcacctgaggtcgggagttcgagaccagcgtgaccaacgtggagaaacccccgtctctactaaaaatacaaaaaattagctgggcatggtggtgcatgcctgtgattccagtttgcctccagctatgtgttttattggcgggattactttgaggaccagccccttctgtatcccccaggctttgacggaagagtcgtggtgtatcccagcaaccagactttaaaggactacctcagctggcgacaagcagattgtcacatcaataatctttataatacagttttctgggcacttatacaacaatctggactaacaccagtacaagcccaagggagattacagggaactcttgcagcagacaagaatgagattttgttttctgaattcaacatcaactataataatgagccgccgatgtataggaaagggactgtgttgatatggcagaaggtggatgaagtgatgacaaaagaaattaagctgccaacagaaatggaaggaaaaaagatggcagtgacccggaccaggacaaagccagtgcccttgcactgcgatatcatcggggatgctttctggaaggaacatccagagattctagatgaagacagctgacccttttgcgcttcagttctggtgtgcttaaccatgcaagccctcccacctcccagggctccttgccttaggtggctgtagcatccctaccacccaggacactggtgtgaatgacacaactcaagttgggaggggaacagggaaggaagggatggatgggggtggtgtatcttattctgtttaagcagaacaccttgtttgcggtgttggaacatggttcctttggcagaagtgctttttttttaatcgcagtactatttttataaagcaagaactattccatgccttggagaatgaatcaattttttaactgtgctatggagtagaagcaggaggttttcaacctagtcacagagcagcacctaccccctcctcctttccacacctgcaaactcttttacttgggctgaatatttagtgtaattacatctcagctttgagggctcctgtggcaaattcccggattaaaaggttccctggttgtgaaaatacatgagataaatcatgaaggccactatcatcctccttctgcttgcacaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtggtccagtgttctgatttgggtctggacaaagtgccaaaggatcttccccctgacacaactctgctagacctgcaaaacaacaaaataaccgaaatcaaagatggagactttaagaacctgaagaaccttcacgcattgattcttgtcaacaataaaattagcaaagttagtcctggagcatttacacctttggtgaagttggaacgactttatctgtccaagaatcagctgaaggaattgccagaaaaaatgcccaaaactcttcaggagctgcgtgcccatgagaatgagatcaccaaagtgcgaaaagttactttcaatggactgaaccagatgattgtcatagaactgggcaccaatccgctgaagagctcaggaattgaaaatggggctttccagggaatgaagaagctctcctacatccgcattgctgataccaatatcaccagcattcctcaaggtcttcctccttcccttacggaattacatcttgatggcaacgttgggattgagtttcaacagcatctctgctgttgacaatggctctctggccaacacgcctcatctgagggagcttcacttggacaacaacaagcttaccagagtacctggtgggctggcagagcataagtacatccaggttgtctaccttcataacaacaatatctctgtagttggatcaagtgacttctgcccacctggacacaacaccaaaaaggcttcttattcgggtgtgagtcttttcagcaacccggtccagtactgggagatacagccatccaccttcagatgtgtctacgtgcgctctgccattcaactcggaaactataagtaattctcaagaaagccctcatttttataacctggcaaaatcttgttaatgtcattgctaaaaaataaataaaagctagatactggaaacctaactgcaatgtggatgttttacccacatgacttattatgcataaagccaaatttccagtttaagtaattgcctacaataaaaagaaattttgcctgccattttcagaatcatcttttgaagctttctgttgatgttaactgagctactagagatattcttatttcactaaatgtaaaatttggagtaaatatatatgtcaatatttagtaaagcttttcttttttaatttccaggaaaaaataaaaagagtatgagtcttctgtaattcattgagcagttagctcatttgagataaagtcaaatgccaaacactagctctgtattaatccccatcattactggtaaagcctcatttgaatgtgtgaattcaatacaggctatgtaaaatttttactaatgtcattattttgaaaaaataaatttaaaaatacattcaaaatactattgtatacaagcttaattgttaatattccctaaacacaattttatgaagggagaagacattggtttgttgacaataacagtacatcttttcaagttctcagctatttcttctacctctccctatcttacatttgagtatggtaacttatgtcatctatgttgaatgtaagcttataaagcacaaagcatacatttcctgactggtctagagaactgatgtttcaatttacccctctgctaaataaatattaaaactatcatgtgacttcatgt

SEQ ID NO: 448985 - DNA, 3853 bp, Homo sapiens
ttagattatgacataaatcttgtaaaaacctgtcagttattttcatctatgagagaagaggagcccaaactctcgcccacctgttcttaaccagaaaacccactgactttgaaaatctcacctctgccacccatctacttgcattcgtctttggcagacctcaagataaatatgggttaatgcctgcatgatgcctctgaattcaggaattgcagggaaaactcggggctttgtgccagtctctaagttggcaactttggctgaacaaatgagtagtggcttcagtgtccttgcgtacacattctgtggattgatttaatggagttgtcagcatgatcatcatcttctagccaggggcatagttgccaaggccatttacctctttctaagaagaaacagaattatgtgtatatatgagagaaagaaacaagaatgcgtgaatgaggatgaagaaacatttaccccatgtactcaagacatttcagttttaaaagtcactttcctattagacttcttgaaaaagattctcacatagcctctatgtaatcagacaaatgacatttgatttcaagagcagaggggtaaacatcctctgctaatcgacaggtagcaggtgtcagaggaggcataatattaatagcgccaccttctgttgggtcagtggagatgggtgaggagcagcacagagcagcagggatcatcacatgcagccaaacttggcctctgaagggggaaggtagtgggaataggtggtgagagaactcacatttttctcttgtcctggttttatatttcggagggaaaggattatttggccccattaagaattaagaggctgggtgcggtggctcacgtctgtaatcccagcaccttgggaggcccaggcaggcagatcacctgaggtcgggagttcgagaccagcgtgaccaacgtggagaaacccccgtctctactaaaaatacaaaaaattagctgggcatggtggtgcatgcctgtgattccagtttgcctccagctatgtgttttattggcgggattactttgaggaccagccccttctgtatcccccaggctttgacggaagagtcgtggtgtatcccagcaaccagactttaaaggactacctcagctggcgacaagcagattgtcacatcaataatctttataatacagttttctgggcacttatacaacaatctggactaacaccagtacaagcccaagggagattacagggaactcttgcagcagacaagaatgagattttgttttctgaattcaacatcaactataataatgagccgccgatgtataggaaagggactgtgttgatatggcagaaggtggatgaagtgatgacaaaagaaattaagctgccaacagaaatggaaggaaaaaagatggcagtgacccggaccaggacaaagccagtgcccttgcactgcgatatcatcggggatgctttctggaaggaacatccagagattctagatgaagacagctgacccttttgcgcttcagttctggtgtgcttaaccatgcaagccctcccacctcccagggctccttgccttaggtggctgtagcatccctaccacccaggacactggtgtgaatgacacaactcaagttgggaggggaacagggaaggaagggatggatgggggtggtgtatcttattctgtttaagcagaacaccttgtttgcggtgttggaacatggttcctttggcagaagtgctttttttttaatcgcagtactatttttataaagcaagaactattccatgccttggagaatgaatcaattttttaactgtgctatggagtagaagcaggaggttttcaacctagtcacagagcagcacctaccccctcctcctttccacacctgcaaactcttttacttgggctgaatatttagtgtaattacatctcagctttgagggctcctgtggcaaattcccggattaaaaggttccctggttgtgaaaatacatgagataaatcatgaaggccactatcatcctccttctgcttgcacaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtggtccagtgttctgatttgggtctggacaaagtgccaaaggatcttccccctgacacaactctgctagacctgcaaaacaacaaaataaccgaaatcaaagatggagactttaagaacctgaagaaccttcacgcattgattcttgtcaacaataaaattagcaaagttagtcctggagcatttacacctttggtgaagttggaacgactttatctgtccaagaatcagctgaaggaattgccagaaaaaatgcccaaaactcttcaggagctgcgtgcccatgagaatgagatcaccaaagtgaactgggcaccaatccgctgaagagctcaggaattgaaaatggggctttccagggaatgaagaagctctcctacatccgcattgctgataccaatatcaccagcattcctcaaggtcttcctccttcccttacggaattacatcttgatggcaacaaaatcagcagagttgatgcagctagcctgaaaggactgaataatttggctaagttgggattgagtttcaacagcatctctgctgttgacaatggctctctggccaacacgcctcatctgagggagcttcacttggacaacaacaagcttaccagagtacctggtgggctggcagagcataagtacatccaggttgtctaccttcataacaacaatatctctgtagttggatcaagtgacttctgcccacctggacacaacaccaaaaaggcttcttattcgggtgtgagtcttttcagcaacccggtccagtactgggagatacagccatccaccttcagatgtgtctacgtgcgctctgccattcaactcggaaactataagtaattctcaagaaagccctcatttttataacctggcaaaatcttgttaatgtcattgctaaaaaataaataaaagctagatactggaaacctaactgcaatgtggatgttttacccacatgacttattatgcataaagccaaatttccagtttaagtaattgcctacaataaaaagaaattttgcctgccattttcagaatcatcttttgaagctttctgttgatgttaactgagctactagagatattcttatttcactaaatgtaaaatttggagtaaatatatatgtcaatatttagtaaagcttttcttttttaatttccaggaaaaaataaaaagagtatgagtcttctgtaattcattgagcagttagctcatttgagataaagtcaaatgccaaacactagctctgtattaatccccatcattactggtaaagcctcatttgaatgtgtgaattcaatacaggctatgtaaaatttttactaatgtcattattttgaaaaaataaatttaaaaatacattcaaaatactattgtatacaagcttaattgttaatattccctaaacacaattttatgaagggagaagacattggtttgttgacaataacagtacatcttttcaagttctcagctatttcttctacctctccctatcttacatttgagtatggtaacttatgtcatctatgttgaatgtaagcttataaagcacaaagcatacatttcctgactggtctagagaactgatgtttcaatttacccctctgctaaataaatattaaaactatcatgtgacttcatgt

SEQ ID NO: 448986 - DNA, 3819 bp, Homo sapiens
ttagattatgacataaatcttgtaaaaacctgtcagttattttcatctatgagagaagaggagcccaaactctcgcccacctgttcttaaccagaaaacccactgactttgaaaatctcacctctgccacccatctacttgcattcgtctttggcagacctcaagataaatatgggttaatgcctgcatgatgcctctgaattcaggaattgcagggaaaactcggggctttgtgccagtctctaagttggcaactttggctgaacaaatgagtagtggcttcagtgtccttgcgtacacattctgtggattgatttaatggagttgtcagcatgatcatcatcttctagccaggggcatagttgccaaggccatttacctctttctaagaagaaacagaattatgtgtatatatgagagaaagaaacaagaatgcgtgaatgaggatgaagaaacatttaccccatgtactcaagacatttcagttttaaaagtcactttcctattagacttcttgaaaaagattctcacatagcctctatgtaatcagacaaatgacatttgatttcaagagcagaggggtaaacatcctctgctaatcgacaggtagcaggtgtcagaggaggcataatattaatagcgccaccttctgttgggtcagtggagatgggtgaggagcagcacagagcagcagggatcatcacatgcagccaaacttggcctctgaagggggaaggtagtgggaataggtggtgagagaactcacatttttctcttgtcctggttttatatttcggagggaaaggattatttggccccattaagaattaagaggctgggtgcggtggctcacgtctgtaatcccagcaccttgggaggcccaggcaggcagatcacctgaggtcgggagttcgagaccagcgtgaccaacgtggagaaacccccgtctctactaaaaatacaaaaaattagctgggcatggtggtgcatgcctgtgattccagtttgcctccagctatgtgttttattggcgggattactttgaggaccagccccttctgtatcccccaggctttgacggaagagtcgtggtgtatcccagcaaccagactttaaaggactacctcagctggcgacaagcagattgtcacatcaataatctttataatacagttttctgggcacttatacaacaatctggactaacaccagtacaagcccaagggagattacagggaactcttgcagcagacaagaatgagattttgttttctgaattcaacatcaactataataatgagccgccgatgtataggaaagggactgtgttgatatggcagaaggtggatgaagtgatgacaaaagaaattaagctgccaacagaaatggaaggaaaaaagatggcagtgacccggaccaggacaaagccagtgcccttgcactgcgatatcatcggggatgctttctggaaggaacatccagagattctagatgaagacagctgacccttttgcgcttcagttctggtgtgcttaaccatgcaagccctcccacctcccagggctccttgccttaggtggctgtagcatccctaccacccaggacactggtgtgaatgacacaactcaagttgggaggggaacagggaaggaagggatggatgggggtggtgtatcttattctgtttaagcagaacaccttgtttgcggtgttggaacatggttcctttggcagaagtgctttttttttaatcgcagtactatttttataaagcaagaactattccatgccttggagaatgaatcaattttttaactgtgctatggagtagaagcaggaggttttcaacctagtcacagagcagcacctaccccctcctcctttccacacctgcaaactcttttacttgggctgaatatttagtgtaattacatctcagctttgagggctcctgtggcaaattcccggattaaaaggttccctggttgtgaaaatacatgagataaatcatgaaggccactatcatcctccttctgcttgcacaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtggtccagtgttctgatttgggtctggacaaagtgccaaaggatcttccccctgacacaactctgctagacctgcaaaacaacaaaataaccgaaatcaaagatggagactttaagaacctgaagaaccttcacgcattgattcttgtcaacaataaaattagcaaagttagtcctggagcatttacacctttggtgaagttggaacgactttatctgtccaagaatcagctgaaggaattgccagaaaaaatgcccaaaactcttcaggaaactgggcaccaatccgctgaagagctcaggaattgaaaatggggctttccagggaatgaagaagctctcctacatccgcattgctgataccaatatcaccagcattcctcaaggtcttcctccttcccttacggaattacatcttgatggcaacaaaatcagcagagttgatgcagctagcctgaaaggactgaataatttggctaagttgggattgagtttcaacagcatctctgctgttgacaatggctctctggccaacacgcctcatctgagggagcttcacttggacaacaacaagcttaccagagtacctggtgggctggcagagcataagtacatccaggttgtctaccttcataacaacaatatctctgtagttggatcaagtgacttctgcccacctggacacaacaccaaaaaggcttcttattcgggtgtgagtcttttcagcaacccggtccagtactgggagatacagccatccaccttcagatgtgtctacgtgcgctctgccattcaactcggaaactataagtaattctcaagaaagccctcatttttataacctggcaaaatcttgttaatgtcattgctaaaaaataaataaaagctagatactggaaacctaactgcaatgtggatgttttacccacatgacttattatgcataaagccaaatttccagtttaagtaattgcctacaataaaaagaaattttgcctgccattttcagaatcatcttttgaagctttctgttgatgttaactgagctactagagatattcttatttcactaaatgtaaaatttggagtaaatatatatgtcaatatttagtaaagcttttcttttttaatttccaggaaaaaataaaaagagtatgagtcttctgtaattcattgagcagttagctcatttgagataaagtcaaatgccaaacactagctctgtattaatccccatcattactggtaaagcctcatttgaatgtgtgaattcaatacaggctatgtaaaatttttactaatgtcattattttgaaaaaataaatttaaaaatacattcaaaatactattgtatacaagcttaattgttaatattccctaaacacaattttatgaagggagaagacattggtttgttgacaataacagtacatcttttcaagttctcagctatttcttctacctctccctatcttacatttgagtatggtaacttatgtcatctatgttgaatgtaagcttataaagcacaaagcatacatttcctgactggtctagagaactgatgtttcaatttacccctctgctaaataaatattaaaactatcatgtgacttcatgt

SEQ ID NO: 448987 - DNA, 3768 bp, Homo sapiens
ttagattatgacataaatcttgtaaaaacctgtcagttattttcatctatgagagaagaggagcccaaactctcgcccacctgttcttaaccagaaaacccactgactttgaaaatctcacctctgccacccatctacttgcattcgtctttggcagacctcaagataaatatgggttaatgcctgcatgatgcctctgaattcaggaattgcagggaaaactcggggctttgtgccagtctctaagttggcaactttggctgaacaaatgagtagtggcttcagtgtccttgcgtacacattctgtggattgatttaatggagttgtcagcatgatcatcatcttctagccaggggcatagttgccaaggccatttacctctttctaagaagaaacagaattatgtgtatatatgagagaaagaaacaagaatgcgtgaatgaggatgaagaaacatttaccccatgtactcaagacatttcagttttaaaagtcactttcctattagacttcttgaaaaagattctcacatagcctctatgtaatcagacaaatgacatttgatttcaagagcagaggggtaaacatcctctgctaatcgacaggtagcaggtgtcagaggaggcataatattaatagcgccaccttctgttgggtcagtggagatgggtgaggagcagcacagagcagcagggatcatcacatgcagccaaacttggcctctgaagggggaaggtagtgggaataggtggtgagagaactcacatttttctcttgtcctggttttatatttcggagggaaaggattatttggccccattaagaattaagaggctgggtgcggtggctcacgtctgtaatcccagcaccttgggaggcccaggcaggcagatcacctgaggtcgggagttcgagaccagcgtgaccaacgtggagaaacccccgtctctactaaaaatacaaaaaattagctgggcatggtggtgcatgcctgtgattccagtttgcctccagctatgtgttttattggcgggattactttgaggaccagccccttctgtatcccccaggctttgacggaagagtcgtggtgtatcccagcaaccagactttaaaggactacctcagctggcgacaagcagattgtcacatcaataatctttataatacagttttctgggcacttatacaacaatctggactaacaccagtacaagcccaagggagattacagggaactcttgcagcagacaagaatgagattttgttttctgaattcaacatcaactataataatgagccgccgatgtataggaaagggactgtgttgatatggcagaaggtggatgaagtgatgacaaaagaaattaagctgccaacagaaatggaaggaaaaaagatggcagtgacccggaccaggacaaagccagtgcccttgcactgcgatatcatcggggatgctttctggaaggaacatccagagattctagatgaagacagctgacccttttgcgcttcagttctggtgtgcttaaccatgcaagccctcccacctcccagggctccttgccttaggtggctgtagcatccctaccacccaggacactggtgtgaatgacacaactcaagttgggaggggaacagggaaggaagggatggatgggggtggtgtatcttattctgtttaagcagaacaccttgtttgcggtgttggaacatggttcctttggcagaagtgctttttttttaatcgcagtactatttttataaagcaagaactattccatgccttggagaatgaatcaattttttaactgtgctatggagtagaagcaggaggttttcaacctagtcacagagcagcacctaccccctcctcctttccacacctgcaaactcttttacttgggctgaatatttagtgtaattacatctcagctttgagggctcctgtggcaaattcccggattaaaaggttccctggttgtgaaaatacatgagataaatcatgaaggccactatcatcctccttctgcttgcacaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtggtccagtgttctgatttgggtctggacaaagtgccaaaggatcttccccctgacacaactctgctagacctgcaaaacaacaaaataaccgaaatcaaagatggagactttaagaacctgaagaaccttcacgcattgattcttgtcaacaataaaattagcaaagttagtcctggagcatttacacctttggtgaagttggaacgactttatctgtcaactgggcaccaatccgctgaagagctcaggaattgaaaatggggctttccagggaatgaagaagctctcctacatccgcattgctgataccaatatcaccagcattcctcaaggtcttcctccttcccttacggaattacatcttgatggcaacaaaatcagcagagttgatgcagctagcctgaaaggactgaataatttggctaagttgggattgagtttcaacagcatctctgctgttgacaatggctctctggccaacacgcctcatctgagggagcttcacttggacaacaacaagcttaccagagtacctggtgggctggcagagcataagtacatccaggttgtctaccttcataacaacaatatctctgtagttggatcaagtgacttctgcccacctggacacaacaccaaaaaggcttcttattcgggtgtgagtcttttcagcaacccggtccagtactgggagatacagccatccaccttcagatgtgtctacgtgcgctctgccattcaactcggaaactataagtaattctcaagaaagccctcatttttataacctggcaaaatcttgttaatgtcattgctaaaaaataaataaaagctagatactggaaacctaactgcaatgtggatgttttacccacatgacttattatgcataaagccaaatttccagtttaagtaattgcctacaataaaaagaaattttgcctgccattttcagaatcatcttttgaagctttctgttgatgttaactgagctactagagatattcttatttcactaaatgtaaaatttggagtaaatatatatgtcaatatttagtaaagcttttcttttttaatttccaggaaaaaataaaaagagtatgagtcttctgtaattcattgagcagttagctcatttgagataaagtcaaatgccaaacactagctctgtattaatccccatcattactggtaaagcctcatttgaatgtgtgaattcaatacaggctatgtaaaatttttactaatgtcattattttgaaaaaataaatttaaaaatacattcaaaatactattgtatacaagcttaattgttaatattccctaaacacaattttatgaagggagaagacattggtttgttgacaataacagtacatcttttcaagttctcagctatttcttctacctctccctatcttacatttgagtatggtaacttatgtcatctatgttgaatgtaagcttataaagcacaaagcatacatttcctgactggtctagagaactgatgtttcaatttacccctctgctaaataaatattaaaactatcatgtgacttcatgt

SEQ ID NO: 448988 - DNA, 3782 bp, Homo sapiens
ttagattatgacataaatcttgtaaaaacctgtcagttattttcatctatgagagaagaggagcccaaactctcgcccacctgttcttaaccagaaaacccactgactttgaaaatctcacctctgccacccatctacttgcattcgtctttggcagacctcaagataaatatgggttaatgcctgcatgatgcctctgaattcaggaattgcagggaaaactcggggctttgtgccagtctctaagttggcaactttggctgaacaaatgagtagtggcttcagtgtccttgcgtacacattctgtggattgatttaatggagttgtcagcatgatcatcatcttctagccaggggcatagttgccaaggccatttacctctttctaagaagaaacagaattatgtgtatatatgagagaaagaaacaagaatgcgtgaatgaggatgaagaaacatttaccccatgtactcaagacatttcagttttaaaagtcactttcctattagacttcttgaaaaagattctcacatagcctctatgtaatcagacaaatgacatttgatttcaagagcagaggggtaaacatcctctgctaatcgacaggtagcaggtgtcagaggaggcataatattaatagcgccaccttctgttgggtcagtggagatgggtgaggagcagcacagagcagcagggatcatcacatgcagccaaacttggcctctgaagggggaaggtagtgggaataggtggtgagagaactcacatttttctcttgtcctggttttatatttcggagggaaaggattatttggccccattaagaattaagaggctgggtgcggtggctcacgtctgtaatcccagcaccttgggaggcccaggcaggcagatcacctgaggtcgggagttcgagaccagcgtgaccaacgtggagaaacccccgtctctactaaaaatacaaaaaattagctgggcatggtggtgcatgcctgtgattccagtttgcctccagctatgtgttttattggcgggattactttgaggaccagccccttctgtatcccccaggctttgacggaagagtcgtggtgtatcccagcaaccagactttaaaggactacctcagctggcgacaagcagattgtcacatcaataatctttataatacagttttctgggcacttatacaacaatctggactaacaccagtacaagcccaagggagattacagggaactcttgcagcagacaagaatgagattttgttttctgaattcaacatcaactataataatgagccgccgatgtataggaaagggactgtgttgatatggcagaaggtggatgaagtgatgacaaaagaaattaagctgccaacagaaatggaaggaaaaaagatggcagtgacccggaccaggacaaagccagtgcccttgcactgcgatatcatcggggatgctttctggaaggaacatccagagattctagatgaagacagctgacccttttgcgcttcagttctggtgtgcttaaccatgcaagccctcccacctcccagggctccttgccttaggtggctgtagcatccctaccacccaggacactggtgtgaatgacacaactcaagttgggaggggaacagggaaggaagggatggatgggggtggtgtatcttattctgtttaagcagaacaccttgtttgcggtgttggaacatggttcctttggcagaagtgctttttttttaatcgcagtactatttttataaagcaagaactattccatgccttggagaatgaatcaattttttaactgtgctatggagtagaagcaggaggttttcaacctagtcacagagcagcacctaccccctcctcctttccacacctgcaaactcttttacttgggctgaatatttagtgtaattacatctcagctttgagggctcctgtggcaaattcccggattaaaaggttccctggttgtgaaaatacatgagataaatcatgaaggccactatcatcctccttctgcttgcacaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtggtccagtgttctgatttgggtctggacaaagtgccaaaggatcttccccctgacacaactctgctagacctgcaaaacaacaaaataaccgaaatcaaagatggagactttaagaacctgaagaaccttcacgcattgattcttgtcaacaataaaattagcaaagttagtcctggagcatttacacctttggtgaagttggaacgactttatctgtccaagaatcagctgaaggaattgccagaaaaaatgcccaaaactcttcaggagctgcgtgcccatgagaatgagatcaccaaagtgcgaaaagttactttcaatggactgaaccagatgattgtcataggtcttcctccttcccttacggaattacatcttgatggcaacaaaatcagcagagttgatgcagctagcctgaaaggactgaataatttggctaagttgggattgagtttcaacagcatctctgctgttgacaatggctctctggccaacacgcctcatctgagggagcttcacttggacaacaacaagcttaccagagtacctggtgggctggcagagcataagtacatccaggttgtctaccttcataacaacaatatctctgtagttggatcaagtgacttctgcccacctggacacaacaccaaaaaggcttcttattcgggtgtgagtcttttcagcaacccggtccagtactgggagatacagccatccaccttcagatgtgtctacgtgcgctctgccattcaactcggaaactataagtaattctcaagaaagccctcatttttataacctggcaaaatcttgttaatgtcattgctaaaaaataaataaaagctagatactggaaacctaactgcaatgtggatgttttacccacatgacttattatgcataaagccaaatttccagtttaagtaattgcctacaataaaaagaaattttgcctgccattttcagaatcatcttttgaagctttctgttgatgttaactgagctactagagatattcttatttcactaaatgtaaaatttggagtaaatatatatgtcaatatttagtaaagcttttcttttttaatttccaggaaaaaataaaaagagtatgagtcttctgtaattcattgagcagttagctcatttgagataaagtcaaatgccaaacactagctctgtattaatccccatcattactggtaaagcctcatttgaatgtgtgaattcaatacaggctatgtaaaatttttactaatgtcattattttgaaaaaataaatttaaaaatacattcaaaatactattgtatacaagcttaattgttaatattccctaaacacaattttatgaagggagaagacattggtttgttgacaataacagtacatcttttcaagttctcagctatttcttctacctctccctatcttacatttgagtatggtaacttatgtcatctatgttgaatgtaagcttataaagcacaaagcatacatttcctgactggtctagagaactgatgtttcaatttacccctctgctaaataaatattaaaactatcatgtgacttcatgt

SEQ ID NO: 448989 - DNA, 3177 bp, Homo sapiens
ttagattatgacataaatcttgtaaaaacctgtcagttattttcatctatgagagaagaggagcccaaactctcgcccacctgttcttaaccagaaaacccactgactttgaaaatctcacctctgccacccatctacttgcattcgtctttggcagacctcaagataaatatgggttaatgcctgcatgatgcctctgaattcaggaattgcagggaaaactcggggctttgtgccagtctctaagttggcaactttggctgaacaaatgagtagtggcttcagtgtccttgcgtacacattctgtggattgatttaatggagttgtcagcatgatcatcatcttctagccaggggcatagttgccaaggccatttacctctttctaagaagaaacagaattatgtgtatatatgagagaaagaaacaagaatgcgtgaatgaggatgaagaaacatttaccccatgtactcaagacatttcagttttaaaagtcactttcctattagacttcttgaaaaagattctcacatagcctctatgtaatcagacaaatgacatttgatttcaagagcagaggggtaaacatcctctgctaatcgacaggtagcaggtgtcagaggaggcataatattaatagcgccaccttctgttgggtcagtggagatgggtgaggagcagcacagagcagcagggatcatcacatgcagccaaacttggcctctgaagggggaaggtagtgggaataggtggtgagagaactcacatttttctcttgtcctggttttatatttcggagggaaaggattatttggccccattaagaattaagaggctgggtgcggtggctcacgtctgtaatcccagcaccttgggaggcccaggcaggcagatcacctgaggtcgggagttcgagaccagcgtgaccaacgtggagaaacccccgtctctactaaaaatacaaaaaattagctgggcatggtggtgcatgcctgtgattccagtttgcctccagctatgtgttttattggcgggattactttgaggaccagccccttctgtatcccccaggctttgacggaagagtcgtggtgtatcccagcaaccagactttaaaggactacctcagctggcgacaagcagattgtcacatcaataatctttataatacagttttctgggcacttatacaacaatctggactaacaccagtacaagcccaagggagattacagggaactcttgcagcagacaagaatgagattttgttttctgaattcaacatcaactataataatgagccgccgatgtataggaaagggactgtgttgatatggcagaaggtggatgaagtgatgacaaaagaaattaagctgccaacagaaatggaaggaaaaaagatggcagtgacccggaccaggacaaagccagtgcccttgcactgcgatatcatcggggatgctttctggaaggaacatccagagattctagatgaagacagctgacccttttgcgcttcagttctggtgtgcttaaccatgcaagccctcccacctcccagggctccttgccttaggtggctgtagcatccctaccacccaggacactggtgtgaatgacacaactcaagttgggaggggaacagggaaggaagggatggatgggggtggtgtatcttattctgtttaagcagaacaccttgtttgcggtgttggaacatggttcctttggcagaagtgctttttttttaatcgcagtactatttttataaagcaagaactattccatgccttggagaatgaatcaattttttaactgtgctatggagtagaagcaggaggttttcaacctagtcacagagcagcacctaccccctcctcctttccacacctgcaaactcttttacttgggctgaatatttagtgtaattacatctcagctttgagggctcctgtggcaaattcccggattaaaaggttccctggttgtgaaaatacatgagataaatcatgaaggccactatcatcctccttctgcttgcacaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtggtccagtgttctgatttgggtctggacaaagtgccaaaggatcttccccctgacacaactctgctagacctgcaaaacaacaaaataaccgaaatcaaagatggagactttaagaacctgaagaaccttcacgcattgattcttgtcaacaataaaattagcaaagttagtcctggagcatttacacctttggtgaagttggaacgactttatctgtccaagaatcagctgaaggaattgccagaaaaaatgcccaaaactcttcaggagctgcgtgcccatgagaatgagatcaccaaagtgcgaaaagttactttcaatggactgaaccagatgattgtcatagaactgggcaccaatccgctgaagagctcaggaattgaaaatggggctttccagggaatgaagaagctctcctacatccgcattgctgataccaatatcaccagcattcctcaaggtcttcctccttcccttacggaattacatcttgatggcaacaaaatcagcagagttgatgcagctagcctgaaaggactgaataatttggctaagttgggattgagtttcaacagcatctctgctgttgacaatggctctctggccaacacgcctcatctgagggagcttcacttggacaacaacaagcttaccagagtacctggtgggctggcagagcataagtacatccaggttgtctaccttcataacaacaatatctctgtagttggatcaagtgacttctgcccacctggacacaacaccaaaaaggcttcttattcgggtgtgagtcttttcagcaacccggtccagtactgggagatacagccatccaccttcagatgtgtctacgtgcgctctgccattcaactcggaaactataagtaattctcaagaaagccctcatttttataacctggcaaaatcttgttaatgtcattgctaaaaaataaataaaagctagatactggaaacc

SEQ ID NO: 448990 - DNA, 3551 bp, Homo sapiens
ttagattatgacataaatcttgtaaaaacctgtcagttattttcatctatgagagaagaggagcccaaactctcgcccacctgttcttaaccagaaaacccactgactttgaaaatctcacctctgccacccatctacttgcattcgtctttggcagacctcaagataaatatgggttaatgcctgcatgatgcctctgaattcaggaattgcagggaaaactcggggctttgtgccagtctctaagttggcaactttggctgaacaaatgagtagtggcttcagtgtccttgcgtacacattctgtggattgatttaatggagttgtcagcatgatcatcatcttctagccaggggcatagttgccaaggccatttacctctttctaagaagaaacagaattatgtgtatatatgagagaaagaaacaagaatgcgtgaatgaggatgaagaaacatttaccccatgtactcaagacatttcagttttaaaagtcactttcctattagacttcttgaaaaagattctcacatagcctctatgtaatcagacaaatgacatttgatttcaagagcagaggggtaaacatcctctgctaatcgacaggtagcaggtgtcagaggaggcataatattaatagcgccaccttctgttgggtcagtggagatgggtgaggagcagcacagagcagcagggatcatcacatgcagccaaacttggcctctgaagggggaaggtagtgggaataggtggtgagagaactcacatttttctcttgtcctggttttatatttcggagggaaaggattatttggccccattaagaattaagaggctgggtgcggtggctcacgtctgtaatcccagcaccttgggaggcccaggcaggcagatcacctgaggtcgggagttcgagaccagcgtgaccaacgtggagaaacccccgtctctactaaaaatacaaaaaattagctgggcatggtggtgcatgcctgtgattccagtttgcctccagctatgtgttttattggcgggattactttgaggaccagccccttctgtatcccccaggctttgacggaagagtcgtggtgtatcccagcaaccagactttaaaggactacctcagctggcgacaagcagattgtcacatcaataatctttataatacagttttctgggcacttatacaacaatctggactaacaccagtacaagcccaagggagattacagggaactcttgcagcagacaagaatgagattttgttttctgaattcaacatcaactataataatgagccgccgatgtataggaaagggactgtgttgatatggcagaaggtggatgaagtgatgacaaaagaaattaagctgccaacagaaatggaaggaaaaaagatggcagtgacccggaccaggacaaagccagtgcccttgcactgcgatatcatcggggatgctttctggaaggaacatccagagattctagatgaagacagctgacccttttgcgcttcagttctggtgtgcttaaccatgcaagccctcccacctcccagggctccttgccttaggtggctgtagcatccctaccacccaggacactggtgtgaatgacacaactcaagttgggaggggaacagggaaggaagggatggatgggggtggtgtatcttattctgtttaagcagaacaccttgtttgcggtgttggaacatggttcctttggcagaagtgctttttttttaatcgcagtactatttttataaagcaagaactattccatgccttggagaatgaatcaattttttaactgtgctatggagtagaagcaggaggttttcaacctagtcacagagcagcacctaccccctcctcctttccacacctgcaaactcttttacttgggctgaatatttagtgtaattacatctcagctttgagggctcctgtggcaaattcccggattaaaaggttccctggttgtgaaaatacatgagataaatcatgaaggccactatcatcctccttctgcttgcacaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtggtccagtgttctgatttgggtctggacaaagtgccaaaggatcttccccctgacacaactctgctagacctgcaaaacaacaaaataaccgaaatcaaagatggagactttaagaacctgaagaaccttcacgcattgattcttgtcaacaataaaattagcaaagttagtcctggagcatttacacctttggtgaagttggaacgactttatctgtccaagaatcagctgaaggaattgccagaaaaaatgcccaaaactcttcaggagctgcgtgcccatgagaatgagatcaccaaagtgcgaaaagttactttcaatggactgaaccagatgattgtcatagaactgggcaccaatccgctgaagagctcaggaattgaaaatggggctttccagggaatgaagaagctctcctacatccgcattgctgataccaatatcaccagcattcctcaaggtcttcctccttcccttacggaattacatcttgatggcaacaaaatcagcagagttgatgcagctagcctgaaaggactgaataatttggctaagttgggattgagtttcaacagcatctctgctgttgacaatggctctctggccaacacgcctcatctgagggagcttcacttggacaacaacaagcttaccagagtacctggtgggctggcagagcataagtacatccaggttgtctaccttcataacaacaatatctctgtagttggatcaagtgacttctgcccacctggacacaacaccaaaaaggcttcttattcgggtgtgagtcttttcagcaacccggtccagtactgggagatacagccatccaccttcagatgtgtctacgtgcgctctgccattcaactcggaaactataagtaattctcaagaaagccctcatttttataacctggcaaaatcttgttaatgtcattgctaaaaaataaataaaagctagatactggaaacccaaaaaaaaaaaaaaaaaaaaaaaaaagaaaaaacaaaaaaaaaaaaaaaaaacaaaaaaaaaaaaaaaaaaaaaaaaaaaaaaaaaaaaaaggggggggcgggcaaaaaaagacccagagagggagacaacaaaaagaaacacacccagctatattagtgaaaaaaagggacgcacacaaaaagagaaggaataataaaaaacaaaaagcacgggtaggcgagaacaaaaagcacggagaaggagagaaaacaaaagacacaagagagaaacaatagtgggagagagacaccaaacaaacgagaggggggaaaaaaaaaaatagggaagaaaccacacacaaggaaaaaaaagaaacgagagggaaccaaaaa

SEQ ID NO: 448991 - DNA, 3455 bp, Homo sapiens
ttagattatgacataaatcttgtaaaaacctgtcagttattttcatctatgagagaagaggagcccaaactctcgcccacctgttcttaaccagaaaacccactgactttgaaaatctcacctctgccacccatctacttgcattcgtctttggcagacctcaagataaatatgggttaatgcctgcatgatgcctctgaattcaggaattgcagggaaaactcggggctttgtgccagtctctaagttggcaactttggctgaacaaatgagtagtggcttcagtgtccttgcgtacacattctgtggattgatttaatggagttgtcagcatgatcatcatcttctagccaggggcatagttgccaaggccatttacctctttctaagaagaaacagaattatgtgtatatatgagagaaagaaacaagaatgcgtgaatgaggatgaagaaacatttaccccatgtactcaagacatttcagttttaaaagtcactttcctattagacttcttgaaaaagattctcacatagcctctatgtaatcagacaaatgacatttgatttcaagagcagaggggtaaacatcctctgctaatcgacaggtagcaggtgtcagaggaggcataatattaatagcgccaccttctgttgggtcagtggagatgggtgaggagcagcacagagcagcagggatcatcacatgcagccaaacttggcctctgaagggggaaggtagtgggaataggtggtgagagaactcacatttttctcttgtcctggttttatatttcggagggaaaggattatttggccccattaagaattaagaggctgggtgcggtggctcacgtctgtaatcccagcaccttgggaggcccaggcaggcagatcacctgaggtcgggagttcgagaccagcgtgaccaacgtggagaaacccccgtctctactaaaaatacaaaaaattagctgggcatggtggtgcatgcctgtgattccagtttgcctccagctatgtgttttattggcgggattactttgaggaccagccccttctgtatcccccaggctttgacggaagagtcgtggtgtatcccagcaaccagactttaaaggactacctcagctggcgacaagcagattgtcacatcaataatctttataatacagttttctgggcacttatacaacaatctggactaacaccagtacaagcccaagggagattacagggaactcttgcagcagacaagaatgagattttgttttctgaattcaacatcaactataataatgagccgccgatgtataggaaagggactgtgttgatatggcagaaggtggatgaagtgatgacaaaagaaattaagctgccaacagaaatggaaggaaaaaagatggcagtgacccggaccaggacaaagccagtgcccttgcactgcgatatcatcggggatgctttctggaaggaacatccagagattctagatgaagacagctgacccttttgcgcttcagttctggtgtgcttaaccatgcaagccctcccacctcccagggctccttgccttaggtggctgtagcatccctaccacccaggacactggtgtgaatgacacaactcaagttgggaggggaacagggaaggaagggatggatgggggtggtgtatcttattctgtttaagcagaacaccttgtttgcggtgttggaacatggttcctttggcagaagtgctttttttttaatcgcagtactatttttataaagcaagaactattccatgccttggagaatgaatcaattttttaactgtgctatggagtagaagcaggaggttttcaacctagtcacagagcagcacctaccccctcctcctttccacacctgcaaactcttttacttgggctgaatatttagtgtaattacatctcagctttgagggctcctgtggcaaattcccggattaaaaggttccctggttgtgaaaatacatgagataaatcatgaaggccactatcatcctccttctgcttgcacaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtggtccagtgttctgatttgggtcttcctccttcccttacggaattacatcttgatggcaacaaaatcagcagagttgatgcagctagcctgaaaggactgaataatttggctaagttgggattgagtttcaacagcatctctgctgttgacaatggctctctggccaacacgcctcatctgagggagcttcacttggacaacaacaagcttaccagagtacctggtgggctggcagagcataagtacatccaggttgtctaccttcataacaacaatatctctgtagttggatcaagtgacttctgcccacctggacacaacaccaaaaaggcttcttattcgggtgtgagtcttttcagcaacccggtccagtactgggagatacagccatccaccttcagatgtgtctacgtgcgctctgccattcaactcggaaactataagtaattctcaagaaagccctcatttttataacctggcaaaatcttgttaatgtcattgctaaaaaataaataaaagctagatactggaaacctaactgcaatgtggatgttttacccacatgacttattatgcataaagccaaatttccagtttaagtaattgcctacaataaaaagaaattttgcctgccattttcagaatcatcttttgaagctttctgttgatgttaactgagctactagagatattcttatttcactaaatgtaaaatttggagtaaatatatatgtcaatatttagtaaagcttttcttttttaatttccaggaaaaaataaaaagagtatgagtcttctgtaattcattgagcagttagctcatttgagataaagtcaaatgccaaacactagctctgtattaatccccatcattactggtaaagcctcatttgaatgtgtgaattcaatacaggctatgtaaaatttttactaatgtcattattttgaaaaaataaatttaaaaatacattcaaaatactattgtatacaagcttaattgttaatattccctaaacacaattttatgaagggagaagacattggtttgttgacaataacagtacatcttttcaagttctcagctatttcttctacctctccctatcttacatttgagtatggtaacttatgtcatctatgttgaatgtaagcttataaagcacaaagcatacatttcctgactggtctagagaactgatgtttcaatttacccctctgctaaataaatattaaaactatcatgtgacttcatgt

SEQ ID NO: 448992 - DNA, 3234 bp, Homo sapiens
ttagattatgacataaatcttgtaaaaacctgtcagttattttcatctatgagagaagaggagcccaaactctcgcccacctgttcttaaccagaaaacccactgactttgaaaatctcacctctgccacccatctacttgcattcgtctttggcagacctcaagataaatatgggttaatgcctgcatgatgcctctgaattcaggaattgcagggaaaactcggggctttgtgccagtctctaagttggcaactttggctgaacaaatgagtagtggcttcagtgtccttgcgtacacattctgtggattgatttaatggagttgtcagcatgatcatcatcttctagccaggggcatagttgccaaggccatttacctctttctaagaagaaacagaattatgtgtatatatgagagaaagaaacaagaatgcgtgaatgaggatgaagaaacatttaccccatgtactcaagacatttcagttttaaaagtcactttcctattagacttcttgaaaaagattctcacatagcctctatgtaatcagacaaatgacatttgatttcaagagcagaggggtaaacatcctctgctaatcgacaggtagcaggtgtcagaggaggcataatattaatagcgccaccttctgttgggtcagtggagatgggtgaggagcagcacagagcagcagggatcatcacatgcagccaaacttggcctctgaagggggaaggtagtgggaataggtggtgagagaactcacatttttctcttgtcctggttttatatttcggagggaaaggattatttggccccattaagaattaagaggctgggtgcggtggctcacgtctgtaatcccagcaccttgggaggcccaggcaggcagatcacctgaggtcgggagttcgagaccagcgtgaccaacgtggagaaacccccgtctctactaaaaatacaaaaaattagctgggcatggtggtgcatgcctgtgattccagtttgcctccagctatgtgttttattggcgggattactttgaggaccagccccttctgtatcccccaggctttgacggaagagtcgtggtgtatcccagcaaccagactttaaaggactacctcagctggcgacaagcagattgtcacatcaataatctttataatacagttttctgggcacttatacaacaatctggactaacaccagtacaagcccaagggagattacagggaactcttgcagcagacaagaatgagattttgttttctgaattcaacatcaactataataatgagccgccgatgtataggaaagggactgtgttgatatggcagaaggtggatgaagtgatgacaaaagaaattaagctgccaacagaaatggaaggaaaaaagatggcagtgacccggaccaggacaaagccagtgcccttgcactgcgatatcatcggggatgctttctggaaggaacatccagagattctagatgaagacagctgacccttttgcgcttcagttctggtgtgcttaaccatgcaagccctcccacctcccagggctccttgccttaggtggctgtagcatccctaccacccaggacactggtgtgaatgacacaactcaagttgggaggggaacagggaaggaagggatggatgggggtggtgtatcttattctgtttaagcagaacaccttgtttgcggtgttggaacatggttcctttggcagaagtgctttttttttaatcgcagtactatttttataaagcaagaactattccatgccttggagaatgaatcaattttttaactgtgctatggagtagaagcaggaggttttcaacctagtcacagagcagcacctaccccctcctcctttccacacctgcaaactcttttacttgggctgaatatttagtgtaattacatctcagctttgagggctcctgtggcaaattcccggattaaaaggttccctggttgtgaaaatacatgagataaatcatgaaggccactatcatcctccttctgcttgcacaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtggtccagtgttctgatttgggtctggacaaagtgccaaaggatcttccccctgacacaactctgctagacctgcaaaacaacaaaataaccgaaatcaaagatggagactttaagaacctgaagaaccttcacgcattgattcttgtcaacaataaaattagcaaagttagtcctggagcatttacacctttggtgaagttggaacgactttatctgtccaagaatcagctgaaggaattgccagaaaaaatgcccaaaactcttcaggagctgcgtgcccatgagaatgagatcaccaaagtgcgaaaagttactttcaatggactgaaccagatgattgtcatagaactgggcaccaatccgctgaagagctcaggaattgaaaatggggctttccagggaatgaagaagctctcctacatccgcattgctgataccaatatcaccagcattcctcaaggtcttcctccttcccttacggaattacatcttgatggcaacaaaatcagcagagttgatgcagctagcctgaaaggactgaataatttggctaagttgggattgagtttcaacagcatctctgctgttgacaatggctctctggccaacacgcctcatctgagggagcttcacttggacaacaacaagcttaccagagtacctggtgggctggcagagcataagtacatccaggttgtctaccttcataacaacaatatctctgtagttggatcaagtgacttctgcccacctggacacaacaccaaaaaggcttcttattcgggtgtgagtcttttcagcaacccggtccagtactgggagatacagccatccaccttcagatgtgtctacgtgcgctctgccattcaactcggaaactataagtaattctcaagaaagccctcatttttatccacttcatgtggcaaatcccttttattttagcaacagcctgaggttttctttcacagtgagaaatccaatttgcacattggattgtggacaaatccgtgactgctgatattttctatat

SEQ ID NO: 448993 - DNA, 3288 bp, Homo sapiens
ttagattatgacataaatcttgtaaaaacctgtcagttattttcatctatgagagaagaggagcccaaactctcgcccacctgttcttaaccagaaaacccactgactttgaaaatctcacctctgccacccatctacttgcattcgtctttggcagacctcaagataaatatgggttaatgcctgcatgatgcctctgaattcaggaattgcagggaaaactcggggctttgtgccagtctctaagttggcaactttggctgaacaaatgagtagtggcttcagtgtccttgcgtacacattctgtggattgatttaatggagttgtcagcatgatcatcatcttctagccaggggcatagttgccaaggccatttacctctttctaagaagaaacagaattatgtgtatatatgagagaaagaaacaagaatgcgtgaatgaggatgaagaaacatttaccccatgtactcaagacatttcagttttaaaagtcactttcctattagacttcttgaaaaagattctcacatagcctctatgtaatcagacaaatgacatttgatttcaagagcagaggggtaaacatcctctgctaatcgacaggtagcaggtgtcagaggaggcataatattaatagcgccaccttctgttgggtcagtggagatgggtgaggagcagcacagagcagcagggatcatcacatgcagccaaacttggcctctgaagggggaaggtagtgggaataggtggtgagagaactcacatttttctcttgtcctggttttatatttcggagggaaaggattatttggccccattaagaattaagaggctgggtgcggtggctcacgtctgtaatcccagcaccttgggaggcccaggcaggcagatcacctgaggtcgggagttcgagaccagcgtgaccaacgtggagaaacccccgtctctactaaaaatacaaaaaattagctgggcatggtggtgcatgcctgtgattccagtttgcctccagctatgtgttttattggcgggattactttgaggaccagccccttctgtatcccccaggctttgacggaagagtcgtggtgtatcccagcaaccagactttaaaggactacctcagctggcgacaagcagattgtcacatcaataatctttataatacagttttctgggcacttatacaacaatctggactaacaccagtacaagcccaagggagattacagggaactcttgcagcagacaagaatgagattttgttttctgaattcaacatcaactataataatgagccgccgatgtataggaaagggactgtgttgatatggcagaaggtggatgaagtgatgacaaaagaaattaagctgccaacagaaatggaaggaaaaaagatggcagtgacccggaccaggacaaagccagtgcccttgcactgcgatatcatcggggatgctttctggaaggaacatccagagattctagatgaagacagctgacccttttgcgcttcagttctggtgtgcttaaccatgcaagccctcccacctcccagggctccttgccttaggtggctgtagcatccctaccacccaggacactggtgtgaatgacacaactcaagttgggaggggaacagggaaggaagggatggatgggggtggtgtatcttattctgtttaagcagaacaccttgtttgcggtgttggaacatggttcctttggcagaagtgctttttttttaatcgcagtactatttttataaagcaagaactattccatgccttggagaatgaatcaattttttaactgtgctatggagtagaagcaggaggttttcaacctagtcacagagcagcacctaccccctcctcctttccacacctgcaaactcttttacttgggctgaatatttagtgtaattacatctcagctttgagggctcctgtggcaaattcccggattaaaaggttccctggttgtgaaaatacatgagataaatcatgaaggccactatcatcctccttctgcttgcacaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtggtccagtgttctgatttgggtctggacaaagtgccaaaggatcttccccctgacacaactctgctagacctgcaaaacaacaaaataaccgaaatcaaagatggagactttaagaacctgaagaaccttcacgcattgattcttgtcaacaataaaattagcaaagttagtcctggagcatttacacctttggtgaagttggaacgactttatctgtccaagaatcagctgaaggaattgccagaaaaaatgcccaaaactcttcaggagctgcgtgcccatgagaatgagatcaccaaagtgcgaaaagttactttcaatggactgaaccagatgattgtcatagaactgggcaccaatccgctgaagagctcaggaattgaaaatggggctttccagggaatgaagaagctctcctacatccgcattgctgataccaatatcaccagcattcctcaaggtcttcctccttcccttacggaattacatcttgatggcaacaaaatcagcagagttgatgcagctagcctgaaaggactgaataatttggctaagttgggattgagtttcaacagcatctctgctgttgacaatggctctctggccaacacgcctcatctgagggagcttcacttggacaacaacaagcttaccagagtacctggtgggctggcagagcataagtacatccaggttgtctaccttcataacaacaatatctctgtagttggatcaagtgacttctgcccacctggacacaacaccaaaaaggcttcttattcgggtgtgagtcttttcagcaacccggtccagtactgggagatacagccatccaccttcagatgtgtctacgtgcgctctgccattcaactcggaaactataaaaaaaataaaaagagtatgagtcttctgtaattcattgagcagttagctcatttgagataaagtcaaatgccaaacactagctctgtattaatccccatcattactggtaaagcctcatttgaatgtgtgaattcaatacaggctatgtaaaatttttactaatgtcattattttgaaaaaataaatttaaaaatacattcaa

SEQ ID NO: 448994 - DNA, 1198 bp, Homo sapiens
taacctggggaccttataatatacagctagcctgaaaggactgaataatttggctaagttgggattgagtttcaacagcatctctgctgttgacaatggctctctggccaacacgcctcatctgagggagcttcacttggacaacaacaagcttaccagagtacctggtgggctggcagagcataagtacatccaggttgtctaccttcataacaacaatatctctgtagttggatcaagtgacttctgcccacctggacacaacaccaaaaaggcttcttattcgggtgtgagtcttttcagcaacccggtccagtactgggagatacagccatccaccttcagatgtgtctacgtgcgctctgccattcaactcggaaactataagtaattctcaagaaagccctcatttttataacctggcaaaatcttgttaatgtcattgctaaaaaataaataaaagctagatactggaaacctaactgcaatgtggatgttttacccacatgacttattatgcataaagccaaatttccagtttaagtaattgcctacaataaaaagaaattttgcctgccattttcagaatcatcttttgaagctttctgttgatgttaactgagctactagagatattcttatttcactaaatgtaaaatttggagtaaatatatatgtcaatatttagtaaagcttttcttttttaatttccaggaaaaaataaaaagagtatgagtcttctgtaattcattgagcagttagctcatttgagataaagtcaaatgccaaacactagctctgtattaatccccatcattactggtaaagcctcatttgaatgtgtgaattcaatacaggctatgtaaaatttttactaatgtcattattttgaaaaaataaatttaaaaatacattcaaaatactattgtatacaagcttaattgttaatattccctaaacacaattttatgaagggagaagacattggtttgttgacaataacagtacatcttttcaagttctcagctatttcttctacctctccctatcttacatttgagtatggtaacttatgtcatctatgttgaatgtaagcttataaagcacaaagcatacatttcctgactggtctagagaactgatgtttcaatttacccctctgctaaataaatattaaaactatcatgtgacttcatgt

SEQ ID NO: 448995 - DNA, 3214 bp, Homo sapiens
ttagattatgacataaatcttgtaaaaacctgtcagttattttcatctatgagagaagaggagcccaaactctcgcccacctgttcttaaccagaaaacccactgactttgaaaatctcacctctgccacccatctacttgcattcgtctttggcagacctcaagataaatatgggttaatgcctgcatgatgcctctgaattcaggaattgcagggaaaactcggggctttgtgccagtctctaagttggcaactttggctgaacaaatgagtagtggcttcagtgtccttgcgtacacattctgtggattgatttaatggagttgtcagcatgatcatcatcttctagccaggggcatagttgccaaggccatttacctctttctaagaagaaacagaattatgtgtatatatgagagaaagaaacaagaatgcgtgaatgaggatgaagaaacatttaccccatgtactcaagacatttcagttttaaaagtcactttcctattagacttcttgaaaaagattctcacatagcctctatgtaatcagacaaatgacatttgatttcaagagcagaggggtaaacatcctctgctaatcgacaggtagcaggtgtcagaggaggcataatattaatagcgccaccttctgttgggtcagtggagatgggtgaggagcagcacagagcagcagggatcatcacatgcagccaaacttggcctctgaagggggaaggtagtgggaataggtggtgagagaactcacatttttctcttgtcctggttttatatttcggagggaaaggattatttggccccattaagaattaagaggctgggtgcggtggctcacgtctgtaatcccagcaccttgggaggcccaggcaggcagatcacctgaggtcgggagttcgagaccagcgtgaccaacgtggagaaacccccgtctctactaaaaatacaaaaaattagctgggcatggtggtgcatgcctgtgattccagtttgcctccagctatgtgttttattggcgggattactttgaggaccagccccttctgtatcccccaggctttgacggaagagtcgtggtgtatcccagcaaccagactttaaaggactacctcagctggcgacaagcagattgtcacatcaataatctttataatacagttttctgggcacttatacaacaatctggactaacaccagtacaagcccaagggagattacagggaactcttgcagcagacaagaatgagattttgttttctgaattcaacatcaactataataatgagccgccgatgtataggaaagggactgtgttgatatggcagaaggtggatgaagtgatgacaaaagaaattaagctgccaacagaaatggaaggaaaaaagatggcagtgacccggaccaggacaaagccagtgcccttgcactgcgatatcatcggggatgctttctggaaggaacatccagagattctagatgaagacagctgacccttttgcgcttcagttctggtgtgcttaaccatgcaagccctcccacctcccagggctccttgccttaggtggctgtagcatccctaccacccaggacactggtgtgaatgacacaactcaagttgggaggggaacagggaaggaagggatggatgggggtggtgtatcttattctgtttaagcagaacaccttgtttgcggtgttggaacatggttcctttggcagaagtgctttttttttaatcgcagtactatttttataaagcaagaactattccatgccttggagaatgaatcaattttttaactgtgctatggagtagaagcaggaggttttcaacctagtcacagagcagcacctaccccctcctcctttccacacctgcaaactcttttacttgggctgaatatttagtgtaattacatctcagctttgagggctcctgtggcaaattcccggattaaaaggttccctggttgtgaaaatacatgagataaatcatgaaggccactatcatcctccttctgcttgcacaagtttcctgggctggaccgtttcaacagagttgggattgagtttcaacagcatctctgctgttgacaatggctctctggccaacacgcctcatctgagggagcttcacttggacaacaacaagcttaccagagtacctggtgggctggcagagcataagtacatccaggttgtctaccttcataacaacaatatctctgtagttggatcaagtgacttctgcccacctggacacaacaccaaaaaggcttcttattcgggtgtgagtcttttcagcaacccggtccagtactgggagatacagccatccaccttcagatgtgtctacgtgcgctctgccattcaactcggaaactataagtaattctcaagaaagccctcatttttataacctggcaaaatcttgttaatgtcattgctaaaaaataaataaaagctagatactggaaacctaactgcaatgtggatgttttacccacatgacttattatgcataaagccaaatttccagtttaagtaattgcctacaataaaaagaaattttgcctgccattttcagaatcatcttttgaagctttctgttgatgttaactgagctactagagatattcttatttcactaaatgtaaaatttggagtaaatatatatgtcaatatttagtaaagcttttcttttttaatttccaggaaaaaataaaaagagtatgagtcttctgtaattcattgagcagttagctcatttgagataaagtcaaatgccaaacactagctctgtattaatccccatcattactggtaaagcctcatttgaatgtgtgaattcaatacaggctatgtaaaatttttactaatgtcattattttgaaaaaataaatttaaaaatacattcaaaatactattgtatacaagcttaattgttaatattccctaaacacaattttatgaagggagaagacattggtttgttgacaataacagtacatcttttcaagttctcagctatttcttctacctctccctatcttacatttgagtatggtaacttatgtcatctatgttgaatgtaagcttataaagcacaaagcatacatttcctgactggtctagagaactgatgtttcaatttacccctctgctaaataaatattaaaactatcatgtgacttcatgt

SEQ ID NO: 448996 - DNA, 1179 bp, Homo sapiens
actgaggtaataagccctgaggttgtttattagcaacagttgggattgagtttcaacagcatctctgctgttgacaatggctctctggccaacacgcctcatctgagggagcttcacttggacaacaacaagcttaccagagtacctggtgggctggcagagcataagtacatccaggttgtctaccttcataacaacaatatctctgtagttggatcaagtgacttctgcccacctggacacaacaccaaaaaggcttcttattcgggtgtgagtcttttcagcaacccggtccagtactgggagatacagccatccaccttcagatgtgtctacgtgcgctctgccattcaactcggaaactataagtaattctcaagaaagccctcatttttataacctggcaaaatcttgttaatgtcattgctaaaaaataaataaaagctagatactggaaacctaactgcaatgtggatgttttacccacatgacttattatgcataaagccaaatttccagtttaagtaattgcctacaataaaaagaaattttgcctgccattttcagaatcatcttttgaagctttctgttgatgttaactgagctactagagatattcttatttcactaaatgtaaaatttggagtaaatatatatgtcaatatttagtaaagcttttcttttttaatttccaggaaaaaataaaaagagtatgagtcttctgtaattcattgagcagttagctcatttgagataaagtcaaatgccaaacactagctctgtattaatccccatcattactggtaaagcctcatttgaatgtgtgaattcaatacaggctatgtaaaatttttactaatgtcattattttgaaaaaataaatttaaaaatacattcaaaatactattgtatacaagcttaattgttaatattccctaaacacaattttatgaagggagaagacattggtttgttgacaataacagtacatcttttcaagttctcagctatttcttctacctctccctatcttacatttgagtatggtaacttatgtcatctatgttgaatgtaagcttataaagcacaaagcatacatttcctgactggtctagagaactgatgtttcaatttacccctctgctaaataaatattaaaactatcatgtgacttcatgt

SEQ ID NO: 448997 - DNA, 3335 bp, Homo sapiens
ttagattatgacataaatcttgtaaaaacctgtcagttattttcatctatgagagaagaggagcccaaactctcgcccacctgttcttaaccagaaaacccactgactttgaaaatctcacctctgccacccatctacttgcattcgtctttggcagacctcaagataaatatgggttaatgcctgcatgatgcctctgaattcaggaattgcagggaaaactcggggctttgtgccagtctctaagttggcaactttggctgaacaaatgagtagtggcttcagtgtccttgcgtacacattctgtggattgatttaatggagttgtcagcatgatcatcatcttctagccaggggcatagttgccaaggccatttacctctttctaagaagaaacagaattatgtgtatatatgagagaaagaaacaagaatgcgtgaatgaggatgaagaaacatttaccccatgtactcaagacatttcagttttaaaagtcactttcctattagacttcttgaaaaagattctcacatagcctctatgtaatcagacaaatgacatttgatttcaagagcagaggggtaaacatcctctgctaatcgacaggtagcaggtgtcagaggaggcataatattaatagcgccaccttctgttgggtcagtggagatgggtgaggagcagcacagagcagcagggatcatcacatgcagccaaacttggcctctgaagggggaaggtagtgggaataggtggtgagagaactcacatttttctcttgtcctggttttatatttcggagggaaaggattatttggccccattaagaattaagaggctgggtgcggtggctcacgtctgtaatcccagcaccttgggaggcccaggcaggcagatcacctgaggtcgggagttcgagaccagcgtgaccaacgtggagaaacccccgtctctactaaaaatacaaaaaattagctgggcatggtggtgcatgcctgtgattccagtttgcctccagctatgtgttttattggcgggattactttgaggaccagccccttctgtatcccccaggctttgacggaagagtcgtggtgtatcccagcaaccagactttaaaggactacctcagctggcgacaagcagattgtcacatcaataatctttataatacagttttctgggcacttatacaacaatctggactaacaccagtacaagcccaagggagattacagggaactcttgcagcagacaagaatgagattttgttttctgaattcaacatcaactataataatgagccgccgatgtataggaaagggactgtgttgatatggcagaaggtggatgaagtgatgacaaaagaaattaagctgccaacagaaatggaaggaaaaaagatggcagtgacccggaccaggacaaagccagtgcccttgcactgcgatatcatcggggatgctttctggaaggaacatccagagattctagatgaagacagctgacccttttgcgcttcagttctggtgtgcttaaccatgcaagccctcccacctcccagggctccttgccttaggtggctgtagcatccctaccacccaggacactggtgtgaatgacacaactcaagttgggaggggaacagggaaggaagggatggatgggggtggtgtatcttattctgtttaagcagaacaccttgtttgcggtgttggaacatggttcctttggcagaagtgctttttttttaatcgcagtactatttttataaagcaagaactattccatgccttggagaatgaatcaattttttaactgtgctatggagtagaagcaggaggttttcaacctagtcacagagcagcacctaccccctcctcctttccacacctgcaaactcttttacttgggctgaatatttagtgtaattacatctcagctttgagggctcctgtggcaaattcccggattaaaaggttccctggttgtgaaaatacatgagataaatcatgaaggccactatcatcctccttctgcttgcacaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtggtccagtgttctgatttgggtctggacaaagtgccaaaggatcttccccctgacacaactctgctagacctgcaaaacaacaaaataaccgaaatcaaagatggagactttaagaacctgaagaaccttcacgttgtctaccttcataacaacaatatctctgtagttggatcaagtgacttctgcccacctggacacaacaccaaaaaggcttcttattcgggtgtgagtcttttcagcaacccggtccagtactgggagatacagccatccaccttcagatgtgtctacgtgcgctctgccattcaactcggaaactataagtaattctcaagaaagccctcatttttataacctggcaaaatcttgttaatgtcattgctaaaaaataaataaaagctagatactggaaacctaactgcaatgtggatgttttacccacatgacttattatgcataaagccaaatttccagtttaagtaattgcctacaataaaaagaaattttgcctgccattttcagaatcatcttttgaagctttctgttgatgttaactgagctactagagatattcttatttcactaaatgtaaaatttggagtaaatatatatgtcaatatttagtaaagcttttcttttttaatttccaggaaaaaataaaaagagtatgagtcttctgtaattcattgagcagttagctcatttgagataaagtcaaatgccaaacactagctctgtattaatccccatcattactggtaaagcctcatttgaatgtgtgaattcaatacaggctatgtaaaatttttactaatgtcattattttgaaaaaataaatttaaaaatacattcaaaatactattgtatacaagcttaattgttaatattccctaaacacaattttatgaagggagaagacattggtttgttgacaataacagtacatcttttcaagttctcagctatttcttctacctctccctatcttacatttgagtatggtaacttatgtcatctatgttgaatgtaagcttataaagcacaaagcatacatttcctgactggtctagagaactgatgtttcaatttacccctctgctaaataaatattaaaactatcatgtgacttcatgt

SEQ ID NO: 448998 - DNA, 3484 bp, Homo sapiens
ttagattatgacataaatcttgtaaaaacctgtcagttattttcatctatgagagaagaggagcccaaactctcgcccacctgttcttaaccagaaaacccactgactttgaaaatctcacctctgccacccatctacttgcattcgtctttggcagacctcaagataaatatgggttaatgcctgcatgatgcctctgaattcaggaattgcagggaaaactcggggctttgtgccagtctctaagttggcaactttggctgaacaaatgagtagtggcttcagtgtccttgcgtacacattctgtggattgatttaatggagttgtcagcatgatcatcatcttctagccaggggcatagttgccaaggccatttacctctttctaagaagaaacagaattatgtgtatatatgagagaaagaaacaagaatgcgtgaatgaggatgaagaaacatttaccccatgtactcaagacatttcagttttaaaagtcactttcctattagacttcttgaaaaagattctcacatagcctctatgtaatcagacaaatgacatttgatttcaagagcagaggggtaaacatcctctgctaatcgacaggtagcaggtgtcagaggaggcataatattaatagcgccaccttctgttgggtcagtggagatgggtgaggagcagcacagagcagcagggatcatcacatgcagccaaacttggcctctgaagggggaaggtagtgggaataggtggtgagagaactcacatttttctcttgtcctggttttatatttcggagggaaaggattatttggccccattaagaattaagaggctgggtgcggtggctcacgtctgtaatcccagcaccttgggaggcccaggcaggcagatcacctgaggtcgggagttcgagaccagcgtgaccaacgtggagaaacccccgtctctactaaaaatacaaaaaattagctgggcatggtggtgcatgcctgtgattccagtttgcctccagctatgtgttttattggcgggattactttgaggaccagccccttctgtatcccccaggctttgacggaagagtcgtggtgtatcccagcaaccagactttaaaggactacctcagctggcgacaagcagattgtcacatcaataatctttataatacagttttctgggcacttatacaacaatctggactaacaccagtacaagcccaagggagattacagggaactcttgcagcagacaagaatgagattttgttttctgaattcaacatcaactataataatgagccgccgatgtataggaaagggactgtgttgatatggcagaaggtggatgaagtgatgacaaaagaaattaagctgccaacagaaatggaaggaaaaaagatggcagtgacccggaccaggacaaagccagtgcccttgcactgcgatatcatcggggatgctttctggaaggaacatccagagattctagatgaagacagctgacccttttgcgcttcagttctggtgtgcttaaccatgcaagccctcccacctcccagggctccttgccttaggtggctgtagcatccctaccacccaggacactggtgtgaatgacacaactcaagttgggaggggaacagggaaggaagggatggatgggggtggtgtatcttattctgtttaagcagaacaccttgtttgcggtgttggaacatggttcctttggcagaagtgctttttttttaatcgcagtactatttttataaagcaagaactattccatgccttggagaatgaatcaattttttaactgtgctatggagtagaagcaggaggttttcaacctagtcacagagcagcacctaccccctcctcctttccacacctgcaaactcttttacttgggctgaatatttagtgtaattacatctcagctttgagggctcctgtggcaaattcccggattaaaaggttccctggttgtgaaaatacatgagataaatcatgaaggccactatcatcctccttctgcttgcacaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtggtccagtgttctgatttgggtctggacaaagtgccaaaggatcttccccctgacacaactctgctagacctgcaaaacaacaaaataaccgaaatcaaagatggagactttaagaacctgaagaaccttcacgcattgattcttgtcaacaataaaattagcaaagttagtcctggagcatttacacctttggtgaagttggaacgactttatctgtccaagaatcagctgaaggaattgccagaaaaaatgcccaaaactcttcaggagctgcgtgcccatgagaatgagatcaccaaagtgcgaaaagttactttcaatggactgaaccagatgattgtcatagaactgggcaccaatccgctgaagagctcaggaattgaaaatggggctttccagggaatgaagaagctctcctacatccgcattgctgataccaatatcaccagcattcctcaaggtcttcctccttcccttacggaattacatcttgatggcaacaacctggcaaaatcttgttaatgtcattgctaaaaaataaataaaagctagatactggaaacctaactgcaatgtggatgttttacccacatgacttattatgcataaagccaaatttccagtttaagtaattgcctacaataaaaagaaattttgcctgccattttcagaatcatcttttgaagctttctgttgatgttaactgagctactagagatattcttatttcactaaatgtaaaatttggagtaaatatatatgtcaatatttagtaaagcttttcttttttaatttccaggaaaaaataaaaagagtatgagtcttctgtaattcattgagcagttagctcatttgagataaagtcaaatgccaaacactagctctgtattaatccccatcattactggtaaagcctcatttgaatgtgtgaattcaatacaggctatgtaaaatttttactaatgtcattattttgaaaaaataaatttaaaaatacattcaaaatactattgtatacaagcttaattgttaatattccctaaacacaattttatgaagggagaagacattggtttgttgacaataacagtacatcttttcaagttctcagctatttcttctacctctccctatcttacatttgagtatggtaacttatgtcatctatgttgaatgtaagcttataaagcacaaagcatacatttcctgactggtctagagaactgatgtttcaatttacccctctgctaaataaatattaaaactatcatgtgacttcatgt

SEQ ID NO: 448999 - DNA, 3027 bp, Homo sapiens
ttagattatgacataaatcttgtaaaaacctgtcagttattttcatctatgagagaagaggagcccaaactctcgcccacctgttcttaaccagaaaacccactgactttgaaaatctcacctctgccacccatctacttgcattcgtctttggcagacctcaagataaatatgggttaatgcctgcatgatgcctctgaattcaggaattgcagggaaaactcggggctttgtgccagtctctaagttggcaactttggctgaacaaatgagtagtggcttcagtgtccttgcgtacacattctgtggattgatttaatggagttgtcagcatgatcatcatcttctagccaggggcatagttgccaaggccatttacctctttctaagaagaaacagaattatgtgtatatatgagagaaagaaacaagaatgcgtgaatgaggatgaagaaacatttaccccatgtactcaagacatttcagttttaaaagtcactttcctattagacttcttgaaaaagattctcacatagcctctatgtaatcagacaaatgacatttgatttcaagagcagaggggtaaacatcctctgctaatcgacaggtagcaggtgtcagaggaggcataatattaatagcgccaccttctgttgggtcagtggagatgggtgaggagcagcacagagcagcagggatcatcacatgcagccaaacttggcctctgaagggggaaggtagtgggaataggtggtgagagaactcacatttttctcttgtcctggttttatatttcggagggaaaggattatttggccccattaagaattaagaggctgggtgcggtggctcacgtctgtaatcccagcaccttgggaggcccaggcaggcagatcacctgaggtcgggagttcgagaccagcgtgaccaacgtggagaaacccccgtctctactaaaaatacaaaaaattagctgggcatggtggtgcatgcctgtgattccagtttgcctccagctatgtgttttattggcgggattactttgaggaccagccccttctgtatcccccaggctttgacggaagagtcgtggtgtatcccagcaaccagactttaaaggactacctcagctggcgacaagcagattgtcacatcaataatctttataatacagttttctgggcacttatacaacaatctggactaacaccagtacaagcccaagggagattacagggaactcttgcagcagacaagaatgagattttgttttctgaattcaacatcaactataataatgagccgccgatgtataggaaagggactgtgttgatatggcagaaggtggatgaagtgatgacaaaagaaattaagctgccaacagaaatggaaggaaaaaagatggcagtgacccggaccaggacaaagccagtgcccttgcactgcgatatcatcggggatgctttctggaaggaacatccagagattctagatgaagacagctgacccttttgcgcttcagttctggtgtgcttaaccatgcaagccctcccacctcccagggctccttgccttaggtggctgtagcatccctaccacccaggacactggtgtgaatgacacaactcaagttgggaggggaacagggaaggaagggatggatgggggtggtgtatcttattctgtttaagcagaacaccttgtttgcggtgttggaacatggttcctttggcagaagtgctttttttttaatcgcagtactatttttataaagcaagaactattccatgccttggagaatgaatcaattttttaactgtgctatggagtagaagcaggaggttttcaacctagtcacagagcagcacctaccccctcctcctttccacacctgcaaactcttttacttgggctgaatatttagtgtaattacatctcagctttgagggctcctgtggcaaattcccggattaaaaggttccctggttgtgaaaatacatgagataaatcatgaaggccactatcatcctccttctgcttgcacaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtggtccagtgttctgatttgggtctggacaaagtgccaaaggatcttccccctgacacaactctgctagacctgcaaaacaacaaaataaccgaaatcaaagatggagactttaagaacctgaagaaccttcacgcattgattcttgtcaacaataaaattagcaaagttagtcctggagcatttacacctttggtgaagttggaacgactttatctgtccaagaatcagctgaaggaattgccagaaaaaatgcccaaaactcttcaggagctgcgtgcccatgagaatgagatcaccaaagtgcgaaaagttactttcaatggactgaaccagatgattgtcatagaactgggcaccaatccgctgaagagctcaggaattgaaaatggggctttccagggaatgaagaagctctcctacatccgcattgctgataccaatatcaccagcattcctcaaggtcttcctccttcccttacggaattacatcttgatggcaacaaaatcagcagagttgatgcagctagcctgaaaggactgaataatttggctaagttgggattgagtttcaacagcatctctgctgttgacaatggctctctggccaacacgcctcatctgagggagcttcacttggacaacaacaagcttaccagagtacctggtgggctggcagagcataagtacatccagggtgctacttctcaacaattcgtggtggcaggaactgccccggaacccggtgttttcgggttggtttcccccgaggggaacccccaaagttcgggaccaatatataaccccacgctagcggaccggcatagtc

SEQ ID NO: 449000 - DNA, 1152 bp, Homo sapiens
tattttattacactgacaacactctttttctttctgtttgtactatgagactctctggtccatctatcgcctcatctgagggagcttcacttggacaacaacaagcttaccagagtacctggtgggctggcagagcataagtacatccaggttgtctaccttcataacaacaatatctctgtagttggatcaagtgacttctgcccacctggacacaacaccaaaaaggcttcttattcgggtgtgagtcttttcagcaacccggtccagtactgggagatacagccatccaccttcagatgtgtctacgtgcgctctgccattcaactcggaaactataagtaattctcaagaaagccctcatttttataacctggcaaaatcttgttaatgtcattgctaaaaaataaataaaagctagatactggaaacctaactgcaatgtggatgttttacccacatgacttattatgcataaagccaaatttccagtttaagtaattgcctacaataaaaagaaattttgcctgccattttcagaatcatcttttgaagctttctgttgatgttaactgagctactagagatattcttatttcactaaatgtaaaatttggagtaaatatatatgtcaatatttagtaaagcttttcttttttaatttccaggaaaaaataaaaagagtatgagtcttctgtaattcattgagcagttagctcatttgagataaagtcaaatgccaaacactagctctgtattaatccccatcattactggtaaagcctcatttgaatgtgtgaattcaatacaggctatgtaaaatttttactaatgtcattattttgaaaaaataaatttaaaaatacattcaaaatactattgtatacaagcttaattgttaatattccctaaacacaattttatgaagggagaagacattggtttgttgacaataacagtacatcttttcaagttctcagctatttcttctacctctccctatcttacatttgagtatggtaacttatgtcatctatgttgaatgtaagcttataaagcacaaagcatacatttcctgactggtctagagaactgatgtttcaatttacccctctgctaaataaatattaaaactatcatgtgacttcatgt

SEQ ID NO: 449001 - DNA, 1088 bp, Homo sapiens
cctagttttagaagtttcaatagcacttggacaacaacaagcttaccagagtacctggtgggctggcagagcataagtacatccaggttgtctaccttcataacaacaatatctctgtagttggatcaagtgacttctgcccacctggacacaacaccaaaaaggcttcttattcgggtgtgagtcttttcagcaacccggtccagtactgggagatacagccatccaccttcagatgtgtctacgtgcgctctgccattcaactcggaaactataagtaattctcaagaaagccctcatttttataacctggcaaaatcttgttaatgtcattgctaaaaaataaataaaagctagatactggaaacctaactgcaatgtggatgttttacccacatgacttattatgcataaagccaaatttccagtttaagtaattgcctacaataaaaagaaattttgcctgccattttcagaatcatcttttgaagctttctgttgatgttaactgagctactagagatattcttatttcactaaatgtaaaatttggagtaaatatatatgtcaatatttagtaaagcttttcttttttaatttccaggaaaaaataaaaagagtatgagtcttctgtaattcattgagcagttagctcatttgagataaagtcaaatgccaaacactagctctgtattaatccccatcattactggtaaagcctcatttgaatgtgtgaattcaatacaggctatgtaaaatttttactaatgtcattattttgaaaaaataaatttaaaaatacattcaaaatactattgtatacaagcttaattgttaatattccctaaacacaattttatgaagggagaagacattggtttgttgacaataacagtacatcttttcaagttctcagctatttcttctacctctccctatcttacatttgagtatggtaacttatgtcatctatgttgaatgtaagcttataaagcacaaagcatacatttcctgactggtctagagaactgatgtttcaatttacccctctgctaaataaatattaaaactatcatgtgacttcatgt

SEQ ID NO: 449002 - DNA, 1056 bp, Homo sapiens
tagtagtaatatatacgcacttatgttatgtagagcagcccaggagagagctaggttgtctaccttcataacaacaatatctctgtagttggatcaagtgacttctgcccacctggacacaacaccaaaaaggcttcttattcgggtgtgagtcttttcagcaacccggtccagtactgggagatacagccatccaccttcagatgtgtctacgtgcgctctgccattcaactcggaaactataagtaattctcaagaaagccctcatttttataacctggcaaaatcttgttaatgtcattgctaaaaaataaataaaagctagatactggaaacctaactgcaatgtggatgttttacccacatgacttattatgcataaagccaaatttccagtttaagtaattgcctacaataaaaagaaattttgcctgccattttcagaatcatcttttgaagctttctgttgatgttaactgagctactagagatattcttatttcactaaatgtaaaatttggagtaaatatatatgtcaatatttagtaaagcttttcttttttaatttccaggaaaaaataaaaagagtatgagtcttctgtaattcattgagcagttagctcatttgagataaagtcaaatgccaaacactagctctgtattaatccccatcattactggtaaagcctcatttgaatgtgtgaattcaatacaggctatgtaaaatttttactaatgtcattattttgaaaaaataaatttaaaaatacattcaaaatactattgtatacaagcttaattgttaatattccctaaacacaattttatgaagggagaagacattggtttgttgacaataacagtacatcttttcaagttctcagctatttcttctacctctccctatcttacatttgagtatggtaacttatgtcatctatgttgaatgtaagcttataaagcacaaagcatacatttcctgactggtctagagaactgatgtttcaatttacccctctgctaaataaatattaaaactatcatgtgacttcatgt

SEQ ID NO: 449003 - DNA, 1058 bp, Homo sapiens
  misc_feature (40)..(40): n is a, c, g, or t
aggatataaagaaactgggcgcaccaccgataaaatatanaaaaagggagcggagggttgtctaccttcataacaacaatatctctgtagttggatcaagtgacttctgcccacctggacacaacaccaaaaaggcttcttattcgggtgtgagtcttttcagcaacccggtccagtactgggagatacagccatccaccttcagatgtgtctacgtgcgctctgccattcaactcggaaactataagtaattctcaagaaagccctcatttttataacctggcaaaatcttgttaatgtcattgctaaaaaataaataaaagctagatactggaaacctaactgcaatgtggatgttttacccacatgacttattatgcataaagccaaatttccagtttaagtaattgcctacaataaaaagaaattttgcctgccattttcagaatcatcttttgaagctttctgttgatgttaactgagctactagagatattcttatttcactaaatgtaaaatttggagtaaatatatatgtcaatatttagtaaagcttttcttttttaatttccaggaaaaaataaaaagagtatgagtcttctgtaattcattgagcagttagctcatttgagataaagtcaaatgccaaacactagctctgtattaatccccatcattactggtaaagcctcatttgaatgtgtgaattcaatacaggctatgtaaaatttttactaatgtcattattttgaaaaaataaatttaaaaatacattcaaaatactattgtatacaagcttaattgttaatattccctaaacacaattttatgaagggagaagacattggtttgttgacaataacagtacatcttttcaagttctcagctatttcttctacctctccctatcttacatttgagtatggtaacttatgtcatctatgttgaatgtaagcttataaagcacaaagcatacatttcctgactggtctagagaactgatgtttcaatttacccctctgctaaataaatattaaaactatcatgtgacttcatgt

SEQ ID NO: 449004 - DNA, 2721 bp, Homo sapiens
ttagattatgacataaatcttgtaaaaacctgtcagttattttcatctatgagagaagaggagcccaaactctcgcccacctgttcttaaccagaaaacccactgactttgaaaatctcacctctgccacccatctacttgcattcgtctttggcagacctcaagataaatatgggttaatgcctgcatgatgcctctgaattcaggaattgcagggaaaactcggggctttgtgccagtctctaagttggcaactttggctgaacaaatgagtagtggcttcagtgtccttgcgtacacattctgtggattgatttaatggagttgtcagcatgatcatcatcttctagccaggggcatagttgccaaggccatttacctctttctaagaagaaacagaattatgtgtatatatgagagaaagaaacaagaatgcgtgaatgaggatgaagaaacatttaccccatgtactcaagacatttcagttttaaaagtcactttcctattagacttcttgaaaaagattctcacatagcctctatgtaatcagacaaatgacatttgatttcaagagcagaggggtaaacatcctctgctaatcgacaggtagcaggtgtcagaggaggcataatattaatagcgccaccttctgttgggtcagtggagatgggtgaggagcagcacagagcagcagggatcatcacatgcagccaaacttggcctctgaagggggaaggtagtgggaataggtggtgagagaactcacatttttctcttgtcctggttttatatttcggagggaaaggattatttggccccattaagaattaagaggctgggtgcggtggctcacgtctgtaatcccagcaccttgggaggcccaggcaggcagatcacctgaggtcgggagttcgagaccagcgtgaccaacgtggagaaacccccgtctctactaaaaatacaaaaaattagctgggcatggtggtgcatgcctgtgattccagtttgcctccagctatgtgttttattggcgggattactttgaggaccagccccttctgtatcccccaggctttgacggaagagtcgtggtgtatcccagcaaccagactttaaaggactacctcagctggcgacaagcagattgtcacatcaataatctttataatacagttttctgggcacttatacaacaatctggactaacaccagtacaagcccaagggagattacagggaactcttgcagcagacaagaatgagattttgttttctgaattcaacatcaactataataatgagccgccgatgtataggaaagggactgtgttgatatggcagaaggtggatgaagtgatgacaaaagaaattaagctgccaacagaaatggaaggaaaaaagatggcagtgacccggaccaggacaaagccagtgcccttgcactgcgatatcatcggggatgctttctggaaggaacatccagagattctagatgaagacagctgacccttttgcgcttcagttctggtgtgcttaaccatgcaagccctcccacctcccagggctccttgccttaggtggctgtagcatccctaccacccaggacactggtgtgaatgacacaactcaagttgggaggggaacagggaaggaagggatggatgggggtggtgtatcttattctgtttaagcagaacaccttgtttgcggtgttggaacatggttcctttggcagaagtgctttttttttaatcgcagtactatttttataaagcaagaactattccatgccttggagaatgaatcaattttttaactgtgctatggagtagaagcaggaggttttcaacctagtcacagagcagcacctaccccctcctcctttccacacctgcaaactcttttacttgggctgaatatttagtgtaattacatctcagctttgagggctcctgtggcaaattcccggattaaaaggttccctggttgtgaaaatacatgagataaatcatgaaggccactatcatcctccttctgcttgcacaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtggtccagtgttctgatttgggtctggacaaagtgccaaaggatcttccccctgacacaactctgctagacctgcaaaacaacaaaataaccgaaatcaaagatggagactttaagaacctgaagaaccttcacgcattgattcttgtcaacaataaaattagcaaagttagtcctggagcatttacacctttggtgaagttggaacgactttatctgtccaagaatcagctgaaggaattgccagaaaaaatgcccaaaactcttcaggagctgcgtgcccatgagaatgagatcaccaaagtgcgaaaagttactttcaatggactgaaccagatgattgtcatagaactgggcaccaatccgctgaagagctcaggaattgaaaatggggctttccagggaatgaagaagctctcctacatccgcattgctgataccaatatcaccagcattcctcaaggtgatagaagattctccaaaacattttgaaaaatttaaattcaaaggctttaattaaaaa

SEQ ID NO: 449005 - DNA, 2678 bp, Homo sapiens
ttagattatgacataaatcttgtaaaaacctgtcagttattttcatctatgagagaagaggagcccaaactctcgcccacctgttcttaaccagaaaacccactgactttgaaaatctcacctctgccacccatctacttgcattcgtctttggcagacctcaagataaatatgggttaatgcctgcatgatgcctctgaattcaggaattgcagggaaaactcggggctttgtgccagtctctaagttggcaactttggctgaacaaatgagtagtggcttcagtgtccttgcgtacacattctgtggattgatttaatggagttgtcagcatgatcatcatcttctagccaggggcatagttgccaaggccatttacctctttctaagaagaaacagaattatgtgtatatatgagagaaagaaacaagaatgcgtgaatgaggatgaagaaacatttaccccatgtactcaagacatttcagttttaaaagtcactttcctattagacttcttgaaaaagattctcacatagcctctatgtaatcagacaaatgacatttgatttcaagagcagaggggtaaacatcctctgctaatcgacaggtagcaggtgtcagaggaggcataatattaatagcgccaccttctgttgggtcagtggagatgggtgaggagcagcacagagcagcagggatcatcacatgcagccaaacttggcctctgaagggggaaggtagtgggaataggtggtgagagaactcacatttttctcttgtcctggttttatatttcggagggaaaggattatttggccccattaagaattaagaggctgggtgcggtggctcacgtctgtaatcccagcaccttgggaggcccaggcaggcagatcacctgaggtcgggagttcgagaccagcgtgaccaacgtggagaaacccccgtctctactaaaaatacaaaaaattagctgggcatggtggtgcatgcctgtgattccagtttgcctccagctatgtgttttattggcgggattactttgaggaccagccccttctgtatcccccaggctttgacggaagagtcgtggtgtatcccagcaaccagactttaaaggactacctcagctggcgacaagcagattgtcacatcaataatctttataatacagttttctgggcacttatacaacaatctggactaacaccagtacaagcccaagggagattacagggaactcttgcagcagacaagaatgagattttgttttctgaattcaacatcaactataataatgagccgccgatgtataggaaagggactgtgttgatatggcagaaggtggatgaagtgatgacaaaagaaattaagctgccaacagaaatggaaggaaaaaagatggcagtgacccggaccaggacaaagccagtgcccttgcactgcgatatcatcggggatgctttctggaaggaacatccagagattctagatgaagacagctgacccttttgcgcttcagttctggtgtgcttaaccatgcaagccctcccacctcccagggctccttgccttaggtggctgtagcatccctaccacccaggacactggtgtgaatgacacaactcaagttgggaggggaacagggaaggaagggatggatgggggtggtgtatcttattctgtttaagcagaacaccttgtttgcggtgttggaacatggttcctttggcagaagtgctttttttttaatcgcagtactatttttataaagcaagaactattccatgccttggagaatgaatcaattttttaactgtgctatggagtagaagcaggaggttttcaacctagtcacagagcagcacctaccccctcctcctttccacacctgcaaactcttttacttgggctgaatatttagtgtaattacatctcagctttgagggctcctgtggcaaattcccggattaaaaggttccctggttgtgaaaatacatgagataaatcatgaaggccactatcatcctccttctgcttgcacaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtggtccagtgttctgatttgggtctggacaaagtgccaaaggatcttccccctgacacaactctgctagacctgcaaaacaacaaaataaccgaaatcaaagatggagactttaagaacctgaagaaccttcacgcattgattcttgtcaacaataaaattagcaaagttagtcctggagcatttacacctttggtgaagttggaacgactttatctgtccaagaatcagctgaaggaattgccagaaaaaatgcccaaaactcttcaggagctgcgtgcccatgagaatgagatcaccaaagtgaactgggcaccaatccgctgaagagctcaggaattgaaaatggggctttccagggaatgaagaagctctcctacatccgcattgctgataccaatatcaccagcattcctcaaggtgatagaagattctccaaaacattttgaaaaatttaaattcaaaggctttaattaaaaa

SEQ ID NO: 449006 - DNA, 2567 bp, Homo sapiens
ttagattatgacataaatcttgtaaaaacctgtcagttattttcatctatgagagaagaggagcccaaactctcgcccacctgttcttaaccagaaaacccactgactttgaaaatctcacctctgccacccatctacttgcattcgtctttggcagacctcaagataaatatgggttaatgcctgcatgatgcctctgaattcaggaattgcagggaaaactcggggctttgtgccagtctctaagttggcaactttggctgaacaaatgagtagtggcttcagtgtccttgcgtacacattctgtggattgatttaatggagttgtcagcatgatcatcatcttctagccaggggcatagttgccaaggccatttacctctttctaagaagaaacagaattatgtgtatatatgagagaaagaaacaagaatgcgtgaatgaggatgaagaaacatttaccccatgtactcaagacatttcagttttaaaagtcactttcctattagacttcttgaaaaagattctcacatagcctctatgtaatcagacaaatgacatttgatttcaagagcagaggggtaaacatcctctgctaatcgacaggtagcaggtgtcagaggaggcataatattaatagcgccaccttctgttgggtcagtggagatgggtgaggagcagcacagagcagcagggatcatcacatgcagccaaacttggcctctgaagggggaaggtagtgggaataggtggtgagagaactcacatttttctcttgtcctggttttatatttcggagggaaaggattatttggccccattaagaattaagaggctgggtgcggtggctcacgtctgtaatcccagcaccttgggaggcccaggcaggcagatcacctgaggtcgggagttcgagaccagcgtgaccaacgtggagaaacccccgtctctactaaaaatacaaaaaattagctgggcatggtggtgcatgcctgtgattccagtttgcctccagctatgtgttttattggcgggattactttgaggaccagccccttctgtatcccccaggctttgacggaagagtcgtggtgtatcccagcaaccagactttaaaggactacctcagctggcgacaagcagattgtcacatcaataatctttataatacagttttctgggcacttatacaacaatctggactaacaccagtacaagcccaagggagattacagggaactcttgcagcagacaagaatgagattttgttttctgaattcaacatcaactataataatgagccgccgatgtataggaaagggactgtgttgatatggcagaaggtggatgaagtgatgacaaaagaaattaagctgccaacagaaatggaaggaaaaaagatggcagtgacccggaccaggacaaagccagtgcccttgcactgcgatatcatcggggatgctttctggaaggaacatccagagattctagatgaagacagctgacccttttgcgcttcagttctggtgtgcttaaccatgcaagccctcccacctcccagggctccttgccttaggtggctgtagcatccctaccacccaggacactggtgtgaatgacacaactcaagttgggaggggaacagggaaggaagggatggatgggggtggtgtatcttattctgtttaagcagaacaccttgtttgcggtgttggaacatggttcctttggcagaagtgctttttttttaatcgcagtactatttttataaagcaagaactattccatgccttggagaatgaatcaattttttaactgtgctatggagtagaagcaggaggttttcaacctagtcacagagcagcacctaccccctcctcctttccacacctgcaaactcttttacttgggctgaatatttagtgtaattacatctcagctttgagggctcctgtggcaaattcccggattaaaaggttccctggttgtgaaaatacatgagataaatcatgaaggccactatcatcctccttctgcttgcacaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtggtccagtgttctgatttgggtctggacaaagtgccaaaggatcttccccctgacacaactctgctagacctgcaaaacaacaaaataaccgaaatcaaagatggagactttaagaacctgaagaaccttcacgcattgattcttgtcaacaataaaattagcaaagttagtcctggagcatttacacctttggtgaagttggaacgactttatctgtccaagaatcagctgaaggaattgccagaaaaaatgcccaaaactcttcaggagctgcgtgcccatgagaatgagatcaccaaagtgcttgtttaagtaccttaaatgaactaaccaaatttttgatttacactggtcccaattctttaa

SEQ ID NO: 449007 - DNA, 2296 bp, Homo sapiens
  misc_feature (2227)..(2227): n is a, c, g, or t
ttagattatgacataaatcttgtaaaaacctgtcagttattttcatctatgagagaagaggagcccaaactctcgcccacctgttcttaaccagaaaacccactgactttgaaaatctcacctctgccacccatctacttgcattcgtctttggcagacctcaagataaatatgggttaatgcctgcatgatgcctctgaattcaggaattgcagggaaaactcggggctttgtgccagtctctaagttggcaactttggctgaacaaatgagtagtggcttcagtgtccttgcgtacacattctgtggattgatttaatggagttgtcagcatgatcatcatcttctagccaggggcatagttgccaaggccatttacctctttctaagaagaaacagaattatgtgtatatatgagagaaagaaacaagaatgcgtgaatgaggatgaagaaacatttaccccatgtactcaagacatttcagttttaaaagtcactttcctattagacttcttgaaaaagattctcacatagcctctatgtaatcagacaaatgacatttgatttcaagagcagaggggtaaacatcctctgctaatcgacaggtagcaggtgtcagaggaggcataatattaatagcgccaccttctgttgggtcagtggagatgggtgaggagcagcacagagcagcagggatcatcacatgcagccaaacttggcctctgaagggggaaggtagtgggaataggtggtgagagaactcacatttttctcttgtcctggttttatatttcggagggaaaggattatttggccccattaagaattaagaggctgggtgcggtggctcacgtctgtaatcccagcaccttgggaggcccaggcaggcagatcacctgaggtcgggagttcgagaccagcgtgaccaacgtggagaaacccccgtctctactaaaaatacaaaaaattagctgggcatggtggtgcatgcctgtgattccagtttgcctccagctatgtgttttattggcgggattactttgaggaccagccccttctgtatcccccaggctttgacggaagagtcgtggtgtatcccagcaaccagactttaaaggactacctcagctggcgacaagcagattgtcacatcaataatctttataatacagttttctgggcacttatacaacaatctggactaacaccagtacaagcccaagggagattacagggaactcttgcagcagacaagaatgagattttgttttctgaattcaacatcaactataataatgagccgccgatgtataggaaagggactgtgttgatatggcagaaggtggatgaagtgatgacaaaagaaattaagctgccaacagaaatggaaggaaaaaagatggcagtgacccggaccaggacaaagccagtgcccttgcactgcgatatcatcggggatgctttctggaaggaacatccagagattctagatgaagacagctgacccttttgcgcttcagttctggtgtgcttaaccatgcaagccctcccacctcccagggctccttgccttaggtggctgtagcatccctaccacccaggacactggtgtgaatgacacaactcaagttgggaggggaacagggaaggaagggatggatgggggtggtgtatcttattctgtttaagcagaacaccttgtttgcggtgttggaacatggttcctttggcagaagtgctttttttttaatcgcagtactatttttataaagcaagaactattccatgccttggagaatgaatcaattttttaactgtgctatggagtagaagcaggaggttttcaacctagtcacagagcagcacctaccccctcctcctttccacacctgcaaactcttttacttgggctgaatatttagtgtaattacatctcagctttgagggctcctgtggcaaattcccggattaaaaggttccctggttgtgaaaatacatgagataaatcatgaaggccactatcatcctccttctgcttgcacaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtggtccagtgttctgatttggctgacangtccaaggatctcccctacacactctctagcctcaaacacaaatacccaataagatgagctttagacct

SEQ ID NO: 449008 - DNA, 376 bp, Homo sapiens
gagaggttggagaaagcactccaagaactgggaagagtaagtgcaaaaacaaaaaatgtcctttcctatagacttgattaactacacaatgcttgtaagaaaggcatccatgtgtggtgtttgctttcatttctgctttctgttgcagggttgggattgagtttcaacagcatctctgctgttgacaatggctctctggccaacacgcctcatctgagggagcttcacttggacaacaacaagcttaccagagtacctggtgggctggcagagcataagtacatccaggtaatgcaaagccactgcttatgtgaggaatatccaaaaagcaagacccccaccctgcttatgggatgctgggaagcaggaagctctt

SEQ ID NO: 449009 - DNA, 1782 bp, Homo sapiens
gaattccggttacgtctgccccccggtggcaaattcccggattaaaaggttccctggttgtgaaaatacatgagataaatcatgaaggccactatcatcctccttctgcttgcacaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtggtccagtgttctgatttgggtctggacaaagtgccaaaggatcttccccctgacacaactctgctagacctgcaaaacaacaaaataaccgaaatcaaagatggagactttaagaacctgaagaaccttcacgcattgattcttgtcaacaataaaattagcaaagttagtcctggagcatttacacctttggtgaagttggaacgactttatctgtccaagaatcagctgaaggaattgccagaaaaaatgcccaaaactcttcaggagctgcgtgcccatgagaatgagatcaccaaagtgcgaaaagttactttcaatggactgaaccagatgattgtcatagaactgggcaccaatccgctgaagagctcaggaattgaaaatggggctttccagggaatgaagaagctctcctacatccgcattgctgataccaatatcaccagcattcctcaaggtcttcctccttcccttacggaattacatcttgatggcaacaaaatcagcagagttgatgcagctagcctgaaaggactgaataatttggctaagttgggattgagtttcaacagcatctctgctgttgacaatggctctctggccaacacgcctcatctgagggagcttcacttggacaacaacaagcttaccagagtacctggtgggctggcagagcataagtacatccaggttgtctaccttcataacaacaatatctctgtagttggatcaagtgacttctgcccacctggacacaacaccaaaaaggcttcttattcgggtgtgagtcttttcagcaacccggtccagtactgggagatacagccatccaccttcagatgtgtctacgtgcgctctgccattcaactcggaaactataagtaattctcaagaaagccctcatttttataacctggcaaaatcttgttaatgtcattgctaaaaaataaataaaagctagatactggaaacctaactgcaatgtggatgttttacccacatgacttattatgcataaaggttatgatcagtagttgattttgagaaagctctatgagctctaagtaactgcatggttttttgtttaatgtaatataggagacccttcacattcccaaggaatatattccaaaacatttttgtgaatatctaagtttgtgaaactactagggcatgatacagtaaggtgtaattacagaatttacgaaatgtaaatgacctctacagagttttatggaatacctggtactaacgtaggcagctgcaaaaccacactgagttacagctgtcagccctcctcattcctaaataacttgccttacatatcagccctcccacttctgaagttcaaattagtgcctcggaaatgtagaatttattatttgtcatttttttttttttagcatagattgagaacagttgaactcttaaatcctcagatgccaggggtctgctctagcatcagtaagtatttagcagaaactaactccgtaatgaatggaattc

SEQ ID NO: 449010 - DNA, 577 bp, Homo sapiens
aaaaaacgctagaaatacacccccattcgcgagttataatagagaaagaggacgccaggttgtctaccttcataacaacaatatctctgtagttggatcaagtgacttctgcccacctggacacaacaccaaaaaggcttcttattcgggtgtgagtcttttcagcaacccggtccagtactgggagatacagccatccaccttcagatgtgtctacgtgcgctctgccattcaactcggaaactataagtaattctcaagaaagccctcatttttataacctggcaaaatcttgttaatgtcattgctaaaaaataaataaaagctagatactggaaacctaactgcaatgtggatgttttacccacatgacttattatgcataaagccaaatttccagtttaagtaattgcctacaataaaaagaaattttgcctgccattttcagaatcatcttttgaagctttctgttgatgttaactgagctactagagatattcttatttcactaaatgtaaaatttggagtaaatatatatgtcaatatttagtaaagcttttcttttttaatttccagg

SEQ ID NO: 449011 - DNA, 3569 bp, Homo sapiens
ttagattatgacataaatcttgtaaaaacctgtcagttattttcatctatgagagaagaggagcccaaactctcgcccacctgttcttaaccagaaaacccactgactttgaaaatctcacctctgccacccatctacttgcattcgtctttggcagacctcaagataaatatgggttaatgcctgcatgatgcctctgaattcaggaattgcagggaaaactcggggctttgtgccagtctctaagttggcaactttggctgaacaaatgagtagtggcttcagtgtccttgcgtacacattctgtggattgatttaatggagttgtcagcatgatcatcatcttctagccaggggcatagttgccaaggccatttacctctttctaagaagaaacagaattatgtgtatatatgagagaaagaaacaagaatgcgtgaatgaggatgaagaaacatttaccccatgtactcaagacatttcagttttaaaagtcactttcctattagacttcttgaaaaagattctcacatagcctctatgtaatcagacaaatgacatttgatttcaagagcagaggggtaaacatcctctgctaatcgacaggtagcaggtgtcagaggaggcataatattaatagcgccaccttctgttgggtcagtggagatgggtgaggagcagcacagagcagcagggatcatcacatgcagccaaacttggcctctgaagggggaaggtagtgggaataggtggtgagagaactcacatttttctcttgtcctggttttatatttcggagggaaaggattatttggccccattaagaattaagaggctgggtgcggtggctcacgtctgtaatcccagcaccttgggaggcccaggcaggcagatcacctgaggtcgggagttcgagaccagcgtgaccaacgtggagaaacccccgtctctactaaaaatacaaaaaattagctgggcatggtggtgcatgcctgtgattccagtttgcctccagctatgtgttttattggcgggattactttgaggaccagccccttctgtatcccccaggctttgacggaagagtcgtggtgtatcccagcaaccagactttaaaggactacctcagctggcgacaagcagattgtcacatcaataatctttataatacagttttctgggcacttatacaacaatctggactaacaccagtacaagcccaagggagattacagggaactcttgcagcagacaagaatgagattttgttttctgaattcaacatcaactataataatgagccgccgatgtataggaaagggactgtgttgatatggcagaaggtggatgaagtgatgacaaaagaaattaagctgccaacagaaatggaaggaaaaaagatggcagtgacccggaccaggacaaagccagtgcccttgcactgcgatatcatcggggatgctttctggaaggaacatccagagattctagatgaagacagctgacccttttgcgcttcagttctggtgtgcttaaccatgcaagccctcccacctcccagggctccttgccttaggtggctgtagcatccctaccacccaggacactggtgtgaatgacacaactcaagttgggaggggaacagggaaggaagggatggatgggggtggtgtatcttattctgtttaagcagaacaccttgtttgcggtgttggaacatggttcctttggcagaagtgctttttttttaatcgcagtactatttttataaagcaagaactattccatgccttggagaatgaatcaattttttaactgtgctatggagtagaagcaggaggttttcaacctagtcacagagcagcacctaccccctcctcctttccacacctgcaaactcttttacttgggctgaatatttagtgtaattacatctcagctttgagggctcctgtggcaaattcccggattaaaaggttccctggttgtgaaaatacatgagataaatcatgaaggccactatcatcctccttctgcttgcacaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtggtccagtgttctgatttggaactgggcaccaatccgctgaagagctcaggaattgaaaatggggctttccagggaatgaagaagctctcctacatccgcattgctgataccaatatcaccagcattcctcaaggtcttcctccttcccttacggaattacatcttgatggcaacaaaatcagcagagttgatgcagctagcctgaaaggactgaataatttggctaagttgggattgagtttcaacagcatctctgctgttgacaatggctctctggccaacacgcctcatctgagggagcttcacttggacaacaacaagcttaccagagtacctggtgggctggcagagcataagtacatccaggttgtctaccttcataacaacaatatctctgtagttggatcaagtgacttctgcccacctggacacaacaccaaaaaggcttcttattcgggtgtgagtcttttcagcaacccggtccagtactgggagatacagccatccaccttcagatgtgtctacgtgcgctctgccattcaactcggaaactataagtaattctcaagaaagccctcatttttataacctggcaaaatcttgttaatgtcattgctaaaaaataaataaaagctagatactggaaacctaactgcaatgtggatgttttacccacatgacttattatgcataaagccaaatttccagtttaagtaattgcctacaataaaaagaaattttgcctgccattttcagaatcatcttttgaagctttctgttgatgttaactgagctactagagatattcttatttcactaaatgtaaaatttggagtaaatatatatgtcaatatttagtaaagcttttcttttttaatttccaggaaaaaataaaaagagtatgagtcttctgtaattcattgagcagttagctcatttgagataaagtcaaatgccaaacactagctctgtattaatccccatcattactggtaaagcctcatttgaatgtgtgaattcaatacaggctatgtaaaatttttactaatgtcattattttgaaaaaataaatttaaaaatacattcaaaatactattgtatacaagcttaattgttaatattccctaaacacaattttatgaagggagaagacattggtttgttgacaataacagtacatcttttcaagttctcagctatttcttctacctctccctatcttacatttgagtatggtaacttatgtcatctatgttgaatgtaagcttataaagcacaaagcatacatttcctgactggtctagagaactgatgtttcaatttacccctctgctaaataaatattaaaactatcatgtgacttcatgt

SEQ ID NO: 449012 - DNA, 1188 bp, Homo sapiens
gaagttaatacatattcataaatattttcaaatcaaatagaacttgcgttgggattgagtttcaacagcatctctgctgttgacaatggctctctggccaacacgcctcatctgagggagcttcacttggacaacaacaagcttaccagagtacctggtgggctggcagagcataagtacatccaggttgtctaccttcataacaacaatatctctgtagttggatcaagtgacttctgcccacctggacacaacaccaaaaaggcttcttattcgggtgtgagtcttttcagcaacccggtccagtactgggagatacagccatccaccttcagatgtgtctacgtgcgctctgccattcaactcggaaactataagtaattctcaagaaagccctcatttttataacctggcaaaatcttgttaatgtcattgctaaaaaataaataaaagctagatactggaaacctaactgcaatgtggatgttttacccacatgacttattatgcataaagccaaatttccagtttaagtaattgcctacaataaaaagaaattttgcctgccattttcagaatcatcttttgaagctttctgttgatgttaactgagctactagagatattcttatttcactaaatgtaaaatttggagtaaatatatatgtcaatatttagtaaagcttttcttttttaatttccaggaaaaaataaaaagagtatgagtcttctgtaattcattgagcagttagctcatttgagataaagtcaaatgccaaacactagctctgtattaatccccatcattactggtaaagcctcatttgaatgtgtgaattcaatacaggctatgtaaaatttttactaatgtcattattttgaaaaaataaatttaaaaatacattcaaaatactattgtatacaagcttaattgttaatattccctaaacacaattttatgaagggagaagacattggtttgttgacaataacagtacatcttttcaagttctcagctatttcttctacctctccctatcttacatttgagtatggtaacttatgtcatctatgttgaatgtaagcttataaagcacaaagcatacatttcctgactggtctagagaactgatgtttcaatttacccctctgctaaataaatattaaaactatcatgtgacttcatgt

SEQ ID NO: 449013 - DNA, 1066 bp, Homo sapiens
tcctcgattaccagcatatcggaccaatgtgccagcaagcaaaaaggagctttggtgtgtgacagttgtctaccttcataacaacaatatctctgtagttggatcaagtgacttctgcccacctggacacaacaccaaaaaggcttcttattcgggtgtgagtcttttcagcaacccggtccagtactgggagatacagccatccaccttcagatgtgtctacgtgcgctctgccattcaactcggaaactataagtaattctcaagaaagccctcatttttataacctggcaaaatcttgttaatgtcattgctaaaaaataaataaaagctagatactggaaacctaactgcaatgtggatgttttacccacatgacttattatgcataaagccaaatttccagtttaagtaattgcctacaataaaaagaaattttgcctgccattttcagaatcatcttttgaagctttctgttgatgttaactgagctactagagatattcttatttcactaaatgtaaaatttggagtaaatatatatgtcaatatttagtaaagcttttcttttttaatttccaggaaaaaataaaaagagtatgagtcttctgtaattcattgagcagttagctcatttgagataaagtcaaatgccaaacactagctctgtattaatccccatcattactggtaaagcctcatttgaatgtgtgaattcaatacaggctatgtaaaatttttactaatgtcattattttgaaaaaataaatttaaaaatacattcaaaatactattgtatacaagcttaattgttaatattccctaaacacaattttatgaagggagaagacattggtttgttgacaataacagtacatcttttcaagttctcagctatttcttctacctctccctatcttacatttgagtatggtaacttatgtcatctatgttgaatgtaagcttataaagcacaaagcatacatttcctgactggtctagagaactgatgtttcaatttacccctctgctaaataaatattaaaactatcatgtgacttcatgt

SEQ ID NO: 449014 - DNA, 3839 bp, Homo sapiens
ttagattatgacataaatcttgtaaaaacctgtcagttattttcatctatgagagaagaggagcccaaactctcgcccacctgttcttaaccagaaaacccactgactttgaaaatctcacctctgccacccatctacttgcattcgtctttggcagacctcaagataaatatgggttaatgcctgcatgatgcctctgaattcaggaattgcagggaaaactcggggctttgtgccagtctctaagttggcaactttggctgaacaaatgagtagtggcttcagtgtccttgcgtacacattctgtggattgatttaatggagttgtcagcatgatcatcatcttctagccaggggcatagttgccaaggccatttacctctttctaagaagaaacagaattatgtgtatatatgagagaaagaaacaagaatgcgtgaatgaggatgaagaaacatttaccccatgtactcaagacatttcagttttaaaagtcactttcctattagacttcttgaaaaagattctcacatagcctctatgtaatcagacaaatgacatttgatttcaagagcagaggggtaaacatcctctgctaatcgacaggtagcaggtgtcagaggaggcataatattaatagcgccaccttctgttgggtcagtggagatgggtgaggagcagcacagagcagcagggatcatcacatgcagccaaacttggcctctgaagggggaaggtagtgggaataggtggtgagagaactcacatttttctcttgtcctggttttatatttcggagggaaaggattatttggccccattaagaattaagaggctgggtgcggtggctcacgtctgtaatcccagcaccttgggaggcccaggcaggcagatcacctgaggtcgggagttcgagaccagcgtgaccaacgtggagaaacccccgtctctactaaaaatacaaaaaattagctgggcatggtggtgcatgcctgtgattccagtttgcctccagctatgtgttttattggcgggattactttgaggaccagccccttctgtatcccccaggctttgacggaagagtcgtggtgtatcccagcaaccagactttaaaggactacctcagctggcgacaagcagattgtcacatcaataatctttataatacagttttctgggcacttatacaacaatctggactaacaccagtacaagcccaagggagattacagggaactcttgcagcagacaagaatgagattttgttttctgaattcaacatcaactataataatgagccgccgatgtataggaaagggactgtgttgatatggcagaaggtggatgaagtgatgacaaaagaaattaagctgccaacagaaatggaaggaaaaaagatggcagtgacccggaccaggacaaagccagtgcccttgcactgcgatatcatcggggatgctttctggaaggaacatccagagattctagatgaagacagctgacccttttgcgcttcagttctggtgtgcttaaccatgcaagccctcccacctcccagggctccttgccttaggtggctgtagcatccctaccacccaggacactggtgtgaatgacacaactcaagttgggaggggaacagggaaggaagggatggatgggggtggtgtatcttattctgtttaagcagaacaccttgtttgcggtgttggaacatggttcctttggcagaagtgctttttttttaatcgcagtactatttttataaagcaagaactattccatgccttggagaatgaatcaattttttaactgtgctatggagtagaagcaggaggttttcaacctagtcacagagcagcacctaccccctcctcctttccacacctgcaaactcttttacttgggctgaatatttagtgtaattacatctcagctttgagggctcctgtggcaaattcccggattaaaaggttccctggttgtgaaaatacatgagataaatcatgaaggccactatcatcctccttctgcttgcacaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtggtccagtgttctgatttgggtctggacaaagtgccaaaggatcttccccctgacacaactctgctagacctgcaaaacaacaaaataaccgaaatcaaagatggagactttaagaacctgaagaaccttcacgcattgattcttgtcaacaataaaattagcaaagttagtcctggagcatttacacctttggtgaagttggaacgactttatctgtccaagaatcagctgaaggaattgccagaaaaaatgcccaaaactcttcaggagctgcgtgcccatgagaatgagatcaccaaagtgcgaaaagttactttcaatggactgaaccagatgattgtcatagaactgggcaccaatccgctgaagagctcaggaattgaaaatggggctttccagggaatgaagaagctctcctacatccgcattgctgataccaatatcaccagcattcctcaaggtcttcctccttcccttacggaattacatcttgatggcaacaaaatcagcagagttgatgcagctagcctgaaaggactgaataatttggctaagttgggattgagtttcaacagcatctctgctgttgacaatggctctctggccaacacgcctcatctgagggagcttcacttggacaacaacaagcttaccagagtacctggtgggctggcagagcataagtacatccaggttgtctaccttcataacaacaatatctctgtagttggatcaagtgacttctgcccacctggacacaacaccaaaaaggcttcttattcgggtgtgagtcttttcagcaacccggtccagtactgggagatacagccatccaccttcagatgtgtctacgtgcgctctgccattcaactcggaaactataagtaattctcaagaaagccctcatttttataacctggcaaaatcttgttaatgtcattgctaaaaaataaataaaagctagatactggaaacctaactgcaatgtggatgttttacccacatgacttattatgcataaagccaaatttccagtttaagtaattgcctacaataaaaagaaattttgcctgccattttcagaatcatcttttgaagctttctgttgatgttaactgagctactagagatattcttatttcactaaatgtaaaatttggagtaaatatatatgtcaatatttagtaaagcttttcttttttaatttccaggataaagtcaaatgccaaacactagctctgtattaatccccatcattactggtaaagcctcatttgaatgtgtgaattcaatacaggctatgtaaaatttttactaatgtcattattttgaaaaaataaatttaaaaatacattcaaaatactattgtatacaagcttaattgttaatattccctaaacacaattttatgaagggagaagacattggtttgttgacaataacagtacatcttttcaagttctcagctatttcttctacctctccctatcttacatttgagtatggtaacttatgtcatctatgttgaatgtaagcttataaagcacaaagcatacatttcctgactggtctagagaactgatgtttcaatttacccctctgctaaataaatattaaaactatcatgtgacttcatgt

SEQ ID NO: 449015 - DNA, 3735 bp, Homo sapiens
  misc_feature (3618)..(3619): n is a, c, g, or t
  misc_feature (3624)..(3624): n is a, c, g, or t
  misc_feature (3627)..(3627): n is a, c, g, or t
  misc_feature (3631)..(3631): n is a, c, g, or t
ttagattatgacataaatcttgtaaaaacctgtcagttattttcatctatgagagaagaggagcccaaactctcgcccacctgttcttaaccagaaaacccactgactttgaaaatctcacctctgccacccatctacttgcattcgtctttggcagacctcaagataaatatgggttaatgcctgcatgatgcctctgaattcaggaattgcagggaaaactcggggctttgtgccagtctctaagttggcaactttggctgaacaaatgagtagtggcttcagtgtccttgcgtacacattctgtggattgatttaatggagttgtcagcatgatcatcatcttctagccaggggcatagttgccaaggccatttacctctttctaagaagaaacagaattatgtgtatatatgagagaaagaaacaagaatgcgtgaatgaggatgaagaaacatttaccccatgtactcaagacatttcagttttaaaagtcactttcctattagacttcttgaaaaagattctcacatagcctctatgtaatcagacaaatgacatttgatttcaagagcagaggggtaaacatcctctgctaatcgacaggtagcaggtgtcagaggaggcataatattaatagcgccaccttctgttgggtcagtggagatgggtgaggagcagcacagagcagcagggatcatcacatgcagccaaacttggcctctgaagggggaaggtagtgggaataggtggtgagagaactcacatttttctcttgtcctggttttatatttcggagggaaaggattatttggccccattaagaattaagaggctgggtgcggtggctcacgtctgtaatcccagcaccttgggaggcccaggcaggcagatcacctgaggtcgggagttcgagaccagcgtgaccaacgtggagaaacccccgtctctactaaaaatacaaaaaattagctgggcatggtggtgcatgcctgtgattccagtttgcctccagctatgtgttttattggcgggattactttgaggaccagccccttctgtatcccccaggctttgacggaagagtcgtggtgtatcccagcaaccagactttaaaggactacctcagctggcgacaagcagattgtcacatcaataatctttataatacagttttctgggcacttatacaacaatctggactaacaccagtacaagcccaagggagattacagggaactcttgcagcagacaagaatgagattttgttttctgaattcaacatcaactataataatgagccgccgatgtataggaaagggactgtgttgatatggcagaaggtggatgaagtgatgacaaaagaaattaagctgccaacagaaatggaaggaaaaaagatggcagtgacccggaccaggacaaagccagtgcccttgcactgcgatatcatcggggatgctttctggaaggaacatccagagattctagatgaagacagctgacccttttgcgcttcagttctggtgtgcttaaccatgcaagccctcccacctcccagggctccttgccttaggtggctgtagcatccctaccacccaggacactggtgtgaatgacacaactcaagttgggaggggaacagggaaggaagggatggatgggggtggtgtatcttattctgtttaagcagaacaccttgtttgcggtgttggaacatggttcctttggcagaagtgctttttttttaatcgcagtactatttttataaagcaagaactattccatgccttggagaatgaatcaattttttaactgtgctatggagtagaagcaggaggttttcaacctagtcacagagcagcacctaccccctcctcctttccacacctgcaaactcttttacttgggctgaatatttagtgtaattacatctcagctttgagggctcctgtggcaaattcccggattaaaaggttccctggttgtgaaaatacatgagataaatcatgaaggccactatcatcctccttctgcttgcacaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtggtccagtgttctgatttgggtctggacaaagtgccaaaggatcttccccctgacacaactctgctagacctgcaaaacaacaaaataaccgaaatcaaagatggagactttaagaacctgaagaaccttcacgcattgattcttgtcaacaataaaattagcaaagttagtcctggagcatttacacctttggtgaagttggaacgactttatctgtccaagaatcagctgaaggaattgccagaaaaaatgcccaaaactcttcaggagctgcgtgcccatgagaatgagatcaccaaagtgcgaaaagttactttcaatggactgaaccagatgattgtcatagaactgggcaccaatccgctgaagagctcaggaattgaaaatggggctttccagggaatgaagaagctctcctacatccgcattgctgataccaatatcaccagcattcctcaaggtcttcctccttcccttacggaattacatcttgatggcaacaaaatcagcagagttgatgcagctagcctgaaaggactgaataatttggctaagttgggattgagtttcaacagcatctctgctgttgacaatggctctctggccaacacgcctcatctgagggagcttcacttggacaacaacaagcttaccagagtacctggtgggctggcagagcataagtacatccaggttgtctaccttcataacaacaatatctctgtagttggatcaagtgacttctgcccacctggacacaacaccaaaaaggcttcttattcgggtgtgagtcttttcagcaacccggtccagtactgggagatacagccatccaccttcagatgtgtctacgtgcgctctgccattcaactcggaaactataagtaattctcaagaaagccctcatttttataacctggcaaaatcttgttaatgtcattgctaaaaaataaataaaagctagatactggaaacctaactgcaatgtggatgttttacccacatgacttattatgcataaagccaaatttccagtttaagtaattgcctacaataaaaagaaattttgcctgccattttcagaatcatcttttgaagctttctgttgatgttaactgagctactagagatattcttatttcactaaatgtaaaatttggagtaaatatatatgtcaatatttagtaaagcttttcttttttaatttccaggaaaaaataaaaagagtatgagtcttctgtaattcattgagcagttagctcatttgagataaagtcaaatgccaaacactagctctgtattaatccccatcattactggtaaagcctcatttgaatgtgtgaattcaatacaggctatgtaaaatttttactaatgtcattattttgaaaaaataaatttaaaaatacattcaacnnaaaanacnaaancacacaaaaacaacactgtgcgggcagctcctgtgccctgaaaatttttaaaaccatcttagcgcgcgggcacacagagagtagacacaagacaaacggctccc

SEQ ID NO: 449016 - DNA, 3616 bp, Homo sapiens
ttagattatgacataaatcttgtaaaaacctgtcagttattttcatctatgagagaagaggagcccaaactctcgcccacctgttcttaaccagaaaacccactgactttgaaaatctcacctctgccacccatctacttgcattcgtctttggcagacctcaagataaatatgggttaatgcctgcatgatgcctctgaattcaggaattgcagggaaaactcggggctttgtgccagtctctaagttggcaactttggctgaacaaatgagtagtggcttcagtgtccttgcgtacacattctgtggattgatttaatggagttgtcagcatgatcatcatcttctagccaggggcatagttgccaaggccatttacctctttctaagaagaaacagaattatgtgtatatatgagagaaagaaacaagaatgcgtgaatgaggatgaagaaacatttaccccatgtactcaagacatttcagttttaaaagtcactttcctattagacttcttgaaaaagattctcacatagcctctatgtaatcagacaaatgacatttgatttcaagagcagaggggtaaacatcctctgctaatcgacaggtagcaggtgtcagaggaggcataatattaatagcgccaccttctgttgggtcagtggagatgggtgaggagcagcacagagcagcagggatcatcacatgcagccaaacttggcctctgaagggggaaggtagtgggaataggtggtgagagaactcacatttttctcttgtcctggttttatatttcggagggaaaggattatttggccccattaagaattaagaggctgggtgcggtggctcacgtctgtaatcccagcaccttgggaggcccaggcaggcagatcacctgaggtcgggagttcgagaccagcgtgaccaacgtggagaaacccccgtctctactaaaaatacaaaaaattagctgggcatggtggtgcatgcctgtgattccagtttgcctccagctatgtgttttattggcgggattactttgaggaccagccccttctgtatcccccaggctttgacggaagagtcgtggtgtatcccagcaaccagactttaaaggactacctcagctggcgacaagcagattgtcacatcaataatctttataatacagttttctgggcacttatacaacaatctggactaacaccagtacaagcccaagggagattacagggaactcttgcagcagacaagaatgagattttgttttctgaattcaacatcaactataataatgagccgccgatgtataggaaagggactgtgttgatatggcagaaggtggatgaagtgatgacaaaagaaattaagctgccaacagaaatggaaggaaaaaagatggcagtgacccggaccaggacaaagccagtgcccttgcactgcgatatcatcggggatgctttctggaaggaacatccagagattctagatgaagacagctgacccttttgcgcttcagttctggtgtgcttaaccatgcaagccctcccacctcccagggctccttgccttaggtggctgtagcatccctaccacccaggacactggtgtgaatgacacaactcaagttgggaggggaacagggaaggaagggatggatgggggtggtgtatcttattctgtttaagcagaacaccttgtttgcggtgttggaacatggttcctttggcagaagtgctttttttttaatcgcagtactatttttataaagcaagaactattccatgccttggagaatgaatcaattttttaactgtgctatggagtagaagcaggaggttttcaacctagtcacagagcagcacctaccccctcctcctttccacacctgcaaactcttttacttgggctgaatatttagtgtaattacatctcagctttgagggctcctgtggcaaattcccggattaaaaggttccctggttgtgaaaatacatgagataaatcatgaaggccactatcatcctccttctgcttgcacaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtggtccagtgttctgatttgggtctggacaaagtgccaaaggatcttccccctgacacaactctgctagacctgcaaaacaacaaaataaccgaaatcaaagatggagactttaagaacctgaagaaccttcacgcattgattcttgtcaacaataaaattagcaaagttagtcctggagcatttacacctttggtgaagttggaacgactttatctgtccaagaatcagctgaaggaattgccagaaaaaatgcccaaaactcttcaggagctgcgtgcccatgagaatgagatcaccaaagtgcgaaaagttactttcaatggactgaaccagatgattgtcatagaactgggcaccaatccgctgaagagctcaggaattgaaaatggggctttccagggaatgaagaagctctcctacatccgcattgctgataccaatatcaccagcattcctcaaggtcttcctccttcccttacggaattacatcttgatggcaacaaaatcagcagagttgatgcagctagcctgaaaggactgaataatttggctaagttgggattgagtttcaacagcatctctgctgttgacaatggctctctggccaacacgcctcatctgagggagcttcacttggacaacaacaagcttaccagagtacctggtgggctggcagagcataagtacatccaggttgtctaccttcataacaacaatatctctgtagttggatcaagtgacttctgcccacctggacacaacaccaaaaaggcttcttattcgggtgtgagtcttttcagcaacccggtccagtactgggagatacagccatccaccttcagatgtgtctacgtgcgctctgccattcaactcggaaactataagtaattctcaagaaagccctcatttttataacctggcaaaatcttgttaatgtcattgctaaaaaataaataaaagctagatactggaaacctaactgcaatgtggatgttttacccacatgacttattatgcataaagccaaatttccagtttaagtaattgcctacaataaaaagaaattttgcctgccattttcagaatcatcttttgaagctttctgttgatgttaactgagctactagagatattcttatttcactaaatgtaaaatttggagtaaatatatatgtcaatatttagtaaagcttttcttttttaatttccaggaaaaaataaaaagagtatgagtcttctgtaattcattgagcagttagctcatttgagataaagtcaaatgccaaacactagctctgtattaatccccatcattactggtaaagcctcatttgaatgtgtgaattcaatacaggctatgtaaaatttttactaatgtcattattttgaaaaaataaatttaaaaatacattcaa

SEQ ID NO: 449017 - DNA, 1681 bp, Homo sapiens
ggagtcgaccgctcgggcagcgccaccgccacgagagcccgggacgcgggaaagaccgaaaggaagaggaagaggcaccggtggccatggggctggaggcggcgcgcgagctggagtgcgcggcgctgggcacgctgctgcgggatccgcgggaggcggaacgcacgctgctgctggactgccgccccttcctggccttctgccggcgccacgtgcgcgccgcgcggccagtgccttggaacgcgctgctgcggcgccgcgcgcgcggccctcctgccgccgttctcgcctgcctgctgcccgaccgcgcgctgcggacgcgcctggtccgcggggagctggcgcgggccgtggtgctggacgagggcagtgcctcggtggcggagctccggcccgacagcccggctcatgtgctgctggccgcgctgctgcacgagacccgcgcggggcccactgccgtgtacttcctgcgaggaggcttcgacggcttccagggctgctgtcccgatctgtgctctgaggcccccgcccctgcgctgccgccaacaggggacaaaaccagccgctccgactccagggctcctgtctacgaccagggtggccctgtggagatcttgccctacctgttcctgggcagctgcagtcactcgtcagacctgcaggggctgcaggcctgtggcatcacagccgtcctcaacgtgtccgccagctgccccaaccactttgagggccttttccgctacaagagtatccctgtggaggacaaccagatggtggagatcagtgcctggttccaggaggccataggcttcattgactgggtgaagaacagcggaggccgggtgctggtgcactgccaggcgggtatctcgcgctctgccaccatctgtctggcatacctcatgcagagtcgccgtgtgcggctggacgaggcctttgacttcgttaagcagcgccggggggtcatctcccccaacttcagtttcatggggcagctgctgcagtttgagacccaggtgctgtgtcactgaggtggtgcccctctgcctgcctgccccactgtgctggcaggagctgactgtggactggtgggctcccctctgggccagcacagtcccctcacctctggcagggctgctacctcctcagagtttcagaagcccccacatgggggctctaggaatgccggcatgctggtctttccgacctggtgctcttctgctgggggactgaggctggccctcattcggggtcgggaaccaagggtgtgtctgctctttccctccccatcctctggcagaaatcagctagacgctataccgtggactctccctggtccaccaccatgttgaagcccttggcagcctgagagctccaaggaacaagctgtgacaaccaggagccctgtctgtgggttcgtctgcccagggcctggagcccaagccctgtgttcctggggaagctggggacttgggaagtgatgggtgtgtcatgttgcgtgtgtctgtctgtgagcctttcacacctgtgctggcgctggaaaattatttgtgctcagctgacatttaacactccctcccccgcttcctcctagccctgtgggcaggggttggaaacttagcactttatatttatacagaacattcaggatatgtcaataaaatattgttatatttaaaaa

SEQ ID NO: 449018 - DNA, 1821 bp, Homo sapiens
ggagtcgaccgctcgggcagcgccaccgccacgagagcccgggacgcgggaaagaccgaaaggaagaggaagaggcaccggtggccatggggctggaggcggcgcgcgagctggagtgcgcggcgctgggcacgctgctgcgggatccgcgggaggcggaacgcacgctgctgctggactgccgccccttcctggccttctgccggcgccacgtgcgcgccgcgcggccagtgccttggaacgcgctgctgcggcgccgcgcgcgcggccctcctgccgccgttctcgcctgcctgctgcccgaccgcgcgctgcggacgcgcctggtccgcggggagctggcgcgggccgtggtgctggacgagggcagtgcctcggtggcggagctccggcccgacagcccggctcatgtgctgctggccgcgctgctgcacgagacccgcgcggggcccactgccgtgtacttcctgcgaggaggcttcgacggcttccagggctgctgtcccgatctgtgctctgaggcccccgcccctgcgctgccgccaacaggggacaaaaccagccgctccgactccagggctcctgtctacgaccagggtggccctgtggagatcttgccctacctgttcctgggcagctgcagtcactcgtcagacctgcaggggctgcaggcctgtggcatcacagccgtcctcaacgtgtccgccagctgccccaaccactttgagggccttttccgctacaagagtatccctgtggaggacaaccagatggtggagatcagtgcctggttccaggaggccataggcttcattgactgggtgaagaacagcggaggccgggtgctggtgcactgccaggcgggtatctcgcgctctgccaccatctgtctggcatacctcatgcagagtcgccgtgtgcggctggacgaggcctttgacttcgttaagcagcgccggggggtcatctcccccaacttcagtttcatggggcagctgctgcagtttgagacccaggtgctgtgtcactgaggtggtgcccctctgcctgcctgccccactgtgctggcaggagctgactgtggactggtgggctcccctctgggccagcacagtcccctcacctctggcagggctgctacctcctcagagtttcagaagcccccacatgggggctctaggaatgccggcatgctggtctttccgacctggtgctcttctgctgggggactgaggctggccctcattcggggtcgggaaccaagggtgtgtctgctctttccctccccatcctctggcagaaatcagctagacgctataccgtggactctccctggtccaccaccatgttgaagcccttggcagcctgagagctccaaggaacaagctgtgacaaccaggagccctgtctgtgggttcgtctgcccagggcctggagcccaagccctgtgttcctggggaagctggggacttgggaagtgatgggtgtgtcatgttgcgtgtgtctgtctgtgagcctttcacacctgtgctggcgctggaaaattatttgtgctcagctgacatttaacactccctcccccgcttcctcctagccctgtgggcaggggttggaaacttagcactttatatttatacagaacattcaggatatgtcaataaaatattgttatatttaaaaaccataatagagaatagtatttttcttaaccagaacaacaatctctgattaataccctttgaactcaaaccgttatacgccaaaaaagctttctgtttggtgccaattgtccaataagagaccctttttgggggggctggg

SEQ ID NO: 449019 - DNA, 2155 bp, Homo sapiens
ggagtcgaccgctcgggcagcgccaccgccacgagagcccgggacgcgggaaagaccgaaaggaagaggaagaggcaccggtggccatggggctggaggcggcgcgcgagctggagtgcgcggcgctgggcacgctgctgcgggatccgcgggaggcggaacgcacgctgctgctggactgccgccccttcctggccttctgccggcgccacgtgcgcgccgcgcggccagtgccttggaacgcgctgctgcggcgccgcgcgcgcggccctcctgccgccgttctcgcctgcctgctgcccgaccgcgcgctgcggacgcgcctggtccgcggggagctggcgcgggccgtggtgctggacgagggcagtgcctcggtggcggagctccggcccgacagcccggctcatgtgctgctggccgcgctgctgcacgagacccgcgcggggcccactgccgtgtacttcctgcgaggaggcttcgacggcttccagggctgctgtcccgatctgtgctctgaggcccccgcccctgcgctgccgccaacaggggacaaaaccagccgctccgactccagggctcctgtctacgaccagggtggccctgtggagatcttgccctacctgttcctgggcagctgcagtcactcgtcagacctgcaggggctgcaggcctgtggcatcacagccgtcctcaacgtgtccgccagctgccccaaccactttgagggccttttccgctacaagagtatccctgtggaggacaaccagatggtggagatcagtgcctggttccaggaggccataggcttcattgactgggtgaagaacagcggaggccgggtgctggtgcactgccaggcgggtatctcgcgctctgccaccatctgtctggcatacctcatgcagagtcgccgtgtgcggctggacgaggcctttgacttcgttaagcagcgccggggggtcatctcccccaacttcagtttcatggggcagctgctgcagtttgagacccaggtgctgtgtcactgaggtggtgcccctctgcctgcctgccccactgtgctggcaggagctgactgtggactggtgggctcccctctgggccagcacagtcccctcacctctggcagggctgctacctcctcagagtttcagaagcccccacatgggggctctaggaatgccggcatgctggtctttccgacctggtgctcttctgctgggggactgaggctggccctcattcggggtcgggaaccaagggtgtgtctgctctttccctccccatcctctggcagaaatcagctagacgctataccgtggactctccctggtccaccaccatgttgaagcccttggcagcctgagagctccaaggaacaagctgtgacaaccaggagccctgtctgtgggttcgtctgcccagggcctggagcccaagccctgtgttcctggggaagctggggacttgggaagtgatgggtgtgtcatgttgcgtgtgtctgtctgtgagcctttcacacctgtgctggcgctggaaaattatttgtgctcagctgacatttaacactccctcccccgcttcctcctagccctgtgggcaggggttggaaacttagcactttatatttatacagaacattcaggatatgtcaataaaatattgttatatttaaaaaaaaaaaaaaaaaacaaaaaaaaaaacaacaaaaaaaaaaaaaaaaaaaaaaacaacaacaacaacaaaaaaaaaacaaaaaaaaaaaaaaaagaaaaaaaaaaaaaaaaagagggggggcgcgccgaacaaacaccgccctgggagggagagcacctatagaacccccaccacatttgagacaacgagagagcggcgcccagagagagggtctgtcttatataacagaggagcgagcgtgcgcgcaggccgcgagttttacacaacacgaccgttaatgggtgaggaacacatacggacacatcggatgggcacatactgcggtaggagcaccgccaacccccacatatgttggagggcgggaacgaaactcgagagggcggacacaaccgcgctccacagcgggaccgtgaccagtcagccgagcgtaggggaacgtcctatcacaatggcggacggaggaaacgaatgaggc

SEQ ID NO: 449020 - DNA, 475 bp, Homo sapiens
tttatatataaatctataaaaagaagcacaaaagacagaccggtcaccgcacactccccttattttgcactttcttgtgagagaggtgacacactgtgtgtgtgtgtgtgtgtgagtgtgtgtgtgtgtgtgtgatgggtgtgtcatgttgcgtgtgtctgtctgtgagcctttcacacctgtgctggcgctggaaaattatttgtgctcagctgacatttaacactccctcccccgcttcctcctagccctgtgggcaggggttggaaacttagcactttatatttatacagaacattcaggatatgtcaataaaatattgttatatttaaaaaccataatagagaatagtatttttcttaaccagaacaacaatctctgattaataccctttgaactcaaaccgttatacgccaaaaaagctttctgtttggtgccaattgtccaataagagaccctttttgggggggctggg

SEQ ID NO: 449021 - DNA, 889 bp, Homo sapiens
ccacgagagcccgggacgcgggaaagaccgaaaggaagaggaagaggcaccggtggccatggggctggaggcggcgcgcgagctggagtgcgcggcgctgggcacgctgctgcgggatccgcgggaggcggaacgcacgctgctgctggactgccgccccttcctggccttctgccggcgccacgtgcgcgccgcgcggccagtgccttggaacgcgctgctgcggcgccgcgcgcgcggccctcctgccgccgttctcgcctgcctgctgcccgaccgcgcgctgcggacgcgcctggtccgcggggagctggcgcgggccgtggtgctggacgagggcagtgcctcggtggcggagctccggcccgacagcccggctcatgtgctgctggccgcgctgctgcacgagacccgcgcggggcccactgccgtgtacttcctgcgaggtgagcaagccggccgcccttggcccgccccacccgactccagcccggctttccctgctgatcgtgctcttcccctccttgcaggaggcttcgacggcttccagggctgctgtcccgatctgtgctctgaggcccccgcccctgcgctgccgccaacaggggacaaaaccagccgctccgactccagggctcctgtctacgaccaggtgagtattgacccccctcccccgaacctccctctctccccgccgcggactgggcgcctctagggaaagagcctgccatttggggatgcgagcagtttgcccatatacacacacttttatacgtgtgtgtgttgggggagggggtggggcatggctgctcgcgcgtgcctgtatgggtctgtgtatgtttgcatgtgtatgttgggagcatgaagggaaatgtatgtcccggtgtgt

SEQ ID NO: 449022 - DNA, 1475 bp, Homo sapiens
ggagtcgaccgctcgggcagcgccaccgccacgagagcccgggacgcgggaaagaccgaaaggaagaggaagaggcaccggtggccatggggctggaggcggcgcgcgagctggagtgcgcggcgctgggcacgctgctgcgggatccgcgggaggcggaacgcacgctgctgctggactgccgccccttcctggccttctgccggcgccacgtgcgcgctgctgcacgagacccgcgcggggcccactgccgtgtacttcctgcgaggaggcttcgacggcttccagggctgctgtcccgatctgtgctctgaggcccccgcccctgcgctgccgccaacaggggacaaaaccagccgctccgactccagggctcctgtctacgaccagggtggccctgtggagatcttgccctacctgttcctgggcagctgcagtcactcgtcagacctgcaggggctgcaggcctgtggcatcacagccgtcctcaacgtgtccgccagctgccccaaccactttgagggccttttccgctacaagagtatccctgtggaggacaaccagatggtggagatcagtgcctggttccaggaggccataggcttcattgactgggtgaagaacagcggaggccgggtgctggtgcactgccaggcgggtatctcgcgctctgccaccatctgtctggcatacctcatgcagagtcgccgtgtgcggctggacgaggcctttgacttcgttaagcagcgccggggggtcatctcccccaacttcagtttcatggggcagctgctgcagtttgagacccaggtgctgtgtcactgaggtggtgcccctctgcctgcctgccccactgtgctggcaggagctgactgtggactggtgggctcccctctgggccagcacagtcccctcacctctggcagggctgctacctcctcagagtttcagaagcccccacatgggggctctaggaatgccggcatgctggtctttccgacctggtgctcttctgctgggggactgaggctggccctcattcggggtcgggaaccaagggtgtgtctgctctttccctccccatcctctggcagaaatcagctagacgctataccgtggactctccctggtccaccaccatgttgaagcccttggcagcctgagagctccaaggaacaagctgtgacaaccaggagccctgtctgtgggttcgtctgcccagggcctggagcccaagccctgtgttcctggggaagctggggacttgggaagtgatgggtgtgtcatgttgcgtgtgtctgtctgtgagcctttcacacctgtgctggcgctggaaaattatttgtgctcagctgacatttaacactccctcccccgcttcctcctagccctgtgggcaggggttggaaacttagcactttatatttatacagaacattcaggatatgtcaataaaatattgttatatttaaaaa

SEQ ID NO: 449023 - DNA, 833 bp, Homo sapiens
ctacctgttcctgggcagctgcagtcactcgtcagacctgcaggggctgcaggcctgtggcatcacagccgtcctcaacgtgtccgccagctgccccaaccactttgagggccttttccgctacaagagtatccctgtggaggacaaccagatggtggagatcagtgcctggttccaggaggccataggcttcattggtaagggggcacctctgcccagaaatcccgaggggctccagaggagaggactgggggcacctgtctcctgggctgtgcacattccgtctgacaccactcccccatctcccttgcagactgggtgaagaacagcggaggccgggtgctggtgcactgccaggcgggtatctcgcgctctgccaccatctgtctggcatacctcatgcagagtcgccgtgtgcggctggacgaggcctttgacttcgttaagcagcgccggggggtcatctcccccaacttcagtttcatggggcagctgctgcagtttgagacccaggtgctgtgtcactgaggtggtgcccctctgcctgcctgccccactgtgctggcaggagctgactgtggactggtgggctcccctctgggccagcacagtcccctcacctctggcagggctgctacctcctcagagtttcagaagcccccacatgggggctctaggaatgccggcatgctggtctttccgacctggtgctcttctgctgggggactgaggctggccctcattcggggtcgggaaccaagggtgtgtctgctctttccctccccatcctctggcagaaatcagctagacgctataccgtggactctccctgg

SEQ ID NO: 449024 - DNA, 3456 bp, Homo sapiens
  misc_feature (1921)..(1921): n is a, c, g, or t
tttccttcatgtagattgctgtgtgtgtctttttcttcataattccccttaattctgtgtgctttgaatgacactgttgttgttactgttgttttatatccattgtcacataaaactcttatcatttattcttccaggccagggactgtccttatgggtagagatacactatctgcaggaatttatttttttacgtatttttactagttgatgggaaagacattgggaaagacctgggctggatttgtgatgagctgtgtttactgagcatgatgaagtaaagctcaacgtgattactctgaagtccagccttactgtcagtctaaggactcaggatacaaatactcaaaacataaattcttagactctaaatttcacatggtttttcctatcagtacaggttaaggataatggcgtgttgtaggtttttccagtgcaatacaaggaagttggttctagatcctttagtacagttaatgttttgtagagtgtgttctatgttcactgcattggtatgtctcatctttggcatgatcttggctcaccgcaacctccgcctcttgcattcaagcacttcttgtctcagcctccagagtagctgggattacaagcatgtgccaacatgcccggctaatttttgtatgcttttgtggagacaggctttgccatgtttgccaggttggtctctaagtgatccacccgcctcagccccacaaagtgctgggattacatgcgtgagccaccgtacccagccacacctttgcttatttctactatgcatttcaagtgatcatttcaagagaataagtacttaggagctcctatgctctttttttttttaaccctgttgcttgcatcacccggttccaaccctatatgaaagtttcatgagcatgtttctgtcactgaggcagcttctccatttggcatataattgagaaattgctagtttgtggctgagacattggtttgagaggagacgtaatttatatatttagcagaatgcttaagttacatttccagagattaatttaattctacttttaattaagttaaccctttgctgtatctttacaagacgtaggtggagatttaattttgactcttagattcagttaaggtgatgaaattggcattatatagtttttgatgctgagccccacggagattaaaagatttgctaaacaccatgcaatttttgaatcacatctctaatctcacattattctgtactctattttttgcttgtatgattgatgggtctttcattatctgtgattgacattctatgagtaggtgcttttgctttgcctataagtcgttattatgaaggaggaatggtgaataagaaggtaatttagaaaagcctatattaaatataccatgaacattgaatatagcaagatcttattctctagttgttatcttagttgataaattctgtatgtgttatgtgtttgtgtatacatatgtacatattaatgatgtgggtgttgatactgtgatcacatgacaaatgactggtttatagtgaaaagctgttggggttcagagaaatgaacattcttctaaaagtgaggtagataagttattttatagttcttgcctttgagtctctgttcttctggtagaaatgttagtgtatttataacctctcagatttgtttggttctcttagtgttcttgatccaggcagttagcgatatgttggatgaattgagaaaaatgagtttttcctttcctactaactgaattagattagaaataagcagttaagtgagaaaaatagggaattagtgccagatatgttgaggtgtagtgttgacagggggtcttttaccttcagatgtttggtgcaacttagagaatgcagtggtagttgctggcccagcccatccaaacaacctcatttgtggggtgntacttcacagatgacttaaaataaatcccctgaaaataagaatctctggaagagatgacacgtgtatgtgcgtgtgtgcacgtgtgtgcgtgtgtgcacgtgtgtgtgtgtgtgtgttttggtggagtggtaggaggagggttggcttaatgatgagaatcattatttcttgaattggatgacactttccattcctgcaaagggagcgtgaggtccagccttgctaattcatgatcaaagtaatttgctgagagtagtggaaggaatgagttagcagaagatggcaaattgcattaatgagtagtaggaggaaaacaaataagcaaattttaatgtggttggaacatgttcctgagttgtatgaagggagacaggtaaattgagagtaatgttatgattgtttcatttgttggaaataaggaaaacttgcatggtttgaattgtggaacaataggtggtgtatgttaggagtcagaattatcatttaacatgtaagtttctgttttacttcagataaagaatgtcagctacctttcccatgttagcttctataccttttcttgaggtgaccataaataggtaatattgtctttcactgagattgttttaattagcgaagtgtgctgattaaatgtcttttcttgataaattattagaatgaataaaggatggtatttctagatagccttggttagtcagtgatttgtttaaatttagtgtggataagaatcacctgagggctttttaaacacagtttactgggtcctgaccttagtgtttctggcttattaggtataagtatgagaagttgatttttatcaagtttctagatgctacagatctaggaaccatacttagagtgctattatatgtcttttaatgtacactgatatggaaaaagcaatgatacatcatgttatcgcatattttaaaatgtgatcatgaccagggaatcttgaaagttgtcttatgtaataatgtaaatcaatgtagaataccatatatttttttcttgcaaggttattattaataggaatgactatttgtagccaatgtgttcaaatgcatgggaggacgtaaacacttcataatttcctggaaatacagacatatatcacttaaaataatacatttctaatataaatttaaattatctacgtgatatgaggaaacgagcttatttttgataattttcctagcagtgaatcaactatactcatttgaatctaaattaaattaaatttgagtaaattcagccatttctaaattcagtccatataaattcactttgggtaaaagaagacaaaattcctgaaaacagtagattaaaaaaataacattttaagagcaggtatgatctcaatgaatatagtgtggtaatttctgcctaatacctacccttttggaggaaggaaaggtaatcctgtttgtgtttaatgttaattactgactctttataacttgttttatttatttattgtttgattttaagcatctgcttctggtggacttacatatgttgggtttgggaaatt

SEQ ID NO: 449025 - DNA, 1193 bp, Homo sapiens
gaaaactatattcctgttggaaaatataaggattgcctttcttttcatttggtaggactattgccagagcctactgaatttcatttttgttttctttttcttaagaaacatacaagaaatgcccattccttttaaaatcatcagttattttacattccaaaaatattgcagtgagattcttgtagtcaatgagttctacggactgaatttcacttgtggcagctcaaatgtttctgtgacaactaatccaatgtgtgccttcactcaaggaattcaattcattgagaaaacctgcccaggtgcaacatctagattcacaatgaactttctgattttgtattcatttattccagctcttgtcatcctaggaatagttgttttcaaaataagggatcatctcattagcaggtagtgaaagccatggctgggaaaatggaagtgaagctgccgactgtgcatgactgctctgaacgtctgaaatgagagtgccatgtatttctttcttgacaggacatctcaagtcttttaaccattaagactccatttgtgcctcttggatccaagcaggccttgaatgcaatggaagtggtttatagtcccttgctcttacaacttgcagggacatgtggttatttggaaattgtgactgagcggacccaagaatgtaaataatattcataaacctatgggagactcgtgtgactattttttttccttgttctaggcacagaaaaaaataggtcagcttaaaaatatgtttacattggataaaggattaggcaaaaataaaatgtttcaaggattcctgaccataagtgacagagaaagagagttgtgggtttagatgaagcaaggttatcatgcagaattgggtaagaatgcttctgttcctggaagacccagagttaaatgcagatgtccacacgaggggtcggagttacctgatcacatcgagagagtgctgggcagatggatggtgagcaccactgctacagagcacccagtgattttactgaggattaaaataaaaaaccgtaggaatgggctcaacagtgaacaaagcacaccagacaaacctctggttatgtttttaaagattcgtttgctatttttcactttcagctgagtttacttataggcacattgtgcacatgtaccctaaaacttaaagtataaaaaaaaaaaaacctacc

SEQ ID NO: 449026 - DNA, 1644 bp, Homo sapiens
taggtaggtgtggtgttggctaggcagaacatggttatttatgaagatgcctgtagagttcaacaagcctgcttactgcggttagttgtgaccattgtctaagtaatttaatgttttcctatgagagctgaaggagccgtgaaagggaaaaggtggctcccaatgagttgcagccaatgggaacaatttgatataataaatagtctcatgttgactcctttccaaaacggcctttcaaaggggagtgtggcttgccctgcaaacttctcccacccactcaccacaaaggatttattcacagaggcaagtgcagtatttttcttaaatgatagcccttggagaggaaactaaagagcttatgcttttctaggacgctgggcttacatcctgaggttgcccgatttggatatttttctgctgctctcttggccccccacttaattggtgaatttctaactcttgtgctacttggtatcgtccaaaatccaaatatagtcaacagtgtagtggctctgctgtccattgcgggggtgcttgttggatctggattcctcagaaacatacaagaaatgcccattccttttaaaatcatcagttattttacattccaaaaatattgcagtgagattcttgtagtcaatgagttctacggactgaatttcacttgtggcagctcaaatgtttctgtgacaactaatccaatgtgtgccttcactcaaggaattcaattcattgagaaaacctgcccaggtgcaacatctagattcacaatgaactttctgattttgtattcatttattccagctcttgtcatcctaggaatagttgttttcaaaataagggatcatctcattagcaggtagtgaaagccatggctgggaaaatggaagtgaagctgccgactgtgcatgactgctctgaacgtctgaaatgagagtgccatgtatttctttcttgacaggacatctcaagtcttttaaccattaagactccatttgtgcctcttggatccaagcaggccttgaatgcaatggaagtggtttatagtcccttgctcttacaacttgcagggacatgtggttatttggaaattgtgactgagcggacccaagaatgtaaataatattcataaacctatgggagactcgtgtgactattttttttccttgttctaggcacagaaaaaaataggtcagcttaaaaatatgtttacattggataaaggattaggcaaaaataaaatgtttcaaggattcctgaccataagtgacagagaaagagagttgtgggtttagatgaagcaaggttatcatgcagaattgggtaagaatgcttctgttcctggaagacccagagttaaatgcagatgtccacacgaggggtcggagttacctgatcacatcgagagagtgctgggcagatggatggtgagcaccactgctacagagcacccagtgattttactgaggattaaaataaaaaaccgtaggaatgggctcaacagtgaacaaagcacaccagacaaacctctggttatgtttttaaagattcgtttgctatttttcactttcagctgagtttacttataggcacattgtgcacatgtaccctaaaacttaaagtataaaaaaaaaaaaacctacc

SEQ ID NO: 449027 - DNA, 1880 bp, Homo sapiens
aagtcccagtcctgctgtcccaagggactccggggtcaggtggagcaggcagggcagtctgccacgggctccccaactgaagccactctggggagggtccggccaccagaaaatttgcccagctttgctgcctgttggccatgggtgacctctcatctttgacccccggagggtccatgggtctccaagtaaacagaggctcccagagctccctggagggggctcctgccaccgccccggagcctcacagcctgggcatcctccatgcctcctacagcgtcagccaccgcgtgaggccctggtgggacatcacatcttgccggcagcagtggaccaggcagatcctcaaagatgtctccttgtacgtggagagcgggcagatcatgtgcatcctaggaagctcaggctccgggaaaaccacgctgctggacgccatgtccgggaggctggggcgcgcggggaccttcctgggggaggtgtatgtgaacggccgggcgctgcgccgggagcagttccaggactgcttctcctacgtcctgcagagcgacaccctgctgagcagcctcaccgtgcgcgagacgctgcactacaccgcgctgctggccatccgccgcggcaatcccggctccttccagaagaaggtggaggccgtcatggcagagctgagtctgagccatgtggcagaccgactgattggcaactacagcttggggggcatttccacgggtgagcggcgccgggtctccatcgcagcccagctgctccaggatcctaaggtcatgctgtttgatgagccaaccacaggcctggactgcatgactgctaatcagattgtcgtcctcctggtggaactggctcgcaggaaccgaattgtggttctcaccattcaccagccccgttctgagctttttcagctctttgacaaaattgccatcctgagcttcggagagctgattttctgtggcacgccagcggaaatgcttgatttcttcaatgactgcggttacccttgtcctgaacattcaaacccttttgacttctatatggacctgacgtcagtggatacccaaagcaaggaacgggaaatagaaacctccaagagagtccagatgatagaatctgcctacaagaaatcagcaatttgtcataaaactttgaagaatattgaaagaatgaaacacctgaaaacgttaccaatggttcctttcaaaaccaaagattctcctggagttttctctaaactgggtgttctcctgaggagagtgacaagaaacttggtgagaaataagctggcagtgattacgcgtctccttcagaatctgatcatgggtttgttcctccttttcttcgttctgcgggtccgaagcaatgtgctaaagggtgctatccaggaccgcgtaggtctcctttaccagtttgtgggcgccaccccgtacacaggcatgctgaacgctgtgaatctgtttcccgtgctgcgagctgtcagcgaccaggagagtcaggacggcctctaccagaagtggcagatgatgctggcctatgcactgcacgtcctccccttcagcgttgttgccaccatgattttcagcagtgtgtgctactggacgctgggcttacatcctgaggttgcccgatttggatatttttctgctgctctcttggccccccacttaattggtgaatttctaactcttgtgctacttggtatcgtccaaaatccaaatatagtcaacagtgtagtggctctgctgtccattgcgggggtgcttgttggatctggattcctcagaaacatacaagaaatgcccattccttttaatgagttctacggacttgatttcacttgtggcagctctgtttctgtgacaacttccctgtgt

SEQ ID NO: 449028 - DNA, 387 bp, Homo sapiens
cttgtcctgaacattcaaacccttttgacttctatagtaagtttttctttcacattccccatcatgaatgttttttaaactttctcatctcagacttctgcctggatgacaccagtctagtggatttgatttttgcttttgtttttgtgttttatactcttcaaggaatcaatttggccgggtcaatgaacttgccagagatgactatcagaatgaggtcagggatctctctcaaacaaactggcgcactgctactactttatcagagcataattagctgagcttctgaattctcccagacaatcccaatgggatcctcaaggccctgctgggatgctttaaagtattctgattttataggtgggcattaaccacaaattttatctt

SEQ ID NO: 449029 - DNA, 2877 bp, Homo sapiens
aagtcccagtcctgctgtcccaagggactccggggtcaggtggagcaggcagggcagtctgccacgggctccccaactgaagccactctggggagggtccggccaccagaaaatttgcccagctttgctgcctgttggccatgggtgacctctcatctttgacccccggagggtccatgggtctccaagtaaacagaggctcccagagctccctggagggggctcctgccaccgccccggagcctcacagcctgggcatcctccatgcctcctacagcgtcagccaccgcgtgaggccctggtgggacatcacatcttgccggcagcagtggaccaggcagatcctcaaagatgtctccttgtacgtggagagcgggcagatcatgtgcatcctaggaagctcaggctccgggaaaaccacgctgctggacgccatgtccgggaggctggggcgcgcggggaccttcctgggggaggtgtatgtgaacggccgggcgctgcgccgggagcagttccaggactgcttctcctacgtcctgcagagcgacaccctgctgagcagcctcaccgtgcgcgagacgctgcactacaccgcgctgctggccatccgccgcggcaatcccggctccttccagaagaaggtggaggccgtcatggcagagctgagtctgagccatgtggcagaccgactgattggcaactacagcttggggggcatttccacgggtgagcggcgccgggtctccatcgcagcccagctgctccaggatcctaaggtcatgctgtttgatgagccaaccacaggcctggactgcatgactgctaatcagattgtcgtcctcctggtggaactggctcgcaggaaccgaattgtggttctcaccattcaccagccccgttctgagctttttcagctctttgacaaaattgccatcctgagcttcggagagctgattttctgtggcacgccagcggaaatgcttgatttcttcaatgactgcggttacccttgtcctgaacattcaaacccttttgacttctatatggacctgacgtcagtggatacccaaagcaaggaacgggaaatagaaacctccaagagagtccagatgatagaatctgcctacaagaaatcagcaatttgtcataaaactttgaagaatattgaaagaatgaaacacctgaaaacgttaccaatggttcctttcaaaaccaaagattctcctggagttttctctaaactgggtgttctcctgaggagagtgacaagaaacttggtgagaaataagctggcagtgattacgcgtctccttcagaatctgatcatgggtttgttcctccttttcttcgttctgcgggtccgaagcaatgtgctaaagggtgctatccaggaccgcgtaggtctcctttaccagtttgtgggcgccaccccgtacacaggcatgctgaacgctgtgaatctgtttcccgtgctgcgagctgtcagcgaccaggagagtcaggacggcctctaccagaagtggcagatgatgctggcctatgcactgcacgtcctccccttcagcgttgttgccaccatgattttcagcagtgtgtgctactggacgctgggcttacatcctgaggttgcccgatttggatatttttctgctgctctcttggccccccacttaattggtgaatttctaactcttgtgctacttggtatcgtccaaaatccaaatatagtcaacagtgtagtggctctgctgtccattgcgggggtgcttgttggatctggattcctcagaaacatacaagaaatgcccattccttttaaaatcatcagttattttacattccaaaaatattgcagtgagattcttgtagtcaatgagttctacggactgaatttcacttgtggcagctcaaatgtttctgtgacaactaatccaatgtgtgccttcactcaaggaattcaattcattgagaaaacctgcccaggtgcaacatctagattcacaatgaactttctgattttgtattcatttattccagctcttgtcatcctaggaatagttgttttcaaaataagggatcatctcattagcaggtagtgaaagccatggctgggaaaatggaagtgaagctgccgactgtgcatgactgctctgaacgtctgaaatgagagtgccatgtatttctttcttgacaggacatctcaagtcttttaaccattaagactccatttgtgcctcttggatccaagcaggccttgaatgcaatggaagtggtttatagtcccttgctcttacaacttgcagggacatgtggttatttggaaattgtgactgagcggacccaagaatgtaaataatattcataaacctatgggagactcgtgtgactattttttttccttgttctaggcacagaaaaaaataggtcagcttaaaaatatgtttacattggataaaggattaggcaaaaataaaatgtttcaaggattcctgaccataagtgacagagaaagagagttgtgggtttagatgaagcaaggttatcatgcagaattgggtaagaatgcttctgttcctggaagacccagagttaaatgcagatgtccacacgaggggtcggagttacctgatcacatcgagagagtgctgggcagatggatggtgagcaccactgctacagagcacccagtgattttactgaggattaaaataaaaaaccgtaggaatgggctcaacagtgaacaaagcacaccagacaaacctctggttatgtttttaaagattcgtttgctatttttcactttcagctgagtttacttataggcacattgtgcacatgtaccctaaaacttaaagtataaaaaaaaaaaaacctacc

SEQ ID NO: 449030 - DNA, 3263 bp, Homo sapiens
gaattccggcaggcgcccatggcgggctgagtcctgcccatgccctggtggcctggaagcctgcatgggcgccgtgcaaagatcaacgttttccagaggagcttttgggctcatcactggcctggggagggcttgacacggggttcccacagcttgccccacaccaccttcacacccacacacagcaggtccccgcggggccggtgcaggctgtggctgcccgcgctgcgctgttgctctgtcccggctggctggctccgagtgtggggcgctctgggccggggccgctggggcgcgcacagtggggtgacaggcggcctggctgcagaaacgttgcaccggtgcctgaggtgggaggatgtgatgacgcggcccacgcagcgggaacccaggcctttaaaaagcccaggaaacagcctcagctcaagcggtggctccactggaggaaaacacaccccggtctcacattaaagaagccaaactgtcggcttcaaagagaaaaggcaacatcctgtcacaggccatgctctggcaaaaacccacagctccggagcaagccccagccccggcccggccataccagggcgtccgtgtgaaggagccagtgaaggaactgctgaggaggaagcgaggccacgccagcagtggggcagcacctgcacctacggcggtggtgctgccccatcagcccctggcgacctacaccacagtgggtccttcctgcctggacatggaaggttctgtgtctgcagtgacagaggaggctgccctgtgtgccggctggctctcccagcccaccccggccaccctgcagcccctggccccatggacaccttacaccgagtatgtgccccatgaagctgtcagctgcccctactcagctgacatgtatgtgcagcccgtgtgccccagctacacggtggtggggccctcctcagtgttgacctatgcctctccgccactcatcaccaatgtcacgacaagaagctccgccacgcccgcagtggggcccccgctggagggcccagagcaccaggcacccctcacctatttcccgtggcctcagcccctttccacactacccacctccaccctgcagtaccagcctccggccccagccctacctgggccccagtttgtccagctccccatctctatcccagagccagtccttcaggacatggaagaccccagaagagccgccagctcgttgaccatcgacaagctgcttttggaggaagaggatagcgacgcctatgcgcttaaccacactctctctgtggaaggcttttaggcgtggctcccacctgagtcctgttccctgaaactgggattttaaaatgagcctggaattgagccccaggttcatgcttgtttggagtagtcatttcatgactacactttctacgcacagctagaattgtagacctgtaaaccttccttcccttcttccttcccctccctccctcacttcctccctctcccccatccttccattcttcccctccctcccttcttcctttccaaccccttccttccttttcctccctcccttccttccctccttcccttctccctttccaaccccttccttccttttcctccctcccttccttccctccttcccttctccctttccttctttacctccctccctccctcgcttcttctctctttcttacttcttttttcaattctgttccattttgggaggtaattatagggattttagcaataacattttatgtcaaatgttgccaagtctgtggtccatgggctttcatttctgtcacatttcatttcttggaaaaggcctccttcctccagtgcctgctgaaccatcttagggtcactcacaccctctgtaattttaagatgtatgtggtggccggcgggaagaccagccccgacagcacctcctgagaaagtcagccaagggcctaccctgatgccagagtccttgagctgtcagttcccacagttgctcctttgtttgctcttctcagcctcggccagatttacagtccaggcagcaaaatctcaaggcctggggctcagagtagtaaggggtgggaagtgggtggcagggagaaaagaacatcagggtgggtggggacaggccagtgacgaagagagggacagaggagggatgggaacaggctgtgcatcttagttggagagaggggtgtgggaggaagcttgagtttgatgcagggaggaggaaggctgaggaatgacttggctccagattacttggttattaagaagaacaataaactaaaggaaagcattgcttgaagagatggttttgctgctctccttgaggatacgtgcaagggaagttgggctgttgtaaacagggtgaagggtgtgtttggtcggccatttctgtctcacctctaggccctctgctggtgctgtggaggccaagaccccattaagcctaaaggtgatgggtcctcgcctaggcttagtgctaccatgtgggttttgtttctttccttccttccttccttccttccttccttccttccttccttccttccttcctctctctttctttcttttttttggttttttttgggacggagtctcactccattgcccaggctggagtacaatggtgcgatcttggctcactgcacctctgtctcccaagttcaagtgattctcctgcctgagcctcccgagtagctgggattacaggtgcatgccaccatgcctggctaatttttgtatttttagtagagacggggtttcaccatgttggccaggctggtctcgaactcctgaccttgtgatccgcccgcctcagcctctcagagtgctgggatcacaggcgtgagccaccgcacccagccttttaccatgtgggtttctttagtgtcttaaaagcgtccataagccaccattctgtggaaccaaggccccctccacgcaaacaccctccctcctggggacctctggagcctcagccagaagtaccattaggtttaattttaatttgttttgctggagaaacatcaggtttgtaggagactgagttgttagcaggtgtgcttagctcttgatagtgaacgtgtaccttgggaactggctcacccacctgctaatagcaccatcgtcactattaagcagacatttcagttggtagaatccatgtagaagtcatggacttttctgggaaatgacttttctgggaaatgacagtttctttgacatattttctttgcccactttaaataaaaactctggagaaagtt

SEQ ID NO: 449031 - DNA, 3516 bp, Homo sapiens
gaattccggcaggcgcccatggcgggctgagtcctgcccatgccctggtggcctggaagcctgcatgggcgccgtgcaaagatcaacgttttccagaggagcttttgggctcatcactggcctggggagggcttgacacggggttcccacagcttgccccacaccaccttcacacccacacacagcaggtccccgcggggccggtgcaggctgtggctgcccgcgctgcgctgttgctctgtcccggctggctggctccgagtgtggggcgctctgggccggggccgctggggcgcgcacagtggggtgacaggcggcctggctgcagaaacgttgcaccggtgcctgaggtgggaggatgtgatgacgcggcccacgcagcgggaacccaggcctttaaaaagcccaggaaacagcctcagctcaagcggtggctccactggaggaaaacacaccccggtctcacattaaagaagccaaactgtcggcttcaaagagaaaaggcaacatcctgtcacaggccatgctctggcaaaaacccacagctccggagcaagccccagccccggcccggccataccagggcgtccgtgtgaaggagccagtgaaggaactgctgaggaggaagcgaggccacgccagcagtggggcagcacctgcacctacggcggtggtgctgccccatcagcccctggcgacctacaccacagtgggtccttcctgcctggacatggaaggttctgtgtctgcagtgacagaggaggctgccctgtgtgccggctggctctcccagcccaccccggccaccctgcagcccctggccccatggacaccttacaccgagtatgtgccccatgaagctgtcagctgcccctactcagctgacatgtatgtgcagcccgtgtgccccagctacacggtggtggggccctcctcagtgttgacctatgcctctccgccactcatcaccaatgtcacgacaagaagctccgccacgcccgcagtggggcccccgctggagggcccagagcaccaggcacccctcacctatttcccgtggcctcagcccctttccacactacccacctccaccctgcagtaccagcctccggccccagccctacctgggccccagtttgtccagctccccatctctatcccagagccagtccttcaggacatggaagaccccagaagagccgccagctcgttgaccatcgacaagctgcttttggaggaagaggatagcgacgcctatgcgcttaaccacactctctctgtggaaggcttttaggcgtggctcccacctgagtcctgttccctgaaactgggattttaaaatgagcctggaattgagccccaggttcatgcttgtttggagtagtcatttcatgactacactttctacgcacagctagaattgtagacctgtaaaccttccttcccttcttccttcccctccctccctcacttcctccctctcccccatccttccattcttcccctccctcccttcttcctttccaaccccttccttccttttcctccctcccttccttccctccttcccttctccctttccaaccccttccttccttttcctccctcccttccttccctccttcccttctccctttccttctttacctccctccctccctcgcttcttctctctttcttacttcttttttcaattctgttccattttgggaggtaattatagggattttagcaataacattttatgtcaaatgttgccaagtctgtggtccatgggctttcatttctgtcacatttcatttcttggaaaaggcctccttcctccagtgcctgctgaaccatcttagggtcactcacaccctctgtaattttaagatgtatgtggtggccggcgggaagaccagccccgacagcacctcctgagaaagtcagccaagggcctaccctgatgccagagtccttgagctgtcagttcccacagttgctcctttgtttgctcttctcagcctcggccagatttacagtccaggcagcaaaatctcaaggcctggggctcagagtagtaaggggtgggaagtgggtggcagggagaaaagaacatcagggtgggtggggacaggccagtgacgaagagagggacagaggagggatgggaacaggctgtgcatcttagttggagagaggggtgtgggaggaagcttgagtttgatgcagggaggaggaaggctgaggaatgacttggctccagattacttggttattaagaagaacaataaactaaaggaaagcattgcttgaagagatggttttgctgctctccttgaggatacgtgcaagggaagttgggctgttgtaaacagggtgaagggtgtgtttggtcggccatttctgtctcacctctaggccctctgctggtgctgtggaggccaagaccccattaagcctaaaggtgatgggtcctcgcctaggcttagtgctaccatgtgggttttgtttctttccttccttccttccttccttccttccttccttccttccttccttccttccttccttccttccttctttccttccttccttccttccttccttcctctctctttctttcttttttttggttttttttgggacggagtctcactccattgcccaggctggagtacaatggtgcgatcttggctcactgcacctctgtctcccaagttcaagtgattctcctgcctgagcctcccgagtagctgggattacaggtgcatgccaccatgcctggctaatttttgtatttttagtagagacggggtttcaccatgttggccaggctggtctcgaactcctgaccttgtgatccgcccgcctcagcctctcagagtgctgggatcacaggcgtgagccaccgcacccagccttttaccatgtgggtttctttagtgtcttaaaagcgtccataagccaccattctgtggaaccaaggccccctccacgcaaacaccctccctcctggggacctctggagcctcagccagaagtaccattaggtttaattttaatttgttttgctggagaaacatcaggtttgtaggagactgagttgttagcaggtgtgcttagctcttgatagtgaacgtgtaccttgggaactggctcacccacctgctaatagcaccatcgtcactattaagcagacatttcagttggtagaatccatgtagaagtcatggacttttctgggaaatgacttttctgggaaatgacagtttctttgacatattttctttgcccactttaaataaaaactctggagaaagttaaaaaaaaaaaaaaaaaaaaaaaaaacccggggggctcattagggcggggggggaacaacgcgcggcaccaacaggggcccgtgggcacaaacggtgatcccgagacccaaggttccggggcaccaacgggggcacaactcggggggtcccccataatggggaccccgataaaccccagaaacccgggtacccggctagaactcgcaaa

SEQ ID NO: 449032 - DNA, 3386 bp, Homo sapiens
gaattccggcaggcgcccatggcgggctgagtcctgcccatgccctggtggcctggaagcctgcatgggcgccgtgcaaagatcaacgttttccagaggagcttttgggctcatcactggcctggggagggcttgacacggggttcccacagcttgccccacaccaccttcacacccacacacagcaggtccccgcggggccggtgcaggctgtggctgcccgcgctgcgctgttgctctgtcccggctggctggctccgagtgtggggcgctctgggccggggccgctggggcgcgcacagtggggtgacaggcggcctggctgcagaaacgttgcaccggtgcctgaggtgggaggatgtgatgacgcggcccacgcagcgggaacccaggcctttaaaaagcccaggaaacagcctcagctcaagcggtggctccactggaggaaaacacaccccggtctcacattaaagaagccaaactgtcggcttcaaagagaaaaggcaacatcctgtcacaggccatgctctggcaaaaacgcgatggagcagcggcagcctatcctttctgggacaatggcagctgaccctgttgtgagtgctgtgtggatgagagcagccacagctccggagcaagccccagccccggcccggccataccagggcgtccgtgtgaaggagccagtgaaggaactgctgaggaggaagcgaggccacgccagcagtggggcagcacctgcacctacggcggtggtgctgccccatcagcccctggcgacctacaccacagtgggtccttcctgcctggacatggaaggttctgtgtctgcagtgacagaggaggctgccctgtgtgccggctggctctcccagcccaccccggccaccctgcagcccctggccccatggacaccttacaccgagtatgtgccccatgaagctgtcagctgcccctactcagctgacatgtatgtgcagcccgtgtgccccagctacacggtggtggggccctcctcagtgttgacctatgcctctccgccactcatcaccaatgtcacgacaagaagctccgccacgcccgcagtggggcccccgctggagggcccagagcaccaggcacccctcacctatttcccgtggcctcagcccctttccacactacccacctccaccctgcagtaccagcctccggccccagccctacctgggccccagtttgtccagctccccatctctatcccagagccagtccttcaggacatggaagaccccagaagagccgccagctcgttgaccatcgacaagctgcttttggaggaagaggatagcgacgcctatgcgcttaaccacactctctctgtggaaggcttttaggcgtggctcccacctgagtcctgttccctgaaactgggattttaaaatgagcctggaattgagccccaggttcatgcttgtttggagtagtcatttcatgactacactttctacgcacagctagaattgtagacctgtaaaccttccttcccttcttccttcccctccctccctcacttcctccctctcccccatccttccattcttcccctccctcccttcttcctttccaaccccttccttccttttcctccctcccttccttccctccttcccttctccctttccaaccccttccttccttttcctccctcccttccttccctccttcccttctccctttccttctttacctccctccctccctcgcttcttctctctttcttacttcttttttcaattctgttccattttgggaggtaattatagggattttagcaataacattttatgtcaaatgttgccaagtctgtggtccatgggctttcatttctgtcacatttcatttcttggaaaaggcctccttcctccagtgcctgctgaaccatcttagggtcactcacaccctctgtaattttaagatgtatgtggtggccggcgggaagaccagccccgacagcacctcctgagaaagtcagccaagggcctaccctgatgccagagtccttgagctgtcagttcccacagttgctcctttgtttgctcttctcagcctcggccagatttacagtccaggcagcaaaatctcaaggcctggggctcagagtagtaaggggtgggaagtgggtggcagggagaaaagaacatcagggtgggtggggacaggccagtgacgaagagagggacagaggagggatgggaacaggctgtgcatcttagttggagagaggggtgtgggaggaagcttgagtttgatgcagggaggaggaaggctgaggaatgacttggctccagattacttggttattaagaagaacaataaactaaaggaaagcattgcttgaagagatggttttgctgctctccttgaggatacgtgcaagggaagttgggctgttgtaaacagggtgaagggtgtgtttggtcggccatttctgtctcacctctaggccctctgctggtgctgtggaggccaagaccccattaagcctaaaggtgatgggtcctcgcctaggcttagtgctaccatgtgggttttgtttctttccttccttccttccttccttccttccttccttccttccttccttccttccttccttccttccttctttccttccttccttccttccttccttcctctctctttctttcttttttttggttttttttgggacggagtctcactccattgcccaggctggagtacaatggtgcgatcttggctcactgcacctctgtctcccaagttcaagtgattctcctgcctgagcctcccgagtagctgggattacaggtgcatgccaccatgcctggctaatttttgtatttttagtagagacggggtttcaccatgttggccaggctggtctcgaactcctgaccttgtgatccgcccgcctcagcctctcagagtgctgggatcacaggcgtgagccaccgcacccagccttttaccatgtgggtttctttagtgtcttaaaagcgtccataagccaccattctgtggaaccaaggccccctccacgcaaacaccctccctcctggggacctctggagcctcagccagaagtaccattaggtttaattttaatttgttttgctggagaaacatcaggtttgtaggagactgagttgttagcaggtgtgcttagctcttgatagtgaacgtgtaccttgggaactggctcacccacctgctaatagcaccatcgtcactattaagcagacatttcagttggtagaatccatgtagaagtcatggacttttctgggaaatgacttttctgggaaatgacagtttctttgacatattttctttgcccactttaaataaaaactctggagaaagtt

SEQ ID NO: 449033 - DNA, 3307 bp, Homo sapiens
gaattccggcaggcgcccatggcgggctgagtcctgcccatgccctggtggcctggaagcctgcatgggcgccgtgcaaagatcaacgttttccagaggagcttttgggctcatcactggcctggggagggcttgacacggggttcccacagcttgccccacaccaccttcacacccacacacagcaggtccccgcggggccggtgcaggctgtggctgcccgcgctgcgctgttgctctgtcccggctggctggctccgagtgtggggcgctctgggccggggccgctggggcgcgcacagtggggtgacaggcggcctggctgcagaaacgttgcaccggtgcctgaggtgggaggatgtgatgacgcggcccacgcagcgggaacccaggcctttaaaaagcccaggaaacagcctcagctcaagcggtggctccactggaggaaaacacaccccggtctcacattaaagaagccaaactgtcggcttcaaagagaaaaggcaacatcctgtcacaggccatgctctggcaaaaacccacagctccggagcaagccccagccccggcccggccataccagggcgtccgtgtgaaggagccagtgaaggaactgctgaggaggaagcgaggccacgccagcagtggggcagcacctgcacctacggcggtggtgctgccccatcagcccctggcgacctacaccacagtgggtccttcctgcctggacatggaaggttctgtgtctgcagtgacagaggaggctgccctgtgtgccggctggctctcccagcccaccccggccaccctgcagcccctggccccatggacaccttacaccgagtatgtgccccatgaagctgtcagctgcccctactcagctgacatgtatgtgcagcccgtgtgccccagctacacggtggtggggccctcctcagtgttgacctatgcctctccgccactcatcaccaatgtcacgacaagaagctccgccacgcccgcagtggggcccccgctggagggcccagagcaccaggcacccctcacctatttcccgtggcctcagcccctttccacactacccacctccaccctgcagtaccagcctccggccccagccctacctgggccccagtttgtccagctccccatctctatcccagagccagtccttcaggacatggaagaccccagaagagccgccagctcgttgaccatcgacaagctgcttttggaggaagaggatagcgacgcctatgcgcttaaccacactctctctgtggaaggcttttaggcgtggctcccacctgagtcctgttccctgaaactgggattttaaaatgagcctggaattgagccccaggttcatgcttgtttggagtagtcatttcatgactacactttctacgcacagctagaattgtagacctgtaaaccttccttcccttcttccttcccctccctccctcacttcctccctctcccccatccttccattcttcccctccctcccttcttcctttccaaccccttccttccttttcctccctcccttccttccctccttcccttctccctttccaaccccttccttccttttcctccctcccttccttccctccttcccttctccctttccttctttacctccctccctccctcgcttcttctctctttcttacttcttttttcaattctgttccattttgggaggtaattatagggattttagcaataacattttatgtcaaatgttgccaagtctgtggtccatgggctttcatttctgtcacatttcatttcttggaaaaggcctccttcctccagtgcctgctgaaccatcttagggtcactcacaccctctgtaattttaagatgtatgtggtggccggcgggaagaccagccccgacagcacctcctgagaaagtcagccaagggcctaccctgatgccagagtccttgagctgtcagttcccacagttgctcctttgtttgctcttctcagcctcggccagatttacagtccaggcagcaaaatctcaaggcctggggctcagagtagtaaggggtgggaagtgggtggcagggagaaaagaacatcagggtgggtggggacaggccagtgacgaagagagggacagaggagggatgggaacaggctgtgcatcttagttggagagaggggtgtgggaggaagcttgagtttgatgcagggaggaggaaggctgaggaatgacttggctccagattacttggttattaagaagaacaataaactaaaggaaagcattgcttgaagagatggttttgctgctctccttgaggatacgtgcaagggaagttgggctgttgtaaacagggtgaagggtgtgtttggtcggccatttctgtctcacctctaggccctctgctggtgctgtggaggccaagaccccattaagcctaaaggtgatgggtcctcgcctaggcttagtgctaccatgtgggttttgtttctttccttccttccttccttccttccttccttccttccttccttccttccttccttccttccttccttctttccttccttccttccttccttccttcctctctctttctttcttttttttggttttttttgggacggagtctcactccattgcccaggctggagtacaatggtgcgatcttggctcactgcacctctgtctcccaagttcaagtgattctcctgcctgagcctcccgagtagctgggattacaggtgcatgccaccatgcctggctaatttttgtatttttagtagagacggggtttcaccatgttggccaggctggtctcgaactcctgaccttgtgatccgcccgcctcagcctctcagagtgctgggatcacaggcgtgagccaccgcacccagccttttaccatgtgggtttctttagtgtcttaaaagcgtccataagccaccattctgtggaaccaaggccccctccacgcaaacaccctccctcctggggacctctggagcctcagccagaagtaccattaggtttaattttaatttgttttgctggagaaacatcaggtttgtaggagactgagttgttagcaggtgtgcttagctcttgatagtgaacgtgtaccttgggaactggctcacccacctgctaatagcaccatcgtcactattaagcagacatttcagttggtagaatccatgtagaagtcatggacttttctgggaaatgacttttctgggaaatgacagtttctttgacatattttctttgcccactttaaataaaaactctggagaaagtt

SEQ ID NO: 449034 - DNA, 2418 bp, Homo sapiens
gaattccggcaggcgcccatggcgggctgagtcctgcccatgccctggtggcctggaagcctgcatgggcgccgtgcaaagatcaacgttttccagaggagcttttgggctcatcactggcctggggagggcttgacacggggttcccacagcttgccccacaccaccttcacacccacacacagcaggtccccgcggggccggtgcaggctgtggctgcccgcgctgcgctgttgctctgtcccggctggctggctccgagtgtggggcgctctgggccggggccgctggggcgcgcacagtggggtgacaggcggcctggctgcagaaacgttgcaccggtgcctgaggtgggaggatgtgatgacgcggcccacgcagcgggaacccaggcctttaaaaagcccaggaaacagcctcagctcaagcggtggctccactggaggaaaacacaccccggtctcacattaaagaagccaaactgtcggcttcaaagagaaaaggcaacatcctgtcacaggccatgctctggcaaaaacccacagctccggagcaagccccagccccggcccggccataccagggcgtccgtgtgaaggagccagtgaaggaactgctgaggaggaagcgaggccacgccagcagtggggcagcacctgcacctacggcggtggtgctgccccatcagcccctggcgacctacaccacagtgggtccttcctgcctggacatggaaggttctgtgtctgcagtgacagaggaggctgccctgtgtgccggctggctctcccagcccaccccggccaccctgcagcccctggccccatggacaccttacaccgagtatgtgccccatgaagctgtcagctgcccctactcagctgacatgtatgtgcagcccgtgtgccccagctacacggtggtggggccctcctcagtgttgacctatgcctctccgccactcatcaccaatgtcacgacaagaagctccgccacgcccgcagtggggcccccgctggagggcccagagcaccaggcacccctcacctatttcccgtggcctcagcccctttccacactacccacctccaccctgcagtaccagcctccggccccagccctacctgggccccagtttgtccagctccccatctctatcccagagccagtccttcaggacatggaagaccccagaagagccgccagctcgttgaccatcgacaagctgcttttggaggaagaggatagcgacgcctatgcgcttaaccacactctctctgtggaaggcttttaggcgtggctcccacctgagtcctgttccctgaaactgggattttaaaatgagcctggaattgagccccaggttcatgcttgtttggagtagtcatttcatgactacactttctacgcacagctagaattgtagacctgtaaaccttccttcccttcttccttcccctccctccctcacttcctccctctcccccatccttccattcttcccctccctcccttcttcctttccaaccccttccttcctttggccgtcccgtccgcgttcgcgttccgcgtcgcgtgttccgcgttgcgtgcgcgctgttcgcaggcgcggtgtcggttcgcgtttgtgcgtcggggtcgcgcggtttggcgttcgcgggtgccgtatcgcgcgtgtcagtcggcgttgtgcgctgttcgtgtgtaggcgttcgcgcgtcgcgcgttccacattccgaccgtgtacttttcgatacgtaccatatgtgccttaaccgtatgcgtggtttctgctgaacaaaacgtactacgtcggttctccgcgagattactgggggcgcgaagggcattagacgtctagctaagaggcgaagttgtacacagcctagacgttagaagcgaagtagcggctcaagtgggatcgagaagcaatggttttaggaccacgaacaggcttccttggtcggcgattccaccaattgtcgagtccgtagtcgtatcgaagtatcgtccgttggggttaccaaagcacactgtcatgccaagcttatcatcccctagtgagcaaatcaacaggcggcaccagtccacctgtgtacccaatatcccgaaaggaatgggcagcacttggcatgtcgggagcaccacgacaggtacccttcgtctaacagggggggttcatcgacctttcctgaagcagatcacaccatttccatctgcgtacaacacttgtcatcacagagggaaacttcggatcaactaggttcagggggttgggaggcccagcgagatggagcgacaacagtgaacaccaacggatagcgccaccaggaagagcagggagcgacccttaccattgggatggaaacacaatgagtccgagcgggcacctacagaggtggaccacgttgaaggagc

SEQ ID NO: 449035 - DNA, 1044 bp, Homo sapiens
gaattccggcaggcgcccatggcgggctgagtcctgcccatgccctggtggcctggaagcctgcatgggcgccgtgcaaagatcaacgttttccagaggagcttttgggctcatcactggcctggggagggcttgacacggggttcccacagcttgccccacaccaccttcacacccacacacagcaggtccccgcggggccggtgcaggctgtggctgcccgcgctgcgctgttgctctgtcccggctggctggctccgagtgtggggcgctctgggccggggccgctggggcgcgcacagtggggtgacaggcggcctggctgcagaaacgttgcaccggtgcctgaggtgggaggatgtgatgacgcggcccacgcagcgggaacccaggcctttaaaaagcccaggaaacagcctcagctcaagcggtggctccactggaggaaaacacaccccggtctcacattaaagaagccaaactgtcggcttcaaagagaaaaggcaacatcctgtcacaggccatgctctggcaaaaacccacagctccggagcaagccccagccccggcccggccataccagggcgtccgtgtgaaggagccagtgaaggaactgctgaggaggaagcgaggccacgccagcagtggggcagcacctgcacctacggcggtgagagtttgtgtgtgtgagagtgtgagtgtgtgtgtgtgagagagaatgtgtgtgtcagggatagtgtgagagtgtatgtgtgtgtgagagtatgtgtatgcgtgtgtgtatgtgtttgtgtgtgatagagtgtgtgagagtgtgatagtgtgagagaatgtgtatgtgcataagtgtgtgagtgtatgtgtgtgtgagggagtgtgagtgtgtgagtgtatgcatgtgagtgtgtatgtgtttgtgtgtgatggcgtgtgtgagtgtgtgatagtgtgagagagaatgtgtatgtgtcagtgtgtgagaacgtatgtgtgtgagggagtgtgtgtgaagtgtgtgagagtgtgagcgtgtgtgtgagagag

SEQ ID NO: 449036 - DNA, 2134 bp, Homo sapiens
cgagctcgcgggcgactgcctgccaggcagacgctgcagctaagctgcgcggtggctgtggcaggtgagagcctccggaagggaggcggcctctggccccgaccctgctccgcgatcgcccactcgggcgcccggccgggcctggcagggaagggccgccgccgccgccgcgcgtttgcgaggcctggcggggccgcggggcccaggaatggcgtaaggggcccccccagactccgagacggcccgagcgggtcgccggctgtgggacggcggcgtgcccttcctttcctccctcccaggttcgcgcccgagctctgctagccacccgtccgacaacttccggactcccagggacagccctgccatcaaggaagacagcacaggactgggacccacccatgaacccttctcaggacaacccaacagcaccagtggggatgttctcctaagccgcagagggcctgggcacgccatccgtcctccaggaagagccatggtgttaatgcaggacaagggcagctctcagcagtggcctggtctggggggcgagggtggtggcacaggtcccttaagcatgctcagagctgccctgctgctcatcagcctgccatggggggcccaagggacagccagcaccagcctcagcactgctgggggtcacaccgtgccaccgactgggggccgctacttgagcattggagatggctctgtgatggagtttgagtttcctgaggacagtgagggcatcatcgtgatctccagccagtacccaggccaggccaacaggacggcgcctggccccatgctcagggtcacctccctggacacagaggtgctgaccatcaagaacgtgagtgctataacctggggaggcgggggtggctttgtggtgagcatccactcaggcctggctgggctggccccactccacatccagctcgtggacgcccatgaggccccgcccacactgattgaggagcggagagacttctgcatcaaggtctcacctgctgaagacacgcctgccaccctcagcgccgacctggcccacttctcggaaaacccaatcctctacctgctcctgcctcttatctttgtcaacaagtgttcgtttgggtgcaaagtggaactcgaggttctgaaggggctcatgcagagcccccagcccatgctgctgggcctcctgggccagtttctggtcatgcccttgtacgctttcctcatggccaaggtcttcatgctgcccaaggccctggctctgggcctcatcatcacctgctcgtcgcctggcggcggggggagctacctcttcagcctccttcttggaggggacgtcaccctggccatctccatgactttcctctctacggtggctgccactggcttcttgcctctgtcttcggccatctacagccgcctgctcagcatccatgagacgctccacgtgcccatctccaagatcctggggaccctgctgttcattgccatccccatagccgtgggcgtgctgatcaagtccaagctccccaagttctcccagctgctgctgcaggtcgtcaagcccttcagctttgtgctcctcctgggcggcctcttcctggcctatcgcatgggggtcttcatcctggcaggcatccggctacccatcgtactggtgggtatcacggtgcccctggttggcctgttggtgggctactgcctagccacgtgtctgaagctgccagtggcccagcggcggacggtcagcattgaggtaggggtgcagaacagcctgctggccttggccatgctgcagctatccctccgccgccttcaagctgactatgcctcccaggcccccttcattgtggcgctgagcggcacctccgagatgctggccttggtcattggccacttcatctacagcagcctgttcccagttccctgaggcctctgggtcaagctttcatcagccccagcccccacactccaccaaagttctcatgcactatgcactcagaaaaatccaggcttattttttttactgattttttattctccagctttcagtgccaaagaggccatgctgagttaggtaggtgggcgctgcccagaaaatatatttcaataaaagagagaagcaaaaaaaaaacct

SEQ ID NO: 449037 - DNA, 2072 bp, Homo sapiens
  misc_feature (14)..(14): n is a, c, g, or t
  misc_feature (17)..(19): n is a, c, g, or t
  misc_feature (21)..(21): n is a, c, g, or t
  misc_feature (50)..(50): n is a, c, g, or t
tcatgtctggtacnccnnngngttttggatatcgtcgacccacgcgctcnggcagacgctgcagctaagctgcgcggtggctgtggcaggtgagagcctccggaagggaggcggcctctggccccgaccctgctccgcgatcgcccactcgggcgcccggccgggcctggcagggaagggccgccgccgccgccgcgcgtttgcgaggcctggcggggccgcggggcccaggaatggcgtaaggggcccccccagactccgagacggcccgagcgggtcgccggctgtgggacggcggcgtgcccttcctttcctccctcccaggttcgcgcccgagctctgctagccacccgtccgacaacttccggactcccagggacagccctgccatcaaggaagacagcacaggactgggacccacccatgaacccttctcaggacaacccaacagcaccagtggggatgttctcctaagccgcagagggcctgggcacgccatccgtcctccaggaagagccatggtgttaatgcaggacaagggcagctctcagcagtggcctggtctggggggcgagggtggtggcacaggtcccttaagcatgctcagagctgccctgctgctcatcagcctgccatggggggcccaagggacagccagcaccagcctcagcactgctgggggtcacaccgtgccaccgactgggggccgctacttgagcattggagatggctctgtgatggagtttgagtttcctgaggacagtgagggcatcatcgtgatctccagccagtacccaggccaggccaacaggacggcgcctggccccatgctcagggtcacctccctggacacagaggtgctgaccatcaagaacctcgtggacgcccatgaggccccgcccacactgattgaggagcggagagacttctgcatcaaggtctcacctgctgaagacacgcctgccaccctcagcgccgacctggcccacttctcggaaaacccaatcctctacctgctcctgcctcttatctttgtcaacaagtgttcgtttgggtgcaaagtggaactcgaggttctgaaggggctcatgcagagcccccagcccatgctgctgggcctcctgggccagtttctggtcatgcccttgtacgctttcctcatggccaaggtcttcatgctgcccaaggccctggctctgggcctcatcatcacctgctcgtcgcctggcggcggggggagctacctcttcagcctccttcttggaggggacgtcaccctggccatctccatgactttcctctctacggtggctgccactggcttcttgcctctgtcttcggccatctacagccgcctgctcagcatccatgagacgctccacgtgcccatctccaagatcctggggaccctgctgttcattgccatccccatagccgtgggcgtgctgatcaagtccaagctccccaagttctcccagctgctgctgcaggtcgtcaagcccttcagctttgtgctcctcctgggcggcctcttcctggcctatcgcatgggggtcttcatcctggcaggcatccggctacccatcgtactggtgggtatcacggtgcccctggttggcctgttggtgggctactgcctagccacgtgtctgaagctgccagtggcccagcggcggacggtcagcattgaggtaggggtgcagaacagcctgctggccttggccatgctgcagctatccctccgccgccttcaagctgactatgcctcccaggcccccttcattgtggcgctgagcggcacctccgagatgctggccttggtcattggccacttcatctacagcagcctgttcccagttccctgaggcctctgggtcaagctttcatcagccccagcccccacactccaccaaagttctcatgcactatgcactcagaaaaatccaggcttattttttttactgattttttattctccagctttcagtgccaaagaggccatgctgagttaggtaggtgggcgctgcccagaaaatatatttcaataaaagagagaagcaaaaaaaaaacct

SEQ ID NO: 449038 - DNA, 1872 bp, Homo sapiens
  misc_feature (14)..(14): n is a, c, g, or t
  misc_feature (17)..(19): n is a, c, g, or t
  misc_feature (21)..(21): n is a, c, g, or t
  misc_feature (50)..(50): n is a, c, g, or t
tcatgtctggtacnccnnngngttttggatatcgtcgacccacgcgctcnggcagacgctgcagctaagctgcgcggtggctgtggcagggacagccctgccatcaaggaagacagcacaggactgggacccacccatgaacccttctcaggacaacccaacagcaccagtggggatgttctcctaagccgcagagggcctgggcacgccatccgtcctccaggaagagccatggtgttaatgcaggacaagggcagctctcagcagtggcctggtctggggggcgagggtggtggcacaggtcccttaagcatgctcagagctgccctgctgctcatcagcctgccatggggggcccaagggacagccagcaccagcctcagcactgctgggggtcacaccgtgccaccgactgggggccgctacttgagcattggagatggctctgtgatggagtttgagtttcctgaggacagtgagggcatcatcgtgatctccagccagtacccaggccaggccaacaggacggcgcctggccccatgctcagggtcacctccctggacacagaggtgctgaccatcaagaacgtgagtgctataacctggggaggcgggggtggctttgtggtgagcatccactcaggcctggctgggctggccccactccacatccagctcgtggacgcccatgaggccccgcccacactgattgaggagcggagagacttctgcatcaaggtctcacctgctgaagacacgcctgccaccctcagcgccgacctggcccacttctcggaaaacccaatcctctacctgctcctgcctcttatctttgtcaacaagtgttcgtttgggtgcaaagtggaactcgaggttctgaaggggctcatgcagagcccccagcccatgctgctgggcctcctgggccagtttctggtcatgcccttgtacgctttcctcatggccaaggtcttcatgctgcccaaggccctggctctgggcctcatcatcacctgctcgtcgcctggcggcggggggagctacctcttcagcctccttcttggaggggacgtcaccctggccatctccatgactttcctctctacggtggctgccactggcttcttgcctctgtcttcggccatctacagccgcctgctcagcatccatgagacgctccacgtgcccatctccaagatcctggggaccctgctgttcattgccatccccatagccgtgggcgtgctgatcaagtccaagctccccaagttctcccagctgctgctgcaggtcgtcaagcccttcagctttgtgctcctcctgggcggcctcttcctggcctatcgcatgggggtcttcatcctggcaggcatccggctacccatcgtactggtgggtatcacggtgcccctggttggcctgttggtgggctactgcctagccacgtgtctgaagctgccagtggcccagcggcggacggtcagcattgaggtaggggtgcagaacagcctgctggccttggccatgctgcagctatccctccgccgccttcaagctgactatgcctcccaggcccccttcattgtggcgctgagcggcacctccgagatgctggccttggtcattggccacttcatctacagcagcctgttcccagttccctgaggcctctgggtcaagctttcatcagccccagcccccacactccaccaaagttctcatgcactatgcactcagaaaaatccaggcttattttttttactgattttttattctccagctttcagtgccaaagaggccatgctgagttaggtaggtgggcgctgcccagaaaatatatttcaataaaagagagaagcaaaaaaaaaacct

SEQ ID NO: 449039 - DNA, 2524 bp, Homo sapiens
  misc_feature (14)..(14): n is a, c, g, or t
  misc_feature (17)..(19): n is a, c, g, or t
  misc_feature (21)..(21): n is a, c, g, or t
  misc_feature (50)..(50): n is a, c, g, or t
tcatgtctggtacnccnnngngttttggatatcgtcgacccacgcgctcnggcagacgctgcagctaagctgcgcggtggctgtggcaggtgagagcctccggaagggaggcggcctctggccccgaccctgctccgcgatcgcccactcgggcgcccggccgggcctggcagggaagggccgccgccgccgccgcgcgtttgcgaggcctggcggggccgcggggcccaggaatggcgtaaggggcccccccagactccgagacggcccgagcgggtcgccggctgtgggacggcggcgtgcccttcctttcctccctcccaggttcgcgcccgagctctgctagccacccgtccgacaacttccggactcccaggtagggaggagcccctgttagcactgccagttaccccgaacacttggccgttttggaagggccgggactccctcccctgccttgtgggtgcatctgctcaaactctgtcggcccctcaagcagaaatggtgtgggttctgggccaaacccctcttggagtgactcagagccgccagccctactggagggatggggcatggggtggatggcccctagcctttcccttctgagctggtttgtatcaccccggtggcttcagtcctggtgccttcatcttagctcctgtactttgcctctcccaccccactggttttcctgcctccctcttcagaggtaagacacatggctggaccaaggcctccaggggacagccctgccatcaaggaagacagcacaggactgggacccacccatgaacccttctcaggacaacccaacagcaccagtggggatgttctcctaagccgcagagggcctgggcacgccatccgtcctccaggaagagccatggtgttaatgcaggacaagggcagctctcagcagtggcctggtctggggggcgagggtggtggcacaggtcccttaagcatgctcagagctgccctgctgctcatcagcctgccatggggggcccaagggacagccagcaccagcctcagcactgctgggggtcacaccgtgccaccgactgggggccgctacttgagcattggagatggctctgtgatggagtttgagtttcctgaggacagtgagggcatcatcgtgatctccagccagtacccaggccaggccaacaggacggcgcctggccccatgctcagggtcacctccctggacacagaggtgctgaccatcaagaacgtgagtgctataacctggggaggcgggggtggctttgtggtgagcatccactcaggcctggctgggctggccccactccacatccagctcgtggacgcccatgaggccccgcccacactgattgaggagcggagagacttctgcatcaaggtctcacctgctgaagacacgcctgccaccctcagcgccgacctggcccacttctcggaaaacccaatcctctacctgctcctgcctcttatctttgtcaacaagtgttcgtttgggtgcaaagtggaactcgaggttctgaaggggctcatgcagagcccccagcccatgctgctgggcctcctgggccagtttctggtcatgcccttgtacgctttcctcatggccaaggtcttcatgctgcccaaggccctggctctgggcctcatcatcacctgctcgtcgcctggcggcggggggagctacctcttcagcctccttcttggaggggacgtcaccctggccatctccatgactttcctctctacggtggctgccactggcttcttgcctctgtcttcggccatctacagccgcctgctcagcatccatgagacgctccacgtgcccatctccaagatcctggggaccctgctgttcattgccatccccatagccgtgggcgtgctgatcaagtccaagctccccaagttctcccagctgctgctgcaggtcgtcaagcccttcagctttgtgctcctcctgggcggcctcttcctggcctatcgcatgggggtcttcatcctggcaggcatccggctacccatcgtactggtgggtatcacggtgcccctggttggcctgttggtgggctactgcctagccacgtgtctgaagctgccagtggcccagcggcggacggtcagcattgaggtaggggtgcagaacagcctgctggccttggccatgctgcagctatccctccgccgccttcaagctgactatgcctcccaggcccccttcattgtggcgctgagcggcacctccgagatgctggccttggtcattggccacttcatctacagcagcctgttcccagttccctgaggcctctgggtcaagctttcatcagccccagcccccacactccaccaaagttctcatgcactatgcactcagaaaaatccaggcttattttttttactgattttttattctccagctttcagtgccaaagaggccatgctgagttaggtaggtgggcgctgcccagaaaatatatttcaataaaagagagaagcaaaaaaaaaacct

SEQ ID NO: 449040 - DNA, 1139 bp, Homo sapiens
  misc_feature (14)..(14): n is a, c, g, or t
  misc_feature (17)..(19): n is a, c, g, or t
  misc_feature (21)..(21): n is a, c, g, or t
  misc_feature (50)..(50): n is a, c, g, or t
tcatgtctggtacnccnnngngttttggatatcgtcgacccacgcgctcnggcagacgctgcagctaagctgcgcggtggctgtggcaggtgagagcctccggaagggaggcggcctctggccccgaccctgctccgcgatcgcccactcgggcgcccggccgggcctggcagggaagggccgccgccgccgccgcgcgtttgcgaggcctggcggggccgcggggcccaggaatggcgtaaggggcccccccagactccgagacggcccgagcgggtcgccggctgtgggacggcggcgtgcccttcctttcctccctcccaggttcgcgcccgagctctgctagccacccgtccgacaacttccggactcccaggtagggaggagcccctgttagcactgccagttaccccgaacacttggccgttttggaagggccgggactccctcccctgccttgtgggtgcatctgctcaaactctgtcggcccctcaagcagaaatggtgtgggttctgggccaaacccctcttggagtgactcagagccgccagccctactggagggatggggcatggggtggatggcccctagcctttcccttctgagctggtttgtatcaccccggtggcttcagtcctggtgccttcatcttagctcctgtactttgcctctcccaccccactggttttcctgcctccctcttcagaggtaagacacatggctggaccaaggcctccaggggacagccctgccatcaaggaagacagcacaggactgggacccacccatgaacccttctcaggacaacccaacagcaccagtggggatgttctcccaggcccccttcattgtggcgctgagcggcacctccgagatgctggccttggtcattggccacttcatctacagcagcctgttcccagttccctgaggcctctgggtcaagctttcatcagccccagcccccacactccaccaaagttctcatgcactatgcactcagaaaaatccaggcttattttttttactgattttttattctccagctttcagtgccaaagaggccatgctgagttaggtaggtgggcgctgcccagaaaatatatttcaataaaagagagaagcaaaaaaaaaacct

SEQ ID NO: 449041 - DNA, 2047 bp, Homo sapiens
cgagctcgcgggcgactgcctgccaggcagacgctgcagctaagctgcgcggtggctgtggcaggtgagagcctccggaagggaggcggcctctggccccgaccctgctccgcgatcgcccactcgggcgcccggccgggcctggcagggaagggccgccgccgccgccgcgcgtttgcgaggcctggcggggccgcggggcccaggaatggcgtaaggggcccccccagactccgagacggcccgagcgggtcgccggctgtgggacggcggcgtgcccttcctttcctccctcccaggttcgcgcccgagctctgctagccacccgtccgacaacttccggactcccagggacagccctgccatcaaggaagacagcacaggactgggacccacccatgaacccttctcaggacaacccaacagcaccagtggggatgttctcctaagccgcagagggcctgggcacgccatccgtcctccaggaagagccatggtgttaatgcaggacaagggcagctctcagcagtggcctggtctggggggcgagggtggtggcacaggtcccttaagcatgctcagagctgccctgctgctcatcagcctgccatggggggcccaagggacagccagcaccagcctcagcactgctgggggtcacaccgtgccaccgactgggggccgctacttgagcattggagatggctctgtgatggagtttgagtttcctgaggacagtgagggcatcatcgtgatctccagccagtacccaggccaggccaacaggacggcgcctggccccatgctcagggtcacctccctggacacagaggtgctgaccatcaagaacctcgtggacgcccatgaggccccgcccacactgattgaggagcggagagacttctgcatcaaggtctcacctgctgaagacacgcctgccaccctcagcgccgacctggcccacttctcggaaaacccaatcctctacctgctcctgcctcttatctttgtcaacaagtgttcgtttgggtgcaaagtggaactcgaggttctgaaggggctcatgcagagcccccagcccatgctgctgggcctcctgggccagtttctggtcatgcccttgtacgctttcctcatggccaaggtcttcatgctgcccaaggccctggctctgggcctcatcatcacctgctcgtcgcctggcggcggggggagctacctcttcagcctccttcttggaggggacgtcaccctggccatctccatgactttcctctctacggtggctgccactggcttcttgcctctgtcttcggccatctacagccgcctgctcagcatccatgagacgctccacgtgcccatctccaagatcctggggaccctgctgttcattgccatccccatagccgtgggcgtgctgatcaagtccaagctccccaagttctcccagctgctgctgcaggtcgtcaagcccttcagctttgtgctcctcctgggcggcctcttcctggcctatcgcatgggggtcttcatcctggcaggcatccggctacccatcgtactggtgggtatcacggtgcccctggttggcctgttggtgggctactgcctagccacgtgtctgaagctgccagtggcccagcggcggacggtcagcattgaggtaggggtgcagaacagcctgctggccttggccatgctgcagctatccctccgccgccttcaagctgactatgcctcccaggcccccttcattgtggcgctgagcggcacctccgagatgctggccttggtcattggccacttcatctacagcagcctgttcccagttccctgaggcctctgggtcaagctttcatcagccccagcccccacactccaccaaagttctcatgcactatgcactcagaaaaatccaggcttattttttttactgattttttattctccagctttcagtgccaaagaggccatgctgagttaggtaggtgggcgctgcccagaaaatatatttcaataaaagagagaagcaaaaaaaaaacct

SEQ ID NO: 449042 - DNA, 2034 bp, Homo sapiens
  misc_feature (14)..(14): n is a, c, g, or t
  misc_feature (17)..(19): n is a, c, g, or t
  misc_feature (21)..(21): n is a, c, g, or t
  misc_feature (50)..(50): n is a, c, g, or t
tcatgtctggtacnccnnngngttttggatatcgtcgacccacgcgctcnggtgagagcctccggaagggaggcggcctctggccccgaccctgctccgcgatcgcccactcgggcgcccggccgggcctggcagggaagggccgccgccgccgccgcgcgtttgcgaggcctggcggggccgcggggcccaggaatggcgtaaggggcccccccagactccgagacggcccgagcgggtcgccggctgtgggacggcggcgtgcccttcctttcctccctcccaggttcgcgcccgagctctgctagccacccgtccgacaacttccggactcccagggacagccctgccatcaaggaagacagcacaggactgggacccacccatgaacccttctcaggacaacccaacagcaccagtggggatgttctcctaagccgcagagggcctgggcacgccatccgtcctccaggaagagccatggtgttaatgcaggacaagggcagctctcagcagtggcctggtctggggggcgagggtggtggcacaggtcccttaagcatgctcagagctgccctgctgctcatcagcctgccatggggggcccaagggacagccagcaccagcctcagcactgctgggggtcacaccgtgccaccgactgggggccgctacttgagcattggagatggctctgtgatggagtttgagtttcctgaggacagtgagggcatcatcgtgatctccagccagtacccaggccaggccaacaggacggcgcctggccccatgctcagggtcacctccctggacacagaggtgctgaccatcaagaacctcgtggacgcccatgaggccccgcccacactgattgaggagcggagagacttctgcatcaaggtctcacctgctgaagacacgcctgccaccctcagcgccgacctggcccacttctcggaaaacccaatcctctacctgctcctgcctcttatctttgtcaacaagtgttcgtttgggtgcaaagtggaactcgaggttctgaaggggctcatgcagagcccccagcccatgctgctgggcctcctgggccagtttctggtcatgcccttgtacgctttcctcatggccaaggtcttcatgctgcccaaggccctggctctgggcctcatcatcacctgctcgtcgcctggcggcggggggagctacctcttcagcctccttcttggaggggacgtcaccctggccatctccatgactttcctctctacggtggctgccactggcttcttgcctctgtcttcggccatctacagccgcctgctcagcatccatgagacgctccacgtgcccatctccaagatcctggggaccctgctgttcattgccatccccatagccgtgggcgtgctgatcaagtccaagctccccaagttctcccagctgctgctgcaggtcgtcaagcccttcagctttgtgctcctcctgggcggcctcttcctggcctatcgcatgggggtcttcatcctggcaggcatccggctacccatcgtactggtgggtatcacggtgcccctggttggcctgttggtgggctactgcctagccacgtgtctgaagctgccagtggcccagcggcggacggtcagcattgaggtaggggtgcagaacagcctgctggccttggccatgctgcagctatccctccgccgccttcaagctgactatgcctcccaggcccccttcattgtggcgctgagcggcacctccgagatgctggccttggtcattggccacttcatctacagcagcctgttcccagttccctgaggcctctgggtcaagctttcatcagccccagcccccacactccaccaaagttctcatgcactatgcactcagaaaaatccaggcttattttttttactgattttttattctccagctttcagtgccaaagaggccatgctgagttaggtaggtgggcgctgcccagaaaatatatttcaataaaagagagaagcaaaaaaaaaacct

SEQ ID NO: 449043 - DNA, 1329 bp, Homo sapiens
cgagctcgcgggcgactgcctgccaggcagacgctgcagctaagctgcgcggtggctgtggcaggtgagagcctccggaagggaggcggcctctggccccgaccctgctccgcgatcgcccactcgggcgcccggccgggcctggcagggaagggccgccgccgccgccgcgcgtttgcgaggcctggcggggccgcggggcccaggaatggcgtaaggggcccccccagactccgagacggcccgagcgggtcgccggctgtgggacggcggcgtgcccttcctttcctccctcccaggttcgcgcccgagctctgctagccacccgtccgacaacttccggactcccagggacagccctgccatcaaggaagacagcacaggactgggacccacccatgaacccttctcaggacaacccaacagcaccagtggggatgttctcctaagccgcagagggcctgggcacgccatccgtcctccaggaagagccatggtgttaatgcaggacaagggcagctctcagcagtggcctggtctggggggcgagggtggtggcacaggtcccttaagcatgctcagagctgccctgctgctcatcagcctgccatggggggcccaagggacagccagcaccagcctcagcactgctgggggtcacaccgtgccaccgactgggggccgctacttgagcattggagatggctctgtgatggagtttgagtttcctgaggacagtgagggcatcatcgtgatctccagccagtacccaggccaggccaacaggacggcgcctggccccatgctcagggtcacctccctggacacagaggtgctgaccatcaagaacgtgagtgctataacctggggaggcgggggtggctttgtggtgagcatccactcaggcctggctgggctggccccactccacatccagctcgtggacgcccatgaggccccgcccacactgattgaggagcggagagacttctgcatcaaggtctcacctgctgaagacacgcctgccaccctcagcgccgacctggcccacttctcggaaaacccaatcctctacctgctcctgcctcttatctttgtcaacaagtgttcccagttccctgaggcctctgggtcaagctttcatcagccccagcccccacactccaccaaagttctcatgcactatgcactcagaaaaatccaggcttattttttttactgattttttattctccagctttcagtgccaaagaggccatgctgagttaggtaggtgggcgctgcccagaaaatatatttcaataaaagagagaagcaaaaaaaaaacct

SEQ ID NO: 449044 - DNA, 1719 bp, Homo sapiens
gacgtcagcgtgctgacgtcacgggccggaggtcccggggctgctgggtgcgggcggtgggctgcgcgttgtccgctggactgggtcccggtcacgccccgccaagccccgcccctcaggccggggcgcgaccgcggatccgcagttcccgggccagcctggggcggccggccaggaaccacccgttaaggtgtcttctctttagggatggtgaggttggaaaaaggctcctgtaaccctcctccaggatgaaccacctgccagaagacatggagaacgctctcaccgggagccagagctcccatgcttctctgcgcaatatccattccatcaaccccacacaactcatggccaggattgagtcctatgaaggaagggaaaagaaaggcatatctgatgtcaggaggactttctgtttgtttgtcacctttgacctcttattcgtaacattactgtggataatagagttaaatgtgaatggaggcattgagaacacattagagaaggaggtgatgcagtatgactactattcttcatattttgatatatttcttctggcagtttttcgatttaaagtgttaatacttgcatatgctgtgtgcagactgcgccattggtgggcaatagcgttgacaacggcagtgaccagtgcctttttactagcaaaagtgatcctttcgaagcttttctctcaaggggcttttggctatgtgctgcccatcatttcattcatccttgcctggattgagacgtggttcctggatttcaaagtgttacctcaagaagcagaagaagaaaacagactcctgatagttcaggatgcttcagagagggcagcacttatacctggtggtctttctgatggtcagttttattcccctcctgaatccgaagcaggatctgaagaagctgaagaaaaacaggacagtgagaaaccacttttagaactatgagtactacttttgttaaatgtgaaaaaccctcacagaaagtcatcgaggcaaaaagaggcaggcagtggagtctccctgtcgacagtaaagttgaaatggtgacgtccactgctggctttattgaacagctaataaagatttatttattgtaatacctcacagacgttgtaccatatccatgcacatttagttgcctgcctgtggctggtaaggtaatgtcatgattcatcctctcttcagtgagactgagcctgatgtgttaacaaataggtgaagaaagtcttgtgctgtattcctaatcaaaagacttaatatattgaagtaacacttttttagtaagcaagatacctttttatttcaattcacagaatggaatttttttgtttcatgtctcagatttattttgtatttcttttttaacactctacatttcccttgttttttaactcatgcacatgtgctctttgtacagttttaaaaagtgtaataaaatctgacatgtcaatgtggctagttttatttttcttgttttgcattatgtgtatggcctgaagtgttggacttgcaaaaggggaagaaaggaattgcgaatacatgtaaaatgtcaccagacatttgtattatttttatcatgaaatcatgtttttctctgattgttctgaaatgttctaaatactcttattttgaatgcacaaaatgacttaaaccattcatatcatgtttcctttgcgttcagccaatttcaattaaaatgaactaaattata

SEQ ID NO: 449045 - DNA, 791 bp, Homo sapiens
gacgtcagcgtgctgacgtcacgggccggaggtcccggggctgctgggtgcgggcggtgggctgcgcgttgtccgctggactgggtcccggtcacgccccgccaagccccgcccctcaggccggggcgcgaccgcggatccgcagttcccgggccagcctggggcggccggccaggaaccacccgttaaggtgtcttctctttagggatggtgaggttggaaaaaggctcctgtaaccctcctccaggatgaaccacctgccagaagacatggagaacgctctcaccgggagccagagctcccatgcttctctgcgcaatatccattccatcaaccccacacaactcatggccaggattgagtcctatgaaggaagggaaaagaaaggcatatctgatgtcaggaggactttctgtttgtttgtcacctttgacctcttattcgtaacattactgtggataatagagttaaatgtgaatggaggcattgagaacacattagagaaggaggtgatgcagtatgactactattcttcatattttgatatatttcttctggcagtttttcgatttaaagtgttaatacttgcatatgctgtgtgcagactgcgccattggtgggcaatagcggtgagtatgccctgcatgagtgggtcatctcctccagtgctggtggccaagtcctgctctcaacaggcctgggctgggagaagatacagttctaatgcaggtggaatcccaccagctttcctgagtcccgtttcctccatacttaagtaggtttaatactcc

SEQ ID NO: 449046 - DNA, 1775 bp, Homo sapiens
gacgtcagcgtgctgacgtcacgggccggaggtcccggggctgctgggtgcgggcggtgggctgcgcgttgtccgctggactgggtcccggtcacgccccgccaagccccgcccctcaggccggggcgcgaccgcggatccgcagttcccgggccagcctggggcggccggccaggaaccacccgttaagatggaatcactgaattcatcacttgacacagtactagtttggataagtttagcaaggtgtcttctctttagggatggtgaggttggaaaaaggctcctgtaaccctcctccaggatgaaccacctgccagaagacatggagaacgctctcaccgggagccagagctcccatgcttctctgcgcaatatccattccatcaaccccacacaactcatggccaggattgagtcctatgaaggaagggaaaagaaaggcatatctgatgtcaggaggactttctgtttgtttgtcacctttgacctcttattcgtaacattactgtggataatagagttaaatgtgaatggaggcattgagaacacattagagaaggaggtgatgcagtatgactactattcttcatattttgatatatttcttctggcagtttttcgatttaaagtgttaatacttgcatatgctgtgtgcagactgcgccattggtgggcaatagcgttgacaacggcagtgaccagtgcctttttactagcaaaagtgatcctttcgaagcttttctctcaaggggcttttggctatgtgctgcccatcatttcattcatccttgcctggattgagacgtggttcctggatttcaaagtgttacctcaagaagcagaagaagaaaacagactcctgatagttcaggatgcttcagagagggcagcacttatacctggtggtctttctgatggtcagttttattcccctcctgaatccgaagcaggatctgaagaagctgaagaaaaacaggacagtgagaaaccacttttagaactatgagtactacttttgttaaatgtgaaaaaccctcacagaaagtcatcgaggcaaaaagaggcaggcagtggagtctccctgtcgacagtaaagttgaaatggtgacgtccactgctggctttattgaacagctaataaagatttatttattgtaatacctcacagacgttgtaccatatccatgcacatttagttgcctgcctgtggctggtaaggtaatgtcatgattcatcctctcttcagtgagactgagcctgatgtgttaacaaataggtgaagaaagtcttgtgctgtattcctaatcaaaagacttaatatattgaagtaacacttttttagtaagcaagatacctttttatttcaattcacagaatggaatttttttgtttcatgtctcagatttattttgtatttcttttttaacactctacatttcccttgttttttaactcatgcacatgtgctctttgtacagttttaaaaagtgtaataaaatctgacatgtcaatgtggctagttttatttttcttgttttgcattatgtgtatggcctgaagtgttggacttgcaaaaggggaagaaaggaattgcgaatacatgtaaaatgtcaccagacatttgtattatttttatcatgaaatcatgtttttctctgattgttctgaaatgttctaaatactcttattttgaatgcacaaaatgacttaaaccattcatatcatgtttcctttgcgttcagccaatttcaattaaaatgaactaaattata

SEQ ID NO: 449047 - DNA, 1972 bp, Homo sapiens
gacgtcagcgtgctgacgtcacgggccggaggtcccggggctgctgggtgcgggcggtgggctgcgcgttgtccgctggactgggtcccggtcacgccccgccaagccccgcccctcaggccggggcgcgaccgcggatccgcagttcccgggccagcctggggcggccggccaggaaccacccgttaagggtcttactctgttgcccaggctggagtgcagtggcaccatctcagctcactggagcgtctgcctccaggttcaagtgattctcctgcctcagcatcccaagtagctgggactacaggtgtgcactaccactcctgtctaatgtttgtattttttggtagagacagggtttccctatgttggccagtctggtcttgaactgctggcctcaagtgatctgcccgcctcggcctcctaaagtgctgggattacaggtgtcttctctttagggatggtgaggttggaaaaaggctcctgtaaccctcctccaggatgaaccacctgccagaagacatggagaacgctctcaccgggagccagagctcccatgcttctctgcgcaatatccattccatcaaccccacacaactcatggccaggattgagtcctatgaaggaagggaaaagaaaggcatatctgatgtcaggaggactttctgtttgtttgtcacctttgacctcttattcgtaacattactgtggataatagagttaaatgtgaatggaggcattgagaacacattagagaaggaggtgatgcagtatgactactattcttcatattttgatatatttcttctggcagtttttcgatttaaagtgttaatacttgcatatgctgtgtgcagactgcgccattggtgggcaatagcgttgacaacggcagtgaccagtgcctttttactagcaaaagtgatcctttcgaagcttttctctcaaggggcttttggctatgtgctgcccatcatttcattcatccttgcctggattgagacgtggttcctggatttcaaagtgttacctcaagaagcagaagaagaaaacagactcctgatagttcaggatgcttcagagagggcagcacttatacctggtggtctttctgatggtcagttttattcccctcctgaatccgaagcaggatctgaagaagctgaagaaaaacaggacagtgagaaaccacttttagaactatgagtactacttttgttaaatgtgaaaaaccctcacagaaagtcatcgaggcaaaaagaggcaggcagtggagtctccctgtcgacagtaaagttgaaatggtgacgtccactgctggctttattgaacagctaataaagatttatttattgtaatacctcacagacgttgtaccatatccatgcacatttagttgcctgcctgtggctggtaaggtaatgtcatgattcatcctctcttcagtgagactgagcctgatgtgttaacaaataggtgaagaaagtcttgtgctgtattcctaatcaaaagacttaatatattgaagtaacacttttttagtaagcaagatacctttttatttcaattcacagaatggaatttttttgtttcatgtctcagatttattttgtatttcttttttaacactctacatttcccttgttttttaactcatgcacatgtgctctttgtacagttttaaaaagtgtaataaaatctgacatgtcaatgtggctagttttatttttcttgttttgcattatgtgtatggcctgaagtgttggacttgcaaaaggggaagaaaggaattgcgaatacatgtaaaatgtcaccagacatttgtattatttttatcatgaaatcatgtttttctctgattgttctgaaatgttctaaatactcttattttgaatgcacaaaatgacttaaaccattcatatcatgtttcctttgcgttcagccaatttcaattaaaatgaactaaattata

SEQ ID NO: 449048 - DNA, 1436 bp, Homo sapiens
gacgtcagcgtgctgacgtcacgggccggaggtcccggggctgctgggtgcgggcggtgggctgcgcgttgtccgctggactgggtcccggtcacgccccgccaagccccgcccctcaggccggggcgcgaccgcggatccgcagttcccgggccagcctggggcggccggccaggaaccacccgttaaggtgaatggaggcattgagaacacattagagaaggaggtgatgcagtatgactactattcttcatattttgatatatttcttctggcagtttttcgatttaaagtgttaatacttgcatatgctgtgtgcagactgcgccattggtgggcaatagcgttgacaacggcagtgaccagtgcctttttactagcaaaagtgatcctttcgaagcttttctctcaaggggcttttggctatgtgctgcccatcatttcattcatccttgcctggattgagacgtggttcctggatttcaaagtgttacctcaagaagcagaagaagaaaacagactcctgatagttcaggatgcttcagagagggcagcacttatacctggtggtctttctgatggtcagttttattcccctcctgaatccgaagcaggatctgaagaagctgaagaaaaacaggacagtgagaaaccacttttagaactatgagtactacttttgttaaatgtgaaaaaccctcacagaaagtcatcgaggcaaaaagaggcaggcagtggagtctccctgtcgacagtaaagttgaaatggtgacgtccactgctggctttattgaacagctaataaagatttatttattgtaatacctcacagacgttgtaccatatccatgcacatttagttgcctgcctgtggctggtaaggtaatgtcatgattcatcctctcttcagtgagactgagcctgatgtgttaacaaataggtgaagaaagtcttgtgctgtattcctaatcaaaagacttaatatattgaagtaacacttttttagtaagcaagatacctttttatttcaattcacagaatggaatttttttgtttcatgtctcagatttattttgtatttcttttttaacactctacatttcccttgttttttaactcatgcacatgtgctctttgtacagttttaaaaagtgtaataaaatctgacatgtcaatgtggctagttttatttttcttgttttgcattatgtgtatggcctgaagtgttggacttgcaaaaggggaagaaaggaattgcgaatacatgtaaaatgtcaccagacatttgtattatttttatcatgaaatcatgtttttctctgattgttctgaaatgttctaaatactcttattttgaatgcacaaaatgacttaaaccattcatatcatgtttcctttgcgttcagccaatttcaattaaaatgaactaaattata

SEQ ID NO: 449049 - DNA, 1665 bp, Homo sapiens
gacgtcagcgtgctgacgtcacgggccggaggtcccggggctgctgggtgcgggcggtgggctgcgcgttgtccgctggactgggtcccggtcacgccccgccaagccccgcccctcaggccggggcgcgaccgcggatccgcagttcccgggccagcctggggcggccggccaggaaccacccgttaaggtgtcttctctttagggatggtgaggttggaaaaaggctcctgtaaccctcctccaggatgaaccacctgccagaagacatggagaacgctctcaccgggagccagagctcccatgcttctctgcgcaatatccattccatcaaccccacacaactcatggccaggattgagtcctatgaaggaagggaaaagaaaggcatatctgatgtcaggaggactttctgtttgtttgtcacctttgacctcttattcgtaacattactgtggataatagagttaaatgtgaatggaggcattgagaacacattagagaaggaggtgatgcagtatgactactattcttcatattttgatatatttcttctggcagtttttcgatttaaagtgttaatacttgcatatgctgtgtgcagactgcgccattggtgggcaatagcgcttttctctcaaggggcttttggctatgtgctgcccatcatttcattcatccttgcctggattgagacgtggttcctggatttcaaagtgttacctcaagaagcagaagaagaaaacagactcctgatagttcaggatgcttcagagagggcagcacttatacctggtggtctttctgatggtcagttttattcccctcctgaatccgaagcaggatctgaagaagctgaagaaaaacaggacagtgagaaaccacttttagaactatgagtactacttttgttaaatgtgaaaaaccctcacagaaagtcatcgaggcaaaaagaggcaggcagtggagtctccctgtcgacagtaaagttgaaatggtgacgtccactgctggctttattgaacagctaataaagatttatttattgtaatacctcacagacgttgtaccatatccatgcacatttagttgcctgcctgtggctggtaaggtaatgtcatgattcatcctctcttcagtgagactgagcctgatgtgttaacaaataggtgaagaaagtcttgtgctgtattcctaatcaaaagacttaatatattgaagtaacacttttttagtaagcaagatacctttttatttcaattcacagaatggaatttttttgtttcatgtctcagatttattttgtatttcttttttaacactctacatttcccttgttttttaactcatgcacatgtgctctttgtacagttttaaaaagtgtaataaaatctgacatgtcaatgtggctagttttatttttcttgttttgcattatgtgtatggcctgaagtgttggacttgcaaaaggggaagaaaggaattgcgaatacatgtaaaatgtcaccagacatttgtattatttttatcatgaaatcatgtttttctctgattgttctgaaatgttctaaatactcttattttgaatgcacaaaatgacttaaaccattcatatcatgtttcctttgcgttcagccaatttcaattaaaatgaactaaattata

SEQ ID NO: 449050 - DNA, 1140 bp, Homo sapiens
cacagtgtgagatgcctagtgtgaacagtgctggattatgtgtcttgcagttgacaacggcagtgaccagtgcctttttactagcaaaagtgatcctttcgaagcttttctctcaaggggcttttggctatgtgctgcccatcatttcattcatccttgcctggattgagacgtggttcctggatttcaaagtgttacctcaagaagcagaagaagaaaacagactcctgatagttcaggatgcttcagagagggcagcacttatacctggtggtctttctgatggtcagttttattcccctcctgaatccgaagcaggatctgaagaagctgaagaaaaacaggacagtgagaaaccacttttagaactatgagtactacttttgttaaatgtgaaaaaccctcacagaaagtcatcgaggcaaaaagaggcaggcagtggagtctccctgtcgacagtaaagttgaaatggtgacgtccactgctggctttattgaacagctaataaagatttatttattgtaatacctcacagacgttgtaccatatccatgcacatttagttgcctgcctgtggctggtaaggtaatgtcatgattcatcctctcttcagtgagactgagcctgatgtgttaacaaataggtgaagaaagtcttgtgctgtattcctaatcaaaagacttaatatattgaagtaacacttttttagtaagcaagatacctttttatttcaattcacagaatggaatttttttgtttcatgtctcagatttattttgtatttcttttttaacactctacatttcccttgttttttaactcatgcacatgtgctctttgtacagttttaaaaagtgtaataaaatctgacatgtcaatgtggctagttttatttttcttgttttgcattatgtgtatggcctgaagtgttggacttgcaaaaggggaagaaaggaattgcgaatacatgtaaaatgtcaccagacatttgtattatttttatcatgaaatcatgtttttctctgattgttctgaaatgttctaaatactcttattttgaatgcacaaaatgacttaaaccattcatatcatgtttcctttgcgttcagccaatttcaattaaaatgaactaaattata

SEQ ID NO: 449051 - DNA, 872 bp, Homo sapiens
gatgactctagaggatcccgagtgtcttcaagaagcagaagaagaaaacagatctgaagaagctgaagaaaaacaggacagtgagaaaccacttttagaactatgagtactacttttgttaaatgtgaaaaaccctcacagaaagtcatcgaggcaaaaagaggcaggcagtggagtctccctgtcgacagtaaagttgaaatggtgacgtccactgctggctttattgaacagctaataaagatttatttattgtaatacctcacagacgttgtaccatatccatgcacatttagttgcctgcctgtggctggtaaggtaatgtcatgattcatcctctcttcagtgagactgagcctgatgtgttaacaaataggtgaagaaagtcttgtgctgtattcctaatcaaaagacttaatatattgaagtaacacttttttagtaagcaagatacctttttatttcaattcacagaatggaatttttttgtttcatgtctcagatttattttgtatttcttttttaacactctacatttcccttgttttttaactcatgcacatgtgctctttgtacagttttaaaaagtgtaataaaatctgacatgtcaatgtggctagttttatttttcttgttttgcattatgtgtatggcctgaagtgttggacttgcaaaaggggaagaaaggaattgcgaatacatgtaaaatgtcaccagacatttgtattatttttatcatgaaatcatgtttttctctgattgttctgaaatgttctaaatactcttattttgaatgcacaaaatgacttaaaccattcatatcatgtttcctttgcgttcagccaatttcaattaaaatgaactaaattata

SEQ ID NO: 449052 - DNA, 879 bp, Homo sapiens
taccatgtgagcacgtattgctggtcaatggtaccgccctccagtatgcaatcatggacctgactaagctctgtatgaacatggacagtgagaaaccacttttagaactatgagtactacttttgttaaatgtgaaaaaccctcacagaaagtcatcgaggcaaaaagaggcaggcagtggagtctccctgtcgacagtaaagttgaaatggtgacgtccactgctggctttattgaacagctaataaagatttatttattgtaatacctcacagacgttgtaccatatccatgcacatttagttgcctgcctgtggctggtaaggtaatgtcatgattcatcctctcttcagtgagactgagcctgatgtgttaacaaataggtgaagaaagtcttgtgctgtattcctaatcaaaagacttaatatattgaagtaacacttttttagtaagcaagatacctttttatttcaattcacagaatggaatttttttgtttcatgtctcagatttattttgtatttcttttttaacactctacatttcccttgttttttaactcatgcacatgtgctctttgtacagttttaaaaagtgtaataaaatctgacatgtcaatgtggctagttttatttttcttgttttgcattatgtgtatggcctgaagtgttggacttgcaaaaggggaagaaaggaattgcgaatacatgtaaaatgtcaccagacatttgtattatttttatcatgaaatcatgtttttctctgattgttctgaaatgttctaaatactcttattttgaatgcacaaaatgacttaaaccattcatatcatgtttcctttgcgttcagccaatttcaattaaaatgaactaaattata

SEQ ID NO: 449053 - DNA, 683 bp, Homo sapiens
tacaggagataactggtacctgtgacattgattggctctaactacagcttcagtgatggggggatggaaaatgtcccaacccaattgtgctgattcagcacataaagttgcctgcctgtggctggtaaggtaatgtcatgattcatcctctcttcagtgagactgagcctgatgtgttaacaaataggtgaagaaagtcttgtgctgtattcctaatcaaaagacttaatatattgaagtaacacttttttagtaagcaagatacctttttatttcaattcacagaatggaatttttttgtttcatgtctcagatttattttgtatttcttttttaacactctacatttcccttgttttttaactcatgcacatgtgctctttgtacagttttaaaaagtgtaataaaatctgacatgtcaatgtggctagttttatttttcttgttttgcattatgtgtatggcctgaagtgttggacttgcaaaaggggaagaaaggaattgcgaatacatgtaaaatgtcaccagacatttgtattatttttatcatgaaatcatgtttttctctgattgttctgaaatgttctaaatactcttattttgaatgcacaaaatgacttaaaccattcatatcatgtttcctttgcgttcagccaatttcaattaaaatgaactaaattata

SEQ ID NO: 449054 - DNA, 598 bp, Homo sapiens
gcggccgctccaacatcagaatcgtaacattaccttaccagccacaggaggcaactaaatgtgcatggatatggtacaacgtctgtgaggtattacaaataggtgaagaaagtcttgtgctgtattcctaatcaaaagacttaatatattgaagtaacacttttttagtaagcaagatacctttttatttcaattcacagaatggaatttttttgtttcatgtctcagatttattttgtatttcttttttaacactctacatttcccttgttttttaactcatgcacatgtgctctttgtacagttttaaaaagtgtaataaaatctgacatgtcaatgtggctagttttatttttcttgttttgcattatgtgtatggcctgaagtgttggacttgcaaaaggggaagaaaggaattgcgaatacatgtaaaatgtcaccagacatttgtattatttttatcatgaaatcatgtttttctctgattgttctgaaatgttctaaatactcttattttgaatgcacaaaatgacttaaaccattcatatcatgtttcctttgcgttcagccaatttcaattaaaatgaactaaattata

SEQ ID NO: 449055 - DNA, 834 bp, Homo sapiens
gacgtcagcgtgctgacgtcacgggccggaggtcccggggctgctgggtgcgggcggtgggctgcgcgttgtccgctggactgggtcccggtcacgccccgccaagccccgcccctcaggccggggcgcgaccgcggatccgcagttcccgggccagcctggggcggccggccaggaaccacccgttaaggtgtcttctctttagggatggtgaggttggaaaaaggctcctgtaaccctcctccaggatgaaccacctgccagaagacatggagaacgctctcaccgggagccagagctcccatgcttctctgcgcaatatccattccatcaaccccacacaactcatggccaggattgagtcctatgaaggaagggaaaagaaaggcatatctgatgtcaggaggactttctgtttgtttgtcacctttgacctcttattcgtaacattactgtggataatagagttaaatgtgaatggaggcattgagaacacattagagaaggaattgcgaatacatgtaaaatgtcaccagacatttgtattatttttatcatgaaatcatgtttttctctgattgttctgaaatgttctaaatactcttattttgaatgcacaaaatgacttaaaccattcatatcatgtttcctttgcgttcagccaatttcaattaaaatgaactaaattataaaaaaaaaaaaaaaaaaactcgagggggggcccggtacccaaattcccctatagggagtcggttaacaatcaatggccccgcgttttaacaactccgtgacctggggaaaacccccgcggttcccccaactttaatcggcttt

SEQ ID NO: 449056 - DNA, 856 bp, Homo sapiens
cacagtgtgagatgcctagtgtgaacagtgctggattatgtgtcttgcagttgacaacggcagtgaccagtgcctttttactagcaaaagtgatcctttcgaagcttttctctcaaggggcttttggctatgtgctgcccatcatttcattcatccttgcctggattgagacgtggttcctggatttcaaagtgttacctcaagaagcagaagaagaaaacagactcctgatagttcaggatgcttcagagagggcagcacttatacctggtggtctttctgatggtcagttttattcccctcctgaatccgaagcaggatctgaagaagctgaagaaaaacaggacagtgagaaaccacttttagaactatgagtactacttttgttaaatgtgaaaaaccctcacagaaagtcatcgaggcaaaaagaggcaggcagtggagtctccctgtcgacagtaaagttgaaatggtgacgtccactgctggctttattgaacagctaataaagatttatttattgtaatacctcacagacgttgtaccatatccatgcacatttagttgcctgcctgtggctggtaaggtaatgtcatgattcatcctctcttcagtgagactgagcctgatgtgttaacaaataggtgaagaaagtcttgtgctgtattcctaatcaaaagacttaatatattgaagtaacacttttttagtaagcaagatacctttttatttcaattcacagaatggaattttgggtccgggcccaaattttttgggtctcttaaacctcacatcccgtgttaaccaggcacggcctgggcatcacaggttaaaccgcggggggcgcggagcggga

SEQ ID NO: 449057 - DNA, 1842 bp, Homo sapiens
gacgtcagcgtgctgacgtcacgggccggaggtcccggggctgctgggtgcgggcggtgggctgcgcgttgtccgctggactgggtcccggtcacgccccgccaagccccgcccctcaggccggggcgcgaccgcggatccgcagttcccgggccagcctggggcggccggccaggaaccacccgttaaggtgtcttctctttagggatggtgaggttggaaaaaggctcctgtaaccctcctccaggatgaaccacctgccagaagacatggagaacgctctcaccgggagccagagctcccatgcttctctgcgcaatatccattccatcaaccccacacaactcatggccaggattgagtcctatgaaggaagggaaaagaaaggcatatctgatgtcaggaggactttctgtttgtttgtcacctttgacctcttattcgtaacattactgtggataatagagttaaatgtgaatggaggcattgagaacacattagagaaggaggtgatgcagtatgactactattcttcatattttgatatatttcttctggcagtttttcgatttaaagtgttaatacttgcatatgctgtgtgcagactgcgccattggtgggcaatagcgttgacaacggcagtgaccagtgcctttttactagcaaaagtgatcctttcgaagcttttctctcaaggggcttttggctatgtgctgcccatcatttcattcatccttgcctggattgagacgtggttcctggatttcaaagtgttacctcaagaagcagaagaagaaaacagactcctgatagttcaggatgcttcagagagggcagcacttatacctggtggtctttctgatggtcagttttattcccctcctgaatccgaagcaggatctgaagaagctgaagaaaaacaggacagtgagaaaccacttttagaactatgagtactacttttgttaaatgtgaaaaaccctcacagaaagtcatcgaggcaaaaagaggcaggcagtggagtctccctgtcgacagtaaagttgaaatggtgacgtccactgctggctttattgaacagctaataaagatttatttattgtaatacctcacagacgttgtaccatatccatgcacatttagttgcctgcctgtggctggtaaggtaatgtcatgattcatcctctcttcagtgagactgagcctgatgtgttaacaaataggtgaagaaagtcttgtgctgtattcctaatcaaaagacttaatatattgaagtaacacttttttagtaagcaagatacctttttatttcaattcacagaatggaatttttttgtttcatgtctcagatttattttgtatttcttttttaacactctacatttcccttgttttttaactcatgcacatgtgctctttgtacagttttaaaaagtgtaataaaatctgacatgtcaatgtggctagttttatttttcttgttttgcattatgtgtatggcctgaagtgttggacttgcaaaaggggaagaaaggaattgcgaatacatgtaaaatgtcaccagacatttgtattatttttatcatgaaatcatgtttttctctgattgttctgaaatgttctaaatactcttattttgaatgcacaaaatgacttaaaccattcatatcatgtttcctttgcgttcagccaatttcaattaaaatgaactaaattatactgtgtgctgttttttcaaacatgaatattccccttgactcaagggaagtcaggatgtctgttagttttctttcatcattcattgtgtcattgaagaaaaacctaattgcctgtagtggtgat

SEQ ID NO: 449058 - DNA, 1836 bp, Homo sapiens
gacgtcagcgtgctgacgtcacgggccggaggtcccggggctgctgggtgcgggcggtgggctgcgcgttgtccgctggactgggtcccggtcacgccccgccaagccccgcccctcaggccggggcgcgaccgcggatccgcagttcccgggccagcctggggcggccggccaggaaccacccgttaagggtcttactctgttgcccaggctggagtgcagtggcaccatctcagctcactggagcgtctgcctccaggttcaagtgattctcctgcctcagcatcccaagtagctgggactacaggtgtcttctctttagggatggtgaggttggaaaaaggctcctgtaaccctcctccaggatgaaccacctgccagaagacatggagaacgctctcaccgggagccagagctcccatgcttctctgcgcaatatccattccatcaaccccacacaactcatggccaggattgagtcctatgaaggaagggaaaagaaaggcatatctgatgtcaggaggactttctgtttgtttgtcacctttgacctcttattcgtaacattactgtggataatagagttaaatgtgaatggaggcattgagaacacattagagaaggaggtgatgcagtatgactactattcttcatattttgatatatttcttctggcagtttttcgatttaaagtgttaatacttgcatatgctgtgtgcagactgcgccattggtgggcaatagcgttgacaacggcagtgaccagtgcctttttactagcaaaagtgatcctttcgaagcttttctctcaaggggcttttggctatgtgctgcccatcatttcattcatccttgcctggattgagacgtggttcctggatttcaaagtgttacctcaagaagcagaagaagaaaacagactcctgatagttcaggatgcttcagagagggcagcacttatacctggtggtctttctgatggtcagttttattcccctcctgaatccgaagcaggatctgaagaagctgaagaaaaacaggacagtgagaaaccacttttagaactatgagtactacttttgttaaatgtgaaaaaccctcacagaaagtcatcgaggcaaaaagaggcaggcagtggagtctccctgtcgacagtaaagttgaaatggtgacgtccactgctggctttattgaacagctaataaagatttatttattgtaatacctcacagacgttgtaccatatccatgcacatttagttgcctgcctgtggctggtaaggtaatgtcatgattcatcctctcttcagtgagactgagcctgatgtgttaacaaataggtgaagaaagtcttgtgctgtattcctaatcaaaagacttaatatattgaagtaacacttttttagtaagcaagatacctttttatttcaattcacagaatggaatttttttgtttcatgtctcagatttattttgtatttcttttttaacactctacatttcccttgttttttaactcatgcacatgtgctctttgtacagttttaaaaagtgtaataaaatctgacatgtcaatgtggctagttttatttttcttgttttgcattatgtgtatggcctgaagtgttggacttgcaaaaggggaagaaaggaattgcgaatacatgtaaaatgtcaccagacatttgtattatttttatcatgaaatcatgtttttctctgattgttctgaaatgttctaaatactcttattttgaatgcacaaaatgacttaaaccattcatatcatgtttcctttgcgttcagccaatttcaattaaaatgaactaaattata

SEQ ID NO: 449059 - DNA, 1457 bp, Homo sapiens
gacgtcagcgtgctgacgtcacgggccggaggtcccggggctgctgggtgcgggcggtgggctgcgcgttgtccgctggactgggtcccggtcacgccccgccaagccccgcccctcaggccggggcgcgaccgcggatccgcagttcccgggccagcctggggcggccggccaggaaccacccgttaaggtgtcttctctttagggatggtgaggttggaaaaaggctcctgtaaccctcctccaggatgaaccacctgccagaagacatggagaacgctctcaccgggagccagagctcccatgcttctctgcgcaatatccattccatcaaccccacacaactcatggccaggattgagtcctatgaaggaagggaaaagaaaggcatatctgatgtcaggaggactttctgtttgtttgtcacctttgacctcttattcgtaacattactgtggataatagagttaaatgtgaatggaggcattgagaacacattagagaaggaggtgatgcagtatgactactattcttcatattttgatatatttcttctggcagtttttcgatttaaagtgttaatacttgcatatgctgtgtgcagactgcgccattggtgggcaatagcgttgacaacggcagtgaccagtgcctttttactagcaaaagtgatcctttcgaagcttttctctcaaggggcttttggctatgtgctgcccatcatttcattcatccttgcctggattgagacgtggttcctggatttcaaagtgttacctcaagaagcagaagaagaaaacagactcctgatagttcaggatgcttcagagagggcagcacttatacctggtggtctttctgatggtcagttttattcccctcctgaatccgaagcaggatctgaagaagctgaagaaaaacaggacagtgagaaaccacttttagaactatgagtactacttttgttaaatgtgaaaaaccctcacagaaagtcatcgaggcaaaaagaggcaggcagtggagtctccctgtcgacagtaaagttgaaatggtgacgtccactgctggctttattgaacagctaataaagatttatttattgtaatacctcacagacgttgtaccatatccatgcacatttagttgcctgcctgtggctggtaaggtaatgtcatgattcatcctctcttcagtgagactgagcctgatgtgttaacaaataggtgaagaaagtcttgtgctgtattcctaatcaaaagacttaatatattgaagtaacacttttttagtaagcaagatacctttttatttcaattcacagaatggaatttttttgtttcatgtctcagatttattttgtatttcttttttaacactctacatttcccttgttttttaactcatgcacatgtgctctttgtacagttttaaaaagtgtaataaaatctgacatgtca

SEQ ID NO: 449060 - DNA, 968 bp, Homo sapiens
gatgactctagaggatcccgagtgtcttcaagaagcagaagaagaaaacagactcctgatagttcaggatgcttcagagagggcagcacttatacctggtggtctttctgatggtcagttttattcccctcctgaatccgaagcaggatctgaagaagctgaagaaaaacaggacagtgagaaaccacttttagaactatgagtactacttttgttaaatgtgaaaaaccctcacagaaagtcatcgaggcaaaaagaggcaggcagtggagtctccctgtcgacagtaaagttgaaatggtgacgtccactgctggctttattgaacagctaataaagatttatttattgtaatacctcacagacgttgtaccatatccatgcacatttagttgcctgcctgtggctggtaaggtaatgtcatgattcatcctctcttcagtgagactgagcctgatgtgttaacaaataggtgaagaaagtcttgtgctgtattcctaatcaaaagacttaatatattgaagtaacacttttttagtaagcaagatacctttttatttcaattcacagaatggaatttttttgtttcatgtctcagatttattttgtatttcttttttaacactctacatttcccttgttttttaactcatgcacatgtgctctttgtacagttttaaaaagtgtaataaaatctgacatgtcaatgtggctagttttatttttcttgttttgcattatgtgtatggcctgaagtgttggacttgcaaaaggggaagaaaggaattgcgaatacatgtaaaatgtcaccagacatttgtattatttttatcatgaaatcatgtttttctctgattgttctgaaatgttctaaatactcttattttgaatgcacaaaatgacttaaaccattcatatcatgtttcctttgcgttcagccaatttcaattaaaatgaactaaattata

SEQ ID NO: 449061 - DNA, 805 bp, Homo sapiens
gacgtcagcgtgctgacgtcacgggccggaggtcccggggctgctgggtgcgggcggtgggctgcgcgttgtccgctggactgggtcccggtcacgccccgccaagccccgcccctcaggccggggcgcgaccgcggatccgcagttcccgggccagcctggggcggccggccaggaaccacccgttaaggtgtcttctctttagggatggtgaggttggaaaaaggctcctgtaaccctcctccaggatgaaccacctgccagaagacatggagaacgctctcaccgggagccagagctcccatgcttctctgcgcaatatccattccatcaaccccacacaactcatggccaggattgagtcctatgaaggaagggaaaagaaaggcatatctgatgtcaggaggactttctgtttgtttgtcacctttgacctcttattcgtaacattactgtggataatagagttaaatgtaagttggtggttctttcataactttttaagaagtgtttccagagacaacagggtttttttgttcgtttctcttatcatttgtttcatttagtaatttccatctttttccaaatgaagccattgcttttctcctcctgatttggacctttcttgttctttaatattattgtttaaggcaaatgtgatcagtttaaaactcatgttgtctggggttttgaaatttgaattcctggtattttgctctgtaacaggagttgacaaactataggctgtaagacaaattcagtaggcctgttttaataaagttttattggaacgtggaaaaaaaaa

SEQ ID NO: 449062 - DNA, 1739 bp, Homo sapiens
ctgcagcctgcgcgacgcggcgggaggctacccggaggcgatgggaaggcgggcgcagtcgacccaagggtggagaagagggaaggcgaaggacgcgcgttcccgggctcgtgaccgccagcggcccggggaacccgctcccagacagactcggagagatggcaggcggaagacaccggcgcgtcgtgggcaccctccacctgctgctgctggtggccgccctgccctgggcatccaggggggtcagtccgagtgcctcagcctggccagaggagaagaattaccaccagccagccattttgaattcatcggctcttcggcaaattgcagaaggcaccagtatctctgaaatgtggcaaaatgacttacagccattgctgatagagcgatacccgggatcccctggaagctatgctgctcgtcagcacatcatgcagcgaattcagaggcttcaggctgactgggtcttggaaatagacaccttcttgagtcagacaccctatgggtaccggtctttctcaaatatcatcagcaccctcaatcccactgctaaacgacatttggtcctcgcctgccactatgactccaagtatttttcccactggaacaacagagtgtttgtaggagccactgattcagccgtgccatgtgcaatgatgttggaacttgctcgtgccttagacaagaaactcctttccttaaagactgtttcagactccaagccagatttgtcactccagctgatcttctttgatggtgaagaggcttttcttcactggtctcctcaagattctctctatgggtctcgacacttagctgcaaagatggcatcgaccccgcacccacctggagcgagaggcaccagccaactgcatggcatggatttattggtcttattggatttgattggagctccaaacccaacgtttcccaatttttttccaaactcagccaggtggttcgaaagacttcaagcaattgaacatgaacttcatgaattgggtttgctcaaggatcactctttggaggggcggtatttccagaattacagttatggaggtgtgattcaggatgaccatattccatttttaagaagaggtgttccagttctgcatctgataccgtctcctttccctgaagtctggcacaccatggatgacaatgaagaaaatttggatgaatcaaccattgacaatctaaacaaaatcctacaagtctttgtgttggaatatcttcatttgtaatactctgatttagtttaggataattggttctagaattgaattcaaaagtcaaggcatcatttaaaataatctgatttcagacaaatgctgtgtggaaacatctatcctatagatcatcctattcttatgtgtctttggttatcagatcaattacagaataattgtgttgtgatattgtgtcctaaattgctcattaatttttatttacagattgaaaaagagggaccgtgtaaagaaaatggaaaataaatatctttcaaagactcttttagataaacacgatgaggcaaaatcaggttcattcattcaacgatagtttctaaacagtacttaaatagcggttggaaaacgtagccttcattttatgattttttcatatgtggaaatctattacatgtaatacaaaacaaacatgtagtttgaaggcggtcagatttctttgagaaatctttgtagagttaattttatggaaattaaaatcagaattaaatgcta

SEQ ID NO: 449063 - DNA, 956 bp, Homo sapiens
ctgcagcctgcgcgacgcggcgggaggctacccggaggcgatgggaaggcgggcgcagtcgacccaagggtggagaagagggaaggcgaaggacgcgcgttcccgggctcgtgaccgccagcggcccggggaacccgctcccagacagactcggagagatggcaggcggaagacaccggcgcgtcgtgggcaccctccacctgctgctgctggtggccgccctgccctgggcatccaggggggtcagtccgagtgcctcagcctggccagaggagaagaattaccaccagccagccattttgaattcatcggctcttcggcaaattgcagaaggcaccagtatctctgaaatgtggcaaaatgacttacagccattgctgatagagcgatacccgggatcccctggaagctatgctgctcgtcagtgagcggaggtctgaaataacctgaaccaccccctagctatgggagctttctacgttatccttagcagcacatcatgcagcgaattcagaggcttcaggctgactgggtcttggaaatagacaccttcttgagtcagacaccctatgggtaccggtctttctcaaatatcatcagcaccctcaatcccactgctaaacgacatttggtcctcgcctgccactatgactccaagtatttttcccactggaacaacagagtgtttgtaggagccactgattcagccgtgccatgtgcaatgatgttggaacttgctcgtgccttagacaagaaactcctttccttaaaggtatctgttttctgcttattgattcctaggataaagtacattaacagtaactcagagtgaattctagaatccttggaggaatgagaaggccatttagaaatggagacttttggtacatttttattatgaacattaattgtaagattgcatgattgggaatatcaaccatgggcaataaacctaa

SEQ ID NO: 449064 - DNA, 2265 bp, Homo sapiens
ctgcagcctgcgcgacgcggcgggaggctacccggaggcgatgggaaggcgggcgcagtcgacccaagggtggagaagagggaaggcgaaggacgcgcgttcccgggctcgtgaccgccagcggcccggggaacccgctcccagacagactcggagagatggcaggcggaagacaccggcgcgtcgtgggcaccctccacctgctgctgctggtggccgccctgccctgggcatccaggggggtcagtccgagtgcctcagcctggccagaggagaagaattaccaccagccagccattttgaattcatcggctcttcggcaaattgcagaaggcaccagtatctctgaaatgtggcaaaatgacttacagccattgctgatagagcgatacccgggatcccctggaagctatgctgctcgtcagcacatcatgcagcgaattcagaggcttcaggctgactgggtcttggaaatagacaccttcttgagtcagacaccctatgggtaccggtctttctcaaatatcatcagcaccctcaatcccactgctaaacgacatttggtcctcgcctgccactatgactccaagtatttttcccactggaacaacagagtgtttgtaggagccactgattcagccgtgccatgtgcaatgatgttggaacttgctcgtgccttagacaagaaactcctttccttaaagactgtttcagactccaagccagatttgtcactccagctgatcttctttgatggtgaagaggcttttcttcactggtctcctcaagattctctctatgggtctcgacacttagctgcaaagatggcatcgaccccgcacccacctggagcgagaggcaccagccaactgcatggcatggatttattggtcttattggatttgattggagctccaaacccaacgtttcccaatttttttccaaactcagccaggtggttcgaaagacttcaagcaattgaacatgaacttcatgaattgggtttgctcaaggatcactctttggaggggcggtatttccagaattacagttatggaggtgtgattcaggatgaccatattccatttttaagaagaggtgttccagttctgcatctgataccgtctcctttccctgaagtctggcacaccatggatgacaatgaagaaaatttggatgaatcaaccattgacaatctaaacaaaatcctacaagtctttgtgttggaatatcttcatttgtaatactctgatttagtttaggataattggttctagaattgaattcaaaagtcaaggcatcatttaaaataatctgatttcagacaaatgctgtgtggaaacatctatcctatagatcatcctattcttatgtgtctttggttatcagatcaattacagaataattgtgttgtgatattgtgtcctaaattgctcattaatttttatttacagattgaaaaagagggaccgtgtaaagaaaatggaaaataaatatctttcaaagactcttttagataaacacgatgaggcaaaatcaggttcattcattcaacgatagtttctaaacagtacttaaatagcggttggaaaacgtagccttcattttatgattttttcatatgtggaaatctattacatgtaatacaaaacaaacatgtagtttgaaggcggtcagatttctttgagaaatctttgtagagttaattttatggaaattaaaatcagaattaaatgctaaaaaaaaaaaaagaaaaaaaaaaacaaaaaaaaacaaaacaccacaggagaaacaacaaaaagaaaaacgccaagaagaagacccaacaacaaacgaaacaaggaacacgaaaggacataaaaatacaaggcaggcacggcgcaacgaaatacccaaacaaccgcgcacagaagagaccgcagcacccgacgagggacaaacgaaccgcacaaggaaaagcgaccatgaagacgaatcacgtagtaggccgacaaagacgagagaagagaacacaaagaggtacaatgcaaggggagcgaagcaaaagcaacagaggcgacgaagagcaacacggaacgacacacgcagtggcgcgcaaacaacggagagggagagagccataccacgtggaggaacgacagagagacgaaaaaaagaagaaagagaaagagaggaaacaacgagaacaacagggcggaagcgggagcagacagcgcgacgacagaacgagaaaaacagaacaacagagaaaaagaaaagacgaaa

SEQ ID NO: 449065 - DNA, 1592 bp, Homo sapiens
ctgcagcctgcgcgacgcggcgggaggctacccggaggcgatgggaaggcgggcgcagtcgacccaagggtggagaagagggaaggcgaaggacgcgcgttcccgggctcgtgaccgccagcggcccggggaacccgctcccagacagactcggagagatggcaggcggaagacaccggcgcgtcgtgggcaccctccacctgctgctgctggtggccgccctgccctgggcatccaggggggtcagtccgagtgcctcagcctggccagaggagaagcacatcatgcagcgaattcagaggcttcaggctgactgggtcttggaaatagacaccttcttgagtcagacaccctatgggtaccggtctttctcaaatatcatcagcaccctcaatcccactgctaaacgacatttggtcctcgcctgccactatgactccaagtatttttcccactggaacaacagagtgtttgtaggagccactgattcagccgtgccatgtgcaatgatgttggaacttgctcgtgccttagacaagaaactcctttccttaaagactgtttcagactccaagccagatttgtcactccagctgatcttctttgatggtgaagaggcttttcttcactggtctcctcaagattctctctatgggtctcgacacttagctgcaaagatggcatcgaccccgcacccacctggagcgagaggcaccagccaactgcatggcatggatttattggtcttattggatttgattggagctccaaacccaacgtttcccaatttttttccaaactcagccaggtggttcgaaagacttcaagcaattgaacatgaacttcatgaattgggtttgctcaaggatcactctttggaggggcggtatttccagaattacagttatggaggtgtgattcaggatgaccatattccatttttaagaagaggtgttccagttctgcatctgataccgtctcctttccctgaagtctggcacaccatggatgacaatgaagaaaatttggatgaatcaaccattgacaatctaaacaaaatcctacaagtctttgtgttggaatatcttcatttgtaatactctgatttagtttaggataattggttctagaattgaattcaaaagtcaaggcatcatttaaaataatctgatttcagacaaatgctgtgtggaaacatctatcctatagatcatcctattcttatgtgtctttggttatcagatcaattacagaataattgtgttgtgatattgtgtcctaaattgctcattaatttttatttacagattgaaaaagagggaccgtgtaaagaaaatggaaaataaatatctttcaaagactcttttagataaacacgatgaggcaaaatcaggttcattcattcaacgatagtttctaaacagtacttaaatagcggttggaaaacgtagccttcattttatgattttttcatatgtggaaatctattacatgtaatacaaaacaaacatgtagtttgaaggcggtcagatttctttgagaaatctttgtagagttaattttatggaaattaaaatcagaattaaatgcta

SEQ ID NO: 449066 - DNA, 1491 bp, Homo sapiens
tctcttttatatttgccagcatttgcagtgcgtctcaacctgcctgggtgcagagggaaagctgcttgatatgttattatggttcagggttgcttattaattcttacagtgagcggaggtctgaaataacctgaaccaccccctagctatgggagctttctacgttatccttagcagcacatcatgcagcgaattcagaggcttcaggctgactgggtcttggaaatagacaccttcttgagtcagacaccctatgggtaccggtctttctcaaatatcatcagcaccctcaatcccactgctaaacgacatttggtcctcgcctgccactatgactccaagtatttttcccactggaacaacagagtgtttgtaggagccactgattcagccgtgccatgtgcaatgatgttggaacttgctcgtgccttagacaagaaactcctttccttaaagactgtttcagactccaagccagatttgtcactccagctgatcttctttgatggtgaagaggcttttcttcactggtctcctcaagattctctctatgggtctcgacacttagctgcaaagatggcatcgaccccgcacccacctggagcgagaggcaccagccaactgcatggcatggatttattggtcttattggatttgattggagctccaaacccaacgtttcccaatttttttccaaactcagccaggtggttcgaaagacttcaagcaattgaacatgaacttcatgaattgggtttgctcaaggatcactctttggaggggcggtatttccagaattacagttatggaggtgtgattcaggatgaccatattccatttttaagaagaggtgttccagttctgcatctgataccgtctcctttccctgaagtctggcacaccatggatgacaatgaagaaaatttggatgaatcaaccattgacaatctaaacaaaatcctacaagtctttgtgttggaatatcttcatttgtaatactctgatttagtttaggataattggttctagaattgaattcaaaagtcaaggcatcatttaaaataatctgatttcagacaaatgctgtgtggaaacatctatcctatagatcatcctattcttatgtgtctttggttatcagatcaattacagaataattgtgttgtgatattgtgtcctaaattgctcattaatttttatttacagattgaaaaagagggaccgtgtaaagaaaatggaaaataaatatctttcaaagactcttttagataaacacgatgaggcaaaatcaggttcattcattcaacgatagtttctaaacagtacttaaatagcggttggaaaacgtagccttcattttatgattttttcatatgtggaaatctattacatgtaatacaaaacaaacatgtagtttgaaggcggtcagatttctttgagaaatctttgtagagttaattttatggaaattaaaatcagaattaaatgcta

SEQ ID NO: 449067 - DNA, 1766 bp, Homo sapiens
ctgcagcctgcgcgacgcggcgggaggctacccggaggcgatgggaaggcgggcgcagtcgacccaagggtggagaagagggaaggcgaaggacgcgcgttcccgggctcgtgaccgccagcggcccggggaacccgctcccagacagactcggagagatggcaggcggaagacaccggcgcgtcgtgggcaccctccacctgctgctgctggtggccgccctgccctgggcatccaggggggtcagtccgagtgcctcagcctggccagaggagaagaattaccaccagccagccattttgaattcatcggctcttcggcaaattgcagaaggcaccagtatctctgaaatgtggcaaaatgacttacagccattgctgatagagcgatacccgggatcccctggaagctatgctgctcgtcagcacatcatgcagcgaattcagaggcttcaggctgactgggtcttggaaatagacaccttcttgagtcagacaccctatgggtaccggtctttctcaaatatcatcagcaccctcaatcccactgctaaacgacatttggtcctcgcctgccactatgactccaagtatttttcccactggaacaacagagtgtttgtaggagccactgattcagccgtgccatgtgcaatgatgttggaacttgctcgtgccttagacaagaaactcctttccttaaagactgtttcagactccaagccagatttgtcactccagctgatcttctttgatggtgaagaggcttttcttcactggtctcctcaagattctctctatgggtctcgacacttagctgcaaagatggcatcgaccccgcacccacctggagcgagaggcaccagccaactgcatggcatggatttattggtcttattggatttgattggagctccaaacccaacgtttcccaatttttttccaaactcagccaggtggttcgaaagacttcaagcaattgaacatgaacttcatgaattgggtttgctcaaggatcactctttggaggggcggtatttccagaattacagttatggaggtgtgattcaggatgaccatattccatttttaagaagaggtgttccagttctgcatctgataccgtctcctttccctgaagtctggcacaccatggatgacaatgaagtctggcacaccatggatgacaatgaagaaaatttggatgaatcaaccattgacaatctaaacaaaatcctacaagtctttgtgttggaatatcttcatttgtaatactctgatttagtttaggataattggttctagaattgaattcaaaagtcaaggcatcatttaaaataatctgatttcagacaaatgctgtgtggaaacatctatcctatagatcatcctattcttatgtgtctttggttatcagatcaattacagaataattgtgttgtgatattgtgtcctaaattgctcattaatttttatttacagattgaaaaagagggaccgtgtaaagaaaatggaaaataaatatctttcaaagactcttttagataaacacgatgaggcaaaatcaggttcattcattcaacgatagtttctaaacagtacttaaatagcggttggaaaacgtagccttcattttatgattttttcatatgtggaaatctattacatgtaatacaaaacaaacatgtagtttgaaggcggtcagatttctttgagaaatctttgtagagttaattttatggaaattaaaatcagaattaaatgcta

SEQ ID NO: 449068 - DNA, 1354 bp, Homo sapiens
  misc_feature (1314)..(1315): n is a, c, g, or t
  misc_feature (1318)..(1318): n is a, c, g, or t
ctgcagcctgcgcgacgcggcgggaggctacccggaggcgatgggaaggcgggcgcagtcgacccaagggtggagaagagggaaggcgaaggacgcgcgttcccgggctcgtgaccgccagcggcccggggaacccgctcccagacagactcggagagatggcaggcggaagacaccggcgcgtcgtgggcaccctccacctgctgctgctggtggccgccctgccctgggcatccaggggggtcagtccgagtgcctcagcctggccagaggagaagaattaccaccagccagccattttgaattcatcggctcttcggcaaattgcagaaggcaccagtatctctgaaatgtggcaaaatgacttacagccattgctgatagagcgatacccgggatcccctggaagctatgctgctcgtcagcacatcatgcagcgaattcagaggcttcaggctgactgggtcttggaaatagacaccttcttgagtcagacaccctatgggtaccggtctttctcaaatatcatcagcaccctcaatcccactgctaaacgacatttggtcctcgcctgccactatgactccaagtatttttcccactggaacaacagagtgtttgtaggagccactgattcagccgtgccatgtgcaatgatgttggaacttgctcgtgccttagacaagaaactcctttccttaaagactgtttcagactccaagccagatttgtcactccagctgatcttctttgatggtgaagaggcttttcttcactggtctcctcaagattctctctatgggtctcgacacttagctgcaaagatggcatcgaccccgcacccacctggagcgagaggcaccagccaactgcatggcatggatttattggtcttattggatttgattggagctccaaacccaacgtttcccaatttttttccaaactcagccaggtggttcgaaagacttcaagcaattgaacatgaacttcatgaattgggtttgctcaaggatcactctttggaggggcggtatttccagaattacagttatggaggtgtgattcaggatgaccatattccatttttaagaagaggtgttccagttctgcatctgataccgtctcctttccctgaagtctggcacaccatggatgacaatgaagaaaatttggatgaatcaaccattgacaatctaaacaaaatcctacaagtctttgtgttggaatatcttcatttgtaatactctgatttagtttaggataattggttctagaattgaattcaaaagtcaaggcatcattttcctattnntangtgtctttggtatcagatcactaccagataattgcg

SEQ ID NO: 449069 - DNA, 1063 bp, Homo sapiens
gctatgtttttattgttgtttttaccagactgtttcagactccaagccagatttgtcactccagctgatcttctttgatggtgaagaggcttttcttcactggtctcctcaagattctctctatgggtctcgacacttagctgcaaagatggcatcgaccccgcacccacctggagcgagaggcaccagccaactgcatggcatggatttattggtcttattggatttgattggagctccaaacccaacgtttcccaatttttttccaaactcagccaggtggttcgaaagacttcaagcaattgaacatgaacttcatgaattgggtttgctcaaggatcactctttggaggggcggtatttccagaattacagttatggaggtgtgattcaggatgaccatattccatttttaagaagaggtgttccagttctgcatctgataccgtctcctttccctgaagtctggcacaccatggatgacaatgaagaaaatttggatgaatcaaccattgacaatctaaacaaaatcctacaagtctttgtgttggaatatcttcatttgtaatactctgatttagtttaggataattggttctagaattgaattcaaaagtcaaggcatcatttaaaataatctgatttcagacaaatgctgtgtggaaacatctatcctatagatcatcctattcttatgtgtctttggttatcagatcaattacagaataattgtgttgtgatattgtgtcctaaattgctcattaatttttatttacagattgaaaaagagggaccgtgtaaagaaaatggaaaataaatatctttcaaagactcttttagataaacacgatgaggcaaaatcaggttcattcattcaacgatagtttctaaacagtacttaaatagcggttggaaaacgtagccttcattttatgattttttcatatgtggaaatctattacatgtaatacaaaacaaacatgtagtttgaaggcggtcagatttctttgagaaatctttgtagagttaattttatggaaattaaaatcagaattaaatgcta

SEQ ID NO: 449070 - DNA, 1238 bp, Homo sapiens
ccccattcctgggcccacactccatccctaatccctcccccgacccctgcatcttctcctgactctgactctcttcccatatttgatcttctttctgtccccacgtcttcactaaccccagcttggaacctcatgctacccttgagacttcactagccccggtgccttcatccctccctgacgctcaccccatctgtgaactgatagcttattcccagcacccccgcttattcctatccattgccctatcactgaccttcgccctataaaagtacaaatggtcacattctgtgtcctctgtgaccctaacacacctcctgttggcatttgctctccctcctgttatccattggcagctcctaatgggccaggggaatgtggatttattggtcttattggatttgattggagctccaaacccaacgtttcccaatttttttccaaactcagccaggtggttcgaaagacttcaagcaattgaacatgaacttcatgaattgggtttgctcaaggatcactctttggaggggcggtatttccagaattacagttatggaggtgtgattcaggatgaccatattccatttttaagaagaggtgttccagttctgcatctgataccgtctcctttccctgaagtctggcacaccatggatgacaatgaagaaaatttggatgaatcaaccattgacaatctaaacaaaatcctacaagtctttgtgttggaatatcttcatttgtaatactctgatttagtttaggataattggttctagaattgaattcaaaagtcaaggcatcatttaaaataatctgatttcagacaaatgctgtgtggaaacatctatcctatagatcatcctattcttatgtgtctttggttatcagatcaattacagaataattgtgttgtgatattgtgtcctaaattgctcattaatttttatttacagattgaaaaagagggaccgtgtaaagaaaatggaaaataaatatctttcaaagactcttttagataaacacgatgaggcaaaatcaggttcattcattcaacgatagtttctaaacagtacttaaatagcggttggaaaacgtagccttcattttatgattttttcatatgtggaaatctattacatgtaatacaaaacaaacatgtagtttgaaggcggtcagatttctttgagaaatctttgtagagttaattttatggaaattaaaatcagaattaaatgcta

SEQ ID NO: 449071 - DNA, 1706 bp, Homo sapiens
ctgcagcctgcgcgacgcggcgggaggctacccggaggcgatgggaaggcgggcgcagtcgacccaagggtggagaagagggaaggcgaaggacgcgcgttcccgggctcgtgaccgccagcggcccggggaacccgctcccagacagactcggagagatggcaggcggaagacaccggcgcgtcgtgggcaccctccacctgctgctgctggtggccgccctgccctgggcatccaggggggtcagtccgagtgcctcagcctggccagaggagaagaattaccaccagccagccattttgaattcatcggctcttcggcaaattgcagaaggcaccagtatctctgaaatgtggcaaaatgacttacagccattgctgatagagcgatacccgggatcccctggaagctatgctgctcgtcagcacatcatgcagcgaattcagaggcttcaggctgactgggtcttggaaatagacaccttcttgagtcagacaccctatgggtaccggtctttctcaaatatcatcagcaccctcaatcccactgctaaacgacatttggtcctcgcctgccactatgactccaagtatttttcccactggaacaacagagtgtttgtaggagccactgattcagccgtgccatgtgcaatgatgttggaacttgctcgtgccttagacaagaaactcctttccttaaagactgtttcagactccaagccagatttgtcactccagctgatcttctttgatggtgaagaggcttttcttcactggtctcctcaagattctctctatgggtctcgacacttagctgcaaagatggcatcgaccccgcacccacctggagcgagaggcaccagccaactgcatggcatggatttattggtcttattggatttgattggagctccaaacccaacgtttcccaatttttttccaaactcagccaggtggttcgaaagacttcaagcaattgaacatgaacttcatgaattgggtttgctcaaggatcactctttggaggggcggtatttccagaattacagttatggaggtgtgattcaggatgaccatattccatttttaagaagaggtgttccagttctgcatctgataccgtctcctttccctgaagtctggcacaccatggatgacaatgaagaaaatttggatgaatcaaccattgacaatctaaacaaaatcctacaagtctttgtgttggaatatcttcatttgtaatactctgatttagtttaggataattggttctagaattgaattcaaaagtcaaggcatcatttaaaataatctgatttcagacaaatgctgtgtggaaacatctatcctatagatcatcctattcttatgtgtctttggttatcagatcaattacagaataattgtgttgtgatattgtgtcctaaattgctcattaatttttatttacagattgaaaaagagggaccgtgtaaagaaaatggaaaataaatatctttcaaagagttcattcattcaacgatagtttctaaacagtacttaaatagcggttggaaaacgtagccttcattttatgattttttcatatgtggaaatctattacatgtaatacaaaacaaacatgtagtttgaaggcggtcagatttctttgagaaatctttgtagagttaattttatggaaattaaaatcagaattaaatgcta

SEQ ID NO: 449072 - DNA, 1559 bp, Homo sapiens
cactccatggaggtgcagagataaggccccagacattttggcccagtatgggacaactttgaccgtctttttcagcttcaggactcccatggagttggaattaccaccagccagccattttgaattcatcggctcttcggcaaattgcagaaggcaccagtatctctgaaatgtggcaaaatgacttacagccattgctgatagagcgatacccgggatcccctggaagctatgctgctcgtcagcacatcatgcagcgaattcagaggcttcaggctgactgggtcttggaaatagacaccttcttgagtcagacaccctatgggtaccggtctttctcaaatatcatcagcaccctcaatcccactgctaaacgacatttggtcctcgcctgccactatgactccaagtatttttcccactggaacaacagagtgtttgtaggagccactgattcagccgtgccatgtgcaatgatgttggaacttgctcgtgccttagacaagaaactcctttccttaaagactgtttcagactccaagccagatttgtcactccagctgatcttctttgatggtgaagaggcttttcttcactggtctcctcaagattctctctatgggtctcgacacttagctgcaaagatggcatcgaccccgcacccacctggagcgagaggcaccagccaactgcatggcatggatttattggtcttattggatttgattggagctccaaacccaacgtttcccaatttttttccaaactcagccaggtggttcgaaagacttcaagcaattgaacatgaacttcatgaattgggtttgctcaaggatcactctttggaggggcggtatttccagaattacagttatggaggtgtgattcaggatgaccatattccatttttaagaagaggtgttccagttctgcatctgataccgtctcctttccctgaagtctggcacaccatggatgacaatgaagaaaatttggatgaatcaaccattgacaatctaaacaaaatcctacaagtctttgtgttggaatatcttcatttgtaatactctgatttagtttaggataattggttctagaattgaattcaaaagtcaaggcatcatttaaaataatctgatttcagacaaatgctgtgtggaaacatctatcctatagatcatcctattcttatgtgtctttggttatcagatcaattacagaataattgtgttgtgatattgtgtcctaaattgctcattaatttttatttacagattgaaaaagagggaccgtgtaaagaaaatggaaaataaatatctttcaaagactcttttagataaacacgatgaggcaaaatcaggttcattcattcaacgatagtttctaaacagtacttaaatagcggttggaaaacgtagccttcattttatgattttttcatatgtggaaatctattacatgtaatacaaaacaaacatgtagtttgaaggcggtcagatttctttgagaaatctttgtagagttaattttatggaaattaaaatcagaattaaatgcta

SEQ ID NO: 449073 - DNA, 1678 bp, Homo sapiens
ctgcagcctgcgcgacgcggcgggaggctacccggaggcgatgggaaggcgggcgcagtcgacccaagggtggagaagagggaaggcgaaggacgcgcgttcccgggctcgtgaccgccagcggcccggggaacccgctcccagacagactcggagagatggcaggcggaagacaccggcgcgtcgtgggcaccctccacctgctgctgctggtggccgccctgccctgggcatccaggggggtcagtccgagtgcctcagcctggccagaggagaagaattaccaccagccagccattttgaattcatcggctcttcggcaaattgcagaaggcaccagtatctctgaaatgtggcaaaatgacacatcatgcagcgaattcagaggcttcaggctgactgggtcttggaaatagacaccttcttgagtcagacaccctatgggtaccggtctttctcaaatatcatcagcaccctcaatcccactgctaaacgacatttggtcctcgcctgccactatgactccaagtatttttcccactggaacaacagagtgtttgtaggagccactgattcagccgtgccatgtgcaatgatgttggaacttgctcgtgccttagacaagaaactcctttccttaaagactgtttcagactccaagccagatttgtcactccagctgatcttctttgatggtgaagaggcttttcttcactggtctcctcaagattctctctatgggtctcgacacttagctgcaaagatggcatcgaccccgcacccacctggagcgagaggcaccagccaactgcatggcatggatttattggtcttattggatttgattggagctccaaacccaacgtttcccaatttttttccaaactcagccaggtggttcgaaagacttcaagcaattgaacatgaacttcatgaattgggtttgctcaaggatcactctttggaggggcggtatttccagaattacagttatggaggtgtgattcaggatgaccatattccatttttaagaagaggtgttccagttctgcatctgataccgtctcctttccctgaagtctggcacaccatggatgacaatgaagaaaatttggatgaatcaaccattgacaatctaaacaaaatcctacaagtctttgtgttggaatatcttcatttgtaatactctgatttagtttaggataattggttctagaattgaattcaaaagtcaaggcatcatttaaaataatctgatttcagacaaatgctgtgtggaaacatctatcctatagatcatcctattcttatgtgtctttggttatcagatcaattacagaataattgtgttgtgatattgtgtcctaaattgctcattaatttttatttacagattgaaaaagagggaccgtgtaaagaaaatggaaaataaatatctttcaaagactcttttagataaacacgatgaggcaaaatcaggttcattcattcaacgatagtttctaaacagtacttaaatagcggttggaaaacgtagccttcattttatgattttttcatatgtggaaatctattacatgtaatacaaaacaaacatgtagtttgaaggcggtcagatttctttgagaaatctttgtagagttaattttatggaaattaaaatcagaattaaatgcta

SEQ ID NO: 449074 - DNA, 1659 bp, Homo sapiens
  misc_feature (1517)..(1517): n is a, c, g, or t
ctgcagcctgcgcgacgcggcgggaggctacccggaggcgatgggaaggcgggcgcagtcgacccaagggtggagaagagggaaggcgaaggacgcgcgttcccgggctcgtgaccgccagcggcccggggaacccgctcccagacagactcggagagatggcaggcggaagacaccggcgcgtcgtgggcaccctccacctgctgctgctggtggccgccctgccctgggcatccaggggggtcagtccgagtgcctcagcctggccagaggagaagaattaccaccagccagccattttgaattcatcggctcttcggcaaattgcagaaggcaccagtatctctgaaatgtggcaaaatgacttacagccattgctgatagagcgatacccgggatcccctggaagctatgctgctcgtcagcacatcatgcagcgaattcagaggcttcaggctgactgggtcttggaaatagacaccttcttgagtcagacaccctatgggtaccggtctttctcaaatatcatcagcaccctcaatcccactgctaaacgacatttggtcctcgcctgccactatgactccaagtatttttcccactggaacaacagagtgtttgtaggagccactgattcagccgtgccatgtgcaatgatgttggaacttgctcgtgccttagacaagaaactcctttccttaaagactgtttcagactccaagccagatttgtcactccagctgatcttctttgatggtgaagaggcttttcttcactggtctcctcaagattctctctatgggtctcgacacttagctgcaaagatggcatcgaccccgcacccacctggagcgagaggcaccagccaactgcatggcatggatttattggtcttattggatttgattggagctccaaacccaacgtttcccaatttttttccaaactcagccaggtggttcgaaagacttcaagcaattgaacatgaacttcatgaattgggtttgctcaaggatcactctttggaggggcggtatttccagaattacagttatggaggtgtgattcaggatgaccatattccatttttaagaagaggtgttccagttctgcatctgataccgtctcctttccctgaagtctggcacaccatggatgacaatgaagaaaatttggatgaatcaaccattgacaatctaaacaaaatcctacaagtctttgtgttggaatatcttcatttgtaatactctgatttagtttaggataattggttctagaattgaattcaaaagtcaaggcatcatttaaaataatctgatttcagacaaatgctgtgtggaaacatctatcctatagatcatcctattcttatgtgtctttggttatcagatcaattacagaataattgtgttgtgatattgtgtcctaaattgctcattaatttttatttacagattgaaaaagagggaccgtgtaaagaaaatggaaaataaatatctttcaaagactctttaaanaaacaccatttaggcgcaattagggttattcctttcaccattgattgcttaagaatacttatatatggggtagcaaaaggtaatctttcagtcatggtttgtatctatggggaagaacttttactcgtcatacatagtccat

SEQ ID NO: 449075 - DNA, 1624 bp, Homo sapiens
ctgcagcctgcgcgacgcggcgggaggctacccggaggcgatgggaaggcgggcgcagtcgacccaagggtggagaagagggaaggcgaaggacgcgcgttcccgggctcgtgaccgccagcggcccggggaacccgctcccagacagactcggagagatggcaggcggaagacaccggcgcgtcgtgggcaccctccacctgctgctgctggtggccgccctgccctgggcatccaggggggtcagtccgagtgcctcagcctggccagaggagaagaattaccaccagccagccattttgaattcatcggctcttcggcaaattgcagaaggcaccagtatctctgaaatgtggcaaaatgacttacagccattgctgatagagcgatacccgggatcccctggaagctatgctgctcgtcagcacatcatgcagcgaattcagaggcttcaggctgactgggtcttggaaatagacaccttcttgagtcagacaccctatgggtaccggtctttctcaaatatcatcagcaccctcaatcccactgctaaacgacatttggtcctcgcctgccactatgactccaagtatttttcccactggaacaacagagtgtttgtaggagccactgattcagccgtgccatgtgcaatgatgttggaacttgctcgtgccttagacaagaaactcctttccttaaagactgtttcagactccaagccagatttgtcactccagctgatcttctttgatggtgaagaggcttttcttcactggtctcctcaagattctctctatgggtctcgacacttagctgcaaagatggcatcgaccccgcacccacctggagcgagaggcaccagccaactgcatggcatggatttattggtcttattggatttgattggagctccaaacccaacgtttcccaatttttttccaaactcagccaggtggttcgaaagacttcaagcaattgaacatgaacttcatgaattgggtttgctcaaggatcactctttggaggggcggtatttccagaattacagttatggaggtgtgattcaggatgaccatattccatttttaagaagaggtgttccagttctgcatctgataccgtctcctttccctgaagtctggcacaccatggatgacaatgaagaaaatttggatgaatcaaccattgacaatctaaacaaaatcctacaagtctttgtgttggaatatcttcatttgtaatacttattcttatgtgtctttggttatcagatcaattacagaataattgtgttgtgatattgtgtcctaaattgctcattaatttttatttacagattgaaaaagagggaccgtgtaaagaaaatggaaaataaatatctttcaaagactcttttagataaacacgatgaggcaaaatcaggttcattcattcaacgatagtttctaaacagtacttaaatagcggttggaaaacgtagccttcattttatgattttttcatatgtggaaatctattacatgtaatacaaaacaaacatgtagtttgaaggcggtcagatttctttgagaaatctttgtagagttaattttatggaaattaaaatcagaattaaatgcta

SEQ ID NO: 449076 - DNA, 1685 bp, Homo sapiens
ctgcagcctgcgcgacgcggcgggaggctacccggaggcgatgggaaggcgggcgcagtcgacccaagggtggagaagagggaaggcgaaggacgcgcgttcccgggctcgtgaccgccagcggcccggggaacccgctcccagacagactcggagagatggcaggcggaagacaccggcgcgtcgtgggcaccctccacctgctgctgctggtggccgccctgccctgggcatccaggggggtcagtccgagtgcctcagcctggccagaggagaagaattaccaccagccagccattttgaattcatcggctcttcggcaaattgcagaaggcaccagtatctctgaaatgtggcaaaatgacttacagccattgctgatagagcgatacccgggatcccctggaagctatgctgctcgtcagcacatcatgcagcgaattcagaggcttcaggctgactgggtcttggaaatagacaccttcttgagtcagacaccctatgggtaccggtctttctcaaatatcatcagcaccctcaatcccactgctaaacgacatttggtcctcgcctgccactatgactccaagtatttttcccactggaacaacagagtgtttgtaggagccactgattcagccgtgccatgtgcaatgatgttggaacttgctcgtgccttagacaagaaactcctttccttaaagactgtttcagactccaagccagatttgtcactccagctgatcttctttgatggtgaagctgcaaagatggcatcgaccccgcacccacctggagcgagaggcaccagccaactgcatggcatggatttattggtcttattggatttgattggagctccaaacccaacgtttcccaatttttttccaaactcagccaggtggttcgaaagacttcaagcaattgaacatgaacttcatgaattgggtttgctcaaggatcactctttggaggggcggtatttccagaattacagttatggaggtgtgattcaggatgaccatattccatttttaagaagaggtgttccagttctgcatctgataccgtctcctttccctgaagtctggcacaccatggatgacaatgaagaaaatttggatgaatcaaccattgacaatctaaacaaaatcctacaagtctttgtgttggaatatcttcatttgtaatactctgatttagtttaggataattggttctagaattgaattcaaaagtcaaggcatcatttaaaataatctgatttcagacaaatgctgtgtggaaacatctatcctatagatcatcctattcttatgtgtctttggttatcagatcaattacagaataattgtgttgtgatattgtgtcctaaattgctcattaatttttatttacagattgaaaaagagggaccgtgtaaagaaaatggaaaataaatatctttcaaagactcttttagataaacacgatgaggcaaaatcaggttcattcattcaacgatagtttctaaacagtacttaaatagcggttggaaaacgtagccttcattttatgattttttcatatgtggaaatctattacatgtaatacaaaacaaacatgtagtttgaaggcggtcagatttctttgagaaatctttgtagagttaattttatggaaattaaaatcagaattaaatgcta

SEQ ID NO: 449077 - DNA, 654 bp, Homo sapiens
atgggattagtggattaaatccgggaaggttggacaagcacctaggacggtgcctggtgccgtgttcagcagacgtcgattccctgtccaccccttctttaggagctgtgggaaacacttcataactccccagggtctggtgaacccttcctcccttttctgttccctgttttggcattggagatcataaaaaggctcttccatgtctcttgcttccttcctttcatcttctccaagagaaggaagtggccgcctttgttagcttgggttcagaagcttgtgtctgtcacccagggccgcccagccccggggtttgcgaaggtccggggtaggagggctgcagcctgcgcgacgcggcgggaggctacccggaggcgatgggaaggcgggcgcagtcgacccaagggtggagaagagggaaggcgaaggacgcgcgttcccgggctcgtgaccgccagcggcccggggaacccgctcccagacagactcggagagatggcaggcggaagacaccggcgcgtcgtgggcaccctccacctgctgctgctggtggccgccctgccctgggcatccaggggggtcagtccgagtgcctcagcctggccagaggagaaggtgaggggctgtttctgcgtagttgtacttgagcggctc

SEQ ID NO: 449078 - DNA, 4651 bp, Homo sapiens
  misc_feature (4516)..(4517): n is a, c, g, or t
  misc_feature (4522)..(4522): n is a, c, g, or t
  misc_feature (4527)..(4528): n is a, c, g, or t
agcggccggggccacgatggagcgcgacggctgcgcggggggcgggagccgcggcggcgagggcgggcgcgctccccgggagggcccggcggggaacggccgcgatcggggccgcagccacgctgccgaggcgcccggggacccgcaggcggccgcgtccttgctggcccctatggacgtgggggaggagccgctggagaaggcggcgcgcgcccgcactgccaaggaccccaacacctataaagtactctcgctggtattgtcagtatgtgtgttaacaacaatacttggttgtatatttgggttgaaaccaagctgtgccaaagaagttaaaagttgcaaaggtcgctgtttcgagagaacatttgggaactgtcgctgtgatgctgcctgtgttgagcttggaaactgctgtttagattaccaggagacgtgcatagaaccagaacatatatggacttgcaacaaattcaggtgtggtgagaaaaggttgaccagaagcctctgtgcctgttcagatgactgcaaggacaagggcgactgctgcatcaactacagttctgtgtgtcaaggtgagaaaagttgggtagaagaaccatgtgagagcattaatgagccacagtgcccagcagggtttgaaacgcctcctaccctcttattttctttggatggattcagggcagaatatttacacacttggggtggacttcttcctgttattagcaaactaaaaaaatgtggaacatatactaaaaacatgagaccggtatatccaacaaaaactttccccaatcactacagcattgtcaccggattgtatccagaatctcatggcataatcgacaataaaatgtatgatcccaaaatgaatgcttccttttcacttaaaagtaaagagaaatttaatcctgagtggtacaaaggagaaccaatttgggtcacagctaagtatcaaggcctcaagtctggcacatttttctggccaggatcagatgtggaaattaacggaattttcccagacatctataaaatgtataatggttcagtaccatttgaagaaaggattttagctgttcttcagtggctacagcttcctaaagatgaaagaccacacttttacactctgtatttagaagaaccagattcttcaggtcattcatatggaccagtcagcagtgaagtcatcaaagccttgcagagggttgatggtatggttggtatgctgatggatggtctgaaagagctgaacttgcacagatgcctgaacctcatccttatttcagatcatggcatggaacaaggcagttgtaagaaatacatatatctgaataaatatttgggggatgttaaaaatattaaagttatctatggacctgcagctcgattgagaccctctgatgtcccagataaatactattcatttaactatgaaggcattgcccgaaatctttcttgccgggaaccaaaccagcacttcaaaccttacctgaaacatttcttacctaagcgtttgcactttgctaagagtgatagaattgagcccttgacattctatttggaccctcagtggcaacttgcattgaatccctcagaaaggaaatattgtggaagtggatttcatggctctgacaatgtattttcaaatatgcaagccctctttgttggctatggacctggattcaagcatggcattgaggctgacacctttgaaaacattgaagtctataacttaatgtgtgatttactgaatttgacaccggctcctaataacggaactcatggaagtcttaaccaccttctaaagaatcctgtttatacgccaaagcatcccaaagaagtgcaccccctggtacagtgccccttcacaagaaaccccagagataaccttggctgctcatgtaacccttcgattttgccgattgaggattttcaaacacagttcaatctgactgtggcagaagagaagattattaagcatgaaactttaccctatggaagacctagagttctccagaaggaaaacaccatctgtcttctttcccagcaccagtttatgagtggatacagccaagacatcttaatgcccctttggacatcctataccgtggacagaaatgacagtttctctacggaagacttctccaactgtctgtaccaggactttagaattcctcttagtcctgtccataaatgttcattttataaaaataacaccaaagtgagttacgggttcctctccccaccacaactaaataaaaattcaagtggaatatattctgaagctttgcttactacaaatatagtgccaatgtaccagagttttcaagttatatggcgctactttcatgacaccctactgcgaaagtatgctgaagaaagaaatggtgtcaatgtcgtcagtggtcctgtgtttgactttgattatgatggacgttgtgattccttagagaatctgaggcaaaaaagaagagtcatccgtaaccaagaaattttgattccaactcacttctttattgtgctaacaagctgtaaagatacatctcagacgcctttgcactgtgaaaacctagacaccttagctttcattttgcctcacaggactgataacagcgagagctgtgtgcatgggaagcatgactcctcatgggttgaagaattgttaatgttacacagagcacggatcacagatgttgagcacatcactggactcagcttctatcaacaaagaaaagagccagtttcagacattttaaagttgaaaacacatttgccaacctttagccaagaagactgatatgttttttatccccaaacaccatgaatctttttgagagaaccttatattttatatagtcctctagctacactattgcattgttcagaaactgtcgaccagagttagaacggagccctcggtgatgcggacatctcagggaaacttgcgtactcagcacagcagtggagagtgttcctgttgaatcttgcacatatttgaatgtgtaagcattgtatacattgatcaagttcgggggaataaagacagaccacacctaaaactgcctttctgcttctcttaaaggagaagtagctgtgaacattgtctggataccagatatttgaatctttcttactattggtaataaaccttgatggcattgggcaaacagtagacttatagtagggttggggtagcccatgttatgtgactatctttatgagaattttaaagtggttctggatatcttttaacttggagtttcatttcttttcattgtaatcaaaaaaaaaattaacagaagccaaaatacttctgagaccttgtttcaatctttgctgtatatcccctcaaaatccaagttattaatcttatgtgttttctttttaattttttgattggatttctttagatttaatggttcaaatgagttcaactttgagggacgatctttgaatatacttacctattataaaatcttactttgtatttgtatttaaaaaagaaaaatattcctatcctgctcactggtaattaacataggtttaaaatggcttcaaatgtggccctatagacggttaaaattgtaccttatcttggcaaaacttcagagcaccagtcagtgcatgcaaggtgccattttttattgagatgcttagaatgtttctttctgtgcacaagacttaccctaccagcagcagagccattctctgttgagtggttcattttgaagttccacagattgaagagaacatgccaccaatcacctcacatcttcttggtggacatgataaatgacacaatgaacttgatttctttactaccttgactgtagctttttatccctacctgtgaaccttcaaagactgcattaacttttaggctacataggtccaattgaggtataatatcagtacaccaaagatttttatatgtccttcgtgtgaccattcttcaacggcctaagggccagctgcaaagacttttggaaaatacaatttacaactcaaaattatttaataatttaggaagttgctttttttttttttttttttcagtcctgcagtttcctgaagctctgtatatgatatttttttcagcctgcttctctctgttgttcagattaggtaattttattcttctgtctcgaagctcactgattctttattctgtctaatctgttctgctgttgagcccatttattcctgatttttatattttagttattgtatgttttatttctaaaatttccattcagtttttctttatatcttctatttgctgagaatttctgtctctttgctgagactttctacgttttcatttgtttcaagtgcatttatacttgcttgttgaagaatttttatgatggctgctgtaaaatccttatcagataattccaacatctgtcacctcattgtttgcatctactgatggtcttttttccattcggaaacattttcctgtttcttggtgtgtggaatgattttttattgaaacctggatatttttaggtaaaannaacanaaaanntctctttactcttaatttttttctcttatttttttttattttatataaaaaacctcggggggggggcccccgggcaccccaatttcggcccctattaggtgggggcggttaattaccaaattc

SEQ ID NO: 449079 - DNA, 4236 bp, Homo sapiens
atatactagtaggaaaatagggaaggacatgagctgacagctagagcttcataattttatgatgtagttcacctttaaatattaataaagcaattttcttctctgtgcctgatatctgagagttcttctcattttcgttcttcaggacagtttctctacggaagacttctccaactgtctgtaccaggactttagaattcctcttagtcctgtccataaatgttcattttataaaaataacaccaaagtgagttacgggttcctctccccaccacaactaaataaaaattcaagtggaatatattctgaagctttgcttactacaaatatagtgccaatgtaccagagttttcaagttatatggcgctactttcatgacaccctactgcgaaagtatgctgaagaaagaaatggtgtcaatgtcgtcagtggtcctgtgtttgactttgattatgatggacgttgtgattccttagagaatctgaggcaaaaaagaagagtcatccgtaaccaagaaattttgattccaactcacttctttattgtgctaacaagctgtaaagatacatctcagacgcctttgcactgtgaaaacctagacaccttagctttcattttgcctcacaggactgataacagcgagagctgtgtgcatgggaagcatgactcctcatgggttgaagaattgttaatgttacacagagcacggatcacagatgttgagcacatcactggactcagcttctatcaacaaagaaaagagccagtttcagacattttaaagttgaaaacacatttgccaacctttagccaagaagactgatatgttttttatccccaaacaccatgaatctttttgagagaaccttatattttatatagtcctctagctacactattgcattgttcagaaactgtcgaccagagttagaacggagccctcggtgatgcggacatctcagggaaacttgcgtactcagcacagcagtggagagtgttcctgttgaatcttgcacatatttgaatgtgtaagcattgtatacattgatcaagttcgggggaataaagacagaccacacctaaaactgcctttctgcttctcttaaaggagaagtagctgtgaacattgtctggataccagatatttgaatctttcttactattggtaataaaccttgatggcattgggcaaacagtagacttatagtagggttggggtagcccatgttatgtgactatctttatgagaattttaaagtggttctggatatcttttaacttggagtttcatttcttttcattgtaatcaaaaaaaaaattaacagaagccaaaatacttctgagaccttgtttcaatctttgctgtatatcccctcaaaatccaagttattaatcttatgtgttttctttttaattttttgattggatttctttagatttaatggttcaaatgagttcaactttgagggacgatctttgaatatacttacctattataaaatcttactttgtatttgtatttaaaaaagaaaaatattcctatcctgctcactggtaattaacataggtttaaaatggcttcaaatgtggccctatagacggttaaaattgtaccttatcttggcaaaacttcagagcaccagtcagtgcatgcaaggtgccattttttattgagatgcttagaatgtttctttctgtgcacaagacttaccctaccagcagcagagccattctctgttgagtggttcattttgaagttccacagattgaagagaacatgccaccaatcacctcacatcttcttggtggacatgataaatgacacaatgaacttgatttctttactaccttgactgtagctttttatccctacctgtgaaccttcaaagactgcattaacttttaggctacataggtccaattgaggtataatatcagtacaccaaagatttttatatgtccttcgtgtgaccattcttcaacggcctaagggccagctgcaaagacttttggaaaatacaatttacaactcaaaattatttaataatttaggaagttgctttttttttttttttttttcagtcctgcagtttcctgaagctctgtatatgatatttttttcagcctgcttctctctgttgttcagattaggtaattttattcttctgtctcgaagctcactgattctttattctgtctaatctgttctgctgttgagcccatttattcctgatttttatattttagttattgtatgttttatttctaaaatttccattcagtttttctttatatcttctatttgctgagaatttctgtctctttgctgagactttctacgttttcatttgtttcaagtgcatttatacttgcttgttgaagaatttttatgatggctgctgtaaaatccttatcagataattccaacatctgtcacctcattgtttgcatctactgatggtcttttttccattcggaaacattttcctgtttcttggtgtgtggaatgattttttattgaaacctggatatttttaggtattatgttatgagactatgggtcttatttaaaccttctgctttagccaactttctcagataccaccacagcaggggaattgggagcactgcttcattattaccaggtgtggctaggagtccaggttccccagtcagcctccctttatactgagtaacagggtcccctcattactactgggcaaggtgagaattcagtttcccattaggtctttattgattcttccctggctggaatgtgcagcggcaccttttggtgcaccctgggaatctccactaatgctatgggacagagtgaccaggaagagcttcattacaccaggtgggaatgaaattcccagtagcctacacagccttctccgacaccactctggagttgtattcttccagcacacaaacatacacaatttaactcaaagcatcttagcagagcttaattaaatggatagatgcctgttccctttgctggataccaagaatacaaaagtcagggagttggggcacctctttacagcttggtgagagtgtaagtctggactccccactcagcatttgctggtatgggtggggccatggtgtttttccatggtgtttggttggagtacagccttttttacccttgcttggctacccttttctggtcctttggcaggagagagcaggactctcttagggcttttttttcccctgcatttattgacatttccaggttgctgactttttcagctccaagttggaaatatatgagctgaaaagaaaatgtagggaactcatcacagtgttgttacttgggccccaatgttcctagcctattttctgtctactattcagagtcttgctgtgttttaatataatatccaggatttttatatgcatttagcagaaggatgtctactctgcctttgtagaagtgtctcactgatttttacatatttttccagcacacaaacatacacaatttaactcaaagcatcttagcagagcttaattaaatggatagatgtctgttccctttgctggacgccaagaatacaaaaaagaacaagtgacaattttctctgtcttagggagaagagacagcagaagtgtaaatgatccctaaagagtgatagatgttatcatgaagccacaggaggggtgccaggctgcacaaaagagacactggatgcttcttggtagtagaggcagtggcttcccagccttggggctaaggcttgtagggtgaattggaacttttcagatgagcaaggcaaagaagggaccttctaacattccttggatggaacatttttgacattttcccatttacagctacttatattttctacaagtgtcactgtgaccaacttatgtacacatactttttcttgcttagttataataatctgttcttaaagaaaatgtcagtctctacattctatgctgactgttaaggaaagagcacccacatctgctcctacttagctttttttctgtggttcttacacagtattcctttttttcttttcttgaaagagactcctcctttcttttcttttcttgaaagagttttaaacagataagatggcaaaagtgactgatctctactcccccagtttgaatggtaaatttgaatggtaaattcccatgaacatatatggaaatgtctttatcctactttctccaataaaggctgttcttagcttttcaaatgcaaaa

SEQ ID NO: 449080 - DNA, 1942 bp, Homo sapiens
agcggccggggccacgatggagcgcgacggctgcgcggggggcgggagccgcggcggcgagggcgggcgcgctccccgggagggcccggcggggaacggccgcgatcggggccgcagccacgctgccgaggcgcccggggacccgcaggcggccgcgtccttgctggcccctatggacgtgggggaggagccgctggagaaggcggcgcgcgcccgcactgccaaggaccccaacacctataaagtactctcgctggtattgtcagtatgtgtgttaacaacaatacttggttgtatatttgggttgaaaccaagctgtgccaaagaagttaaaagttgcaaaggtcgctgtttcgagagaacatttgggaactgtcgctgtgatgctgcctgtgttgagcttggaaactgctgtttagattaccaggagacgtgcatagaaccagaacatatatggacttgcaacaaattcaggtgtggtgagaaaaggttgaccagaagcctctgtgcctgttcagatgactgcaaggacaagggcgactgctgcatcaactacagttctgtgtgtcaaggtgagaaaagttgggtagaagaaccatgtgagagcattaatgagccacagtgcccagcagggtttgaaacgcctcctaccctcttattttctttggatggattcagggcagaatatttacacacttggggtggacttcttcctgttattagcaaactaaaaaaatgtggaacatatactaaaaacatgagaccggtatatccaacaaaaactttccccaatcactacagcattgtcaccggattgtatccagaatctcatggcataatcgacaataaaatgtatgatcccaaaatgaatgcttccttttcacttaaaagtaaagagaaatttaatcctgagtggtacaaaggagaaccaatttgggtcacagctaagtatcaaggcctcaagtctggcacatttttctggccaggatcagatgtggaaattaacggaattttcccagacatctataaaatgtataatggttcagtaccatttgaagaaaggattttagctgttcttcagtggctacagcttcctaaagatgaaagaccacacttttacactctgtatttagaagaaccagattcttcaggtcattcatatggaccagtcagcagtgaagtcatcaaagccttgcagagggttgatggtatggttggtatgctgatggatggtctgaaagagctgaacttgcacagatgcctgaacctcatccttatttcagatcatggcatggaacaaggcagttgtaagaaatacatatatctgaataaatatttgggggatgttaaaaatattaaagttatctatggacctgcagctcgattgagaccctctgatgtcccagataaatactattcatttaactatgaaggcattgcccgaaatctttcttgccgggaaccaaaccagcacttcaaaccttacctgaaacatttcttacctaagcgtttgcactttgctaagagtgatagaattgagcccttgacattctatttggaccctcagtggcaacttgcattgaatccctcagaaaggaaatattgtggaagtggatttcatggctctgacaatgtattttcaaatatgcaagccctctttgttggctatggacctggattcaagcatggcattgaggctgacacctttgaaaacattgaagtctataacttaatgtgtgatttactgaatttgacaccggctcctaataacggaactcatggaagtcttaaccaccttctaaagaatcctgtttatacgccaaagcatcccaaagaagtgcaccccctggtacagtgccccttcacaagaaaccccagagataactgggtggtcagttaccttcgaattgcggatggggtttcaccgttcttgctgggggtt

SEQ ID NO: 449081 - DNA, 6207 bp, Homo sapiens
agcggccggggccacgatggagcgcgacggctgcgcggggggcgggagccgcggcggcgagggcgggcgcgctccccgggagggcccggcggggaacggccgcgatcggggccgcagccacgctgccgaggcgcccggggacccgcaggcggccgcgtccttgctggcccctatggacgtgggggaggagccgctggagaaggcggcgcgcgcccgcactgccaaggaccccaacacctataaagtactctcgctggtattgtcagtatgtgtgttaacaacaatacttggttgtatatttgggttgaaaccaagctgtgccaaagaagttaaaagttgcaaaggtcgctgtttcgagagaacatttgggaactgtcgctgtgatgctgcctgtgttgagcttggaaactgctgtttagattaccaggagacgtgcatagaaccagaacatatatggacttgcaacaaattcaggtgtggtgagaaaaggttgaccagaagcctctgtgcctgttcagatgactgcaaggacaagggcgactgctgcatcaactacagttctgtgtgtcaaggtgagaaaagttgggtagaagaaccatgtgagagcattaatgagccacagtgcccagcagggtttgaaacgcctcctaccctcttattttctttggatggattcagggcagaatatttacacacttggggtggacttcttcctgttattagcaaactaaaaaaatgtggaacatatactaaaaacatgagaccggtatatccaacaaaaactttccccaatcactacagcattgtcaccggattgtatccagaatctcatggcataatcgacaataaaatgtatgatcccaaaatgaatgcttccttttcacttaaaagtaaagagaaatttaatcctgagtggtacaaaggagaaccaatttgggtcacagctaagtatcaaggcctcaagtctggcacatttttctggccaggatcagatgtggaaattaacggaattttcccagacatctataaaatgtataatggttcagtaccatttgaagaaaggattttagctgttcttcagtggctacagcttcctaaagatgaaagaccacacttttacactctgtatttagaagaaccagattcttcaggtcattcatatggaccagtcagcagtgaagtcatcaaagccttgcagagggttgatggtatggttggtatgctgatggatggtctgaaagagctgaacttgcacagatgcctgaacctcatccttatttcagatcatggcatggaacaaggcagttgtaagaaatacatatatctgaataaatatttgggggatgttaaaaatattaaagttatctatggacctgcagctcgattgagaccctctgatgtcccagataaatactattcatttaactatgaaggcattgcccgaaatctttcttgccgggaaccaaaccagcacttcaaaccttacctgaaacatttcttacctaagcgtttgcactttgctaagagtgatagaattgagcccttgacattctatttggaccctcagtggcaacttgcattgaatccctcagaaaggaaatattgtggaagtggatttcatggctctgacaatgtattttcaaatatgcaagccctctttgttggctatggacctggattcaagcatggcattgaggctgacacctttgaaaacattgaagtctataacttaatgtgtgatttactgaatttgacaccggctcctaataacggaactcatggaagtcttaaccaccttctaaagaatcctgtttatacgccaaagcatcccaaagaagtgcaccccctggtacagtgccccttcacaagaaaccccagagataaccttggctgctcatgtaacccttcgattttgccgattgaggattttcaaacacagttcaatctgactgtggcagaagagaagattattaagcatgaaactttaccctatggaagacctagagttctccagaaggaaaacaccatctgtcttctttcccagcaccagtttatgagtggatacagccaagacatcttaatgcccctttggacatcctataccgtggacagaaatgacagtttctctacggaagacttctccaactgtctgtaccaggactttagaattcctcttagtcctgtccataaatgttcattttataaaaataacaccaaagtgagttacgggttcctctccccaccacaactaaataaaaattcaagtggaatatattctgaagctttgcttactacaaatatagtgccaatgtaccagagttttcaagttatatggcgctactttcatgacaccctactgcgaaagtatgctgaagaaagaaatggtgtcaatgtcgtcagtggtcctgtgtttgactttgattatgatggacgttgtgattccttagagaatctgaggcaaaaaagaagagtcatccgtaaccaagaaattttgattccaactcacttctttattgtgctaacaagctgtaaagatacatctcagacgcctttgcactgtgaaaacctagacaccttagctttcattttgcctcacaggactgataacagcgagagctgtgtgcatgggaagcatgactcctcatgggttgaagaattgttaatgttacacagagcacggatcacagatgttgagcacatcactggactcagcttctatcaacaaagaaaagagccagtttcagacattttaaagttgaaaacacatttgccaacctttagccaagaagactgatatgttttttatccccaaacaccatgaatctttttgagagaaccttatattttatatagtcctctagctacactattgcattgttcagaaactgtcgaccagagttagaacggagccctcggtgatgcggacatctcagggaaacttgcgtactcagcacagcagtggagagtgttcctgttgaatcttgcacatatttgaatgtgtaagcattgtatacattgatcaagttcgggggaataaagacagaccacacctaaaactgcctttctgcttctcttaaaggagaagtagctgtgaacattgtctggataccagatatttgaatctttcttactattggtaataaaccttgatggcattgggcaaacagtagacttatagtagggttggggtagcccatgttatgtgactatctttatgagaattttaaagtggttctggatatcttttaacttggagtttcatttcttttcattgtaatcaaaaaaaaaattaacagaagccaaaatacttctgagaccttgtttcaatctttgctgtatatcccctcaaaatccaagttattaatcttatgtgttttctttttaattttttgattggatttctttagatttaatggttcaaatgagttcaactttgagggacgatctttgaatatacttacctattataaaatcttactttgtatttgtatttaaaaaagaaaaatattcctatcctgctcactggtaattaacataggtttaaaatggcttcaaatgtggccctatagacggttaaaattgtaccttatcttggcaaaacttcagagcaccagtcagtgcatgcaaggtgccattttttattgagatgcttagaatgtttctttctgtgcacaagacttaccctaccagcagcagagccattctctgttgagtggttcattttgaagttccacagattgaagagaacatgccaccaatcacctcacatcttcttggtggacatgataaatgacacaatgaacttgatttctttactaccttgactgtagctttttatccctacctgtgaaccttcaaagactgcattaacttttaggctacataggtccaattgaggtataatatcagtacaccaaagatttttatatgtccttcgtgtgaccattcttcaacggcctaagggccagctgcaaagacttttggaaaatacaatttacaactcaaaattatttaataatttaggaagttgctttttttttttttttttttcagtcctgcagtttcctgaagctctgtatatgatatttttttcagcctgcttctctctgttgttcagattaggtaattttattcttctgtctcgaagctcactgattctttattctgtctaatctgttctgctgttgagcccatttattcctgatttttatattttagttattgtatgttttatttctaaaatttccattcagtttttctttatatcttctatttgctgagaatttctgtctctttgctgagactttctacgttttcatttgtttcaagtgcatttatacttgcttgttgaagaatttttatgatggctgctgtaaaatccttatcagataattccaacatctgtcacctcattgtttgcatctactgatggtcttttttccattcggaaacattttcctgtttcttggtgtgtggaatgattttttattgaaacctggatatttttaggtattatgttatgagactatgggtcttatttaaaccttctgctttagccaactttctcagataccaccacagcaggggaattgggagcactgcttcattattaccaggtgtggctaggagtccaggttccccagtcagcctccctttatactgagtaacagggtcccctcattactactgggcaaggtgagaattcagtttcccattaggtctttattgattcttccctggctggaatgtgcagcggcaccttttggtgcaccctgggaatctccactaatgctatgggacagagtgaccaggaagagcttcattacaccaggtgggaatgaaattcccagtagcctacacagccttctccgacaccactctggagttgtattcttccagcacacaaacatacacaatttaactcaaagcatcttagcagagcttaattaaatggatagatgcctgttccctttgctggataccaagaatacaaaagtcagggagttggggcacctctttacagcttggtgagagtgtaagtctggactccccactcagcatttgctggtatgggtggggccatggtgtttttccatggtgtttggttggagtacagccttttttacccttgcttggctacccttttctggtcctttggcaggagagagcaggactctcttagggcttttttttcccctgcatttattgacatttccaggttgctgactttttcagctccaagttggaaatatatgagctgaaaagaaaatgtagggaactcatcacagtgttgttacttgggccccaatgttcctagcctattttctgtctactattcagagtcttgctgtgttttaatataatatccaggatttttatatgcatttagcagaaggatgtctactctgcctttgtagaagtgtctcactgatttttacatatttttccagcacacaaacatacacaatttaactcaaagcatcttagcagagcttaattaaatggatagatgtctgttccctttgctggacgccaagaatacaaaaaagaacaagtgacaattttctctgtcttagggagaagagacagcagaagtgtaaatgatccctaaagagtgatagatgttatcatgaagccacaggaggggtgccaggctgcacaaaagagacactggatgcttcttggtagtagaggcagtggcttcccagccttggggctaaggcttgtagggtgaattggaacttttcagatgagcaaggcaaagaagggaccttctaacattccttggatggaacatttttgacattttcccatttacagctacttatattttctacaagtgtcactgtgaccaacttatgtacacatactttttcttgcttagttataataatctgttcttaaagaaaatgtcagtctctacattctatgctgactgttaaggaaagagcacccacatctgctcctacttagctttttttctgtggttcttacacagtattcctttttttcttttcttgaaagagactcctcctttcttttcttttcttgaaagagttttaaacagataagatggcaaaagtgactgatctctactcccccagtttgaatggtaaatttgaatggtaaattcccatgaacatatatggaaatgtctttatcctactttctccaataaaggctgttcttagcttttcaaatgcaaaa

SEQ ID NO: 449082 - DNA, 6151 bp, Homo sapiens
agcggccggggccacgatggagcgcgacggctgcgcggggggcgggagccgcggcggcgagggcgggcgcgctccccgggagggcccggcggggaacggccgcgatcggggccgcagccacgctgccgaggcgcccggggacccgcaggcggccgcgtccttgctggcccctatggacgtgggggaggagccgctggagaaggcggcgcgcgcccgcactgccaaggaccccaacacctataaagtactctcgctggtattgtcagtatgtgtgttaacaacaatacttggttgtatatttgggttgaaaccaagctgtgccaaagaagttaaaagttgcaaaggtcgctgtttcgagagaacatttgggaactgtcgctgtgatgctgcctgtgttgagcttggaaactgctgtttagattaccaggagacgtgcatagaaccagaacatatatggacttgcaacaaattcaggtgtggtgagaaaaggttgaccagaagcctctgtgcctgttcagatgactgcaaggacaagggcgactgctgcatcaactacagttctgtgtgtcaaggtgagaaaagttgggtagaagaaccatgtgagagcattaatgagccacagtgcccagcagggtttgaaacgcctcctaccctcttattttctttggatggattcagggcagaatatttacacacttggggtggacttcttcctgttattagcaaactaaaaaaatgtggaacatatactaaaaacatgagaccggtatatccaacaaaaactttccccaatcactacagcattgtcaccggattgtatccagaatctcatggcataatcgacaataaaatgtatgatcccaaaatgaatgcttccttttcacttaaaagtaaagagaaatttaatcctgagtggtacaaaggagaaccaatttgggtcacagctaagtatcaaggcctcaagtctggcacatttttctggccaggatcagatgtggaaattaacggaattttcccagacatctataaaatgtataatggttcagtaccatttgaagaaaggattttagctgttcttcagtggctacagcttcctaaagatgaaagaccacacttttacactctgtatttagaagaaccagattcttcaggtcattcatatggaccagtcagcagtgaagtcatcaaagccttgcagagggttgatggtatggttggtatgctgatggatggtctgaaagagctgaacttgcacagatgcctgaacctcatccttatttcagatcatggcatggaacaaggcagttgtaagaaatacatatatctgaataaatatttgggggatgttaaaaatattaaagttatttaactatgaaggcattgcccgaaatctttcttgccgggaaccaaaccagcacttcaaaccttacctgaaacatttcttacctaagcgtttgcactttgctaagagtgatagaattgagcccttgacattctatttggaccctcagtggcaacttgcattgaatccctcagaaaggaaatattgtggaagtggatttcatggctctgacaatgtattttcaaatatgcaagccctctttgttggctatggacctggattcaagcatggcattgaggctgacacctttgaaaacattgaagtctataacttaatgtgtgatttactgaatttgacaccggctcctaataacggaactcatggaagtcttaaccaccttctaaagaatcctgtttatacgccaaagcatcccaaagaagtgcaccccctggtacagtgccccttcacaagaaaccccagagataaccttggctgctcatgtaacccttcgattttgccgattgaggattttcaaacacagttcaatctgactgtggcagaagagaagattattaagcatgaaactttaccctatggaagacctagagttctccagaaggaaaacaccatctgtcttctttcccagcaccagtttatgagtggatacagccaagacatcttaatgcccctttggacatcctataccgtggacagaaatgacagtttctctacggaagacttctccaactgtctgtaccaggactttagaattcctcttagtcctgtccataaatgttcattttataaaaataacaccaaagtgagttacgggttcctctccccaccacaactaaataaaaattcaagtggaatatattctgaagctttgcttactacaaatatagtgccaatgtaccagagttttcaagttatatggcgctactttcatgacaccctactgcgaaagtatgctgaagaaagaaatggtgtcaatgtcgtcagtggtcctgtgtttgactttgattatgatggacgttgtgattccttagagaatctgaggcaaaaaagaagagtcatccgtaaccaagaaattttgattccaactcacttctttattgtgctaacaagctgtaaagatacatctcagacgcctttgcactgtgaaaacctagacaccttagctttcattttgcctcacaggactgataacagcgagagctgtgtgcatgggaagcatgactcctcatgggttgaagaattgttaatgttacacagagcacggatcacagatgttgagcacatcactggactcagcttctatcaacaaagaaaagagccagtttcagacattttaaagttgaaaacacatttgccaacctttagccaagaagactgatatgttttttatccccaaacaccatgaatctttttgagagaaccttatattttatatagtcctctagctacactattgcattgttcagaaactgtcgaccagagttagaacggagccctcggtgatgcggacatctcagggaaacttgcgtactcagcacagcagtggagagtgttcctgttgaatcttgcacatatttgaatgtgtaagcattgtatacattgatcaagttcgggggaataaagacagaccacacctaaaactgcctttctgcttctcttaaaggagaagtagctgtgaacattgtctggataccagatatttgaatctttcttactattggtaataaaccttgatggcattgggcaaacagtagacttatagtagggttggggtagcccatgttatgtgactatctttatgagaattttaaagtggttctggatatcttttaacttggagtttcatttcttttcattgtaatcaaaaaaaaaattaacagaagccaaaatacttctgagaccttgtttcaatctttgctgtatatcccctcaaaatccaagttattaatcttatgtgttttctttttaattttttgattggatttctttagatttaatggttcaaatgagttcaactttgagggacgatctttgaatatacttacctattataaaatcttactttgtatttgtatttaaaaaagaaaaatattcctatcctgctcactggtaattaacataggtttaaaatggcttcaaatgtggccctatagacggttaaaattgtaccttatcttggcaaaacttcagagcaccagtcagtgcatgcaaggtgccattttttattgagatgcttagaatgtttctttctgtgcacaagacttaccctaccagcagcagagccattctctgttgagtggttcattttgaagttccacagattgaagagaacatgccaccaatcacctcacatcttcttggtggacatgataaatgacacaatgaacttgatttctttactaccttgactgtagctttttatccctacctgtgaaccttcaaagactgcattaacttttaggctacataggtccaattgaggtataatatcagtacaccaaagatttttatatgtccttcgtgtgaccattcttcaacggcctaagggccagctgcaaagacttttggaaaatacaatttacaactcaaaattatttaataatttaggaagttgctttttttttttttttttttcagtcctgcagtttcctgaagctctgtatatgatatttttttcagcctgcttctctctgttgttcagattaggtaattttattcttctgtctcgaagctcactgattctttattctgtctaatctgttctgctgttgagcccatttattcctgatttttatattttagttattgtatgttttatttctaaaatttccattcagtttttctttatatcttctatttgctgagaatttctgtctctttgctgagactttctacgttttcatttgtttcaagtgcatttatacttgcttgttgaagaatttttatgatggctgctgtaaaatccttatcagataattccaacatctgtcacctcattgtttgcatctactgatggtcttttttccattcggaaacattttcctgtttcttggtgtgtggaatgattttttattgaaacctggatatttttaggtattatgttatgagactatgggtcttatttaaaccttctgctttagccaactttctcagataccaccacagcaggggaattgggagcactgcttcattattaccaggtgtggctaggagtccaggttccccagtcagcctccctttatactgagtaacagggtcccctcattactactgggcaaggtgagaattcagtttcccattaggtctttattgattcttccctggctggaatgtgcagcggcaccttttggtgcaccctgggaatctccactaatgctatgggacagagtgaccaggaagagcttcattacaccaggtgggaatgaaattcccagtagcctacacagccttctccgacaccactctggagttgtattcttccagcacacaaacatacacaatttaactcaaagcatcttagcagagcttaattaaatggatagatgcctgttccctttgctggataccaagaatacaaaagtcagggagttggggcacctctttacagcttggtgagagtgtaagtctggactccccactcagcatttgctggtatgggtggggccatggtgtttttccatggtgtttggttggagtacagccttttttacccttgcttggctacccttttctggtcctttggcaggagagagcaggactctcttagggcttttttttcccctgcatttattgacatttccaggttgctgactttttcagctccaagttggaaatatatgagctgaaaagaaaatgtagggaactcatcacagtgttgttacttgggccccaatgttcctagcctattttctgtctactattcagagtcttgctgtgttttaatataatatccaggatttttatatgcatttagcagaaggatgtctactctgcctttgtagaagtgtctcactgatttttacatatttttccagcacacaaacatacacaatttaactcaaagcatcttagcagagcttaattaaatggatagatgtctgttccctttgctggacgccaagaatacaaaaaagaacaagtgacaattttctctgtcttagggagaagagacagcagaagtgtaaatgatccctaaagagtgatagatgttatcatgaagccacaggaggggtgccaggctgcacaaaagagacactggatgcttcttggtagtagaggcagtggcttcccagccttggggctaaggcttgtagggtgaattggaacttttcagatgagcaaggcaaagaagggaccttctaacattccttggatggaacatttttgacattttcccatttacagctacttatattttctacaagtgtcactgtgaccaacttatgtacacatactttttcttgcttagttataataatctgttcttaaagaaaatgtcagtctctacattctatgctgactgttaaggaaagagcacccacatctgctcctacttagctttttttctgtggttcttacacagtattcctttttttcttttcttgaaagagactcctcctttcttttcttttcttgaaagagttttaaacagataagatggcaaaagtgactgatctctactcccccagtttgaatggtaaatttgaatggtaaattcccatgaacatatatggaaatgtctttatcctactttctccaataaaggctgttcttagcttttcaaatgcaaaa

SEQ ID NO: 449083 - DNA, 1478 bp, Homo sapiens
agcggccggggccacgatggagcgcgacggctgcgcggggggcgggagccgcggcggcgagggcgggcgcgctccccgggagggcccggcggggaacggccgcgatcggggccgcagccacgctgccgaggcgcccggggacccgcaggcggccgcgtccttgctggcccctatggacgtgggggaggagccgctggagaaggcggcgcgcgcccgcactgccaaggaccccaacacctataaagtactctcgctggtattgtcagtatgtgtgttaacaacaatacttggttgtatatttgggttgaaaccaagctgtgccaaagaagttaaaagttgcaaaggtcgctgtttcgagagaacatttgggaactgtcgctgtgatgctgcctgtgttgagcttggaaactgctgtttagattaccaggagacgtgcatagaaccagaacatatatggacttgcaacaaattcaggtgtggtgagaaaaggttgaccagaagcctctgtgcctgttcagatgactgcaaggacaagggcgactgctgcatcaactacagttctgtgtgtcaaggtgagaaaagttgggtagaagaaccatgtgagagcattaatgagccacagtgcccagcagggtttgaaacgcctcctaccctcttattttctttggatggattcagggcagaatatttacacacttggggtggacttcttcctgttattagcaaactaaaaaaatgtggaacatatactaaaaacatgagaccggtatatccaacaaaaactttccccaatcactacagcattgtcaccggattgtatccagaatctcatggcataatcgacaataaaatgtatgatcccaaaatgaatgcttccttttcacttaaaagtaaagagaaatttaatcctgagtggtacaaaggagaaccaatttgggtcacagctaagtatcaaggcctcaagtctggcacatttttctggccaggatcagatgtggaaattaacggaattttcccagacatctataaaatgtataatggttcagtaccatttgaagaaaggattttagctgttcttcagtggctacagcttcctaaagatgaaagaccacacttttacactctgtatttagaagaaccagattcttcaggtcattcatatggaccagtcagcagtgaagtcatcaaagccttgcagagggttgatggtatggttggtatgctgatggatggtctgaaagagctgaacttgcacagatgcctgaacctcatccttatttcagatcatggcatggaacaaggcagttgtaagaaatacatatatctgaataaatatttgggggatgttaaaaatattaaagttatctatggacctgcagctcgattgagaccctctgatgtcccagataaatactattcatgaaggcattgcccgaaatctttcagcaaggacaccacggggtcacgagctcgcaatc

SEQ ID NO: 449084 - DNA, 679 bp, Homo sapiens
gagatttgtcacagtttggaagcagtctattccatcaactagccaaaaatgcaaacaccctgaggattcagagaacaatttctttgaagggtttccttcaagatactggctcccagctttcttctttccacaagcctttcttgctgctgtgcttcaagactatgggaggtcccgaggaatcgctgtggatgccctcaccttcacccaccatgtgatttccaacaccactgacaaggatgagaagttctccgtatttatgccaaagaaactcaacatagtcaggagagcgtttaagggctcagcttcctctcacactggagtttacatttttggtttattcatcgagggggcaagatggaatcgtgaacagaaaatactggaagactcgctgcctctggagatgtgctgtgattttcccgacatatactttttgccaacaaagatttctaccaaaacaccaaatgcttccaaccagacagattcagaactctatgcttttgaatgcccagtttaccagacacctgagaggtcaagaattttggcaactaccggtttaccaacaaactttttaacatcagtgtatttatcaacgaagaaacctcctagtcactggatcacaatgcgggttgcattgctttgtgagaagaatgaaaaataaatgtccatatcaaaccatttt

SEQ ID NO: 449085 - DNA, 679 bp, Homo sapiens
gagatttgtcacagtttggaagcagtctattccatcaactagccaaaaatgcaaacaccctgaggattcagagaacaatttctttgaagggtttccttcaagatactggctcccagctttcttctttccacaagcctttcttgctgctgtgcttcaagactatgggaggtcccgaggaatcgctgtggatgccctcaccttcacccaccatgtgatttccaacaccactgacaaggatgagaagttctccgtatttatgccaaagaaactcaacatagtcaggagagcgtttaagggctcagcttcctctcacactggagtttacatttttggtttattcatcgagggggcaagatggaatcgtgaacagaaaatactggaagactcgctgcctctggagatgtgctgtgattttcccgacatatactttttgccaacaaagatttctaccaaaacaccaaatgcttccaaccagacagattcagaactctatgcttttgaatgcccagtttcctctcccccctcactctttttttttttttttttctccctcccacccctcccccaccctcctcccctcttttttccaactaataaacctcctagtcactggatcacaatgcgggttgcattgctttgtgagaagaatgaaaaataaatgtccatatcaaaccatttt

SEQ ID NO: 449086 - DNA, 897 bp, Homo sapiens
gagatttgtcacagtttggaagcagtctattccatcaactagccaaaaatgcaaacaccctgaggattcagagaacaatttctttgaagggtttccttcaagatactggctcccagctttcttctttccacaagcctttcttgctgctgtgcttcaagactatgggaggtcccgaggaatcgctgtggatgccctcaccttcacccaccatgtgatttccaacaccactgacaaggatgagaagttctccgtatttatgccaaagaaactcaacatagtcaggagagcgtttaagggctcagcttcctctcacactggagtttacatttttggtttattcatcgagggggcaagatggaatcgtgaacagaaaatactggaagactcgctgcctctggagatgtgctgtgattttcccgacatatactttttgccaacaaagatttctaccaaaacaccaaatgcttccaaccagacagattcagaactctatgcttttgaatgcccagtttaccagacacctgagaggtcaagaattttggcaactaccggtttaccaacaaactttttaacatcagtgtatttatcaacgaagaaacctcctagtcactggatcacaatgcgggttgcattgctttgtgagaagaatgaaaaataaatgtccatatcaaaccattttaatttttgactctaatcagacttacatgtttcaagacattcacatgtagtcaacaccctttataaaatatttgtgtgttcagccagactgggcaggtgcagtctatttcatttgtacatgaaaacttcaacacagaggggaatcttgcagctgctttttattctaagtacatgagacctgactgtgcaatgtccctgtggttgggctctagtacaggt

SEQ ID NO: 449087 - DNA, 5090 bp, Homo sapiens
gcctgcgccgcgcagcccgcctcgggcgggaggcgggaggcgggaggccgggcccaggccggggcagcccctccaccgcaccgtcctgggccggtgcccaggtccgagtcgccttccgcctgccccccccgccaatcccccgccgcggcagccccagccaggtcccgccgccaggccggctcccgcccccgctccgcccccggagccgcagccccgcccgccatcgccgtcgccatgttgtggctcccgcagccggcgctggggacgcgcgcggccgagactctggcctgcagtcgccgccgccgccgccaggtggtgtttggactctagaccatgtgcctaggtagaagtttttcctttctccgcagctctgctcccctagcaacgctcgccacacccttgttttgagatcctctctaaggagcggagagtttaataggcaagaaggaagggagaagacagaaggaagacgctcccccgtacggagacagagggagggggggctccaaagccgaaagaggaggtccctacctgccacggataccagtcagcccttgccagcatccagccatgggggatatgaaaaccccagattttgatgaccttctggctgcctttgacatcccagaccccaccagccttgatgccaaggaggccatccagacacccagtgaggagaatgagagtcccctcaaacctccaggcatatgtatggatgaaagtgtgtccttgtctcactcaggatcagcccccgatgtgccggccgtgagtgtcattgtcaagaacaccagccgccaggagtcatttgaagcggagaaagaccacattactcccagtctcctacacaatggattccggggctcagatctgcctccagatccccacaactgtgggaaatttgattctacttttatgaatggagacagtgccaggagtttccctggcaaactggagcctcccaagtcagagccattacccaccttcaaccagttcagtccaatctccagcccagaacctgaggatcccatcaaagataacggatttgggataaagcccaaacactctgacagttatttcccaccccctcttgggtgcggggctgtgggaggcccagtcctggaggctctggctaagtttccggttccagagctgcatatgtttgatcatttttgtaagaaagaacccaagccagaacccctgcccttggggagccagcaggaacacgagcaaagtgggcagaacacagtggaacctcacaaggatccggatgccactcgattcttcggggaagctttggagttcaacagccatcctagcaacagtattggagagtccaaggggcttgcccgggagcttggtacctgctcatcagtcccccctaggcagcgtctaaagccagctcattccaagctgtcctcttgtgtggcagccttggtggccttgcaggccaaaagagtggctagtgtcactaaggaggatcagcctggccacacaaaggatctctcagggcccactaaagagagttctaaaggtagccccaaaatgcccaagtcaccaaagagtccccggagccctctggaggccactagaaaaagtatcaagccatcggacagccctcgtagcatctgcagtgacagcagcagcaaaggctcaccgtctgtggctgccagctccccaccagcaattcccaaagtgagaatcaaaaccattaagacatcatcaggggaaatcaaacggactgtcacaaggatcctgccagatcctgatgatccaagtaagtcccctgttgggtcacctctagggagcgccattgcagaggcccccagcgagatgccaggggatgaggtgcctgtggaagagcactttcctgaggcaggcacaaattcagggagcccccagggggccaggaaaggggacgagagcatgacaaaggccagtgactcgtcatctcccagctgcagttctgggccccgggtcccaaagggggctgccccaggctcacagacaggcaagaagcaacagagcacagcactgcaggcatccaccctggcccctgccaacctcctgcccaaagccgtgcacttggccaacctgaacctcgtcccccacagtgttgctgcatcagtgacagccaagtcttcagtgcaaagacggagccagccacagcttacacaaatgtcggtgcccctggtccaccaggtgaaaaaggctgccccactgattgtagaggtcttcaacaaggtccttcacagctccaaccccgtgcccctctatgcgccaaatctcagcccgcctgcggacagcaggatccacgtgccggccagtgggtactgctgcctggagtgtggagacgcatttgccttagagaagagcctgagccagcactatggccggcggagcgtccacattgaggtactgtgcacactgtgctccaagacgctgctcttcttcaacaagtgcagcctgctccggcacgcccgtgaccacaagagcaaggggctcgtcatgcagtgttcccagctgctggtgaagcctatctctgcggaccaaatgttcgtgtcggcccctgtgaactccacggcaccagcagccccagccccttcatcctctcccaaacatggcctcacttcgggcagtgccagtccccctcctccagccttgccactctacccagaccctgtgaggctcatccggtactcaatcaagtgtcttgaatgtcacaagcagatgcgggactacatggtcctggctgcacatttccagaggacaacagaggagacagaggggctgacctgccaggtatgccagatgctgctgcccaaccagtgcagtttctgtgcccaccagcggattcatgcacacaagtccccctactgctgcccggagtgtggggtcctctgccgctctgcctacttccagacccatgtaaaggagaattgcctgcactatgcccgcaaggtgggctacaggtgcatccactgtggtgtcgtccacctgaccttggccttgctgaaaagccacatccaggagcgacactgccaggttttccacaaatgtgcattctgccccatggccttcaagactgccagcagcactgcagaccacagtgccacccagcaccccacccagccccacagaccctcccagctcatttataagtgctcctgtgaaatggtcttcaacaagaagaggcacattcagcagcatttttaccagaatgtcagcaagacgcaggtgggcgtcttcaagtgccctgagtgcccactcttgttcgtgcagaagccggagttgatgcaacacgtcaagagcacccacggtgttccccgaaatgtggacgagctgtcaagcctccagtcttcagcggacacatcctcaagccgccctggctctcgagttcccactgagccaccagccactagtgtggctgctcggagcagctccctgccttctggccgctggggtaggcctgaagcccaccgcagggtggaagccaggccgcggctgaggaacactggctggacctgccaggagtgccaggagtgggttccagatcgggagagctacgtgtcccacatgaaaaagagccacggtcggacattgaagcggtacccatgccggcagtgtgaacagtccttccacacccccaacagcctgcgcaaacacatccgcaacaaccatgacacagtaaagaagttctacacctgcgggtactgcacagaggacagccccagctttcctcggccctcccttctggagagccacatcagccttatgcatggcatcagaaaccctgatttgagccagacgtccaaagtgaaacctccgggtggacattcccctcaggtgaaccatctgaaaagaccagtcagtggagtgggggacgctccaggcaccagcaatggcgcaactgtctcttccaccaaaaggcacaagtccctttttcagtgcgcgaaatgtagttttgccacagactcggggctcgagtttcagagccacatacctcagcaccaggtggacagctccacagcccaatgtctcctctgtggtttgtgctacacctctgccagctccctcagccgccacctcttcattgtccacaaggtgagagaccaggaggaggaggaggaagaggaggcggcggcagcggagatggcagtggaggtggcagagccagaggagggctccggggaggaggtgcccatggagactagagagaatggactggaagaatgtgccggtgagcctttgtcagctgacccagaggcgaggagattgctgggcccggcccctgaggacgatggtggccacaatgatcacagtcaaccacaggcctctcaggaccaggacagccacacactgtcccctcaggtgtgaccggagactttgcagtgtgcatggtcaggggtggtgccgaagtgtcttccacctgccctgcggaccgtggaaaataaaaggctctgcccccagtgtgagtgtgaccggttgtaccctggagtagtgtctgccctgagctgccagtgctgggtatcccccagccccaggaaatgtggggtcggccaggaccctcacagctctgaatttgcttctgttatttatggcttttcgctgcttcttggtgccccatctcttgtctgtgtccttccaaccccaagctgcttatgtggcccaaccccactgctgtcaactaggcttgaaccccacagcggctgtgctcttctgggaggttcccgcttgctgccttcagccagggcgctcctcagagctctattttcctgcagacaccagctctccttcctgcctttagatcctgagaaggagggaaatgaggggtgctgacacagtccctctgggagagctctgcctagtctggtttggcgagggcccttgatcaccttgcccctcctccctgtcttctctgattcttttccctcaaaatagtcctgagaactaattgtcacaagacattggaatatttgtactgctctcgtgccatttgagaggctgctgccccaggcaggccagcccctactcctcttggctacactcatgttgctcagactatatttcaaataaaaaatcttctcaccatg

SEQ ID NO: 449088 - DNA, 5279 bp, Homo sapiens
gcctgcgccgcgcagcccgcctcgggcgggaggcgggaggcgggaggccgggcccaggccggggcagcccctccaccgcaccgtcctgggccggtgcccaggtccgagtcgccttccgcctgccccccccgccaatcccccgccgcggcagccccagccaggtcccgccgccaggccggctcccgcccccgctccgcccccggagccgcagccccgcccgccatcgccgtcgccatgttgtggctcccgcagccggcgctggggacgcgcgcggccgagactctggcctgcagtcgccgccgccgccgccaggtggtgtttggactctagaccatgtgcctaggtagaagtttttcctttctccgcagctctgctcccctagcaacgctcgccacacccttgttttgagatcctctctaaggagcggagagtttaataggcaagaaggaagggagaagacagaaggaagacgctcccccgtacggagacagagggagggggggctccaaagccgaaagaggaggtccctacctgccacggataccagtcagcccttgccagcatccagccatgggggatatgaaaaccccagattttgatgaccttctggctgcctttgacatcccagaccccaccagccttgatgccaaggaggccatccagacacccagtgaggagaatgagagtcccctcaaacctccaggcatatgtatggatgaaagtgtgtccttgtctcactcaggatcagcccccgatgtgccggccgtgagtgtcattgtcaagaacaccagccgccaggagtcatttgaagcggagaaagaccacattactcccagtctcctacacaatggattccggggctcagatctgcctccagatccccacaactgtgggaaatttgattctacttttatgaatggagacagtgccaggagtttccctggcaaactggagcctcccaagtcagagccattacccaccttcaaccagttcagtccaatctccagcccagaacctgaggatcccatcaaagataacggatttgggataaagcccaaacactctgacagttatttcccaccccctcttgggtgcggggctgtgggaggcccagtcctggaggctctggctaagtttccggttccagagctgcatatgtttgatcatttttgtaagaaagaacccaagccagaacccctgcccttggggagccagcaggaacacgagcaaagtgggcagaacacagtggaacctcacaaggatccggatgccactcgattcttcggggaagctttggagttcaacagccatcctagcaacagtattggagagtccaaggggcttgcccgggagcttggtacctgctcatcagtcccccctaggcagcgtctaaagccagctcattccaagctgtcctcttgtgtggcagccttggtggccttgcaggccaaaagagtggctagtgtcactaaggaggatcagcctggccacacaaaggatctctcagggcccactaaagagagttctaaaggtagccccaaaatgcccaagtcaccaaagagtccccggagccctctggaggccactagaaaaagtatcaagccatcggacagccctcgtagcatctgcagtgacagcagcagcaaaggctcaccgtctgtggctgccagctccccaccagcaattcccaaagtgagaatcaaaaccattaagacatcatcaggggaaatcaaacggactgtcacaaggatcctgccagatcctgatgatccaagtaagtcccctgttgggtcacctctagggagcgccattgcagaggcccccagcgagatgccaggggatgaggtgcctgtggaagagcactttcctgaggcaggcacaaattcagggagcccccagggggccaggaaaggggacgagagcatgacaaaggccagtgactcgtcatctcccagctgcagttctgggccccgggtcccaaagggggctgccccaggctcacagacaggcaagaagcaacagagcacagcactgcaggcatccaccctggcccctgccaacctcctgcccaaagccgtgcacttggccaacctgaacctcgtcccccacagtgttgctgcatcagtgacagccaagtcttcagtgcaaagacggagccagccacagcttacacaaatgtcggtgcccctggtccaccaggtgaaaaaggctgccccactgattgtagaggtcttcaacaaggtccttcacagctccaaccccgtgcccctctatgcgccaaatctcagcccgcctgcggacagcaggatccacgtgccggccagtgggtactgctgcctggagtgtggagacgcatttgccttagagaagagcctgagccagcactatggccggcggagcgtccacattgaggtactgtgcacactgtgctccaagacgctgctcttcttcaacaagtgcagcctgctccggcacgcccgtgaccacaagagcaaggggctcgtcatgcagtgttcccagctgctggtgaagcctatctctgcggaccaaatgttcgtgtcggcccctgtgaactccacggcaccagcagccccagccccttcatcctctcccaaacatggcctcacttcgggcagtgccagtccccctcctccagccttgccactctacccagaccctgtgaggctcatccggtactcaatcaagtgtcttgaatgtcacaagcagatgcgggactacatggtcctggctgcacatttccagaggacaacagaggagacagaggggctgacctgccaggtatgccagatgctgctgcccaaccagtgcagtttctgtgcccaccagcggattcatgcacacaagtccccctactgctgcccggagtgtggggtcctctgccgctctgcctacttccagacccatgtaaaggagaattgcctgcactatgcccgcaaggtgggctacaggtgcatccactgtggtgtcgtccacctgaccttggccttgctgaaaagccacatccaggagcgacactgccaggttttccacaaatgtgcattctgccccatggccttcaagactgccagcagcactgcagaccacagtgccacccagcaccccacccagccccacagaccctcccagctcatttataagtgctcctgtgaaatggtcttcaacaagaagaggcacattcagcagcatttttaccagaatgtcagcaagacgcaggtgggcgtcttcaagtgccctgagtgcccactcttgttcgtgcagaagccggagttgatgcaacacgtcaagagcacccacggtgttccccgaaatgtggacgagctgtcaagcctccagtcttcagcggacacatcctcaagccgccctggctctcgagttcccactgagccaccagccactagtgtggctgctcggagcagctccctgccttctggccgctggggtaggcctgaagcccaccgcagggtggaagccaggccgcggctgaggaacactggctggacctgccaggagtgccaggagtgggttccagatcgggagagctacgtgtcccacatgaaaaagagccacggtcggacattgaagcggtacccatgccggcagtgtgaacagtccttccacacccccaacagcctgcgcaaacacatccgcaacaaccatgacacagtaaagaagttctacacctgcgggtactgcacagaggacagccccagctttcctcggccctcccttctggagagccacatcagccttatgcatggcatcagaaaccctgatttgagccagacgtccaaagtgaaacctccgggtggacattcccctcaggtgaaccatctgaaaagaccagtcagtggagtgggggacgctccaggcaccagcaatggcgcaactgtctcttccaccaaaaggcacaagtccctttttcagtgcgcgaaatgtagttttgccacagactcggggctcgagtttcagagccacatacctcagcaccaggtggacagctccacagcccaatgtctcctctgtggtttgtgctacacctctgccagctccctcagccgccacctcttcattgtccacaaggtgagagaccaggaggaggaggaggaagaggaggcggcggcagcggagatggcagtggaggtggcagagccagaggagggctccggggaggaggtgcccatggagactagagagaatggactggaagaatgtgccggtgagcctttgtcagctgacccagaggcgaggagattgctgggcccggcccctgaggacgatggtggccacaatgatcacagtcaaccacaggcctctcaggaccaggacagccacacactgtcccctcaggtgtgaccggagactttgcagtgtgcatggtcaggggtggtgccgaagtgtcttccacctgccctgcggaccgtggaaaataaaaggctctgcccccagtgtgagtgtgaccggttgtaccctggagtagtgtctgccctgagctgccagtgctgggtatcccccagccccaggaaatgtggggtcggccaggaccctcacagctctgaatttgcttctgttatttatggcttttcgctgcttcttggtgccccatctcttgtctgtgtccttccaaccccaagctgcttatgtggcccaaccccactgctgtcaactaggcttgaaccccacagcggctgtgctcttctgggaggttcccgcttgctgccttcagccagggcgctcctcagagctctattttcctgcagacaccagctctccttcctgcctttagatcctgagaaggagggaaatgaggggtgctgacacagtccctctgggagagctctgcctagtctggtttggcgagggcccttgatcaccttgcccctcctccctgtcttctctgattcttttccctcaaaatagtcctgagaactaattgtcacactggctcatcatgtctctgtgggtggggtgggagaaacctctgctgcacacctctgtttggaacctgggcagagcaggaggtaaggcaaaggcaggcaggcaccaagaaccagaccccttgagaaggcgctgtgggtgggtctttgttctgctgttctgcctttcctgacaggtggggttggggcacacagacattggaatatttgtactgctctcgtgccatttgagaggctgctgccccaggcaggccagcccctactcctcttggctacactcatgttgctcagactatatttcaaataaaaaatcttctcaccatg

SEQ ID NO: 449089 - DNA, 5708 bp, Homo sapiens
gcctgcgccgcgcagcccgcctcgggcgggaggcgggaggcgggaggccgggcccaggccggggcagcccctccaccgcaccgtcctgggccggtgcccaggtccgagtcgccttccgcctgccccccccgccaatcccccgccgcggcagccccagccaggtcccgccgccaggccggctcccgcccccgctccgcccccggagccgcagccccgcccgccatcgccgtcgccatgttgtggctcccgcagccggcgctggggacgcgcgcggccgagactctggcctgcagtcgccgccgccgccgccaggtggtgtttggactctagaccatgtgcctaggtagaagtttttcctttctccgcagctctgctcccctagcaacgctcgccacacccttgttttgagatcctctctaaggagcggagagtttaataggcaagaaggaagggagaagacagaaggaagacgctcccccgtacggagacagagggagggggggctccaaagccgaaagaggaggtccctacctgccacggataccagtcagcccttgccagcatccagccatgggggatatgaaaaccccagattttgatgaccttctggctgcctttgacatcccagaccccaccagccttgatgccaaggaggccatccagacacccagtgaggagaatgagagtcccctcaaacctccaggcatatgtatggatgaaagtgtgtccttgtctcactcaggatcagcccccgatgtgccggccgtgagtgtcattgtcaagaacaccagccgccaggagtcatttgaagcggagaaagaccacattactcccagtctcctacacaatggattccggggctcagatctgcctccagatccccacaactgtgggaaatttgattctacttttatgaatggagacagtgccaggagtttccctggcaaactggagcctcccaagtcagagccattacccaccttcaaccagttcagtccaatctccagcccagaacctgaggatcccatcaaagataacggatttgggataaagcccaaacactctgacagttatttcccaccccctcttgggtgcggggctgtgggaggcccagtcctggaggctctggctaagtttccggttccagagctgcatatgtttgatcatttttgtaagaaagaacccaagccagaacccctgcccttggggagccagcaggaacacgagcaaagtgggcagaacacagtggaacctcacaaggatccggatgccactcgattcttcggggaagctttggagttcaacagccatcctagcaacagtattggagagtccaaggggcttgcccgggagcttggtacctgctcatcagtcccccctaggcagcgtctaaagccagctcattccaagctgtcctcttgtgtggcagccttggtggccttgcaggccaaaagagtggctagtgtcactaaggaggatcagcctggccacacaaaggatctctcagggcccactaaagagagttctaaaggtagccccaaaatgcccaagtcaccaaagagtccccggagccctctggaggccactagaaaaagtatcaagccatcggacagccctcgtagcatctgcagtgacagcagcagcaaaggctcaccgtctgtggctgccagctccccaccagcaattcccaaagtgagaatcaaaaccattaagacatcatcaggggaaatcaaacggactgtcacaaggatcctgccagatcctgatgatccaagtaagtcccctgttgggtcacctctagggagcgccattgcagaggcccccagcgagatgccaggggatgaggtgcctgtggaagagcactttcctgaggcaggcacaaattcagggagcccccagggggccaggaaaggggacgagagcatgacaaaggccagtgactcgtcatctcccagctgcagttctgggccccgggtcccaaagggggctgccccaggctcacagacaggcaagaagcaacagagcacagcactgcaggcatccaccctggcccctgccaacctcctgcccaaagccgtgcacttggccaacctgaacctcgtcccccacagtgttgctgcatcagtgacagccaagtcttcagtgcaaagacggagccagccacagcttacacaaatgtcggtgcccctggtccaccaggtgaaaaaggctgccccactgattgtagaggtcttcaacaaggtccttcacagctccaaccccgtgcccctctatgcgccaaatctcagcccgcctgcggacagcaggatccacgtgccggccagtgggtactgctgcctggagtgtggagacgcatttgccttagagaagagcctgagccagcactatggccggcggagcgtccacattgaggtactgtgcacactgtgctccaagacgctgctcttcttcaacaagtgcagcctgctccggcacgcccgtgaccacaagagcaaggggctcgtcatgcagtgttcccagctgctggtgaagcctatctctgcggaccaaatgttcgtgtcggcccctgtgaactccacggcaccagcagccccagccccttcatcctctcccaaacatggcctcacttcgggcagtgccagtccccctcctccagccttgccactctacccagaccctgtgaggctcatccggtactcaatcaagtgtcttgaatgtcacaagcagatgcgggactacatggtcctggctgcacatttccagaggacaacagaggagacagaggggctgacctgccaggtatgccagatgctgctgcccaaccagtgcagtttctgtgcccaccagcggattcatgcacacaagtccccctactgctgcccggagtgtggggtcctctgccgctctgcctacttccagacccatgtaaaggagaattgcctgcactatgcccgcaaggtgggctacaggtgcatccactgtggtgtcgtccacctgaccttggccttgctgaaaagccacatccaggagcgacactgccaggttttccacaaatgtgcattctgccccatggccttcaagactgccagcagcactgcagaccacagtgccacccagcaccccacccagccccacagaccctcccagctcatttataagtgctcctgtgaaatggtcttcaacaagaagaggcacattcagcagcatttttaccagaatgtcagcaagacgcaggtgggcgtcttcaagtgccctgagtgcccactcttgttcgtgcagaagccggagttgatgcaacacgtcaagagcacccacggtgttccccgaaatgtggacgagctgtcaagcctccagtcttcagcggacacatcctcaagccgccctggctctcgagttcccactgagccaccagccactagtgtggctgctcggagcagctccctgccttctggccgctggggtaggcctgaagcccaccgcagggtggaagccaggccgcggctgaggaacactggctggacctgccaggagtgccaggagtgggttccagatcgggagagctacgtgtcccacatgaaaaagagccacggtcggacattgaagcggtacccatgccggcagtgtgaacagtccttccacacccccaacagcctgcgcaaacacatccgcaacaaccatgacacagtaaagaagttctacacctgcgggtactgcacagaggacagccccagctttcctcggccctcccttctggagagccacatcagccttatgcatggcatcagaaaccctgatttgagccagacgtccaaagtgaaacctccgggtggacattcccctcaggtgaaccatctgaaaagaccagtcagtggagtgggggacgctccaggcaccagcaatggcgcaactgtctcttccaccaaaaggcacaagtccctttttcagtgcgcgaaatgtagttttgccacagactcggggctcgagtttcagagccacatacctcagcaccaggtggacagctccacagcccaatgtctcctctgtggtttgtgctacacctctgccagctccctcagccgccacctcttcattgtccacaaggtgagagaccaggaggaggaggaggaagaggaggcggcggcagcggagatggcagtggaggtggcagagccagaggagggctccggggaggaggtgcccatggagactagagagaatggactggaagaatgtgccggtgagcctttgtcagctgacccagaggcgaggagattgctgggcccggcccctgaggacgatggtggccacaatgatcacagtcaaccacaggcctctcaggaccaggacagccacacactgtcccctcaggtgtgaccggagactttgcagtgtgcatggtcaggggtggtgccgaagtgtcttccacctgccctgcggaccgtggaaaataaaaggctctgcccccagtgtgagtgtgaccggttgtaccctggagtagtgtctgccctgagctgccagtgctgggtatcccccagccccaggaaatgtggggtcggccaggaccctcacagctctgaatttgcttctgttatttatggcttttcgctgcttcttggtgccccatctcttgtctgtgtccttccaaccccaagctgcttatgtggcccaaccccactgctgtcaactaggcttgaaccccacagcggctgtgctcttctgggaggttcccgcttgctgccttcagccagggcgctcctcagagctctattttcctgcagacaccagctctccttcctgcctttagatcctgagaaggagggaaatgaggggtgctgacacagtccctctgggagagctctgcctagtctggtttggcgagggcccttgatcaccttgcccctcctccctgtcttctctgattcttttccctcaaaatagtcctgagaactaattgtcacactggctcatcatgtctctgtgggtggggtgggagaaacctctgctgcacacctctgtttggaacctgggcagagcaggaggtaaggcaaaggcaggcaggcaccaagaaccagaccccttgagaaggcgctgtgggtgggtctttgttctgctgttctgcctttcctgacaggtggggttggggcacacagacattggaatatttgtactgctctcgtgccatttgagaggctgctgccccaggcaggccagcccctactcctcttggctacactcatgttgctcagactatatttcaaataaaaaatcttctcaccatgcaggtaggctcttgtattcctctccaagtgagcctggccccaccctattccacccaagggtctttcccagacttcccctgtttgtcccatctctgagggagaacaatacttcctactgtctaaggaaggccttctctagattctggagcttgtggttaggaaaccgggagccctgtactacttagttctctagagaccttctgaaggggtgaggggagcggctccacaatggtcaagtcacctccaagatctccaggctagtgacattggctttagggcgtatcgaaattttctaggcaccttcatctttccttcagttgattttcaacataagagaaccccttactggtaaaaagggaaaagggggtggagaagaggaattttataattttcttatagcattcaagaggtttcttatttcttacagca

SEQ ID NO: 449090 - DNA, 767 bp, Homo sapiens
cacgaggtttttttttgcatggtgagaagattttttatttgaaatatagtctgagcaacatgagtgtagccaagaggagtaggggctggcctgcctggggcagcagcctctcaaatggcacgagagcagtacaaatattccaatgtctgtggcccaaccccactgctgtcaactaggcttgaaccccacagcggctgtgctcttctgggaggttcccgcttgctgccttcagccagggcgctcctcagagctctattttcctgcagacaccagctctccttcctgcctttagatcctgagaaggagggaaatgaggggtgctgacacagtccctctgggagagctctgcctagtctggtttggcgagggcccttgatcaccttgcccctcctccctgtcttctctgattcttttccctcaaaatagtcctgagaactaattgtcacactggctcatcatgtctctgtgggtggggtgggagaaacctctgctgcacacctctgtttggaacctgggcagagcaggaggtaaggcaaaggcaggcaggcaccaagaaccagaccccttgagaaggcgctgtgggtgggtctttgttctgctgttctgcctttcctgacaggtggggttggggcacacagacattggaatatttgtactgctctcgtgccatttgagaggctgctgccccaggcaggccagcccctactcctcttggctacactcatgttgctcagactatatttcaaataaaaaatcttctcaccatg

SEQ ID NO: 449091 - DNA, 2996 bp, Homo sapiens
gcctgcgccgcgcagcccgcctcgggcgggaggcgggaggcgggaggccgggcccaggccggggcagcccctccaccgcaccgtcctgggccggtgcccaggtccgagtcgccttccgcctgccccccccgccaatcccccgccgcggcagccccagccaggtcccgccgccaggccggctcccgcccccgctccgcccccggagccgcagccccgcccgccatcgccgtcgccatgttgtggctcccgcagccggcgctggggacgcgcgcggccgagactctggcctgcagtcgccgccgccgccgccaggtggtgtttggactctagaccatgtgcctaggtagaagtttttcctttctccgcagctctgctcccctagcaacgctcgccacacccttgttttgagatcctctctaaggagcggagagtttaataggcaagaaggaagggagaagacagaaggaagacgctcccccgtacggagacagagggagggggggctccaaagccgaaagaggaggtccctacctgccacggataccagtcagcccttgccagcatccagccatgggggatatgaaaaccccagattttgatgaccttctggctgcctttgacatcccagaccccaccagccttgatgccaaggaggccatccagacacccagtgaggagaatgagagtcccctcaaacctccaggcatatgtatggatgaaagtgtgtccttgtctcactcaggatcagcccccgatgtgccggccgtgagtgtcattgtcaagaacaccagccgccaggagtcatttgaagcggagaaagaccacattactcccagtctcctacacaatggattccggggctcagatctgcctccagatccccacaactgtgggaaatttgattctacttttatgaatggagacagtgccaggagtttccctggcaaactggagcctcccaagtcagagccattacccaccttcaaccagttcagtccaatctccagcccagaacctgaggatcccatcaaagataacggatttgggataaagcccaaacactctgacagttatttcccaccccctcttgggtgcggggctgtgggaggcccagtcctggaggctctggctaagtttccggttccagagctgcatatgtttgatcatttttgtaagaaagaacccaagccagaacccctgcccttggggagccagcaggaacacgagcaaagtgggcagaacacagtggaacctcacaaggatccggatgccactcgattcttcggggaagctttggagttcaacagccatcctagcaacagtattggagagtccaaggggcttgcccgggagcttggtacctgctcatcagtcccccctaggcagcgtctaaagccagctcattccaagctgtcctcttgtgtggcagccttggtggccttgcaggccaaaagagtggctagtgtcactaaggaggatcagcctggccacacaaaggatctctcagggcccactaaagagagttctaaaggtagccccaaaatgcccaagtcaccaaagagtccccggagccctctggaggccactagaaaaagtatcaagccatcggacagccctcgtagcatctgcagtgacagcagcagcaaaggctcaccgtctgtggctgccagctccccaccagcaattcccaaagtgagaatcaaaaccattaagacatcatcaggggaaatcaaacggactgtcacaaggatcctgccagatcctgatgatccaagtaagtcccctgttgggtcacctctagggagcgccattgcagaggcccccagcgagatgccaggggatgaggtgcctgtggaagagcactttcctgaggcaggcacaaattcagggagcccccagggggccaggaaaggggacgagagcatgacaaaggccagtgactcgtcatctcccagctgcagttctgggccccgggtcccaaagggggctgccccaggctcacagacaggcaagaagcaacagagcacagcactgcaggcatccaccctggcccctgccaacctcctgcccaaagccgtgcacttggccaacctgaacctcgtcccccacagtgttgctgcatcagtgacagccaagtcttcagtgcaaagacggagccagccacagcttacacaaatgtcggtgcccctggtccaccaggtgaaaaaggctgccccactgattgtagaggtcttcaacaaggtccttcacagctccaaccccgtgcccctctatgcgccaaatctcagcccgcctgcggacagcaggatccacgtgccggccagtgggtactgctgcctggagtgtggagacgcatttgccttagagaagagcctgagccagcactatggccggcggagcgtccacattgaggtactgtgcacactgtgctccaagacgctgctcttcttcaacaagtgcagcctgctccggcacgcccgtgaccacaagagcaaggggctcgtcatgcagtgttcccagctgctggtgaagcctatctctgcggaccaaatgttcgtgtcggcccctgtgaactccacggcaccagcagccccagccccttcatcctctcccaaacatggcctcacttcgggcagtgccagtccccctcctccagccttgccactctacccagaccctgtgaggctcatccggtactcaatcaagtgtcttgaatgtcacaagcagatgcgggactacatggtcctggctgcacatttccagaggacaacagaggagacagaggggctggtaagcagaccctcactgttacgggtatcgggcccctggctcacacaggttccatgactgggcatggagaggaaagctcattgatatgggggcagtggtggaatcttatgagtcttagaagaggatgtctgcctgaatatttagtgtttggtgtttgttggaaaaggtgtcctgcccatactgaggtgagaccctaatttagcaag

SEQ ID NO: 449092 - DNA, 283 bp, Homo sapiens
ccctcaggacgtacttgtcaagggtggaagtccaagtgattgagggagggagaaggtgcctggatagttctgttcctcttctccatccctcctcttgcagcaccacctctgggtccagtactccctatactccacccacactcacactaccccacttctgtctaggtgcatccactgtggtgtcgtccacctgaccttggccttgctgaaaagccacatccaggagcgacactgccaggttttccacaaatgtgcattctgccccatggccttcaagactgcc

SEQ ID NO: 449093 - DNA, 4551 bp, Homo sapiens
cggcggggcccgtgtctggtatagtaggcggcaggctgccgctactactaccaagaacaccagccgccaggagtcatttgaagcggagaaagaccacattactcccagtctcctacacaatggattccggggctcagatctgcctccagatccccacaactgtgggaaatttgattctacttttatgaatggagacagtgccaggagtttccctggcaaactggagcctcccaagtcagagccattacccaccttcaaccagttcagtccaatctccagcccagaacctgaggatcccatcaaagataacggatttgggataaagcccaaacactctgacagttatttcccaccccctcttgggtgcggggctgtgggaggcccagtcctggaggctctggctaagtttccggttccagagctgcatatgtttgatcatttttgtaagaaagaacccaagccagaacccctgcccttggggagccagcaggaacacgagcaaagtgggcagaacacagtggaacctcacaaggatccggatgccactcgattcttcggggaagctttggagttcaacagccatcctagcaacagtattggagagtccaaggggcttgcccgggagcttggtacctgctcatcagtcccccctaggcagcgtctaaagccagctcattccaagctgtcctcttgtgtggcagccttggtggccttgcaggccaaaagagtggctagtgtcactaaggaggatcagcctggccacacaaaggatctctcagggcccactaaagagagttctaaaggtagccccaaaatgcccaagtcaccaaagagtccccggagccctctggaggccactagaaaaagtatcaagccatcggacagccctcgtagcatctgcagtgacagcagcagcaaaggctcaccgtctgtggctgccagctccccaccagcaattcccaaagtgagaatcaaaaccattaagacatcatcaggggaaatcaaacggactgtcacaaggatcctgccagatcctgatgatccaagtaagtcccctgttgggtcacctctagggagcgccattgcagaggcccccagcgagatgccaggggatgaggtgcctgtggaagagcactttcctgaggcaggcacaaattcagggagcccccagggggccaggaaaggggacgagagcatgacaaaggccagtgactcgtcatctcccagctgcagttctgggccccgggtcccaaagggggctgccccaggctcacagacaggcaagaagcaacagagcacagcactgcaggcatccaccctggcccctgccaacctcctgcccaaagccgtgcacttggccaacctgaacctcgtcccccacagtgttgctgcatcagtgacagccaagtcttcagtgcaaagacggagccagccacagcttacacaaatgtcggtgcccctggtccaccaggtgaaaaaggctgccccactgattgtagaggtcttcaacaaggtccttcacagctccaaccccgtgcccctctatgcgccaaatctcagcccgcctgcggacagcaggatccacgtgccggccagtgggtactgctgcctggagtgtggagacgcatttgccttagagaagagcctgagccagcactatggccggcggagcgtccacattgaggtactgtgcacactgtgctccaagacgctgctcttcttcaacaagtgcagcctgctccggcacgcccgtgaccacaagagcaaggggctcgtcatgcagtgttcccagctgctggtgaagcctatctctgcggaccaaatgttcgtgtcggcccctgtgaactccacggcaccagcagccccagccccttcatcctctcccaaacatggcctcacttcgggcagtgccagtccccctcctccagccttgccactctacccagaccctgtgaggctcatccggtactcaatcaagtgtcttgaatgtcacaagcagatgcgggactacatggtcctggctgcacatttccagaggacaacagaggagacagaggggctgacctgccaggtatgccagatgctgctgcccaaccagtgcagtttctgtgcccaccagcggattcatgcacacaagtccccctactgctgcccggagtgtggggtcctctgccgctctgcctacttccagacccatgtaaaggagaattgcctgcactatgcccgcaaggtgggctacaggtgcatccactgtggtgtcgtccacctgaccttggccttgctgaaaagccacatccaggagcgacactgccaggttttccacaaatgtgcattctgccccatggccttcaagactgccagcagcactgcagaccacagtgccacccagcaccccacccagccccacagaccctcccagctcatttataagtgctcctgtgaaatggtcttcaacaagaagaggcacattcagcagcatttttaccagaatgtcagcaagacgcaggtgggcgtcttcaagtgccctgagtgcccactcttgttcgtgcagaagccggagttgatgcaacacgtcaagagcacccacggtgttccccgaaatgtggacgagctgtcaagcctccagtcttcagcggacacatcctcaagccgccctggctctcgagttcccactgagccaccagccactagtgtggctgctcggagcagctccctgccttctggccgctggggtaggcctgaagcccaccgcagggtggaagccaggccgcggctgaggaacactggctggacctgccaggagtgccaggagtgggttccagatcgggagagctacgtgtcccacatgaaaaagagccacggtcggacattgaagcggtacccatgccggcagtgtgaacagtccttccacacccccaacagcctgcgcaaacacatccgcaacaaccatgacacagtaaagaagttctacacctgcgggtactgcacagaggacagccccagctttcctcggccctcccttctggagagccacatcagccttatgcatggcatcagaaaccctgatttgagccagacgtccaaagtgaaacctccgggtggacattcccctcaggtgaaccatctgaaaagaccagtcagtggagtgggggacgctccaggcaccagcaatggcgcaactgtctcttccaccaaaaggcacaagtccctttttcagtgcgcgaaatgtagttttgccacagactcggggctcgagtttcagagccacatacctcagcaccaggtggacagctccacagcccaatgtctcctctgtggtttgtgctacacctctgccagctccctcagccgccacctcttcattgtccacaaggtgagagaccaggaggaggaggaggaagaggaggcggcggcagcggagatggcagtggaggtggcagagccagaggagggctccggggaggaggtgcccatggagactagagagaatggactggaagaatgtgccggtgagcctttgtcagctgacccagaggcgaggagattgctgggcccggcccctgaggacgatggtggccacaatgatcacagtcaaccacaggcctctcaggaccaggacagccacacactgtcccctcaggtgtgaccggagactttgcagtgtgcatggtcaggggtggtgccgaagtgtcttccacctgccctgcggaccgtggaaaataaaaggctctgcccccagtgtgagtgtgaccggttgtaccctggagtagtgtctgccctgagctgccagtgctgggtatcccccagccccaggaaatgtggggtcggccaggaccctcacagctctgaatttgcttctgttatttatggcttttcgctgcttcttggtgccccatctcttgtctgtgtccttccaaccccaagctgcttatgtggcccaaccccactgctgtcaactaggcttgaaccccacagcggctgtgctcttctgggaggttcccgcttgctgccttcagccagggcgctcctcagagctctattttcctgcagacaccagctctccttcctgcctttagatcctgagaaggagggaaatgaggggtgctgacacagtccctctgggagagctctgcctagtctggtttggcgagggcccttgatcaccttgcccctcctccctgtcttctctgattcttttccctcaaaatagtcctgagaactaattgtcacactggctcatcatgtctctgtgggtggggtgggagaaacctctgctgcacacctctgtttggaacctgggcagagcaggaggtaaggcaaaggcaggcaggcaccaagaaccagaccccttgagaaggcgctgtgggtgggtctttgttctgctgttctgcctttcctgacaggtggggttggggcacacagacattggaatatttgtactgctctcgtgccatttgagaggctgctgccccaggcaggccagcccctactcctcttggctacactcatgttgctcagactatatttcaaataaaaaatcttctcaccatg

SEQ ID NO: 449094 - DNA, 5420 bp, Homo sapiens
gcctgcgccgcgcagcccgcctcgggcgggaggcgggaggcgggaggccgggcccaggccggggcagcccctccaccgcaccgtcctgggccggtgcccaggtccgagtcgccttccgcctgccccccccgccaatcccccgccgcggcagccccagccaggtcccgccgccaggccggctcccgcccccgctccgcccccggagccgcagccccgcccgccatcgccgtcgccatgttgtggctcccgcagccggcgctggggacgcgcgcggccgagactctggcctgcagtcgccgccgccgccgccaggtggtgtttggactctagaccatgtgcctaggtagaagtttttcctttctccgcagctctgctcccctagcaacgctcgccacacccttgttttgagatcctctctaaggagcggagagtttaataggcaagaaggaagggagaagacagaaggaagacgctcccccgtacggagacagagggagggggggctccaaagccgaaagaggaggtccctacctgccacggataccagtcagcccttgccagcatccagccatgggggatatgaaaaccccagattttgatgaccttctggctgcctttgacatcccagaccccaccagccttgatgccaaggaggccatccagacacccagtgaggagaatgagagtcccctcaaacctccaggcatatgtatggatgaaagtgtgtccttgtctcactcaggatcagcccccgatgtgccggccgtgagtgtcattgtcaagaacaccagccgccaggagtcatttgaagcggagaaagaccacattactcccagtctcctacacaatggattccggggctcagatctgcctccagatccccacaactgtgggaaatttgattctacttttatgaatggagacagtgccaggagtttccctggcaaactggagcctcccaagtcagagccattacccaccttcaaccagttcagtccaatctccagcccagaacctgaggatcccatcaaagataacggatttgggataaagcccaaacactctgacagttatttcccaccccctcttgggtgcggggctgtgggaggcccagtcctggaggctctggctaagtttccggttccagagctgcatatgtttgatcatttttgtaagaaagaacccaagccagaacccctgcccttggggagccagcaggaacacgagcaaagtgggcagaacacagtggaacctcacaaggatccggatgccactcgattcttcggggaagctttggagttcaacagccatcctagcaacagtattggagagtccaaggggcttgcccgggagcttggtacctgctcatcagtcccccctaggcagcgtctaaagccagctcattccaagctgtcctcttgtgtggcagccttggtggccttgcaggccaaaagagtggctagtgtcactaaggaggatcagcctggccacacaaaggatctctcagggcccactaaagagagttctaaaggtagccccaaaatgcccaagtcaccaaagagtccccggagccctctggaggccactagaaaaagtatcaagccatcggacagccctcgtagcatctgcagtgacagcagcagcaaaggctcaccgtctgtggctgccagctccccaccagcaattcccaaagtgagaatcaaaaccattaagacatcatcaggggaaatcaaacggactgtcacaaggatcctgccagatcctgatgatccaagtaagtcccctgttgggtcacctctagggagcgccattgcagaggcccccagcgagatgccaggggatgaggtgcctgtggaagagcactttcctgaggcaggcacaaattcagggagcccccagggggccaggaaaggggacgagagcatgacaaaggccagtgactcgtcatctcccagctgcagttctgggccccgggtcccaaagggggctgccccaggctcacagacaggcaagaagcaacagagcacagcactgcaggcatccaccctggcccctgccaacctcctgcccaaagccgtgcacttggccaacctgaacctcgtcccccacagtgttgctgcatcagtgacagccaagtcttcagtgcaaagacggagccagccacagcttacacaaatgtcggtgcccctggtccaccaggtgaaaaaggctgccccactgattgtagaggtcttcaacaaggtccttcacagctccaaccccgtgcccctctatgcgccaaatctcagcccgcctgcggacagcaggatccacgtgccggccagtgggtactgctgcctggagtgtggagacgcatttgccttagagaagagcctgagccagcactatggccggcggagcgtccacattgaggtactgtgcacactgtgctccaagacgctgctcttcttcaacaagtgcagcctgctccggcacgcccgtgaccacaagagcaaggggctcgtcatgcagtgttcccagctgctggtgaagcctatctctgcggaccaaatgttcgtgtcggcccctgtgaactccacggcaccagcagccccagccccttcatcctctcccaaacatggcctcacttcgggcagtgccagtccccctcctccagccttgccactctacccagaccctgtgaggctcatccggtactcaatcaagtgtcttgaatgtcacaagcagatgcgggactacatggtcctggctgcacatttccagaggacaacagaggagacagaggggctgacctgccaggtatgccagatgctgctgcccaaccagtgcagtttctgtgcccaccagcggattcatgcacacaagtccccctactgctgcccggagtgtggggtcctctgccgctctgcctacttccagacccatgtaaaggagaattgcctgcactatgcccgcaaggtgggctacaggtgcatccactgtggtgtcgtccacctgaccttggccttgctgaaaagccacatccaggagcgacactgccaggttttccacaaatgtgcattctgccccatggccttcaagactgccagcagcactgcagaccacagtgccacccagcaccccacccagccccacagaccctcccagctcatttataagtgctcctgtgaaatggtcttcaacaagaagaggcacattcagcagcatttttaccagaatgtcagcaagacgcaggtgggcgtcttcaagtgccctgagtgcccactcttgttcgtgcagaagccggagttgatgcaacacgtcaagagcacccacggtgttccccgaaatgtggacgagctgtcaagcctccagtcttcagcggacacatcctcaagccgccctggctctcgagttcccactgagccaccagccactagtgtggctgctcggagcagctccctgccttctggccgctggggtaggcctgaagcccaccgcagggtggaagccaggccgcggctgaggaacactggctggacctgccaggagtgccaggagtgggttccagatcgggagagctacgtgtcccacatgaaaaagagccacggtcggacattgaagcggtacccatgccggcagtgtgaacagtccttccacacccccaacagcctgcgcaaacacatccgcaacaaccatgacacagtaaagaagttctacacctgcgggtactgcacagaggacagccccagctttcctcggccctcccttctggagagccacatcagccttatgcatggcatcagaaaccctgatttgagccagacgtccaaagtgaaacctccgggtggacattcccctcaggtgaaccatctgaaaagaccagtcagtggagtgggggacgctccaggcaccagcaatggcgcaactgtctcttccaccaaaaggcacaagtccctttttcagtgcgcgaaatgtagttttgccacagactcggggctcgagtttcagagccacatacctcagcaccaggtggacagctccacagcccaatgtctcctctgtggtttgtgctacacctctgccagctccctcagccgccacctcttcattgtccacaaggtgagagaccaggaggaggaggaggaagaggaggcggcggcagcggagatggcagtggaggtggcagagccagaggagggctccggggaggaggtgcccatggagactagagagaatggactggaagaatgtgccggtgagcctttgtcagctgacccagaggcgaggagattgctgggcccggcccctgaggacgatggtggccacaatgatcacagtcaaccacaggcctctcaggaccaggacagccacacactgtcccctcaggtgtgaccggagactttgcagtgtgcatggtcaggggtggtgccgaagtgtcttccacctgccctgcggaccgtggaaaataaaaggctctgcccccagtgtgagtgtgaccggttgtaccctggagtagtgtctgccctgagctgccagtgctgggtatcccccagccccaggaaatgtggggtcggccaggaccctcacagctctgaatttgcttctgttatttatggcttttcgctgcttcttggtgccccatctcttgtctgtgtccttccaaccccaagctgcttatgtggcccaaccccactgctgtcaactaggcttgaaccccacagcggctgtgctcttctgggaggttcccgcttgctgccttcagccagggcgctcctcagagctctattttcctgcagacaccagctctccttcctgcctttagatcctgagaaggagggaaatgaggggtgctgacacagtccctctgggagagctctgcctagtctggtttggcgagggcccttgatcaccttgcccctcctccctgtcttctctgattcttttccctcaaaatagtcctgagaactaattgtcacactggctcatcatgtctctgtgggtggggtgggagaaacctctgctgcacacctctgtttggaacctgggcagagcaggaggtaaggcaaaggcaggcaggcaccaagaaccagaccccttgagaaggcgctgtgggtgggtctttgttctgctgttctgcctttcctgacaggtggggttggggcacacagacattggaatatttgtactgctctcgtgccatttgagaggctgctgccccaggcaggccagcccctactcctcttggctacactcatgttgctcagactatatttcaaataaaaaatcttctcaccatgaaaaaaatgaactataataaaaccataaatatatatactgaacttctaaacaacatttcaatatcaaaaaaaccttctaggggggccccgagccccattatgccctaatgggatccctatcacaattaactgaccgatttt

SEQ ID NO: 449095 - DNA, 2765 bp, Homo sapiens
gcctgcgccgcgcagcccgcctcgggcgggaggcgggaggcgggaggccgggcccaggccggggcagcccctccaccgcaccgtcctgggccggtgcccaggtccgagtcgccttccgcctgccccccccgccaatcccccgccgcggcagccccagccaggtcccgccgccaggccggctcccgcccccgctccgcccccggagccgcagccccgcccgccatcgccgtcgccatgttgtggctcccgcagccggcgctggggacgcgcgcggccgagactctggcctgcagtcgccgccgccgccgccaggtggtgtttggactctagaccatgtgcctaggtagaagtttttcctttctccgcagctctgctcccctagcaacgctcgccacacccttgttttgagatcctctctaaggagcggagagtttaataggcaagaaggaagggagaagacagaaggaagacgctcccccgtacggagacagagggagggggggctccaaagccgaaagaggaggtccctacctgccacggataccagtcagcccttgccagcatccagccatgggggatatgaaaaccccagattttgatgaccttctggctgcctttgacatcccagaccccaccagccttgatgccaaggaggccatccagacacccagtgaggagaatgagagtcccctcaaacctccaggcatatgtatggatgaaagtgtgtccttgtctcactcaggatcagcccccgatgtgccggccgtgagtgtcattgtcaagaacaccagccgccaggagtcatttgaagcggagaaagaccacattactcccagtctcctacacaatggattccggggctcagatctgcctccagatccccacaactgtgggaaatttgattctacttttatgaatggagacagtgccaggagtttccctggcaaactggagcctcccaagtcagagccattacccaccttcaaccagttcagtccaatctccagcccagaacctgaggatcccatcaaagataacggatttgggataaagcccaaacactctgacagttatttcccaccccctcttgggtgcggggctgtgggaggcccagtcctggaggctctggctaagtttccggttccagagctgcatatgtttgatcatttttgtaagaaagaacccaagccagaacccctgcccttggggagccagcaggaacacgagcaaagtgggcagaacacagtggaacctcacaaggatccggatgccactcgattcttcggggaagctttggagttcaacagccatcctagcaacagtattggagagtccaaggggcttgcccgggagcttggtacctgctcatcagtcccccctaggcagcgtctaaagccagctcattccaagctgtcctcttgtgtggcagccttggtggccttgcaggccaaaagagtggctagtgtcactaaggaggatcagcctggccacacaaaggatctctcagggcccactaaagagagttctaaaggtagccccaaaatgcccaagtcaccaaagagtccccggagccctctggaggccactagaaaaagtatcaagccatcggacagccctcgtagcatctgcagtgacagcagcagcaaaggctcaccgtctgtggctgccagctccccaccagcaattcccaaagtgagaatcaaaaccattaagacatcatcaggggaaatcaaacggactgtcacaaggatcctgccagatcctgatgatccaagtaagtcccctgttgggtcacctctagggagcgccattgcagaggcccccagcgagatgccaggggatgaggtgcctgtggaagagcactttcctgaggcaggcacaaattcagggagcccccagggggccaggaaaggggacgagagcatgacaaaggccagtgactcgtcatctcccagctgcagttctgggccccgggtcccaaagggggctgccccaggctcacagacaggcaagaagcaacagagcacagcactgcaggcatccaccctggcccctgccaacctcctgcccaaagccgtgcacttggccaacctgaacctcgtcccccacagtgttgctgcatcagtgacagccaagtcttcagtgcaaagacggagccagccacagcttacacaaatgtcggtgcccctggtccaccaggtgaaaaaggctgccccactgattgtagaggtcttcaacaaggtccttcacagctccaaccccgtgcccctctatgcgccaaatctcagcccgcctgcggacagcaggatccacgtgccggccagtgggtactgctgcctggagtgtggagacgcatttgccttagagaagagcctgagccagcactatggccggcggagcgtccacattgaggtactgtgcacactgtgctccaagacgctgctcttcttcaacaagtgcagcctgctccggcacgcccgtgaccacaagagcaaggggctcgtcatgcagtgttcccagctgctggtgaagcctatctctgcggaccaaatgttcgtgtcggcccctgtgaactccacggcaccagcagccccagccccttcatcctctcccaaacatggcctcacttcgggcagtgccagtccccctcctccagccttgccactctacccagaccctgtgtctcctctgtagtcctctggaaatgtgcagccaggaccatgtagtcccgcatctgcttgtgacattcaagacacttgattgag

SEQ ID NO: 449096 - DNA, 2335 bp, Homo sapiens
  misc_feature (659)..(659): n is a, c, g, or t
  misc_feature (672)..(673): n is a, c, g, or t
  misc_feature (675)..(675): n is a, c, g, or t
  misc_feature (680)..(680): n is a, c, g, or t
  misc_feature (687)..(687): n is a, c, g, or t
  misc_feature (690)..(690): n is a, c, g, or t
  misc_feature (706)..(706): n is a, c, g, or t
  misc_feature (712)..(712): n is a, c, g, or t
  misc_feature (719)..(719): n is a, c, g, or t
  misc_feature (725)..(727): n is a, c, g, or t
  misc_feature (730)..(730): n is a, c, g, or t
  misc_feature (752)..(753): n is a, c, g, or t
  misc_feature (762)..(762): n is a, c, g, or t
  misc_feature (775)..(775): n is a, c, g, or t
  misc_feature (787)..(787): n is a, c, g, or t
tgaaacctaaaacgttaatgtgatctttattatacagcacatctggtatttgtgtatcccaacaagtatacagaatactctataaaaccaaacccaacccttcaatattacactaatgaagattaacccagagtcgcatctcttcaaaatgcacacaattaagacggtcctgctgtaacaatattatggaaagagccaggtagcacaagaaaggagagaggataaagactgaagtgtgtgccaaagtcattgtcttttgttattgcacttttattctacacacttagtatcttacacttttatttaacactgtaataaacattagtcctttaaaacaaagaaaaaacattacatgaagacaaaagacaacaggctgcccagaccaattttcttttcaactatctgggcaaggtggcctccccagtgctagatgtcctgatgcacctctgagatcacctcaattggactggatgttaacaaaacagatgaagttaaaaatgaaacccttttaggaacagtagtgctactggaaacctccaggagagtttggaatacaagtgtctcaaggccactccctccttacccactttaacatcaaacaagctctattcatcccacctccataactgaaggattaaccttctttttttttttttttnttttttttgaganngngtctngctctgntgnccaggctggagtgcantggtgngatcttngctcannncancctctgtctcctgggttcaagnnattctcctncctcagcctcccnagtagctgggantacagttggaggtccccctccccactaagtgcctctttgcatagcaccagtccccacccgcacgctctctggaccactacagctggacgggcaatggcgggtcggggaggcgcagcacgacccaatggaccagctgctgggaacaagatctgtcaatttaagctggttctgctgggggagtctgcggtaggcaaatccagcctcgtcctccgctttgtcaagggacagtttcacgagtaccaggagagcacaattggagcggccttcctcacacagactgtctgcctggatgacacaacagtcaagtttgagatctgggacacagctggacaggagcggtatcacagcctggcccccatgtactatcggggggcccaggctgccatcgtggtctatgacatcaccaacacagatacatttgcacgggccaagaactgggtgaaggagctacagaggcaggccagccccaacatcgtcattgcactcgcgggtaacaaggcagacctggccagcaagagagccgtggaattccaggaagcacaagcctatgcagacgacaacagtttgctgttcatggagacatcagcaaagactgcaatgaacgtgaacgaaatcttcatggcaatagctaagaagcttcccaagaacgagccccagaatgcaactggtgctccaggccgaaaccgaggtgtggacctccaggagaacaacccagccagccggagccagtgctgcagcaactgagccccccttgcctgcccgctgcccccgcctcctccgcctgaatgacccgactggaatccactctaaccaatcgcacttaacgactcgggccaccactgggggggcagggggaggggtccaccatgatttctccatataattttgatcataggccggagtgagtcattccacctgcacctttctgtacaaatactaattcaattttaagtcttaagtcacttttttaatatatatgatcttctgctcttcccacttcctcccctttctactgctctcccattttcccttgctgggagtagccacatgctcttgccccccaacccttgtatatggggacagtggggtcagtgcagctaccctttctttccctcctgcggaacagcggacccagcaagagcatccacatcctcactttgttcggagtggtctttggtttgggcggtggggcagaccttgggaaggggcttaggaagggagaggcagctcttccttcagctggctctcatcaggctgcagccccctccccgctcccacctccctgctgggaaaccacagcattatcacagcattattgtgacagccacgaacccattgcccacaacccctccaccctcggtcaccccaacctctggctctgagccctgttctgaccaaatcatgatgatgagtatttgggggtgggtgggtaagggggggagtgggaggggacggaaccaactttttctgtattttgtattgtatgttttcttcaacatgtaaccaatcagtatcttgtcaatatagtcagccgatcgatcgacctca

SEQ ID NO: 449097 - DNA, 881 bp, Homo sapiens
  misc_feature (567)..(567): n is a, c, g, or t
  misc_feature (580)..(580): n is a, c, g, or t
  misc_feature (585)..(585): n is a, c, g, or t
  misc_feature (618)..(618): n is a, c, g, or t
  misc_feature (633)..(633): n is a, c, g, or t
  misc_feature (656)..(656): n is a, c, g, or t
  misc_feature (668)..(668): n is a, c, g, or t
  misc_feature (674)..(674): n is a, c, g, or t
  misc_feature (691)..(691): n is a, c, g, or t
  misc_feature (712)..(712): n is a, c, g, or t
  misc_feature (721)..(721): n is a, c, g, or t
  misc_feature (724)..(724): n is a, c, g, or t
  misc_feature (727)..(727): n is a, c, g, or t
  misc_feature (735)..(735): n is a, c, g, or t
  misc_feature (777)..(777): n is a, c, g, or t
  misc_feature (780)..(780): n is a, c, g, or t
  misc_feature (877)..(877): n is a, c, g, or t
tccggatccggagcggctgaaaggcggaagtggaggccggagcctgggacaccgccggcggggagagaagcggatcccgtccgagccccggccccaagtaacgccgccgccccggagccgccttggaggtccccctccccactaagtgcctctttgcatagcaccagtccccacccgcacgctctctggaccactacagctggacgggcaatggcgggtcggggaggcgcagcacgacccaatggaccagctgctgggaacaagatctgtcaatttaagctggttctgctgggggagtctgcggtaggcaaatccagcctcgtcctccgctttgtcaagggacagtttcacgagtaccaggagagcacaattggagcggccttcctcacacagactgtctgcctggatgacacaacagtcaagtttgagatctgggacacagctggacaggagcggtatcacagcctggcccccatgtactatcggggggcccaggctgccatcgtggtctatgacatcaccaacacagatacatttgcatgtgtgccaagaactgtgtgctgaatngagctacatgatngcatngccagccccaaacatctgtcatttgcactctgntgtgtaacaattgcngaccctgtgccatgcaatgatgngctgtgtgaaantccatngaatgcacaatgcccantgcatgactgacaaacatgtngtgcctgtncanttnatgacatncatgcaaatgacctgcaaatgaactgtgaactgaaaaacccncantgtgcaaaatgccaatgaatgccccccaaatgaactgatgccccatgaaatgcaacctgtgtgcgccattgcctgaaacctgattgttgttgatccnccat

SEQ ID NO: 449098 - DNA, 453 bp, Homo sapiens
attaaagaggtgaccgagggtggaggggttgtgggcatgggttcgtggctgtcacaataatgctgtgataatgctgtggtttcccagcaggaggtgggagccactgggggggcagggggaggggtccaccatgatttctccatataattttgatcataggccggagtgagtcattccacctgcacctttctgtacaaatactaattcaattttaagtcttaagtcacttttttaatatatatgatcttctgctcttcccacttcctcccctttctactgctctcccattttcccttgctgggagtagccacatgctcttgccccccaacccttgtatatggggacagtggggtcagtgcagctaccctttctgtacaaatactaattcaattttaagtcttaagtcacttttttaatatatatgatcttctgctcttcccacctccttaatga

SEQ ID NO: 449099 - DNA, 2017 bp, Homo sapiens
tccggatccggagcggctgaaaggcggaagtggaggccggagcctgggacaccgccggcggggagagaagcggatcccgtccgagccccggccccaagtaacgccgccgccccggagccgccttggaggtccccctccccactaagtgcctctttgcatagcaccagtccccacccgcacgctctctggaccactacagctggacgggcaatggcgggtcggggaggcgcagcacgacccaatggaccagctgctgggaacaagatctgtcaatttaagctggttctgctgggggagtctgcggtaggcaaatccagcctcgtcctccgctttgtcaagggacagtttcacgagtaccaggagagcacaattggagcggccttcctcacacagactgtctgcctggatgacacaacagtcaagtttgagatctgggacacagctggacaggagcggtatcacagcctggcccccatgtactatcggggggcccaggctgccatcgtggtctatgacatcaccaacacagatacatttgcacgggccaagaactgggtgaaggagctacagaggcaggccagccccaacatcgtcattgcactcgcgggtaacaaggcagacctggccagcaagagagccgtggaattccaggaagcacaagcctatgcagacgacaacagtttgctgttcatggagacatcagcaaagactgcaatgaacgtgaacgaaatcttcatggcaatagctaagaagcttcccaagaacgagccccagaatgcaactggtgctccaggccgaaaccgaggtgtggacctccaggagaacaacccagccagccggagccagtgctgcagcaactgagccccccttgcctgcccgctgcccccgcctcctccgcctgaatgacccgactggaatccactctaaccaatcgcacttaacgactcgggccaccactgggggggcagggggaggggtccaccatgatttctccatataattttgatcataggccggagtgagtcattccacctgcacctttctgtacaaatactaattcaattttaagtcttaagtcacttttttaatatatatgatcttctgctcttcccacttcctcccctttctactgctctcccattttcccttgctgggagtagccacatgctcttgccccccaacccttgtatatggggacagtggggtcagtgcagctaccctttctttccctcctgcggaacagcggacccagcaagagcatccacatcctcactttgttcggagtggtctttggtttgggcggtggggcagaccttgggaaggggcttaggaagggagaggcagctcttccttcagctggctctcatcaggctgcagccccctccccgctcccacctccctgctgggaaaccacagcattatcacagcattattgtgacagccacgaacccattgcccacaacccctccaccctcggtcaccccaacctctggctctgagccctgttctgaccaaatcatgatgatgagtatttgggggtgggtgggtaagggggggagtgggaggggacggaaccaactttttctgtattttgtattgtatgttttcttcaacatgtaaccaatcagtatcttgtcaatatagtcagccgatcgatcgacctcaaaaaaaaaaaagccaaacttcgtggacctaggcgttgcggccgccagagtgcggggagagccagaaaggggggggcgcaacaggagagggaaggaagggagaaattacgagaatatctgcggagaacggcctgggcctggacgcgcggtaaaaatcccccgaccagccggaaattttggcctaaagggccacgggtcacggtgggatcagccccacgtgaccctgacagggtggaggcagcaaaggaatcttccccctctggaaagcggtgactctggggccacttatcacctctaagccgaaggatatcctttgtgaatcggacagaaacgaacaagccctggataagaac

SEQ ID NO: 449100 - DNA, 1395 bp, Homo sapiens
aaggctaggtacgaggcgggtgtgaatcggccgaggggcaaatccagcctcgtcctccgctttgtcaagggacagtttcacgagtaccaggagagcacaattggagcggccttcctcacacagactgtctgcctggatgacacaacagtcaagtttgagatctgggacacagctggacaggagcggtatcacagcctggcccccatgtactatcggggggcccaggctgccatcgtggtctatgacatcaccaacacagatacatttgcacgggccaagaactgggtgaaggagctacagaggcaggccagccccaacatcgtcattgcactcgcgggtaacaaggcagacctggccagcaagagagccgtggaattccaggaagcacaagcctatgcagacgacaacagtttgctgttcatggagacatcagcaaagactgcaatgaacgtgaacgaaatcttcatggcaatagctaagaagcttcccaagaacgagccccagaatgcaactggtgctccaggccgaaaccgaggtgtggacctccaggagaacaacccagccagccggagccagtgctgcagcaactgagccccccttgcctgcccgctgcccccgcctcctccgcctgaatgacccgactggaatccactctaaccaatcgcacttaacgactcgggccaccactgggggggcagggggaggggtccaccatgatttctccatataattttgatcataggccggagtgagtcattccacctgcacctttctgtacaaatactaattcaattttaagtcttaagtcacttttttaatatatatgatcttctgctcttcccacttcctcccctttctactgctctcccattttcccttgctgggagtagccacatgctcttgccccccaacccttgtatatggggacagtggggtcagtgcagctaccctttctttccctcctgcggaacagcggacccagcaagagcatccacatcctcactttgttcggagtggtctttggtttgggcggtggggcagaccttgggaaggggcttaggaagggagaggcagctcttccttcagctggctctcatcaggctgcagccccctccccgctcccacctccctgctgggaaaccacagcattatcacagcattattgtgacagccacgaacccattgcccacaacccctccaccctcggtcaccccaacctctggctctgagccctgttctgaccaaatcatgatgatgagtatttgggggtgggtgggtaagggggggagtgggaggggacggaaccaactttttctgtattttgtattgtatgttttcttcaacatgtaaccaatcagtatcttgtcaatatagtcagccgatcgatcgacctca

SEQ ID NO: 449101 - DNA, 1148 bp, Homo sapiens
tccggatccggagcggctgaaaggcggaagtggaggccggagcctgggacaccgccggcggggagagaagcggatcccgtccgagccccggccccaagtaacgccgccgccccggagccgccttggaggtccccctccccactaagtgcctctttgcatagcaccagtccccacccgcacgctctctggaccactacagctggacgggcaatggcgggtcggggaggcgcagcacgacccaatggaccagctgctgggaacaagatctgtcaatttaagctggttctgctgggggagtctgcggtaggcaaatccagcctcgtcctccgctttgtcaagggacagtttcacgagtaccaggagagcacaattggagcggccttcctcacacagactgtctgcctggatgacacaacagtcaagtttgagatctgggacacagctggacaggagcggtatcacagcctggcccccatgtactatcggggggcccaggctgccatcgtggtctatgacatcaccaacacagatacatttgcacgggccaagaactgggtgaaggagctacagaggcaggccagccccaacatcgtcattgcactcgcgggtaacaaggcagacctggccagcaagagagccgtggaattccaggaagcacaagcctatgcagacgacaacagtttgctgttcatggagacatcagcaaagactgcaatgaacgtgaacgaaatcttcatggcaatagctaagaagcttcccaagaacgagccccagaatgcaactggtgctccaggccgaaaccgaggtgtggacctccaggagaacaacccagccagccggagccagtgctgcagcaactgagccccccttgcctgcccgctgcccccgcctcctccgcctgaatgacccgactggaatccactctaaccaatcgcacttaacgactcgggccaccctcggtcaccccaacctctggctctgagccctgttctgaccaaatcatgatgatgagtatttgggggtgggtgggtaagggggggagtgggaggggacggaaccaactttttctgtattttgtattgtatgttttcttcaacatgtaaccaatcagtatcttgtcaatatagtcagccgatcgatcgacctca

SEQ ID NO: 449102 - DNA, 1041 bp, Homo sapiens
tccggatccggagcggctgaaaggcggaagtggaggccggagcctgggacaccgccggcggggagagaagcggatcccgtccgagccccggccccaagtaacgccgccgccccggagccgccttggaggtccccctccccactaagtgcctctttgcatagcaccagtccccacccgcacgctctctggaccactacagctggacgggcaatggcgggtcggggaggcgcagcacgacccaatggaccagctgctgggaacaagatctgtcaatttaagctggttctgctgggggagtctgcggtaggcaaatccagcctcgtcctccgctttgtcaagggacagtttcacgagtaccaggagagcacaattggagcggccttcctcacacagactgtctgcctggatgacacaacagtcaagtttgagatctgggacacagctggacaggagcggtatcacagcctggcccccatgtactatcggggggcccaggctgccatcgtggtctatgacatcaccaacacagatacatttgcacgggccaagaactgggtgaaggagctacagaggcaggccagccccaacatcgtcattgcactcgcgggtaacaaggcagacctggccagcaagagagccgtggaattccaggaagcacaagcctatgcagacgacaacagtttgctgttcatggagacatcagcaaagactgcaatgaacgtgaacgaaatcttcatggcaatagctaagaagcttcccaagaacgagccccagaatgcaactggtgctccaggccgaaaccgaggtgtggacctccaggagaacaacccagccagccggagccagtgctgcagcaactgagccccccttgcctgcccgctgcccccgcctcctccgcctgaatgacccgactggaatccactctaaccaatcgcacttaacgactcgggccacccgagcgctaccagaattcaagtataatattaagtatgcatggacctctagagctaatcaaggaaaatagtttaggagaaaccagct

SEQ ID NO: 449103 - DNA, 975 bp, Homo sapiens
tccggatccggagcggctgaaaggcggaagtggaggccggagcctgggacaccgccggcggggagagaagcggatcccgtccgagccccggccccaagtaacgccgccgccccggagccgccttggaggtccccctccccactaagtgcctctttgcatagcaccagtccccacccgcacgctctctggaccactacagctggacgggcaatggcgggtcggggaggcgcagcacgacccaatggaccagctgctgggaacaagatctgtcaatttaagctggttctgctgggggagtctgcggtaggcaaatccagcctcgtcctccgctttgtcaagggacagtttcacgagtaccaggagagcacaattggagcggccttcctcacacagactgtctgcctggatgacacaacagtcaagtttgagatctgggacacagctggacaggagcggtatcacagcctggcccccatgtactatcggggggcccaggctgccatcgtggtctatgacatcaccaacacagatacatttgcacgggccaagaactgggtgaaggagctacagaggcaggccagccccaacatcgtcattgcactcgcgggtaacaaggcagacctggccagcaagagagccgtggaattccaggaagcacaagcctatgcagacgacaacagtttgctgttcatggagacatcagcaaagactgcaatgaacgtgaacgaaatcttcatggcaatagctaagaagcttcccaagcaacgaaggcccccgagaaattggcaaagcttggggtggccttccccaagggggcccggaaaaaaaccccgaacgggttggttggggaaccccgttccccaaagggggaaggaaaaaacaaaaacggcccccaagggccccaaaggggccccgggggaaaggcccccaagggtttggcctttgggccaagggccaaaaaccctttgggaaagg

SEQ ID NO: 449104 - DNA, 1665 bp, Homo sapiens
tccggatccggagcggctgaaaggcggaagtggaggccggagcctgggacaccgccggcggggagagaagcggatcccgtccgagccccggccccaagtaacgccgccgccccggagccgccttggaggtccccctccccactaagtgcctctttgcatagcaccagtccccacccgcacgctctctggaccactacagctggacgggcaatggcgggtcggggaggcgcagcacgacccaatggaccagctgctgggaacaagatctgtcaatttaagctggttctgctgggggagtctgcggtaggcaaatccagcctcgtcctccgctttgtcaagggacagtttcacgagtaccaggagagcacaattggagcggccttcctcacacagactgtctgcctggatgacacaacagtcaagtttgagatctgggacacagctggacaggagcggtatcacagcctggcccccatgtactatcggggggcccaggctgccatcgtggtctatgacatcaccaacacagatacatttgcacgggccaagaactgggtgaaggagctacagaggcaggccagccccaacatcgtcattgcactcgcgggtaacaaggcagacctggccagcaagagagccgtggaattccaggaagcacaagcctatgcagacgacaacagtttgctgttcatggagacatcagcaaagactgcaatgaacgtgaacgaaatcttcatggcaatagctaagaagcttcccaagaacgagccccagaatgcaactggtgctccaggccgaaaccgaggtgtggacctccaggagaacaacccagccagccggagccagtgctgcagcaactgagccccccttgcctgcccgctgcccccgcctcctccgcctgaatgacccgactggaatccactctaaccaatcgcacttaacgactcgggccaccactgggggggcagggggaggggtccaccatgatttctccatataattttgatcataggccggagtgagtcattccacctgcacctttctgtacaaatactaattcaattttaagtcttaagtcacttttttaatatatatgatcttctgctcttcccacttcctcccctttctactgctctcccattttcccttgctgggagtagccacatgctcttgccccccaacccttgtatatggggacagtggggtcagtgcagctaccctttctttccctcctgcggaacagcggacccagcaagagcatccacatcctcactttgttcggagtggtctttggtttgggcggtggggcagaccttgggaaggggcttaggaagggagaggcagctcttccttcagctggctctcatcaggctgcagccccctccccgctcccacctccctgctgggaaaccacagcattatcacagcattattgtgacagccacgaacccattgcccacaacccctccaccctcggtcaccccaacctctggctctgagccctgttctgaccaaatcatgatgatgagtatttgggggtgggtgggtaagggggggagtgggaggggacggaaccaactttttctgtattttgtattgtatgttttcttcaacatgtaaccaatcagtatcttgtcaatatagtcagccgatcgatcgacctca

SEQ ID NO: 449105 - DNA, 626 bp, Homo sapiens
tccggatccggagcggctgaaaggcggaagtggaggccggagcctgggacaccgccggcggggagagaagcggatcccgtccgagccccggccccaagtaacgccgccgccccggagccgccttggaggtccccctccccactaagtgcctctttgcatagcaccagtccccacccgcacgctctctggaccactacagctggacgggcaatggcgggtcggggaggcgcagcacgacccaatggaccagctgctgggaacaagatctgtcaatttaagctggttctgctgggggagtctgcggtaggcaaatccagcctcgtcctccgctttgtcaagggacagtttcacgagtaccaggagagcacaattggagcggccttcctcacacagactgtctgcctggatgacacaacagtcaagtttgagatctgggacacagctggacaggagcggtatcacagcctggcccccatgtactatcggggggcccaggctgccatcgtggtctatgacatcaccaacacagtaaagatttccccttgcttcttcctttgcccttcatcttctcaaagtcccagggattgggttatcagagccctgatttcaggccgcttaaccctctg

SEQ ID NO: 449106 - DNA, 1782 bp, Homo sapiens
tccggatccggagcggctgaaaggcggaagtggaggccggagcctgggacaccgccggcggggagagaagcggatcccgtccgagccccggccccaagtaacgccgccgccccggagccgccagtctcgctctctcgccaggccggagtgcagtggcactatctcagctcagtgcaacctctgcctcccgggttcaagcgattctcctgcctcagcctcccgagtagctgggactacagttggaggtccccctccccactaagtgcctctttgcatagcaccagtccccacccgcacgctctctggaccactacagctggacgggcaatggcgggtcggggaggcgcagcacgacccaatggaccagctgctgggaacaagatctgtcaatttaagctggttctgctgggggagtctgcggtaggcaaatccagcctcgtcctccgctttgtcaagggacagtttcacgagtaccaggagagcacaattggagcggccttcctcacacagactgtctgcctggatgacacaacagtcaagtttgagatctgggacacagctggacaggagcggtatcacagcctggcccccatgtactatcggggggcccaggctgccatcgtggtctatgacatcaccaacacagatacatttgcacgggccaagaactgggtgaaggagctacagaggcaggccagccccaacatcgtcattgcactcgcgggtaacaaggcagacctggccagcaagagagccgtggaattccaggaagcacaagcctatgcagacgacaacagtttgctgttcatggagacatcagcaaagactgcaatgaacgtgaacgaaatcttcatggcaatagctaagaagcttcccaagaacgagccccagaatgcaactggtgctccaggccgaaaccgaggtgtggacctccaggagaacaacccagccagccggagccagtgctgcagcaactgagccccccttgcctgcccgctgcccccgcctcctccgcctgaatgacccgactggaatccactctaaccaatcgcacttaacgactcgggccaccactgggggggcagggggaggggtccaccatgatttctccatataattttgatcataggccggagtgagtcattccacctgcacctttctgtacaaatactaattcaattttaagtcttaagtcacttttttaatatatatgatcttctgctcttcccacttcctcccctttctactgctctcccattttcccttgctgggagtagccacatgctcttgccccccaacccttgtatatggggacagtggggtcagtgcagctaccctttctttccctcctgcggaacagcggacccagcaagagcatccacatcctcactttgttcggagtggtctttggtttgggcggtggggcagaccttgggaaggggcttaggaagggagaggcagctcttccttcagctggctctcatcaggctgcagccccctccccgctcccacctccctgctgggaaaccacagcattatcacagcattattgtgacagccacgaacccattgcccacaacccctccaccctcggtcaccccaacctctggctctgagccctgttctgaccaaatcatgatgatgagtatttgggggtgggtgggtaagggggggagtgggaggggacggaaccaactttttctgtattttgtattgtatgttttcttcaacatgtaaccaatcagtatcttgtcaatatagtcagccgatcgatcgacctca

SEQ ID NO: 449107 - DNA, 1368 bp, Homo sapiens
aagtgcggcgtaagcagtctgacaggattcttgctgaagccagacagggaggacaccgtgagggtgagcaatgacaatgagcttgagtagatgtcgaggggtcaggggttcgtgctaatctgacctaacagggtgcatgtggctgaaagtggaggtttataaggaaggcaacagttgggctccaggagaaggtgcagaaaccgcgaccagaaggctggccctgccatatgcgatacatttgcacgggccaagaactgggtgaaggagctacagaggcaggccagccccaacatcgtcattgcactcgcgggtaacaaggcagacctggccagcaagagagccgtggaattccaggaagcacaagcctatgcagacgacaacagtttgctgttcatggagacatcagcaaagactgcaatgaacgtgaacgaaatcttcatggcaatagctaagaagcttcccaagaacgagccccagaatgcaactggtgctccaggccgaaaccgaggtgtggacctccaggagaacaacccagccagccggagccagtgctgcagcaactgagccccccttgcctgcccgctgcccccgcctcctccgcctgaatgacccgactggaatccactctaaccaatcgcacttaacgactcgggccaccactgggggggcagggggaggggtccaccatgatttctccatataattttgatcataggccggagtgagtcattccacctgcacctttctgtacaaatactaattcaattttaagtcttaagtcacttttttaatatatatgatcttctgctcttcccacttcctcccctttctactgctctcccattttcccttgctgggagtagccacatgctcttgccccccaacccttgtatatggggacagtggggtcagtgcagctaccctttctttccctcctgcggaacagcggacccagcaagagcatccacatcctcactttgttcggagtggtctttggtttgggcggtggggcagaccttgggaaggggcttaggaagggagaggcagctcttccttcagctggctctcatcaggctgcagccccctccccgctcccacctccctgctgggaaaccacagcattatcacagcattattgtgacagccacgaacccattgcccacaacccctccaccctcggtcaccccaacctctggctctgagccctgttctgaccaaatcatgatgatgagtatttgggggtgggtgggtaagggggggagtgggaggggacggaaccaactttttctgtattttgtattgtatgttttcttcaacatgtaaccaatcagtatcttgtcaatatagtcagccgatcgatcgacctca

SEQ ID NO: 449108 - DNA, 985 bp, Homo sapiens
caaaatgacgaacacaaagggaaagaggagaggcacccgatatatgttctctaggcctttgagaaaacatggagttgttcctttggccacatatatgcgaatctataagaaaggtgatattgtagacatcaagggaatgggtactgttcaaaaaggaatgccccacaagtgttaccatggcaaaactggaagagtctacaatgttacccagcatgctgttggcattgttgtaaacaaacaagttaagggcaagattcttgccaagagaattaatgtgcgtattgagcacattaagcactctaagagccgagatagcttcctgaaacgtgtgaaggaaaatgagtcattccacctgcacctttctgtacaaatactaattcaattttaagtcttaagtcacttttttaatatatatgatcttctgctcttcccacttcctcccctttctactgctctcccattttcccttgctgggagtagccacatgctcttgccccccaacccttgtatatggggacagtggggtcagtgcagctaccctttctttccctcctgcggaacagcggacccagcaagagcatccacatcctcactttgttcggagtggtctttggtttgggcggtggggcagaccttgggaaggggcttaggaagggagaggcagctcttccttcagctggctctcatcaggctgcagccccctccccgctcccacctccctgctgggaaaccacagcattatcacagcattattgtgacagccacgaacccattgcccacaacccctccaccctcggtcaccccaacctctggctctgagccctgttctgaccaaatcatgatgatgagtatttgggggtgggtgggtaagggggggagtgggaggggacggaaccaactttttctgtattttgtattgtatgttttcttcaacatgtaaccaatcagtatcttgtcaatatagtcagccgatcgatcgacctca

SEQ ID NO: 449109 - DNA, 672 bp, Homo sapiens
tttttttttttttctttttcccttctcttcttaggaaccatcagtggacatgaatgtttctacaatgcatttcttcatagattttgtttatggttttgtttcttttttcttctttgtttttcagtgtgggagtgggaagaggagattatagtgactgaagaaagaataggcaaacttttcaaatgaaaatggatatttagtgtattttgtagaagatctccaaagatcttttgtgactacaacttcttttgtaaataatgatatatggtatttccatcgtcagttaccgagtatagccactgggtatcactactttgtgttaaagtgccttcgcactttaagtacattacttaaatgttgcttttagctttgataaattgaaaatattttaatgtgttgtatttttgaaattgaaaacactgtaaaatagattgatgtgtcagctatattaagtcaacgtacagtttgcttgagttatagaaaccagcctgtcatcaaatgattctagttctaggactttgtaggcttaactataaaatatttcctttcctctgggtttaagtgattttatttaagtcaactaaggggatttaacagtggactagaggtaataagccacctcagtcaggattaataattcattaataaaatatatttaacccaaaaaaaaag

SEQ ID NO: 449110 - DNA, 800 bp, Homo sapiens
caaggagatagcaaaggttaaatgactgggggctgtaaagggcacggcaaggagagaacgagtgatgatgtgtagggttggggagagtgcagtgatgggagcacagaccagggtgggagatggagcttggggtctcaatagtctcccttctttgcccacagaaaatttgtgaattcagcctggggctggacatgcactttcttagggggctttgtgttgctggtggtgttcctggctacacggcgcgtggcagtaactgccagacacctgagccgactggtagtaggggcagccgtgtggcggggagccggccgggccttcctgctcatcgaggacctgactggctcctgcttcgagccactgccccagggtctgctgctccacgagctgcctgaccgccgcagctgcctggcagccggccaccagtggcgaggctacaccgtctcctcccacaccttcctgctcaccttttgctgcctgctcatggcagaggaagcagctgtgttcgccaagtacctggcccatgggcttcctgccggcgccccactgcgccttgtcttcctgctgaacgtgctgctgctgggcctctggaacttcttgctgctctgtaccgtcatctatttccaccagtacactcacaaggtggtgggcgccgcagtgggcacctttgcctggtacctcacctatggcagctggtatcatcagccctggtctccagggagcccaggccatgggctcttcccccgtccccactccagccgcaagcataactgaaagaaataaaaaccatcgggcctggc

SEQ ID NO: 449111 - DNA, 910 bp, Homo sapiens
ggaacatggagcgggggccggtggtgggggcaggactgggggccggggcccgaatccaggcactgctgggctgcctgctcaaggtgctgctctgggtggcctctgccttgctgtactttggaagcgaacaggccgcccgccttctgggcagcccctgcttacggcgcctctaccatgcctggctggcagcagtggtcatctttgggccgcttctgcagttccatgtcaaccctcggactatcttcgccagccacggcaacttcttcaacataaaatttgtgaattcagcctggggctggacatgcactttcttagggggctttgtgttgctggtggtgttcctggctacacggcgcgtggcagtaactgccagacacctgagccgactggtagtaggggcagccgtgtggcggggagccggccgggccttcctgctcatcgaggacctgactggctcctgcttcgagccactgccccagggtctgctgctccacgagctgcctgaccgccgcagctgcctggcagccggccaccagtggcgaggctacaccgtctcctcccacaccttcctgctcaccttttgctgcctgctcatggcagaggaagcagctgtgttcgccaagtacctggcccatgggcttcctgccggcgccccactgcgccttgtcttcctgctgaacgtgctgctgctgggcctctggaacttcttgctgctctgtaccgtcatctatttccaccagtacactcacaaggtggtgggcgccgcagtgggcacctttgcctggtacctcacctatggcagctggtatcatcagccctggtctccagggagcccaggccatgggctcttcccccgtccccactccagccgcaagcataactgaaagaaataaaaaccatcgggcctggc

SEQ ID NO: 449112 - DNA, 1929 bp, Homo sapiens
cactggacaaaagcgtggtctctggcgcggggatctcagagtttcccgggcactcaccgtgtgtagttggcatctccgcgcgtccggacacccgatcccagcatccctgcctgcaggactgttcgtgttcagctcgcgtcctgcagctgtccgaggtgctccagttggaggctgaggttcccgggctctgtagctgagtgggcggcggcaccggcggagatgcctgggaagaaggcgcgcaagaacgctcaaccgagccccgcgcgggctccagcagagctggaagtcgagtgtgctactcaactcaggagatttggagacaaactgaacttccggcagaaacttctgaatctgatatccaaactcttctgctcaggaacctgactgcatcaaaaacttgcatgaggggactccttcaaaagagttttctcaggaggtgcacgtttcatcaatttgaagaaagactgcattgtaattgagaggaatgtgaaggtgcattcatgggtgcccttggaaacggaagatggaatacatcaaagtgaatttctgttcaagttttcccagattatcattctttgggatgagagaacattataaaaccactttgtttattttaaagcaagaatggaagacccttgaaaataaagaagtaattattgacacatttcttttttacttagagaatcgttctagtgtttttgccgaagattaccgctggcctactgtgaagggagatgacctgtgattagactgggcggctggggagaaacagttcagtgcattgttgttgttgctgtttttggtgttttgcttttcagtgccaactcagcacattgtatatgattcggtttatacatattaccttgttataatgaaaaaactcattctgagaacactgaaatgttatactcagtgttgatttcttcggtcactacacaacgtaaaatcatttgtttcttttgactcaaattgtattgcttctgttcagatgatctttcattcaatgtgttcctgttgggcgttactagaaactatggaaaactggaaaataactttgaaaaaattggataaagtataggagggttacttggggccagtaaatcagtagactgaacattcaatataataaaagaacatggggattttgtataaccagggataataaaaagaaaaaagaagttaatttttaattgatgtttttgaaacttagtagaacaaatattcagaagtaacttgataagatatgaatgtttctaaagaagtttctaaaggttcggaaaatgctccttgtcacattagtgtgcatcctacaaaaagtgatctcttaatgtaaattaagaatattttcataattggaatatacttttcttaaaaaaaaggaacagttagttctcatctagaatgaaagttccatatatgcattggtgaatatatatgtatacacatacttacatacttatatgggtatctgtatagataatttgtattagagtattatatagcttcttagtagggtctcaagtaagtttcattttttttatctgggctatatacagtcctcaaataaataatgtcttgattttatttcagcaggaataattttatttattttgcctatttataattaaagtatttttctttagtttgaaaatgtgtattaaagttacatttttgagttacaagagtcttataactacttgaatttttagttaaaatgtcttaatgtaggttgtagtcactttagatggaaaattacctcacatctgttttcttcagtattacttaagattgtttatttagtggtagagagttttttttttcagcctagaggcagctattttaccatctggtatttatggtctaatttgtatttaaacatatgcacacatataaaagttgatactgtggcagtaaactattaaaagtttt

SEQ ID NO: 449113 - DNA, 542 bp, Homo sapiens
gtaatatgattgattgtgctcgcctcagagggcggttatatattttgggtggagatggtgttgtgccgctcacattatttgggtctctcccccccgcccccgataatgatggtggggtgttggttttccacaaaaagaagtagcaacgtgcgtgacggtcggtgttttttccctcaccaccatacactcgttttggttataaagaaaggggccgccgcgcgcggcgtcggtattaataatataatagctccctcttttgtgggctccttctttatatttgggggggtgtgttgtggcggccccctgcggggagtgtgtgtgtgctgcgcgcgcccctccctttctttttttttttttttttttttttttttttttttttttttttttttttttgttttttttttttttttttttttttttttttttccgaggggagcccgggggcagctattttaccatctggtatttatggtctaatttgtatttaaacatatgcacacatataaaagttgatactgtggcagtaaactattaaaagtttt

SEQ ID NO: 449114 - DNA, 2216 bp, Homo sapiens
cactggacaaaagcgtggtctctggcgcggggatctcagagtttcccgggcactcaccgtgtgtagttggcatctccgcgcgtccggacacccgatcccagcatccctgcctgcaggactgttcgtgttcagctcgcgtcctgcagctgtccgaggtgctccagttggaggctgaggttcccgggctctgtagctgagtgggcggcggcaccggcggagatgcctgggaagaaggcgcgcaagaacgctcaaccgagccccgcgcgggctccagcaggaccggcgggtacggcgggtacggcgagggaccaagccggatttgcgattgggatgcagctgcgtttcaccaggggcaaaaagctcctttcctcctctctttcctcctcgccacttgcccttccccggggccacgaggaacaagtgcaagtgtaggcggctgtctctaggagaaagtcattgtcgcggcagaaggggcaggagagagccccggggaccgcctggactcccagcgcttccagagacggccccacaagggcccctgtgttcaggagcctagaaaatcttagctggaagtcgagtgtgctactcaactcaggagatttggagacaaactgaacttccggcagaaacttctgaatctgatatccaaactcttctgctcaggaacctgactgcatcaaaaacttgcatgaggggactccttcaaaagagttttctcaggaggtgcacgtttcatcaatttgaagaaagactgcattgtaattgagaggaatgtgaaggtgcattcatgggtgcccttggaaacggaagatggaatacatcaaagtgaatttctgttcaagttttcccagattatcattctttgggatgagagaacattataaaaccactttgtttattttaaagcaagaatggaagacccttgaaaataaagaagtaattattgacacatttcttttttacttagagaatcgttctagtgtttttgccgaagattaccgctggcctactgtgaagggagatgacctgtgattagactgggcggctggggagaaacagttcagtgcattgttgttgttgctgtttttggtgttttgcttttcagtgccaactcagcacattgtatatgattcggtttatacatattaccttgttataatgaaaaaactcattctgagaacactgaaatgttatactcagtgttgatttcttcggtcactacacaacgtaaaatcatttgtttcttttgactcaaattgtattgcttctgttcagatgatctttcattcaatgtgttcctgttgggcgttactagaaactatggaaaactggaaaataactttgaaaaaattggataaagtataggagggttacttggggccagtaaatcagtagactgaacattcaatataataaaagaacatggggattttgtataaccagggataataaaaagaaaaaagaagttaatttttaattgatgtttttgaaacttagtagaacaaatattcagaagtaacttgataagatatgaatgtttctaaagaagtttctaaaggttcggaaaatgctccttgtcacattagtgtgcatcctacaaaaagtgatctcttaatgtaaattaagaatattttcataattggaatatacttttcttaaaaaaaaggaacagttagttctcatctagaatgaaagttccatatatgcattggtgaatatatatgtatacacatacttacatacttatatgggtatctgtatagataatttgtattagagtattatatagcttcttagtagggtctcaagtaagtttcattttttttatctgggctatatacagtcctcaaataaataatgtcttgattttatttcagcaggaataattttatttattttgcctatttataattaaagtatttttctttagtttgaaaatgtgtattaaagttacatttttgagttacaagagtcttataactacttgaatttttagttaaaatgtcttaatgtaggttgtagtcactttagatggaaaattacctcacatctgttttcttcagtattacttaagattgtttatttagtggtagagagttttttttttcagcctagaggcagctattttaccatctggtatttatggtctaatttgtatttaaacatatgcacacatataaaagttgatactgtggcagtaaactattaaaagtttt

SEQ ID NO: 449115 - DNA, 1260 bp, Homo sapiens
  misc_feature (29)..(29): n is a, c, g, or t
  misc_feature (56)..(56): n is a, c, g, or t
  misc_feature (134)..(134): n is a, c, g, or t
  misc_feature (142)..(142): n is a, c, g, or t
  misc_feature (157)..(158): n is a, c, g, or t
atctcgctctctatcagtcgtatgtacanccttgtacgatatacctcactacactncactccgttcatcgctctcctacttacatcgagagtgctcttagagatctactactccgctccccccacatgaacccnattggagntcttgcgacatgcgnngaacctgccaattcggccattatggccgatattaccttgttataatgaaaaaactcattctgagaacactgaaatgttatactcagtgttgatttcttcggtcactacacaacgtaaaatcatttgtttcttttgactcaaattgtattgcttctgttcagatgatctttcattcaatgtgttcctgttgggcgttactagaaactatggaaaactggaaaataactttgaaaaaattggataaagtataggagggttacttggggccagtaaatcagtagactgaacattcaatataataaaagaacatggggattttgtataaccagggataataaaaagaaaaaagaagttaatttttaattgatgtttttgaaacttagtagaacaaatattcagaagtaacttgataagatatgaatgtttctaaagaagtttctaaaggttcggaaaatgctccttgtcacattagtgtgcatcctacaaaaagtgatctcttaatgtaaattaagaatattttcataattggaatatacttttcttaaaaaaaaggaacagttagttctcatctagaatgaaagttccatatatgcattggtgaatatatatgtatacacatacttacatacttatatgggtatctgtatagataatttgtattagagtattatatagcttcttagtagggtctcaagtaagtttcattttttttatctgggctatatacagtcctcaaataaataatgtcttgattttatttcagcaggaataattttatttattttgcctatttataattaaagtatttttctttagtttgaaaatgtgtattaaagttacatttttgagttacaagagtcttataactacttgaatttttagttaaaatgtcttaatgtaggttgtagtcactttagatggaaaattacctcacatctgttttcttcagtattacttaagattgtttatttagtggtagagagttttttttttcagcctagaggcagctattttaccatctggtatttatggtctaatttgtatttaaacatatgcacacatataaaagttgatactgtggcagtaaactattaaaagtttt

SEQ ID NO: 449116 - DNA, 7560 bp, Homo sapiens
aatgaattagagaaacagatgaattgtaacttgaaggaactcaaggaatttatagacaatgagatgctacttatcttgggacagatggacaagccctcccttatcttcgatcatctttatctcggttgattacattttaaatgttaccagagaaatcgataatttttttcctggcttatttgcatatcataacatccgagtctacgatgaagagaccacagacctcctcgcccactggaatgaagcgtatcattttataaacaaagcgaagaggaaccattccaagtgcctggtgcattgcaaaatgggcgtgagtcgctcggcctccacagtcatagcctatgcaatgaaggaattcggctggcctctggaaaaagcatataactatgtaaagcagaagcgcagcatcacgcgccccaacgcgggctttatgaggcagctgtctgagtatgaaggcatcttggatgcaagcaaacagcggcacaacaagctgtggcgtcagcagacagacagcagcctccagcagcctgtggatgaccctgcaggacctggcgacttcttgccagagaccccagatggcaccccggaaagccagctgcccttcttggatgatgccgcccagcccggcttagggccccccctcccctgctgtttccggcgactctcagacccccttctgccttcccctgaggatgaaactggcagcttggtccacctggaggatccggagagggaggctctgttggaggaagctgctccacctgcagaggtgcacaggccggccagacagccccagcaaggttccggactctgtgagaaggatgtgaagaagaaactagagtttgggagtcccaaaggtcggagcggctccttgctgcaggtggaggagacggaaagggaggagggcctgggagcagggaggtgggggcagcttccaacccagctcgatcaaaacctgctcaactcggagaacctaaacaacaacagcaagaggagctgtcccaacggcatggaggatgatgctatatttgggatccttaacaaagtgaagccttcctataaatcctgtgccgactgcatgtaccctacagccagcggggctcctgaggcctccagggagcgatgtgaggaccccaatgctcccgccatctgcacccagccagccttcctaccccacatcacgtcctcccctgtggcccacttggccagcaggtcccgtgttccggagaagccagcctctggcccaaccgaacctcccccgttcctaccaccagcaggctccaggagggcagacaccagtggccctggggctggagctgccctagagccaccagccagccttttggaaccttccagagagaccccaaaagtcctgccaaagtccctccttttgaagaattctcactgtgataagaaccctcccagcacagaagtggtaataaaggaagaatcgtcacccaagaaagatatgaagccagccaaggacctgaggcttctgttcagtaatgaatctgagaagccgacaaccaacagctacctgatgcagcaccaggagtccatcattcagctgcagaaggcaggcttggtccgcaagcacaccaaagagctagagcggctgaagagcgtgcctgcagacccagcacctccctccagggatggccctgccagcaggctggaggccagcatccccgaggagagccaggatccagccgcgctccacgagctgggccccctggttatgcccagccaggccgggagtgatgagaagtcagaggccgcccccgcttcattggaaggaggctcactgaagagcccccctcctttcttctaccgcctggaccacaccagtagtttctcaaaagactttctgaagaccatctgctacacccccacctcctcttccatgagctccaacctgacccggagctccagcagcgatagcatccacagtgtccgtgggaagcccgggctggtgaagcagcggacacaggagattgagacccggctccggctggcgggcctcaccgtctcttccccactgaagcgctcacactctcttgccaagctggggagtctcaccttctcaacggaagacctgtccagtgaggctgacccgtccaccgtcgctgactcccaggacaccactttgagtgaatcttccttcttgcatgagccccagggaaccccgagggacccagctgcaacctccaaaccatcagggaaacccgccccagaaaacttaaagagcccttcgtggatgagcaaaagctgacccgccttttgctgcgtcaggctgggcggatattttcatatgatccctccctcactttcactgtggatttggatcgaccccttacatcttgatttcccttaaacgagtgaagtcatcctaacttttcccctactcttgccatagagaggaggagaagaaactaaccaacatgcagcacaagaaggggagctgtcagtcgtgtggcctgggagaaccaggagccgccggccaggagacacaaaactccgctcccaccgtgtcttcaagaagaaccatgttttaggaagaacgtgcacacataggcgcacacatccagactgttcccttcgcatcctgcagaagagtcctggtggtggcagcctcaccgcggcacacgttctagctcattcttggcctcgcagaaaactctcggatggcaacattaagtcctacctctgttctcgctgcgctttttatttttaaaacacacgaatgaccaaggcttgttccagggaataatgctctgtctgaaagcgtttttccaaaaaaagaatttttcgttttgtgttttggttgggaccccagacgtgtcaagacttttaacccgacagccccaagcactgctgagtaaagtcatcagatgagtagtcccacgctgttgttgagctgactctgtgcccgaatggtggtgcaggcgccctgtcctggttgtgttgttacgtgtttgaccagcacaggggtccggtggggaaaatgtatgggttgttctcagttgttgctaatgctgaagtttaaatctcaaggggaagggcccacctgcattgttgagtgtctgctgctgaaacacatgattgtgtttaggtttgaaattgctcaagtgtctggctcaggtggtggttctgagacacatcgtcctgctgagagcccagatgcttaggtccactagggcccatctagggaagggaaaggagatttcagcggcttccccgaaaggaacgggactgtcgggatgcttcccggatgtctacagttgccccttcctgcagtgagattactgcttcctgtttccctccagctcttcccagcagcagtgagggagtataagagggatctgtagtcgctgcctggctctgtgggcggcccctttaagactcaggtgagctcagccagtcccgctgcgccaggcttgaatcaaaggtgtcagcaagctagatgtcaaaacatttcgagagagaggcagcttgcagaaaagcagaaaggttgaattcaggggtcagcaaactatggcatgtggccccgtgagctaggaatggtttttcctctttaagacagggcctggctctgtcacctaggctggagtacagtagtgcaatcatgactcactgcagcatcaacctccctggctcaagcgatggcttttacctttttaaggagttgtaaaaaaaagaaataatatgtgacagaattcatgtggcccacaaagcctgaggtacttactgtcaggccctttgtagaaaaagttgctgacccctggtttgatttgccacacagggctgctcatggccctgtaggaagaaactgggtaaatgtgaagccctctgcctctctgacacctaaggccagacccttccctcctcccgaccacaagctttgccagccccgcactagcctcacctgtgcaggatggagtaggttgcgtacatgggggaaggcaggtgaacacagttggctgaagctcttccacaattccatcttgccctcagctgggtccgccagattaactcagtgaaaccagaaagccttcaaggaccagctgaattctgaaagtgagtgagtgagccatcatcttaacattggccagaactgtgttccccaaagctattctagaaagcaccccaggagggatctgcaggaacaaggctagttcatattttacctagtgagcacagtttttgcaaaaatcctccctccaggactttgtctccttggagtgatttttaaaaatacatacattactttatagggagctgttttcccactagtgtcaattaaaatcaccttaaaaggtgattatccacttattcctaaacccctgtgggttgttccccctttccctcagccaacaaaagcatagcctcaaaaaatatcaagttcggtatgttttgccaaatcaaatttcatgtggtagatcaatttttgtgtcaaaataatcttttaaatttagtgatgacaggcttttgttggttttttaaccacgtctatgtatgagaatgatatatttttgaaaactttaattttgaaagccataatttttcttatctaaagagttggggggtggggtgtggaatctggagagtacaagttggtctttggcttctggcaaacttacccattcatttttggaagcacagctagcatatcaacatccagacgagagcgctggtcccgtccacagagcagagtgaagcattctggacttgatgcttaatagcctggcctggagaaaagggtaaggtttatttttggaaacccagatcagttgcatgtaaacagatggcacatggctatttaaaatgctgtatgatggggccgggcgcggtggctcacgcctgtaatcctagcactttgggaggccgaggcaggcggatcatctgaggtcaggagttctagaccagcctggccaacatggtgaaaccccgtctctactaaaaatacaaaaacttagctgggtgtggtagtgcgtgcctgtaatcctagctacttaggaggctgaggcaggagaatcgcttgaacctgggtggcggaggttgcaatgagccgagatcgcgccactgcactccagcctgggtgcaatgaaactgggagtgaaactccgtctcaaaaaaataaaatgctgtatgaacaagatgagcattctgtcaggtgtcgggacacctgggcaaagacgaattcatgctgtctgtgaaaaggaagtttgcactgtaacatatgccatagcttggcccttgctttgtatgcaaccttagctgatggggaaaattccaaacataagtggcacaggaaagaggcaggcagaggaggcaggggtctgtgctgtgcaagtcactggttttttatgactatcattttcattgaatgcatttgttgaattgggacaaaaggaacattttctaaatcagcttgatactctttataaaaaacagctgaatcttatcttctgcctcacattaattcatgtggcatgccaaaagttagactgaacttttctacatcttcaccttgcattgatacaggaaagtcttctctttaagtcttgctaagtataagggggatagtggtcacgggaagaggagaaccggggctgctctcggatggtaattgacaatgccgatttccatttctttgtcttacggctacttccgagccttctagcaaggtccctggttgcatgtatttcctaagagcagagtttatttctctttacattccctgcttccttgctctccatgcagggaccccagccaacctctgggctgttgaatagctctctgctgggtggcaagcccttctccttggcaccctgttgcttaagcatacagattgctcaccaggtgcacacagacagctgtactgtccaagcccattctgctccaccctgtcctcttcagctaaagagcattccagtaatctaaagcccttttcccctggagaagtccagagtttgcagcagtgtggagctgagcttgaacagaacagaccctcagcacggccctggactaatgcactcttatctgagggcagtccattctagaaggttgatgaatttccctaccactctcctggggaccttttctctctagtgggaacaaatgctacataatttagtcaagatcctattaagtcatctcacctgaggcatctggagagggagttgccttccattggtgggaaattgttggtgccagaatacattttgcccaaaactcttctcattggctggccacctagcagggctcctctaaacacgcaactcagcgaggggacccccttcacctctggcaagagagctgggtagatcagaaacttggtgacacctggctagcacagagcaggctcacttgtcttggtcccactacccagattcctgcagacattgcaaaccaaatgaaggttgttgaatgacccctgtccccagccacttgttttgttatcatctgctctgcagtggaatgcctgtgtgtttgagttcactctgcatctgtatatttgagtatagaaaccgagtcaagtgatcatgtgcatccagacacactgtgtcacctgagccacagagcaaatcaccttaacgatctggaatgaaactgtgaccagtgccgccctgggtggttctggagagactgccgtcttcttgtttggccataggtgctggggccccggcttcagtcactgtctcagacaggagtcccgataagcagatcaccagtcctccactgtccttcctgtcggccttgctgcatgagaagatagctgcttcctccctcttttcctacactgtaattattgttttacaattgagtgccttaataatagtttacaaatactatgtatttatgcaaaactgttaaagtctcatctgttatgattggatacttggtcttgtcagtagtggtcagcattgggttgtgagcttgtcctactccatacgtgtttatcctgctatgcagttttacattgtgtgttcacatctattccaaggagccttgctagaaacaacactggcggttcctgcaggccaggcaggcattggcccatgctgtgtcccataggagccaatgaaagaacgtagcttggtctgctagccagccgtggggtggcgcaggccaggcagcctctgcaccagagtccagcacctgcccattccccagtcacacaatcatactcttctttcatagagattttattaccacctagaccaccctagttttcctctctgttagtgtcctgagctcttttgcaacaaaatgtaggtacagaccaatccctgtcccttccccaatcaggagctccacaccatgagttgtttggttttccagaagctgccagtgggttcccgtgaattgcgttaagatatcgatgattttttttattgtttttcttcttgtttttttaaataatatatttaaaggcagtatcttttgtactgtgaatttgcagtagaagatgcagaatgcactttttttttacttctgttggtgtgtattgtatatagtgtgtgtgcttcttgtgatgaaaataaactttttctttat

SEQ ID NO: 449117 - DNA, 7834 bp, Homo sapiens
aatgaattagagaaacagatgaattgtaacttgaaggaactcaaggaatttatagacaatgagatgctacttatcttgggacagatggacaagccctcccttatcttcgatcatctttatctcggttgattacattttaaatgttaccagagaaatcgataatttttttcctggcttatttgcatatcataacatccgagtctacgatgaagagaccacagacctcctcgcccactggaatgaagcgtatcattttataaacaaagcgaagaggaaccattccaagtgcctggtgcattgcaaaatgggcgtgagtcgctcggcctccacagtcatagcctatgcaatgaaggaattcggctggcctctggaaaaagcatataactatgtaaagcagaagcgcagcatcacgcgccccaacgcgggctttatgaggcagctgtctgagtatgaaggcatcttggatgcaagcaaacagcggcacaacaagctgtggcgtcagcagacagacagcagcctccagcagcctgtggatgaccctgcaggacctggcgacttcttgccagagaccccagatggcaccccggaaagccagctgcccttcttggatgatgccgcccagcccggcttagggccccccctcccctgctgtttccggcgactctcagacccccttctgccttcccctgaggatgaaactggcagcttggtccacctggaggatccggagagggaggctctgttggaggaagctgctccacctgcagaggtgcacaggccggccagacagccccagcaaggttccggactctgtgagaaggatgtgaagaagaaactagagtttgggagtcccaaaggtcggagcggctccttgctgcaggtggaggagacggaaagggaggagggcctgggagcagggaggtgggggcagcttccaacccagctcgatcaaaacctgctcaactcggagaacctaaacaacaacagcaagaggagctgtcccaacggcatggaggatgatgctatatttgggatccttaacaaagtgaagccttcctataaatcctgtgccgactgcatgtaccctacagccagcggggctcctgaggcctccagggagcgatgtgaggaccccaatgctcccgccatctgcacccagccagccttcctaccccacatcacgtcctcccctgtggcccacttggccagcaggtcccgtgttccggagaagccagcctctggcccaaccgaacctcccccgttcctaccaccagcaggctccaggagggcagacaccagtggccctggggctggagctgccctagagccaccagccagccttttggaaccttccagagagaccccaaaagtcctgccaaagtccctccttttgaagaattctcactgtgataagaaccctcccagcacagaagtggtaataaaggaagaatcgtcacccaagaaagatatgaagccagccaaggacctgaggcttctgttcagtaatgaatctgagaagccgacaaccaacagctacctgatgcagcaccaggagtccatcattcagctgcagaaggcaggcttggtccgcaagcacaccaaagagctagagcggctgaagagcgtgcctgcagacccagcacctccctccagggatggccctgccagcaggctggaggccagcatccccgaggagagccaggatccagccgcgctccacgagctgggccccctggttatgcccagccaggccgggagtgatgagaagtcagaggccgcccccgcttcattggaaggaggctcactgaagagcccccctcctttcttctaccgcctggaccacaccagtagtttctcaaaagactttctgaagaccatctgctacacccccacctcctcttccatgagctccaacctgacccggagctccagcagcgatagcatccacagtgtccgtgggaagcccgggctggtgaagcagcggacacaggagattgagacccggctccggctggcgggcctcaccgtctcttccccactgaagcgctcacactctcttgccaagctggggagtctcaccttctcaacggaagacctgtccagtgaggctgacccgtccaccgtcgctgactcccaggacaccactttgagtgaatcttccttcttgcatgagccccagggaaccccgagggacccagctgcaacctccaaaccatcagggaaacccgccccagaaaacttaaagagcccttcgtggatgagcaaaagctgacccgccttttgctgcgtcaggctgggcggatattttcatatgatccctccctcactttcactgtggatttggatcgaccccttacatcttgatttcccttaaacgagtgaagtcatcctaacttttcccctactcttgccatagagaggaggagaagaaactaaccaacatgcagcacaagaaggggagctgtcagtcgtgtggcctgggagaaccaggagccgccggccaggagacacaaaactccgctcccaccgtgtcttcaagaagaaccatgttttaggaagaacgtgcacacataggcgcacacatccagactgttcccttcgcatcctgcagaagagtcctggtggtggcagcctcaccgcggcacacgttctagctcattcttggcctcgcagaaaactctcggatggcaacattaagtcctacctctgttctcgctgcgctttttatttttaaaacacacgaatgaccaaggcttgttccagggaataatgctctgtctgaaagcgtttttccaaaaaaagaatttttcgttttgtgttttggttgggaccccagacgtgtcaagacttttaacccgacagccccaagcactgctgagtaaagtcatcagatgagtagtcccacgctgttgttgagctgactctgtgcccgaatggtggtgcaggcgccctgtcctggttgtgttgttacgtgtttgaccagcacaggggtccggtggggaaaatgtatgggttgttctcagttgttgctaatgctgaagtttaaatctcaaggggaagggcccacctgcattgttgagtgtctgctgctgaaacacatgattgtgtttaggtttgaaattgctcaagtgtctggctcaggtggtggttctgagacacatcgtcctgctgagagcccagatgcttaggtccactagggcccatctagggaagggaaaggagatttcagcggcttccccgaaaggaacgggactgtcgggatgcttcccggatgtctacagttgccccttcctgcagtgagattactgcttcctgtttccctccagctcttcccagcagcagtgagggagtataagagggatctgtagtcgctgcctggctctgtgggcggcccctttaagactcaggtgagctcagccagtcccgctgcgccaggcttgaatcaaaggtgtcagcaagctagatgtcaaaacatttcgagagagaggcagcttgcagaaaagcagaaaggttgaattcaggggtcagcaaactatggcatgtggccccgtgagctaggaatggtttttcctctttaagacagggcctggctctgtcacctaggctggagtacagtagtgcaatcatgactcactgcagcatcaacctccctggctcaagcgatggcttttacctttttaaggagttgtaaaaaaaagaaataatatgtgacagaattcatgtggcccacaaagcctgaggtacttactgtcaggccctttgtagaaaaagttgctgacccctggtttgatttgccacacagggctgctcatggccctgtaggaagaaactgggtaaatgtgaagccctctgcctctctgacacctaaggccagacccttccctcctcccgaccacaagctttgccagccccgcactagcctcacctgtgcaggatggagtaggttgcgtacatgggggaaggcaggtgaacacagttggctgaagctcttccacaattccatcttgccctcagctgggtccgccagattaactcagtgaaaccagaaagccttcaaggaccagctgaattctgaaagtgagtgagtgagccatcatcttaacattggccagaactgtgttccccaaagctattctagaaagcaccccaggagggatctgcaggaacaaggctagttcatattttacctagtgagcacagtttttgcaaaaatcctccctccaggactttgtctccttggagtgatttttaaaaatacatacattactttatagggagctgttttcccactagtgtcaattaaaatcaccttaaaaggtgattatccacttattcctaaacccctgtgggttgttccccctttccctcagccaacaaaagcatagcctcaaaaaatatcaagttcggtatgttttgccaaatcaaatttcatgtggtagatcaatttttgtgtcaaaataatcttttaaatttagtgatgacaggcttttgttggttttttaaccacgtctatgtatgagaatgatatatttttgaaaactttaattttgaaagccataatttttcttatctaaagagttggggggtggggtgtggaatctggagagtacaagttggtctttggcttctggcaaacttacccattcatttttggaagcacagctagcatatcaacatccagacgagagcgctggtcccgtccacagagcagagtgaagcattctggacttgatgcttaatagcctggcctggagaaaagggtaaggtttatttttggaaacccagatcagttgcatgtaaacagatggcacatggctatttaaaatgctgtatgatggggccgggcgcggtggctcacgcctgtaatcctagcactttgggaggccgaggcaggcggatcatctgaggtcaggagttctagaccagcctggccaacatggtgaaaccccgtctctactaaaaatacaaaaacttagctgggtgtggtagtgcgtgcctgtaatcctagctacttaggaggctgaggcaggagaatcgcttgaacctgggtggcggaggttgcaatgagccgagatcgcgccactgcactccagcctgggtgcaatgaaactgggagtgaaactccgtctcaaaaaaataaaatgctgtatgaacaagatgagcattctgtcaggtgtcgggacacctgggcaaagacgaattcatgctgtctgtgaaaaggaagtttgcactgtaacatatgccatagcttggcccttgctttgtatgcaaccttagctgatggggaaaattccaaacataagtggcacaggaaagaggcaggcagaggaggcaggggtctgtgctgtgcaagtcactggttttttatgactatcattttcattgaatgcatttgttgaattgggacaaaaggaacattttctaaatcagcttgatactctttataaaaaacagctgaatcttatcttctgcctcacattaattcatgtggcatgccaaaagttagactgaacttttctacatcttcaccttgcattgatacaggaaagtcttctctttaagtcttgctaagtataagggggatagtggtcacgggaagaggagaaccggggctgctctcggatggtaattgacaatgccgatttccatttctttgtcttacggctacttccgagccttctagcaaggtccctggttgcatgtatttcctaagagcagagtttatttctctttacattccctgcttccttgctctccatgcagggaccccagccaacctctgggctgttgaatagctctctgctgggtggcaagcccttctccttggcaccctgttgcttaagcatacagattgctcaccaggtgcacacagacagctgtactgtccaagcccattctgctccaccctgtcctcttcagctaaagagcattccagtaatctaaagcccttttcccctggagaagtccagagtttgcagcagtgtggagctgagcttgaacagaacagaccctcagcacggccctggactaatgcactcttatctgagggcagtccattctagaaggttgatgaatttccctaccactctcctggggaccttttctctctagtgggaacaaatgctacataatttagtcaagatcctattaagtcatctcacctgaggcatctggagagggagttgccttccattggtgggaaattgttggtgccagaatacattttgcccaaaactcttctcattggctggccacctagcagggctcctctaaacacgcaactcagcgaggggacccccttcacctctggcaagagagctgggtagatcagaaacttggtgacacctggctagcacagagcaggctcacttgtcttggtcccactacccagattcctgcagacattgcaaaccaaatgaaggttgttgaatgacccctgtccccagccacttgttttgttatcatctgctctgcagtggaatgcctgtgtgtttgagttcactctgcatctgtatatttgagtatagaaaccgagtcaagtgatcatgtgcatccagacacactgtgtcacctgagccacagagcaaatcaccttaacgatctggaatgaaactgtgaccagtgccgccctgggtggttctggagagactgccgtcttcttgtttggccataggtgctggggccccggcttcagtcactgtctcagacaggagtcccgataagcagatcaccagtcctccactgtccttcctgtcggccttgctgcatgagaagatagctgcttcctccctcttttcctacactgtaattattgttttacaattgagtgccttaataatagtttacaaatactatgtatttatgcaaaactgttaaagtctcatctgttatgattggatacttggtcttgtcagtagtggtcagcattgggttgtgagcttgtcctactccatacgtgtttatcctgctatgcagttttacattgtgtgttcacatctattccaaggagccttgctagaaacaacactggcggttcctgcaggccaggcaggcattggcccatgctgtgtcccataggagccaatgaaagaacgtagcttggtctgctagccagccgtggggtggcgcaggccaggcagcctctgcaccagagtccagcacctgcccattccccagtcacacaatcatactcttctttcatagagattttattaccacctagaccaccctagttttcctctctgttagtgtcctgagctcttttgcaacaaaatgtaggtacagaccaatccctgtcccttccccaatcaggagctccacaccatgagttgtttggttttccagaagctgccagtgggttcccgtgaattgcgttaagatatcgatgattttttttattgtttttcttcttgtttttttaaataatatatttaaaggcagtatcttttgtactgtgaatttgcagtagaagatgcagaatgcactttttttttacttctgttggtgtgtattgtatatagtgtgtgtgcttcttgtgatgaaaataaactttttctttataaattcctgatgactgagtttatataaaaggaaactgcttcctcagcccttgccaaaacagtctgatacatcgtcatcatcatcgtcattgacatggccagtctttattgagcatctattacatgctcagttctttgctagaaaacctggacaagttacaccaaagaaaggaccacaggaagaaatgatagttcctcctggaactagtctgttttctttctaattttgtcagtaagcaagaacaggcccacctgtgggtggtcctttgtgtacc

SEQ ID NO: 449118 - DNA, 6822 bp, Homo sapiens
acttagatcctcactgaccaaaaggcaggagggtttccttaggaaacaatgtaaacttgttttctattggggtataaaatccacctcaggccagtggttattctcgatcaagtgggctccaggaggtctgtctgtcagtattaagtgaaatgagagcctcccctccaggcctggcccccagtccggcctcgcacccctttccctgcccaccctcatgtttttggtctttggctcatgactgcaccgtctcaccatgctcttgtccccttccttgcaggatgatgctatatttgggatccttaacaaagtgaagccttcctataaatcctgtgccgactgcatgtaccctacagccagcggggctcctgaggcctccagggagcgatgtgaggaccccaatgctcccgccatctgcacccagccagccttcctaccccacatcacgtcctcccctgtggcccacttggccagcaggtcccgtgttccggagaagccagcctctggcccaaccgaacctcccccgttcctaccaccagcaggctccaggagggcagacaccagtggccctggggctggagctgccctagagccaccagccagccttttggaaccttccagagagaccccaaaagtcctgccaaagtccctccttttgaagaattctcactgtgataagaaccctcccagcacagaagtggtaataaaggaagaatcgtcacccaagaaagatatgaagccagccaaggacctgaggcttctgttcagtaatgaatctgagaagccgacaaccaacagctacctgatgcagcaccaggagtccatcattcagctgcagaaggcaggcttggtccgcaagcacaccaaagagctagagcggctgaagagcgtgcctgcagacccagcacctccctccagggatggccctgccagcaggctggaggccagcatccccgaggagagccaggatccagccgcgctccacgagctgggccccctggttatgcccagccaggccgggagtgatgagaagtcagaggccgcccccgcttcattggaaggaggctcactgaagagcccccctcctttcttctaccgcctggaccacaccagtagtttctcaaaagactttctgaagaccatctgctacacccccacctcctcttccatgagctccaacctgacccggagctccagcagcgatagcatccacagtgtccgtgggaagcccgggctggtgaagcagcggacacaggagattgagacccggctccggctggcgggcctcaccgtctcttccccactgaagcgctcacactctcttgccaagctggggagtctcaccttctcaacggaagacctgtccagtgaggctgacccgtccaccgtcgctgactcccaggacaccactttgagtgaatcttccttcttgcatgagccccagggaaccccgagggacccagctgcaacctccaaaccatcagggaaacccgccccagaaaacttaaagagcccttcgtggatgagcaaaagctgacccgccttttgctgcgtcaggctgggcggatattttcatatgatccctccctcactttcactgtggatttggatcgaccccttacatcttgatttcccttaaacgagtgaagtcatcctaacttttcccctactcttgccatagagaggaggagaagaaactaaccaacatgcagcacaagaaggggagctgtcagtcgtgtggcctgggagaaccaggagccgccggccaggagacacaaaactccgctcccaccgtgtcttcaagaagaaccatgttttaggaagaacgtgcacacataggcgcacacatccagactgttcccttcgcatcctgcagaagagtcctggtggtggcagcctcaccgcggcacacgttctagctcattcttggcctcgcagaaaactctcggatggcaacattaagtcctacctctgttctcgctgcgctttttatttttaaaacacacgaatgaccaaggcttgttccagggaataatgctctgtctgaaagcgtttttccaaaaaaagaatttttcgttttgtgttttggttgggaccccagacgtgtcaagacttttaacccgacagccccaagcactgctgagtaaagtcatcagatgagtagtcccacgctgttgttgagctgactctgtgcccgaatggtggtgcaggcgccctgtcctggttgtgttgttacgtgtttgaccagcacaggggtccggtggggaaaatgtatgggttgttctcagttgttgctaatgctgaagtttaaatctcaaggggaagggcccacctgcattgttgagtgtctgctgctgaaacacatgattgtgtttaggtttgaaattgctcaagtgtctggctcaggtggtggttctgagacacatcgtcctgctgagagcccagatgcttaggtccactagggcccatctagggaagggaaaggagatttcagcggcttccccgaaaggaacgggactgtcgggatgcttcccggatgtctacagttgccccttcctgcagtgagattactgcttcctgtttccctccagctcttcccagcagcagtgagggagtataagagggatctgtagtcgctgcctggctctgtgggcggcccctttaagactcaggtgagctcagccagtcccgctgcgccaggcttgaatcaaaggtgtcagcaagctagatgtcaaaacatttcgagagagaggcagcttgcagaaaagcagaaaggttgaattcaggggtcagcaaactatggcatgtggccccgtgagctaggaatggtttttcctctttaagacagggcctggctctgtcacctaggctggagtacagtagtgcaatcatgactcactgcagcatcaacctccctggctcaagcgatggcttttacctttttaaggagttgtaaaaaaaagaaataatatgtgacagaattcatgtggcccacaaagcctgaggtacttactgtcaggccctttgtagaaaaagttgctgacccctggtttgatttgccacacagggctgctcatggccctgtaggaagaaactgggtaaatgtgaagccctctgcctctctgacacctaaggccagacccttccctcctcccgaccacaagctttgccagccccgcactagcctcacctgtgcaggatggagtaggttgcgtacatgggggaaggcaggtgaacacagttggctgaagctcttccacaattccatcttgccctcagctgggtccgccagattaactcagtgaaaccagaaagccttcaaggaccagctgaattctgaaagtgagtgagtgagccatcatcttaacattggccagaactgtgttccccaaagctattctagaaagcaccccaggagggatctgcaggaacaaggctagttcatattttacctagtgagcacagtttttgcaaaaatcctccctccaggactttgtctccttggagtgatttttaaaaatacatacattactttatagggagctgttttcccactagtgtcaattaaaatcaccttaaaaggtgattatccacttattcctaaacccctgtgggttgttccccctttccctcagccaacaaaagcatagcctcaaaaaatatcaagttcggtatgttttgccaaatcaaatttcatgtggtagatcaatttttgtgtcaaaataatcttttaaatttagtgatgacaggcttttgttggttttttaaccacgtctatgtatgagaatgatatatttttgaaaactttaattttgaaagccataatttttcttatctaaagagttggggggtggggtgtggaatctggagagtacaagttggtctttggcttctggcaaacttacccattcatttttggaagcacagctagcatatcaacatccagacgagagcgctggtcccgtccacagagcagagtgaagcattctggacttgatgcttaatagcctggcctggagaaaagggtaaggtttatttttggaaacccagatcagttgcatgtaaacagatggcacatggctatttaaaatgctgtatgatggggccgggcgcggtggctcacgcctgtaatcctagcactttgggaggccgaggcaggcggatcatctgaggtcaggagttctagaccagcctggccaacatggtgaaaccccgtctctactaaaaatacaaaaacttagctgggtgtggtagtgcgtgcctgtaatcctagctacttaggaggctgaggcaggagaatcgcttgaacctgggtggcggaggttgcaatgagccgagatcgcgccactgcactccagcctgggtgcaatgaaactgggagtgaaactccgtctcaaaaaaataaaatgctgtatgaacaagatgagcattctgtcaggtgtcgggacacctgggcaaagacgaattcatgctgtctgtgaaaaggaagtttgcactgtaacatatgccatagcttggcccttgctttgtatgcaaccttagctgatggggaaaattccaaacataagtggcacaggaaagaggcaggcagaggaggcaggggtctgtgctgtgcaagtcactggttttttatgactatcattttcattgaatgcatttgttgaattgggacaaaaggaacattttctaaatcagcttgatactctttataaaaaacagctgaatcttatcttctgcctcacattaattcatgtggcatgccaaaagttagactgaacttttctacatcttcaccttgcattgatacaggaaagtcttctctttaagtcttgctaagtataagggggatagtggtcacgggaagaggagaaccggggctgctctcggatggtaattgacaatgccgatttccatttctttgtcttacggctacttccgagccttctagcaaggtccctggttgcatgtatttcctaagagcagagtttatttctctttacattccctgcttccttgctctccatgcagggaccccagccaacctctgggctgttgaatagctctctgctgggtggcaagcccttctccttggcaccctgttgcttaagcatacagattgctcaccaggtgcacacagacagctgtactgtccaagcccattctgctccaccctgtcctcttcagctaaagagcattccagtaatctaaagcccttttcccctggagaagtccagagtttgcagcagtgtggagctgagcttgaacagaacagaccctcagcacggccctggactaatgcactcttatctgagggcagtccattctagaaggttgatgaatttccctaccactctcctggggaccttttctctctagtgggaacaaatgctacataatttagtcaagatcctattaagtcatctcacctgaggcatctggagagggagttgccttccattggtgggaaattgttggtgccagaatacattttgcccaaaactcttctcattggctggccacctagcagggctcctctaaacacgcaactcagcgaggggacccccttcacctctggcaagagagctgggtagatcagaaacttggtgacacctggctagcacagagcaggctcacttgtcttggtcccactacccagattcctgcagacattgcaaaccaaatgaaggttgttgaatgacccctgtccccagccacttgttttgttatcatctgctctgcagtggaatgcctgtgtgtttgagttcactctgcatctgtatatttgagtatagaaaccgagtcaagtgatcatgtgcatccagacacactgtgtcacctgagccacagagcaaatcaccttaacgatctggaatgaaactgtgaccagtgccgccctgggtggttctggagagactgccgtcttcttgtttggccataggtgctggggccccggcttcagtcactgtctcagacaggagtcccgataagcagatcaccagtcctccactgtccttcctgtcggccttgctgcatgagaagatagctgcttcctccctcttttcctacactgtaattattgttttacaattgagtgccttaataatagtttacaaatactatgtatttatgcaaaactgttaaagtctcatctgttatgattggatacttggtcttgtcagtagtggtcagcattgggttgtgagcttgtcctactccatacgtgtttatcctgctatgcagttttacattgtgtgttcacatctattccaaggagccttgctagaaacaacactggcggttcctgcaggccaggcaggcattggcccatgctgtgtcccataggagccaatgaaagaacgtagcttggtctgctagccagccgtggggtggcgcaggccaggcagcctctgcaccagagtccagcacctgcccattccccagtcacacaatcatactcttctttcatagagattttattaccacctagaccaccctagttttcctctctgttagtgtcctgagctcttttgcaacaaaatgtaggtacagaccaatccctgtcccttccccaatcaggagctccacaccatgagttgtttggttttccagaagctgccagtgggttcccgtgaattgcgttaagatatcgatgattttttttattgtttttcttcttgtttttttaaataatatatttaaaggcagtatcttttgtactgtgaatttgcagtagaagatgcagaatgcactttttttttacttctgttggtgtgtattgtatatagtgtgtgtgcttcttgtgatgaaaataaactttttctttat

SEQ ID NO: 449119 - DNA, 6355 bp, Homo sapiens
gtgatatccaccttgtagggtccctcctccggggggatgtagcgcacagactgggcttccgctccaccgcctgggtccagatggcagacaccagtggccctggggctggagctgccctagagccaccagccagccttttggaaccttccagagagaccccaaaagtcctgccaaagtccctccttttgaagaattctcactgtgataagaaccctcccagcacagaagtggtaataaaggaagaatcgtcacccaagaaagatatgaagccagccaaggacctgaggcttctgttcagtaatgaatctgagaagccgacaaccaacagctacctgatgcagcaccaggagtccatcattcagctgcagaaggcaggcttggtccgcaagcacaccaaagagctagagcggctgaagagcgtgcctgcagacccagcacctccctccagggatggccctgccagcaggctggaggccagcatccccgaggagagccaggatccagccgcgctccacgagctgggccccctggttatgcccagccaggccgggagtgatgagaagtcagaggccgcccccgcttcattggaaggaggctcactgaagagcccccctcctttcttctaccgcctggaccacaccagtagtttctcaaaagactttctgaagaccatctgctacacccccacctcctcttccatgagctccaacctgacccggagctccagcagcgatagcatccacagtgtccgtgggaagcccgggctggtgaagcagcggacacaggagattgagacccggctccggctggcgggcctcaccgtctcttccccactgaagcgctcacactctcttgccaagctggggagtctcaccttctcaacggaagacctgtccagtgaggctgacccgtccaccgtcgctgactcccaggacaccactttgagtgaatcttccttcttgcatgagccccagggaaccccgagggacccagctgcaacctccaaaccatcagggaaacccgccccagaaaacttaaagagcccttcgtggatgagcaaaagctgacccgccttttgctgcgtcaggctgggcggatattttcatatgatccctccctcactttcactgtggatttggatcgaccccttacatcttgatttcccttaaacgagtgaagtcatcctaacttttcccctactcttgccatagagaggaggagaagaaactaaccaacatgcagcacaagaaggggagctgtcagtcgtgtggcctgggagaaccaggagccgccggccaggagacacaaaactccgctcccaccgtgtcttcaagaagaaccatgttttaggaagaacgtgcacacataggcgcacacatccagactgttcccttcgcatcctgcagaagagtcctggtggtggcagcctcaccgcggcacacgttctagctcattcttggcctcgcagaaaactctcggatggcaacattaagtcctacctctgttctcgctgcgctttttatttttaaaacacacgaatgaccaaggcttgttccagggaataatgctctgtctgaaagcgtttttccaaaaaaagaatttttcgttttgtgttttggttgggaccccagacgtgtcaagacttttaacccgacagccccaagcactgctgagtaaagtcatcagatgagtagtcccacgctgttgttgagctgactctgtgcccgaatggtggtgcaggcgccctgtcctggttgtgttgttacgtgtttgaccagcacaggggtccggtggggaaaatgtatgggttgttctcagttgttgctaatgctgaagtttaaatctcaaggggaagggcccacctgcattgttgagtgtctgctgctgaaacacatgattgtgtttaggtttgaaattgctcaagtgtctggctcaggtggtggttctgagacacatcgtcctgctgagagcccagatgcttaggtccactagggcccatctagggaagggaaaggagatttcagcggcttccccgaaaggaacgggactgtcgggatgcttcccggatgtctacagttgccccttcctgcagtgagattactgcttcctgtttccctccagctcttcccagcagcagtgagggagtataagagggatctgtagtcgctgcctggctctgtgggcggcccctttaagactcaggtgagctcagccagtcccgctgcgccaggcttgaatcaaaggtgtcagcaagctagatgtcaaaacatttcgagagagaggcagcttgcagaaaagcagaaaggttgaattcaggggtcagcaaactatggcatgtggccccgtgagctaggaatggtttttcctctttaagacagggcctggctctgtcacctaggctggagtacagtagtgcaatcatgactcactgcagcatcaacctccctggctcaagcgatggcttttacctttttaaggagttgtaaaaaaaagaaataatatgtgacagaattcatgtggcccacaaagcctgaggtacttactgtcaggccctttgtagaaaaagttgctgacccctggtttgatttgccacacagggctgctcatggccctgtaggaagaaactgggtaaatgtgaagccctctgcctctctgacacctaaggccagacccttccctcctcccgaccacaagctttgccagccccgcactagcctcacctgtgcaggatggagtaggttgcgtacatgggggaaggcaggtgaacacagttggctgaagctcttccacaattccatcttgccctcagctgggtccgccagattaactcagtgaaaccagaaagccttcaaggaccagctgaattctgaaagtgagtgagtgagccatcatcttaacattggccagaactgtgttccccaaagctattctagaaagcaccccaggagggatctgcaggaacaaggctagttcatattttacctagtgagcacagtttttgcaaaaatcctccctccaggactttgtctccttggagtgatttttaaaaatacatacattactttatagggagctgttttcccactagtgtcaattaaaatcaccttaaaaggtgattatccacttattcctaaacccctgtgggttgttccccctttccctcagccaacaaaagcatagcctcaaaaaatatcaagttcggtatgttttgccaaatcaaatttcatgtggtagatcaatttttgtgtcaaaataatcttttaaatttagtgatgacaggcttttgttggttttttaaccacgtctatgtatgagaatgatatatttttgaaaactttaattttgaaagccataatttttcttatctaaagagttggggggtggggtgtggaatctggagagtacaagttggtctttggcttctggcaaacttacccattcatttttggaagcacagctagcatatcaacatccagacgagagcgctggtcccgtccacagagcagagtgaagcattctggacttgatgcttaatagcctggcctggagaaaagggtaaggtttatttttggaaacccagatcagttgcatgtaaacagatggcacatggctatttaaaatgctgtatgatggggccgggcgcggtggctcacgcctgtaatcctagcactttgggaggccgaggcaggcggatcatctgaggtcaggagttctagaccagcctggccaacatggtgaaaccccgtctctactaaaaatacaaaaacttagctgggtgtggtagtgcgtgcctgtaatcctagctacttaggaggctgaggcaggagaatcgcttgaacctgggtggcggaggttgcaatgagccgagatcgcgccactgcactccagcctgggtgcaatgaaactgggagtgaaactccgtctcaaaaaaataaaatgctgtatgaacaagatgagcattctgtcaggtgtcgggacacctgggcaaagacgaattcatgctgtctgtgaaaaggaagtttgcactgtaacatatgccatagcttggcccttgctttgtatgcaaccttagctgatggggaaaattccaaacataagtggcacaggaaagaggcaggcagaggaggcaggggtctgtgctgtgcaagtcactggttttttatgactatcattttcattgaatgcatttgttgaattgggacaaaaggaacattttctaaatcagcttgatactctttataaaaaacagctgaatcttatcttctgcctcacattaattcatgtggcatgccaaaagttagactgaacttttctacatcttcaccttgcattgatacaggaaagtcttctctttaagtcttgctaagtataagggggatagtggtcacgggaagaggagaaccggggctgctctcggatggtaattgacaatgccgatttccatttctttgtcttacggctacttccgagccttctagcaaggtccctggttgcatgtatttcctaagagcagagtttatttctctttacattccctgcttccttgctctccatgcagggaccccagccaacctctgggctgttgaatagctctctgctgggtggcaagcccttctccttggcaccctgttgcttaagcatacagattgctcaccaggtgcacacagacagctgtactgtccaagcccattctgctccaccctgtcctcttcagctaaagagcattccagtaatctaaagcccttttcccctggagaagtccagagtttgcagcagtgtggagctgagcttgaacagaacagaccctcagcacggccctggactaatgcactcttatctgagggcagtccattctagaaggttgatgaatttccctaccactctcctggggaccttttctctctagtgggaacaaatgctacataatttagtcaagatcctattaagtcatctcacctgaggcatctggagagggagttgccttccattggtgggaaattgttggtgccagaatacattttgcccaaaactcttctcattggctggccacctagcagggctcctctaaacacgcaactcagcgaggggacccccttcacctctggcaagagagctgggtagatcagaaacttggtgacacctggctagcacagagcaggctcacttgtcttggtcccactacccagattcctgcagacattgcaaaccaaatgaaggttgttgaatgacccctgtccccagccacttgttttgttatcatctgctctgcagtggaatgcctgtgtgtttgagttcactctgcatctgtatatttgagtatagaaaccgagtcaagtgatcatgtgcatccagacacactgtgtcacctgagccacagagcaaatcaccttaacgatctggaatgaaactgtgaccagtgccgccctgggtggttctggagagactgccgtcttcttgtttggccataggtgctggggccccggcttcagtcactgtctcagacaggagtcccgataagcagatcaccagtcctccactgtccttcctgtcggccttgctgcatgagaagatagctgcttcctccctcttttcctacactgtaattattgttttacaattgagtgccttaataatagtttacaaatactatgtatttatgcaaaactgttaaagtctcatctgttatgattggatacttggtcttgtcagtagtggtcagcattgggttgtgagcttgtcctactccatacgtgtttatcctgctatgcagttttacattgtgtgttcacatctattccaaggagccttgctagaaacaacactggcggttcctgcaggccaggcaggcattggcccatgctgtgtcccataggagccaatgaaagaacgtagcttggtctgctagccagccgtggggtggcgcaggccaggcagcctctgcaccagagtccagcacctgcccattccccagtcacacaatcatactcttctttcatagagattttattaccacctagaccaccctagttttcctctctgttagtgtcctgagctcttttgcaacaaaatgtaggtacagaccaatccctgtcccttccccaatcaggagctccacaccatgagttgtttggttttccagaagctgccagtgggttcccgtgaattgcgttaagatatcgatgattttttttattgtttttcttcttgtttttttaaataatatatttaaaggcagtatcttttgtactgtgaatttgcagtagaagatgcagaatgcactttttttttacttctgttggtgtgtattgtatatagtgtgtgtgcttcttgtgatgaaaataaactttttctttat

SEQ ID NO: 449120 - DNA, 7545 bp, Homo sapiens
aatgaattagagaaacagatgaattgtaacttgaaggaactcaaggaatttatagacaatgagatgctacttatcttgggacagatggacaagccctcccttatcttcgatcatctttatctcggttgattacattttaaatgttaccagagaaatcgataatttttttcctggcttatttgcatatcataacatccgagtctacgatgaagagaccacagacctcctcgcccactggaatgaagcgtatcattttataaacaaagcgaagaggaaccattccaagtgcctggtgcattgcaaaatgggcgtgagtcgctcggcctccacagtcatagcctatgcaatgaaggaattcggctggcctctggaaaaagcatataactatgtaaagcagaagcgcagcatcacgcgccccaacgcgggctttatgaggcagctgtctgagtatgaaggcatcttggatgcaagcaaacagcggcacaacaagctgtggcgtcagcagacagacagcagcctccagcagcctgtggatgaccctgcaggacctggcgacttcttgccagagaccccagatggcaccccggaaagccagctgcccttcttggatgatgccgcccagcccggcttagggccccccctcccctgctgtttccggcgactctcagacccccttctgccttcccctgaggatgaaactggcagcttggtccacctggaggatccggagagggaggctctgttggaggaagctgctccacctgcagaggtgcacaggccggccagacagccccagcaaggttccggactctgtgagaaggatgtgaagaagaaactagagtttgggagtcccaaaggtcggagcggctccttgctgcaggtggaggagacggaaagggaggagggcctgggagcagggaggtgggggcagcttccaacccagctcgatcaaaacctgctcaactcggagaacctaaacaacaacagcaagaggagctgtcccaacggcatggaggatgatgctatatttgggatccttaacaaagtgaagccttcctataaatcctgtgccgactgcatgtaccctacagccagcggggctcctgaggcctccagggagcgatgtgaggaccccaatgctcccgccatctgcacccagccagccttcctaccccacatcacgtcctcccctgtggcccacttggccagcaggtcccgtgttccggagaagccagcctctggcccaaccgaacctcccccgttcctaccaccagcaggctccaggagggcagacaccagtggccctggggctggagctgccctagagccaccagccagccttttggaaccttccagagagaccccaaaagtcctgccaaagtccctccttttgaagaattctcactgtgataagaaccctcccagcacagaagtggtaataaaggaagaatcgtcacccaagaaagatatgaagccagccaaggacctgaggcttctgttcagtaatgaatctgagaagccgacaaccaacagctacctgatgcagcaccaggagtccatcattcagctgcagaaggcaggcttggtccgcaagcacaccaaagagctagagcggctgaagagcgtgcctgcagacccagcacctccctccagggatggccctgccagcaggctggaggccagcatccccgaggagagccaggatccagccgcgctccacgagctgggccccctggttatgcccagccaggccgggagtgatgagaagtcagaggccgcccccgcttcattggaaggaggctcactgaagagcccccctcctttcttctaccgcctggaccacaccagtagtttctcaaaagactttctgaagaccatctgctacacccccacctcctcttccatgagctccaacctgacccggagctccagcagcgatagcatccacagtgtccgtgggaagcccgggctggtgaagcagcggacacaggagattgagacccggctccggctggcgggcctcaccgtctcttccccactgaagcgctcacactctcttgccaagctggggagtctcaccttctcaacggaagacctgtccagtgaggctgacccgtccaccgtcgctgactcccaggacaccactttgagtgaatcttccttcttgcatgagccccagggaaccccgagggacccagctgcaacctccaaaccatcagggaaacccgccccagaaaacttaaagagcccttcgtggatgagcaaaagctgacccgccttttgctgcgtcaggctgggcggatattttcatatgatccctccctcactttcactgtggatttggatcgaccccttacatcttgatttcccttaaacgagtgaagtcatcctaacttttcccctactcttgccatagagaggaggagaagaaactaaccaacatgcagcacaagaaggggagctgtcagtcgtgtggcctgggagaaccaggagccgccggccaggagacacaaaactccgctcccaccgtgtcttcaagaagaaccatgttttaggaagaacgtgcacacataggcgcacacatccagactgttcccttcgcatcctgcagaagagtcctggtggtggcagcctcaccgcggcacacgttctagctcattcttggcctcgcagaaaactctcggatggcaacattaagtcctacctctgttctcgctgcgctttttatttttaaaacacacgaatgaccaaggcttgttccagggaataatgctctgtctgaaagcgtttttccaaaaaaagaatttttcgttttgtgttttggttgggaccccagacgtgtcaagacttttaacccgacagccccaagcactgctgagtaaagtcatcagatgagtagtcccacgctgttgttgagctgactctgtgcccgaatggtggtgcaggcgccctgtcctggttgtgttgttacgtgtttgaccagcacaggggtccggtggggaaaatgtatgggttgttctcagttgttgctaatgctgaagtttaaatctcaaggggaagggcccacctgcattgttgagtgtctgctgctgaaacacatgattgtgtttaggtttgaaattgctcaagtgtctggctcaggtggtggttctgagacacatcgtcctgctgagagcccagatgcttaggtccactagggcccatctagggaagggaaaggagatttcagcggcttccccgaaaggaacgggactgtcgggatgcttcccggatgtctacagttgccccttcctgcagtgagattactgcttcctgtttccctccagctcttcccagcagcagtgagggagtataagagggatctgtagtcgctgcctggctctgtgggcggcccctttaagactcaggtgagctcagccagtcccgctgcgccaggcttgaatcaaaggtgtcagcaagctagatgtcaaaacatttcgagagagaggcagcttgcagaaaagcagaaaggttgaattcaggggtcagcaaactatggcatgtggccccgtgagctaggaatggtttttcctctttaagacagggcctggctctgtcacctaggctggagtacagtagtgcaatcatgactcactgcagcatcaacctccctggctcaagcgatggcttttacctttttaaggagttgtaaaaaaaagaaataatatgtgacagaattcatgtggcccacaaagcctgaggtacttactgtcaggccctttgtagaaaaagttgctgacccctggtttgatttgccacacagggctgctcatggccctgtaggaagaaactgggtaaatgtgaagccctctgcctctctgacacctaaggccagacccttccctcctcccgaccacaagctttgccagccccgcactagcctcacctgtgcaggatggagtaggttgcgtacatgggggaaggcaggtgaacacagttggctgaagctcttccacaattccatcttgccctcagctgggtccgccagattaactcagtgaaaccagaaagccttcaaggaccagctgaattctgaaagtgagtgagtgagccatcatcttaacattggccagaactgtgttccccaaagctattctagaaagcaccccaggagggatctgcaggaacaaggctagttcatattttacctagtgagcacagtttttgcaaaaatcctccctccaggactttgtctccttggagtgatttttaaaaatacatacattactttatagggagctgttttcccactagtgtcaattaaaatcaccttaaaaggtgattatccacttattcctaaacccctgtgggttgttccccctttccctcagccaacaaaagcatagcctcaaaaaatatcaagttcggtatgttttgccaaatcaaatttcatgtggtagatcaatttttgtgtcaaaataatcttttaaatttagtgatgacaggcttttgttggttttttaaccacgtctatgtatgagaatgatatatttttgaaaactttaattttgaaagccataatttttcttatctaaagagttggggggtggggtgtggaatctggagagtacaagttggtctttggcttctggcaaacttacccattcatttttggaagcacagctagcatatcaacatccagacgagagcgctggtcccgtccacagagcagagtgaagcattctggacttgatgcttaatagcctggcctggagaaaagggtaaggtttatttttggaaacccagatcagttgcatgtaaacagatggcacatggctatttaaaatgctgtatgatggggccgggcgcggtggctcacgcctgtaatcctagcactttgggaggccgaggcaggcggatcatctgaggtcaggagttctagaccagcctggccaacatggtgaaaccccgtctctactaaaaatacaaaaacttagctgggtgtggtagtgcgtgcctgtaatcctagctacttaggaggctgaggcaggagaatcgcttgaacctgggtggcggaggttgcaatgagccgagatcgcgccactgcactccagcctgggtgcaatgaaactgggagtgaaactccgtctcaaaaaaataaaatgctgtatgaacaagatgagcattctgtcaggtgtcgggacacctgggcaaagacgaattcatgctgtctgtgaaaaggaagtttgcactgtaacatatgccatagcttggcccttgctttgtatgcaaccttagctgatggggaaaattccaaacataagtggcacaggaaagaggcaggcagaggaggcaggggtctgtgctgtgcaagtcactggttttttatgactatcattttcattgaatgcatttgttgaattgggacaaaaggaacattttctaaatcagcttgatactctttataaaaaacagctgaatcttatcttctgcctcacattaattcatgtggcatgccaaaagttagactgaacttttctacatcttcaccttgcattgatacaggaaagtcttctctttaagtcttgctaagtataagggggatagtggtcacgggaagaggagaaccggggctgctctcggatggtaattgacaatgccgatttccatttctttgtcttacggctacttccgagccttctagcaaggtccctggttgcatgtatttcctaagagcagagtttatttctctttacattccctgcttccttgctctccatgcagggaccccagccaacctctgggctgttgaatagctctctgctgggtggcaagcccttctccttggcaccctgttgcttaagcatacagattgctcaccaggtgcacacagacagctgtactgtccaagcccattctgctccaccctgtcctcttcagctaaagagcattccagtaatctaaagcccttttcccctggagaagtccagagtttgcagcagtgtggagctgagcttgaacagaacagaccctcagcacggccctggactaatgcactcttatctgagggcagtccattctagaaggttgatgaatttccctaccactctcctggggaccttttctctctagtgggaacaaatgctacataatttagtcaagatcctattaagtcatctcacctgaggcatctggagagggagttgccttccattggtgggaaattgttggtgccagaatacattttgcccaaaactcttctcattggctggccacctagcagggctcctctaaacacgcaactcagcgaggggacccccttcacctctggcaagagagctgggtagatcagaaacttggtgacacctggctagcacagagcaggctcacttgtcttggtcccactacccagattcctgcagacattgcaaaccaaatgaaggttgttgaatgacccctgtccccagccacttgttttgttatcatctgctctgcagtggaatgcctgtgtgtttgagttcactctgcatctgtatatttgagtatagaaaccgagtcaagtgatcatgtgcatccagacacactgtgtcacctgagccacagagcaaatcaccttaacgatctggaatgaaactgtgaccagtgccgccctgggtggttctggagagactgccgtcttcttgtttggccataggtgctggggccccggcttcagtcactgtctcagacaggagtcccgataagcagatcaccagtcctccactgtccttcctgtcggccttgctgcatgagaagatagctgcttcctccctcttttcctacactgtaattattgttttacaattgagtgccttaataatagtttacaaatactatgtatttatgcaaaactgttaaagtctcatctgttatgattggatacttggtcttgtcagtagtggtcagcattgggttgtgagcttgtcctactccatacgtgtttatcctgctatgcagttttacattgtgtgttcacatctattccaaggagccttgctagaaacaacactggcggttcctgcaggccaggcaggcattggcccatgctgtgtcccataggagccaatgaaagaacgtagcttggtctgctagccagccgtggggtggcgcaggccaggcagcctctgcaccagagtccagcacctgcccattccccagtcacacaatcatactcttctttcatagagattttattaccacctagaccaccctagttttcctctctgttagtgtcctgagctcttttgcaacaaaatgtaggtacagaccaatccctgtcccttccccaatcaggagctccacaccatgagttgtttggttttccagaagctgccagtgggttcccgtgaattgcgttaagatatcgatgattttttttattgtttttcttcttgtttttttaaataatatatttaaaggcagtatcttttgtactgtgaatttgcagtagaagatgcagaatgcactttttttttacttctgttggttgtgtgtgcttcttgtgatgaaaataaactttttctttat

SEQ ID NO: 449121 - DNA, 2570 bp, Homo sapiens
gcgatcacccggttgtgtatttcatttaccgggccggggttttcgtttaaatcatcgtggtgccgtggttgcaatgagccgagatcgcgccactgcactccagcctgggtgcaatgaaactgggagtgaaactccgtctcaaaaaaataaaatgctgtatgaacaagatgagcattctgtcaggtgtcgggacacctgggcaaagacgaattcatgctgtctgtgaaaaggaagtttgcactgtaacatatgccatagcttggcccttgctttgtatgcaaccttagctgatggggaaaattccaaacataagtggcacaggaaagaggcaggcagaggaggcaggggtctgtgctgtgcaagtcactggttttttatgactatcattttcattgaatgcatttgttgaattgggacaaaaggaacattttctaaatcagcttgatactctttataaaaaacagctgaatcttatcttctgcctcacattaattcatgtggcatgccaaaagttagactgaacttttctacatcttcaccttgcattgatacaggaaagtcttctctttaagtcttgctaagtataagggggatagtggtcacgggaagaggagaaccggggctgctctcggatggtaattgacaatgccgatttccatttctttgtcttacggctacttccgagccttctagcaaggtccctggttgcatgtatttcctaagagcagagtttatttctctttacattccctgcttccttgctctccatgcagggaccccagccaacctctgggctgttgaatagctctctgctgggtggcaagcccttctccttggcaccctgttgcttaagcatacagattgctcaccaggtgcacacagacagctgtactgtccaagcccattctgctccaccctgtcctcttcagctaaagagcattccagtaatctaaagcccttttcccctggagaagtccagagtttgcagcagtgtggagctgagcttgaacagaacagaccctcagcacggccctggactaatgcactcttatctgagggcagtccattctagaaggttgatgaatttccctaccactctcctggggaccttttctctctagtgggaacaaatgctacataatttagtcaagatcctattaagtcatctcacctgaggcatctggagagggagttgccttccattggtgggaaattgttggtgccagaatacattttgcccaaaactcttctcattggctggccacctagcagggctcctctaaacacgcaactcagcgaggggacccccttcacctctggcaagagagctgggtagatcagaaacttggtgacacctggctagcacagagcaggctcacttgtcttggtcccactacccagattcctgcagacattgcaaaccaaatgaaggttgttgaatgacccctgtccccagccacttgttttgttatcatctgctctgcagtggaatgcctgtgtgtttgagttcactctgcatctgtatatttgagtatagaaaccgagtcaagtgatcatgtgcatccagacacactgtgtcacctgagccacagagcaaatcaccttaacgatctggaatgaaactgtgaccagtgccgccctgggtggttctggagagactgccgtcttcttgtttggccataggtgctggggccccggcttcagtcactgtctcagacaggagtcccgataagcagatcaccagtcctccactgtccttcctgtcggccttgctgcatgagaagatagctgcttcctccctcttttcctacactgtaattattgttttacaattgagtgccttaataatagtttacaaatactatgtatttatgcaaaactgttaaagtctcatctgttatgattggatacttggtcttgtcagtagtggtcagcattgggttgtgagcttgtcctactccatacgtgtttatcctgctatgcagttttacattgtgtgttcacatctattccaaggagccttgctagaaacaacactggcggttcctgcaggccaggcaggcattggcccatgctgtgtcccataggagccaatgaaagaacgtagcttggtctgctagccagccgtggggtggcgcaggccaggcagcctctgcaccagagtccagcacctgcccattccccagtcacacaatcatactcttctttcatagagattttattaccacctagaccaccctagttttcctctctgttagtgtcctgagctcttttgcaacaaaatgtaggtacagaccaatccctgtcccttccccaatcaggagctccacaccatgagttgtttggttttccagaagctgccagtgggttcccgtgaattgcgttaagatatcgatgattttttttattgtttttcttcttgtttttttaaataatatatttaaaggcagtatcttttgtactgtgaatttgcagtagaagatgcagaatgcactttttttttacttctgttggtgtgtattgtatatagtgtgtgtgcttcttgtgatgaaaataaactttttctttat

SEQ ID NO: 449122 - DNA, 5309 bp, Homo sapiens
aatgaattagagaaacagatgaattgtaacttgaaggaactcaaggaatttatagacaatgagatgctacttatcttgggacagatggacaagccctcccttatcttcgatcatctttatctcggttgattacattttaaatgttaccagagaaatcgataatttttttcctggcttatttgcatatcataacatccgagtctacgatgaagagaccacagacctcctcgcccactggaatgaagcgtatcattttataaacaaagcgaagaggaaccattccaagtgcctggtgcattgcaaaatgggcgtgagtcgctcggcctccacagtcatagcctatgcaatgaaggaattcggctggcctctggaaaaagcatataactatgtaaagcagaagcgcagcatcacgcgccccaacgcgggctttatgaggcagctgtctgagtatgaaggcatcttggatgcaagcaaacagcggcacaacaagctgtggcgtcagcagacagacagcagcctccagcagcctgtggatgaccctgcaggacctggcgacttcttgccagagaccccagatggcaccccggaaagccagctgcccttcttggatgatgccgcccagcccggcttagggccccccctcccctgctgtttccggcgactctcagacccccttctgccttcccctgaggatgaaactggcagcttggtccacctggaggatccggagagggaggctctgttggaggaagctgctccacctgcagaggtgcacaggccggccagacagccccagcaaggttccggactctgtgagaaggatgtgaagaagaaactagagtttgggagtcccaaaggtcggagcggctccttgctgcaggtggaggagacggaaagggaggagggcctgggagcagggaggtgggggcagcttccaacccagctcgatcaaaacctgctcaactcggagaacctaaacaacaacagcaagaggagctgtcccaacggcatggaggatgatgctatatttgggatccttaacaaagtgaagccttcctataaatcctgtgccgactgcatgtaccctacagccagcggggctcctgaggcctccagggagcgatgtgaggaccccaatgctcccgccatctgcacccagccagccttcctaccccacatcacgtcctcccctgtggcccacttggccagcaggtcccgtgttccggagaagccagcctctggcccaaccgaacctcccccgttcctaccaccagcaggctccaggagggcagacaccagtggccctggggctggagctgccctagagccaccagccagccttttggaaccttccagagagaccccaaaagtcctgccaaagtccctccttttgaagaattctcactgtgataagaaccctcccagcacagaagtggtaataaaggaagaatcgtcacccaagaaagatatgaagccagccaaggacctgaggcttctgttcagtaatgaatctgagaagccgacaaccaacagctacctgatgcagcaccaggagtccatcattcagctgcagaaggcaggcttggtccgcaagcacaccaaagagctagagcggctgaagagcgtgcctgcagacccagcacctccctccagggatggccctgccagcaggctggaggccagcatccccgaggagagccaggatccagccgcgctccacgagctgggccccctggttatgcccagccaggccgggagtgatgagaagtcagaggccgcccccgcttcattggaaggaggctcactgaagagcccccctcctttcttctaccgcctggaccacaccagtagtttctcaaaagactttctgaagaccatctgctacacccccacctcctcttccatgagctccaacctgacccggagctccagcagcgatagcatccacagtgtccgtgggaagcccgggctggtgaagcagcggacacaggagattgagacccggctccggctggcgggcctcaccgtctcttccccactgaagcgctcacactctcttgccaagctggggagtctcaccttctcaacggaagacctgtccagtgaggctgacccgtccaccgtcgctgactcccaggacaccactttgagtgaatcttccttcttgcatgagccccagggaaccccgagggacccagctgcaacctccaaaccatcagggaaacccgccccagaaaacttaaagagcccttcgtggatgagcaaaagctgacccgccttttgctgcgtcaggctgggcggatattttcatatgatccctccctcactttcactgtggatttggatcgaccccttacatcttgatttcccttaaacgagtgaagtcatcctaacttttcccctactcttgccatagagaggaggagaagaaactaaccaacatgcagcacaagaaggggagctgtcagtcgtgtggcctgggagaaccaggagccgccggccaggagacacaaaactccgctcccaccgtgtcttcaagaagaaccatgttttaggaagaacgtgcacacataggcgcacacatccagactgttcccttcgcatcctgcagaagagtcctggtggtggcagcctcaccgcggcacacgttctagctcattcttggcctcgcagaaaactctcggatggcaacattaagtcctacctctgttctcgctgcgctttttatttttaaaacacacgaatgaccaaggcttgttccagggaataatgctctgtctgaaagcgtttttccaaaaaaagaatttttcgttttgtgttttggttgggaccccagacgtgtcaagacttttaacccgacagccccaagcactgctgagtaaagtcatcagatgagtagtcccacgctgttgttgagctgactctgtgcccgaatggtggtgcaggcgccctgtcctggttgtgttgttacgtgtttgaccagcacaggggtccggtggggaaaatgtatgggttgttctcagttgttgctaatgctgaagtttaaatctcaaggggaagggcccacctgcattgttgagtgtctgctgctgaaacacatgattgtgtttaggtttgaaattgctcaagtgtctggctcaggtggtggttctgagacacatcgtcctgctgagagcccagatgcttaggtccactagggcccatctagggaagggaaaggagatttcagcggcttccccgaaaggaacgggactgtcgggatgcttcccggatgtctacagttgccccttcctgcagtgagattactgcttcctgtttccctccagctcttcccagcagcagtgagggagtataagagggatctgtagtcgctgcctggctctgtgggcggcccctttaagactcaggtgagctcagccagtcccgctgcgccaggcttgaatcaaaggtgtcagcaagctagatgtcaaaacatttcgagagagaggcagcttgcagaaaagcagaaaggttgaattcaggggtcagcaaactatggcatgtggccccgtgagctaggaatggtttttcctctttaagacagggcctggctctgtcacctaggctggagtacagtagtgcaatcatgactcactgcagcatcaacctccctggctcaagcgatggcttttacctttttaaggagttgtaaaaaaaagaaataatatgtgacagaattcatgtggcccacaaagcctgaggtacttactgtcaggccctttgtagaaaaagttgctgacccctggtttgatttgccacacagggctgctcatggccctgtaggaagaaactgggtaaatgtgaagccctctgcctctctgacacctaaggccagacccttccctcctcccgaccacaagctttgccagccccgcactagcctcacctgtgcaggatggagtaggttgcgtacatgggggaaggcaggtgaacacagttggctgaagctcttccacaattccatcttgccctcagctgggtccgccagattaactcagtgaaaccagaaagccttcaaggaccagctgaattctgaaagtgagtgagtgagccatcatcttaacattggccagaactgtgttccccaaagctattctagaaagcaccccaggagggatctgcaggaacaaggctagttcatattttacctagtgagcacagtttttgcaaaaatcctccctccaggactttgtctccttggagtgatttttaaaaatacatacattactttatagggagctgttttcccactagtgtcaattaaaatcaccttaaaaggtgattatccacttattcctaaacccctgtgggttgttccccctttccctcagccaacaaaagcatagcctcaaaaaatatcaagttcggtatgttttgccaaatcaaatttcatgtggtagatcaatttttgtgtcaaaataatcttttaaatttagtgatgacaggcttttgttggttttttaaccacgtctatgtatgagaatgatatatttttgaaaactttaattttgaaagccataatttttcttatctaaagagttggggggtggggtgtggaatctggagagtacaagttggtctttggcttctggcaaacttacccattccccagtcacacaatcatactcttctttcatagagattttattaccacctagaccaccctagttttcctctctgttagtgtcctgagctcttttgcaacaaaatgtaggtacagaccaatccctgtcccttccccaatcaggagctccacaccatgagttgtttggttttccagaagctgccagtgggttcccgtgaattgcgttaagatatcgatgattttttttattgtttttcttcttgtttttttaaataatatatttaaaggcagtatcttttgtactgtgaatttgcagtagaagatgcagaatgcactttttttttacttctgttggtgtgtattgtatatagtgtgtgtgcttcttgtgatgaaaataaactttttctttataaattcctgatgactgagtttatataaaaggaaactgcttcctcagcccttgccaaaacagtctgatacatcgtcatcatcatcgtcattgacatggccagtctttattgagcatctattacatgctcagttctttgctagaaaacctggacaagttacaccaaagaaaggaccacaggaagaaatgatagttcctcctggaactagtctgttttctttctaattttgtcagtaagcaagaacaggcccacctgtgggtggtcctttgtgtacc

SEQ ID NO: 449123 - DNA, 1320 bp, Homo sapiens
aatgaattagagaaacagatgaattgtaacttgaaggaactcaaggaatttatagacaatgagatgctacttatcttgggacagatggacaagccctcccttatcttcgatcatctttatctcggttgattacattttaaatgttaccagagaaatcgataatttttttcctggcttatttgcatatcataacatccgagtctacgatgaagagaccacagacctcctcgcccactggaatgaagcgtatcattttataaacaaagcgaagaggaaccattccaagtgcctggtgcattgcaaaatgggcgtgagtcgctcggcctccacagtcatagcctatgcaatgaaggaattcggctggcctctggaaaaagcatataactatgtaaagcagaagcgcagcatcacgcgccccaacgcgggctttatgaggcagctgtctgagtatgaaggcatcttggatgcaagcaaacagcggcacaacaagctgtggcgtcagcagacagacagcagcctccagcagcctgtggatgaccctgcaggacctggcgacttcttgccagagaccccagatggcaccccggaaagccagctgcccttcttggatgatgccgcccagcccggcttagggccccccctcccctgctgtttccggcgactctcagacccccttctgccttcccctgaggatgaaactggcagcttggtccacctggaggatccggagagggaggctctgttggaggaagctgctccacctgcagaggtgcacaggccggccagacagccccagcaaggttccggactctgtgagaaggatgtgaagaagaaactagagtttgggagtcccaaaggtcggagcggctccttgctgcaggtggaggagacggaaagggaggagggcctgggagcagggaggtgggggcagcttccaacccagctcgatcaaaacctgctcaactcggagaacctaaacaacaacagcaagaggagctgtcccaacggcatggaggtaggcagagcccggcctgcagggtggcacaccccatcccttccatcccactctaattggcctacctcagcctctgtagtagggactacaggcacccgccaccacacccagctgatttttttctattgtctcctctgggcccccagctcccatctccagggacctgagggttctttcacagggtgattctgctggtgggtacgtagtgcataccttatatagcaaattgagaatctgttgggaataacacatatctctgcacaccatcttcaccccatgtaccttattcataccctgggcagggc

SEQ ID NO: 449124 - DNA, 7255 bp, Homo sapiens
aatgaattagagaaacagatgaattgtaacttgaaggaactcaaggaatttatagacaatgagatgctacttatcttgggacagatggacaagccctcccttatcttcgatcatctttatctcggttgattacattttaaatgttaccagagaaatcgataatttttttcctggcttatttgcatatcataacatccgagtctacgatgaagagaccacagacctcctcgcccactggaatgaagcgtatcattttataaacaaagcgaagaggaaccattccaagtgcctggtgcattgcaaaatgggcgtgagtcgctcggcctccacagtcatagcctatgcaatgaaggaattcggctggcctctggaaaaagcatataactatgtaaagcagaagcgcagcatcacgcgccccaacgcgggctttatgaggcagctgtctgagtatgaaggcatcttggatgcaagcaaacagcggcacaacaagctgtggcgtcagcagacagacagcagcctccagcagcctgtggatgaccctgcaggacctggcgacttcttgccagagaccccagatggcaccccggaaagccagctgcccttcttggatgatgccgcccagcccggcttagggccccccctcccctgctgtttccggcgactctcagacccccttctgccttcccctgaggatgaaactggcagcttggtccacctggaggatccggagagggaggctctgttggaggaagctgctccacctgcagaggtgcacaggccggccagacagccccagcaaggttccggactctgtgagaaggatgtgaagaagaaactagagtttgggagtcccaaaggtcggagcggctccttgctgcaggtggaggagacggaaagggaggagggcctgggagcagggaggtgggggcagcttccaacccagctcgatcaaaacctgctcaactcggagaacctaaacaacaacagcaagaggagctgtcccaacggcatggaggatgatgctatatttgggatccttaacaaagtgaagccttcctataaatcctgtgccgactgcatgtaccctacagccagcggggctcctgaggcctccagggagcgatgtgaggaccccaatgctcccgccatctgcacccagccagccttcctaccccacatcacgtcctcccctgtggcccacttggccagcaggtcccgtgttccggagaagccagcctctggcccaaccgaacctcccccgttcctaccaccagcaggctccaggagggcagacaccagtggccctggggctggagctgccctagagccaccagccagccttttggaaccttccagagagaccccaaaagtcctgccaaagtccctccttttgaagaattctcactgtgataagaaccctcccagcacagaagtggtaataaaggaagaatcgtcacccaagaaagatatgaagccagccaaggacctgaggcttctgttcagtaatgaatctgagaagccgacaaccaacagctacctgatgcagcaccaggagtccatcattcagctgcagaaggcaggcttggtccgcaagcacaccaaagagctagagcggctgaagagcgtgcctgcagacccagcacctccctccagggatggccctgccagcaggctggaggccagcatccccgaggagagccaggatccagccgcgctccacgagctgggccccctggttatgcccagccaggccgggagtgatgagaagtcagaggccgcccccgcttcattggaaggaggctcactgaagagcccccctcctttcttctaccgcctggaccacaccagtagtttctcaaaagactttctgaagaccatctgctacacccccacctcctcttccatgagctccaacctgacccggagctccagcagcgatagcatccacagtgtccgtgggaagcccgggctggtgaagcagcggacacaggagattgagacccggctccggctggcgggcctcaccgtctcttccccactgaagcgctcacactctcttgccaagctggggagtctcaccttctcaacggaagacctgtccagtgaggctgacccgtccaccgtcgctgactcccaggacaccactttgagtgaatcttccttcttgcatgagccccagggaaccccgagggacccagctgcaacctccaaaccatcagggaaacccgccccagaaaacttaaagagcccttcgtggatgagcaaaagctgacccgccttttgctgcgtcaggctgggcggatattttcatatgatccctccctcactttcactgtggatttggatcgaccccttacatcttgatttcccttaaacgagtgaagtcatcctaacttttcccctactcttgccatagagaggaggagaagaaactaaccaacatgcagcacaagaaggggagctgtcagtcgtgtggcctgggagaaccaggagccgccggccaggagacacaaaactccgctcccaccgtgtcttcaagaagaaccatgttttaggaagaacgtgcacacataggcgcacacatccagactgttcccttcgcatcctgcagaagagtcctggtggtggcagcctcaccgcggcacacgttctagctcattcttggcctcgcagaaaactctcggatggcaacattaagtcctacctctgttctcgctgcgctttttatttttaaaacacacgaatgaccaaggcttgttccagggaataatgctctgtctgaaagcgtttttccaaaaaaagaatttttcgttttgtgttttggttgggaccccagacgtgtcaagacttttaacccgacagccccaagcactgctgagtaaagtcatcagatgagtagtcccacgctgttgttgagctgactctgtgcccgaatggtggtgcaggcgccctgtcctggttgtgttgttacgtgtttgaccagcacaggggtccggtggggaaaatgtatgggttgttctcagttgttgctaatgctgaagtttaaatctcaaggggaagggcccacctgcattgttgagtgtctgctgctgaaacacatgattgtgtttaggtttgaaattgctcaagtgtctggctcaggtggtggttctgagacacatcgtcctgctgagagcccagatgcttaggtccactagggcccatctagggaagggaaaggagatttcagcggcttccccgaaaggaacgggactgtcgggatgcttcccggatgtctacagttgccccttcctgcagtgagattactgcttcctgtttccctccagctcttcccagcagcagtgagggagtataagagggatctgtagtcgctgcctggctctgtgggcggcccctttaagactcaggtgagctcagccagtcccgctgcgccaggcttgaatcaaaggtgtcagcaagctagatgtcaaaacatttcgagagagaggcagcttgcagaaaagcagaaaggttgaattcaggggtcagcaaactatggcatgtggccccgtgagctaggaatggtttttcctctttaagacagggcctggctctgtcacctaggctggagtacagtagtgcaatcatgactcactgcagcatcaacctccctggctcaagcgatggcttttacctttttaaggagttgtaaaaaaaagaaataatatgtgacagaattcatgtggcccacaaagcctgaggtacttactgtcaggccctttgtagaaaaagttgctgacccctggtttgatttgccacacagggctgctcatggccctgtaggaagaaactgggtaaatgtgaagccctctgcctctctgacacctaaggccagacccttccctcctcccgaccacaagctttgccagccccgcactagcctcacctgtgcaggatggagtaggttgcgtacatgggggaaggcaggtgaacacagttggctgaagctcttccacaattccatcttgccctcagctgggtccgccagattaactcagtgaaaccagaaagccttcaaggaccagctgaattctgaaagtgagtgagtgagccatcatcttaacattggccagaactgtgttccccaaagctattctagaaagcaccccaggagggatctgcaggaacaaggctagttcatattttacctagtgagcacagtttttgcaaaaatcctccctccaggactttgtctccttggagtgatttttaaaaatacatacattactttatagggagctgttttcccactagtgtcaattaaaatcaccttaaaaggtgattatccacttattcctaaacccctgtgggttgttccccctttccctcagccaacaaaagcatagcctcaaaaaatatcaagttcggtatgttttgccaaatcaaatttcatgtggtagatcaatttttgtgtcaaaataatcttttaaatttagtgatgacaggcttttgttggttttttaaccacgtctatgtatgagaatgatatatttttgaaaactttaattttgaaagccataatttttcttatctaaagagttggggggtggggtgtggaatctggagagtacaagttggtctttggcttctggcaaacttacccattcatttttggaagcacagctagcatatcaacatccagacgagagcgctggtcccgtccacagagcagagtgaagcattctggacttgatgcttaatagcctggcctggagaaaagggtaaggtttatttttggaaacccagatcagttgcatgtaaacagatggcacatggctatttaaaatgctgtatgatggggccgggcgcggtggctcacgcctgtaatcctagcactttgggaggccgaggcaggcggatcatctgaggtcaggagttctagaccagcctggccaacatggtgaaaccccgtctctactaaaaatacaaaaacttagctgggtgtggtagtgcgtgcctgtaatcctagctacttaggaggctgaggcaggagaatcgcttgaacctgggtggcggaggttgcaatgagccgagatcgcgccactgcactccagcctgggtgcaatgaaactgggagtgaaactccgtctcaaaaaaataaaatgctgtatgaacaagatgagcattctgtcaggtgtcgggacacctgggcaaagacgaattcatgctgtctgtgaaaaggaagtttgcactgtaacatatgccatagcttggcccttgctttgtatgcaaccttagctgatggggaaaattccaaacataagtggcacaggaaagaggcaggcagaggaggcaggggtctgtgctgtgcaagtcactggttttttatgactatcattttcattgaatgcatttgttgaattgggacaaaaggaacattttctaaatcagcttgatactctttataaaaaacagctgaatcttatcttctgcctcacattaattcatgtggcatgccaaaagttagactgaacttttctacatcttcaccttgcattgatacaggaaagtcttctctttaagtcttgctaagtataagggggatagtggtcacgggaagaggagaaccggggctgctctcggatggtaattgacaatgccgatttccatttctttgtcttacggctacttccgagccttctagcaaggtccctggttgcatgtatttcctaagagcagagtttatttctctttacattccctgcttccttgctctccatgcagggaccccagccaacctctgggctgttgaatagctctctgctgggtggcaagcccttctccttggcaccctgttgcttaagcatacagattgctcaccaggtgcacacagacagctgtactgtccaagcccattctgctccaccctgtcctcttcagctaaagagcattccagtaatctaaagcccttttcccctggagaagtccagagtttgcagcagtgtggagctgagcttgaacagaacagaccctcagcacggccctggactaatgcactcttatctgagggcagtccattctagaaggttgatgaatttccctaccactctcctggggaccttttctctctagtgggaacaaatgctacataatttagtcaagatcctattaagtcatctcacctgaggcatctggagagggagttgccttccattggtgggaaattgttggtgccagaatacattttgcccaaaactcttctcattggctggccacctagcagggctcctctaaacacgcaactcagcgaggggacccccttcacctctggcaagagagctgggtagatcagaaacttggtgacacctggctagcacagagcaggctcacttgtcttggtcccactacccagattcctgcagacattgcaaaccaaatgaaggttgttgaatgacccctgtccccagccacttgttttgttatcatctgctctgcagtggaatgcctgtgtgtttgagttcactctgcatctgtatatttgagtatagaaaccgagtcaagtgatcatgtgcatccagacacactgtgtcacctgagccacagagcaaatcaccttaacgatctggaatgaaactgtgaccagtgccgccctgggtggttctggagagactgccgtcttcttgtttggccataggtgctggggccccggcttcagtcactgtctcagacaggagtcccgataagcagatcaccagtcctccactgtccttcctgtcggccttgctgcatgagaagatagctgcttcctccctcttttcctacactgtaattattgttttacaattgagtgccttaataatagtttacaaatactatgtatttatgcaaaactgttaaagtctcatctgttatgattggatacttggtcttgtcagtagtggtcagcattgggttgtgagcttgtcctactccatacgtgtttatcctgctatgcagttttacattgtgtgttcacatctattccaaggagccttgctagaaacaacactggcggttcctgcaggccaggcaggcattggcccatgctgtgtcccataggagccaatgaaagaacgtagcttggtctgctagccagccgtggggtggcgcaggccaggcagcctctgcaccagagtccagcacctgcccattccccagtcacacaatcattacagtgtaggaaaagagggaggaagcagctatcttctcatgcagcaaggccgacaggaagtcgagc

SEQ ID NO: 449125 - DNA, 922 bp, Homo sapiens
tggtatggaaaccaaatttttaaaatctggaatcttcaactctgaaaactcgtatcagtgaataggactcagaaagctcaatttgtatgcttttatgagccaaaaagtacgtgggattgtgtcaaagcaggatactgttatttacctcagatgactgaaaccacaccaggacagccaagggcttccagggtgccagggcatcgaagtaccctccacggcattctcttggggatccaacacttacatgtcaccagcagcaagagctgcttcatttcttctattccatttgcttgaccaaatgctgatgcatttctttttcaggtccacgctagtttgattttgttattaatattgttttaaaaaatgcctttttctgcctttggtaaactaaaggtctaacatatattccaacttcttttgacagaggaaaagacaagcatacgaatctaaccttatctgtcatggcctgcagttagaagcaacaagatcagtaagtactggtccctttttcagccctcggctgaccactgttctcgggcagcttcgtgccacttggaatacttgggtgacattggaaacatgcagccctggccacatcttagtcatagactgggagaggagtcaatcaaaatctgcattgtgtaggatgtattctttttttctgatcaaaactagcagatcttttttaatagccaacgaattttacaatgaatgcatgtatgaatgattattttctttctttaagaaacttctaaaagcttttttgttatacaaaaaatagtttatggtaaaaaattagaaaacataagaataaggaaaataatctgtatcttaattatccataaataattttgcagtccttctgagctgttttactcaaaaatatatatgtacacattttttatctttcaaaaaggagaaa

SEQ ID NO: 449126 - DNA, 944 bp, Homo sapiens
cggccgcactgggcatgctcagtctccgggctccgctcggcaggcgagaggcgtcctccggctctgggctccggtcggtgggtgcctcggctcggctttccccggcgctggctgggctcagcggcccctgagcccaagcgacacacgccccgcggtccccgatccggcccctgggagagccgcgccgttctggaacccgggagcccccaacttcgcgccaagttcggagccgccttctgagggagacatgaaaaagatgagcaggaatgttttgctacaaatggaggaggaggaggacgacgacgatggggatatcggaagaatttaatggaaaacctgactccctcttttttaatgatggccagcgaagaattgactttgttctagtatatgaggatgaaagcagaaaagagaccaataaaaagggtacaaatgaaaaacaaaggaggaaaagacaagcatacgaatctaaccttatctgtcatggcctgcagttagaagcaacaagatcagtaagtactggtccctttttcagccctcggctgaccactgttctcgggcagcttcgtgccacttggaatacttgggtgacattggaaacatgcagccctggccacatcttagtcatagactgggagaggagtcaatcaaaatctgcattgtgtaggatgtattctttttttctgatcaaaactagcagatcttttttaatagccaacgaattttacaatgaatgcatgtatgaatgattattttctttctttaagaaacttctaaaagcttttttgttatacaaaaaatagtttatggtaaaaaattagaaaacataagaataaggaaaataatctgtatcttaattatccataaataattttgcagtccttctgagctgttttactcaaaaatatatatgtacacattttttatctttcaaaaaggagaaa

SEQ ID NO: 449127 - DNA, 1024 bp, Homo sapiens
cggccgcactgggcatgctcagtctccgggctccgctcggcaggcgagaggcgtcctccggctctgggctccggtcggtgggtgcctcggctcggctttccccggcgctggctgggctcagcggcccctgagcccaagcgacacacgccccgcggtccccgatccggcccctgggagagccgcgccgttctggaacccgggagcccccaacttcgcgccaagttcggagccgccttctgagggagacatgaaaaagatgagcaggaatgttttgctacaaatggaggaggaggaggacgacgacgatggggatatcgtgttggaaaaccttggacagacaattgtccccgatttgggatcactggaaagtcagcatgattttcgaaccccggagtttgaagaatttaatggaaaacctgactccctcttttttaatgatggccagcgaagaattgactttgttctagtatatgaggatgaaagcagaaaagagaccaataaaaagggtacaaatgaaaaacaaaggaggaaaagacaagcatacgaatctaaccttatctgtcatggcctgcagttagaagcaacaagatcagtaagtactggtccctttttcagccctcggctgaccactgttctcgggcagcttcgtgccacttggaatacttgggtgacattggaaacatgcagccctggccacatcttagtcatagactgggagaggagtcaatcaaaatctgcattgtgtaggatgtattctttttttctgatcaaaactagcagatcttttttaatagccaacgaattttacaatgaatgcatgtatgaatgattattttctttctttaagaaacttctaaaagcttttttgttatacaaaaaatagtttatggtaaaaaattagaaaacataagaataaggaaaataatctgtatcttaattatccataaataattttgcagtccttctgagctgttttactcaaaaatatatatgtacacattttttatctttcaaaaaggagaaa

SEQ ID NO: 449128 - DNA, 472 bp, Homo sapiens
cggccgcactgggcatgctcagtctccgggctccgctcggcaggcgagaggcgtcctccggctctgggctccggtcggtgggtgcctcggctcggctttccccggcgctggctgggctcagcggcccctgagcccaagcgacacacgccccgcggtccccgatccggcccctgggagagccgcgccgttctggaacccgggagcccccaacttcgcgccaagttcggagccgccttctgagggagacatgaaaaagatgagcaggaatgttttgctacaaatggaggaggaggaggacgacgacgatggggatatcggaagaatttaatggaaaacctgactccctcttttttaatgatggccagcgaagaattgactttgttctagtatatgaggatgaaagcagaaaagagaccaataaaaagggtacaaatgaaaaacaaagggtaagtttttatgctattttcctttc

SEQ ID NO: 449129 - DNA, 1087 bp, Homo sapiens
cggccgcactgggcatgctcagtctccgggctccgctcggcaggcgagaggcgtcctccggctctgggctccggtcggtgggtgcctcggctcggctttccccggcgctggctgggctcagcggcccctgagcccaagcgacacacgccccgcggtccccgatccggcccctgggagagccgcgccgttctggaacccgggagcccccaacttcgcgccaagttcggagccgccttctgagggagacatgaaaaagatgagcaggaatgttttgctacaaatggaggaggaggaggacgacgacgatggggatatcggtgatgttcctgcctccaggaggccttttctgactcctcatactcacctcccatccagcctggtgttggaaaaccttggacagacaattgtccccgatttgggatcactggaaagtcagcatgattttcgaaccccggagtttgaagaatttaatggaaaacctgactccctcttttttaatgatggccagcgaagaattgactttgttctagtatatgaggatgaaagcagaaaagagaccaataaaaagggtacaaatgaaaaacaaaggaggaaaagacaagcatacgaatctaaccttatctgtcatggcctgcagttagaagcaacaagatcagtaagtactggtccctttttcagccctcggctgaccactgttctcgggcagcttcgtgccacttggaatacttgggtgacattggaaacatgcagccctggccacatcttagtcatagactgggagaggagtcaatcaaaatctgcattgtgtaggatgtattctttttttctgatcaaaactagcagatcttttttaatagccaacgaattttacaatgaatgcatgtatgaatgattattttctttctttaagaaacttctaaaagcttttttgttatacaaaaaatagtttatggtaaaaaattagaaaacataagaataaggaaaataatctgtatcttaattatccataaataattttgcagtccttctgagctgttttactcaaaaatatatatgtacacattttttatctttcaaaaaggagaaa

SEQ ID NO: 449130 - DNA, 871 bp, Homo sapiens
cgagcaggcaccctcatctcggcgtctgaggacagaggctttaaggtctgggaccattgtacaggatcattaatatacagttcatctgtgttatcagcatatcctcttctcagtttattcattgatgcagaaagcaggcagctggtcaccgggtgtgctgacggccaggtgagacagccacagagttaagttccagttcccagacatgcctgaacgtgagcttgtacacaaaggtctttgtcttcatgctactttgtattttcctgcgatttgaaaaaacctgtccacctcagtgctgagaacgtgaccttctgtgggtctcagcgtcactgtgggttcaatatggtcctgggccccctggtctgcggaggagctgggtctgcatgtcccagagctccatgcgtggttctggagtgcagcaaaagtgagggccactcacgtgaccctgaaaacctgctgagaagagggctgtgagcagacgtcccccgctcccacgggtgctgcccgcgccccggagaggcgccctggacggctcctgtgtggcatcccccgtgcccgcacgctgcccgcgccccggagaggcgccctggacggctcctgtgtggcatcccccgtgcccgcacgctgcccgcgccccggagaggcgccctggacggctcctgtgtggcatcccccgtgcccgcacgctgcccgcgccccggagaggcgccctggacggctcctgtgtggcatcccccgtggctttgtggtccctttctgtctctttcccctgtttggaaacctgaggatttggccttttcaaacttcttagctgggtctccttggtggttgggaccatttgttgtggcgggtggccagaaaaacgagattc

SEQ ID NO: 449131 - DNA, 2524 bp, Homo sapiens
tgggcctttctgttttggaggagtaaagcacgtttgctgtcagataaaatgcctgagtacccagggaagttgagccttctgctctctgtagaaacacatcccagaaccagcggtgttggtagggccaggactgccctgtccatccagcgtgacttgggcgtgcgccacacctggcctcatggtcaggtcctgagcacgtgtgcagctcgtgaatgccagggtccttgcgttcttccctcagatggctttctgttggtaaatgaagctggcacacggccacacagctacagcattgatggtgcaggcgtccgtccgcggagcacggcataaggagcggtctgtgacgccccagcacctctcccgtgcagcccctgtgcttgtcctcctggcatcttagggcactggtttcctgcattcgctttgctccccttgtgcacgttctgtcttcccagaagaagagagttagggaattaaaaggagagcgttcttccatgcgcatatcctcttctcagtttattcattgatgcagaaagcaggcagctggtcaccgggtgtgctgacggccaggtgagacagccacagagttaagttccagttcccagacatgcctgaacgtgagcttgtacacaaaggtctttgtcttcatgctactttgtattttcctgcgatttgaaaaaacctgtccacctcagtgctgagaacgtgaccttctgtgggtctcagcgtcactgtgggttcaatatggtcctgggccccctggtctgcggaggagctgggtctgcatgtcccagagctccatgcgtggttctggagtgcagcaaaagtgagggccactcacgtgaccctgaaaacctgctgagaagagggctgtgagcagacgtcccccgctcccacgggtgctgcccgcgccccggagaggcgccctggacggctcctgtgtggcatcccccgtgcccgcacgctgcccgcgccccggagaggcgccctggacggctcctgtgtggcatcccccgtgcccgcacgctgcccgcgccccggagaggcgccctggacggctcctgtgtggcatcccccgtgcccgcacgctgcccgcgccccggagaggcgccctggacggctcctgtgtggcatcccccgtgcccgcacgctgcccgcgccccggagaggcgccctggacggctcctgtgtggcatcccccgtgcttcttgtgctcccctttcctgtcatctttacacactgttgaaaaacctgaagatgttggcctttttcaaaacattttttagggcatgtgggacgtgctcttggctgtgaagctgtggggtgtgtgcagagagcctggggcctggggttcccagaggagcatcttggggaggcctgcacagtaggatcctgcccatgtgccctgagctgatgtgccagccgtgtgaaagtgctctgacaccgtgggccgtacggagggcctccagaggggatgttgaaggcaggagacagctgtgccgggagcctctgcaggccgtggagggcccgtcctgtgacgtgtctgccctccctgctccacctctggtgttgctgcttctgcgtcaggacccttgctgcagcgccatgtctgcatcttctttgcttttgtagctttggatcttcagtttgatggatggacaccattatcgtcgtgtggcacgggttgacctaaggaagaagacagagactttctccacaagaagggttaagtctgggctgtgcaaagaaagccagcttccctctacaagtgctctgggaaaaggagagcaggttgaagtaacatttcctgtactgagacttgcaccctgtgatctctcactcatcccaaattctgcatgtggatgtctttcttctgagaacacccgatgtgtgtggatcggaagctcagtgggcttattcgtatttaacctggcaaacctggaagtggaagctgctttgtattacaaggatttccagagcctcagcatcctgctggccggatcgtgtgccctgaggaaccgcactgcggatcaaaaggtgctgtgcttgctggcctccctctttggcgggaagattgccgtgttggagatcaacccggccgcgctagtcagggctcagcagtgccccagcatggggcagagcctctcggtgccagccagctcctgtgtcctaccgacctctccactgtatctgggaattgccaaggagaagagtaccaaggctgctagtgaacagcgacgtgcaacgtgcccaagactgaccgctgttcctctggtgcctgttgcagtgggggtgcagagtggaccttcagcaattactgattgtgagaacatttttttccccttttttctctgctgaggaatttgaaagcagatcccgagcgtgtgattgtactcctgcacacttgagtgtgcatttctggaacatgtatgtttttacctagccaccatgacgttatatcaaaaccagtcattttttggaaccttgtattagcaaggccataataaattattcttgattgccttga

SEQ ID NO: 449132 - DNA, 2643 bp, Homo sapiens
atgatacacttgatctttgatttcatttatagtttaattaggatatgtagtatttttcaatattcatttatctaatgctcctaaattactgacagtttagagtaagttttaaatgaaatgacatcctaggcaacaatttttttttaaggaaacaagacatccatttacttgctgttttcatcactaagtccataattttattatttctggctgactcaggaatccttctgctccaagtgcaacgtcgattaaacggcagtgctgccctccctctaggctataaagcagccggagctgggccgtggtttaagcccaccaggccttctgtcgggaggtgggatgggattcctcgggacccatctgtggtggactcaccgggcagccttttggggtgatgtccccagccttcattgtgtttatggggttttcaacatttgtattcatgtgcaagttttactttttggtgaagaaattattttggaatagttcaaacttgactaacagaaatactgtaagtaaatattacgtgtaaagagataagtaaaactgacagttctcgggttaattggtaccaggcacttacaaagctaaattttccgatgttcctttcaccagcatatcctcttctcagtttattcattgatgcagaaagcaggcagctggtcaccgggtgtgctgacggccaggtgagacagccacagagttaagttccagttcccagacatgcctgaacgtgagcttgtacacaaaggtctttgtcttcatgctactttgtattttcctgcgatttgaaaaaacctgtccacctcagtgctgagaacgtgaccttctgtgggtctcagcgtcactgtgggttcaatatggtcctgggccccctggtctgcggaggagctgggtctgcatgtcccagagctccatgcgtggttctggagtgcagcaaaagtgagggccactcacgtgaccctgaaaacctgctgagaagagggctgtgagcagacgtcccccgctcccacgggtgctgcccgcgccccggagaggcgccctggacggctcctgtgtggcatcccccgtgcccgcacgctgcccgcgccccggagaggcgccctggacggctcctgtgtggcatcccccgtgcccgcacgctgcccgcgccccggagaggcgccctggacggctcctgtgtggcatcccccgtgcccgcacgctgcccgcgccccggagaggcgccctggacggctcctgtgtggcatcccccgtgcccgcacgctgcccgcgccccggagaggcgccctggacggctcctgtgtggcatcccccgtgcttcttgtgctcccctttcctgtcatctttacacactgttgaaaaacctgaagatgttggcctttttcaaaacattttttagggcatgtgggacgtgctcttggctgtgaagctgtggggtgtgtgcagagagcctggggcctggggttcccagaggagcatcttggggaggcctgcacagtaggatcctgcccatgtgccctgagctgatgtgccagccgtgtgaaagtgctctgacaccgtgggccgtacggagggcctccagaggggatgttgaaggcaggagacagctgtgccgggagcctctgcaggccgtggagggcccgtcctgtgacgtgtctgccctccctgctccacctctggtgttgctgcttctgcgtcaggacccttgctgcagcgccatgtctgcatcttctttgcttttgtagctttggatcttcagtttgatggatggacaccattatcgtcgtgtggcacgggttgacctaaggaagaagacagagactttctccacaagaagggttaagtctgggctgtgcaaagaaagccagcttccctctacaagtgctctgggaaaaggagagcaggttgaagtaacatttcctgtactgagacttgcaccctgtgatctctcactcatcccaaattctgcatgtggatgtctttcttctgagaacacccgatgtgtgtggatcggaagctcagtgggcttattcgtatttaacctggcaaacctggaagtggaagctgctttgtattacaaggatttccagagcctcagcatcctgctggccggatcgtgtgccctgaggaaccgcactgcggatcaaaaggtgctgtgcttgctggcctccctctttggcgggaagattgccgtgttggagatcaacccggccgcgctagtcagggctcagcagtgccccagcatggggcagagcctctcggtgccagccagctcctgtgtcctaccgacctctccactgtatctgggaattgccaaggagaagagtaccaaggctgctagtgaacagcgacgtgcaacgtgcccaagactgaccgctgttcctctggtgcctgttgcagtgggggtgcagagtggaccttcagcaattactgattgtgagaacatttttttccccttttttctctgctgaggaatttgaaagcagatcccgagcgtgtgattgtactcctgcacacttgagtgtgcatttctggaacatgtatgtttttacctagccaccatgacgttatatcaaaaccagtcattttttggaaccttgtattagcaaggccataataaattattcttgattgccttga

SEQ ID NO: 449133 - DNA, 944 bp, Homo sapiens
tctcctgcgcatcgcagatgccacctgcacccgcccagcaccctcgtactcacctggtctcctgcgcattgcagatgccacatgcacccacccagcaaccttgtcctcacctggtctctggctgtccagagttgcttcctgttgacgacagctctcctcagaagaaagccagcttccctctacaagtgctctgggaaaaggagagcaggttgaagtaacatttcctgtactgagacttgcaccctgtgatctctcactcatcccaaattctgcatgtggatgtctttcttctgagaacacccgatgtgtgtggatcggaagctcagtgggcttattcgtatttaacctggcaaacctggaagtggaagctgctttgtattacaaggatttccagagcctcagcatcctgctggccggatcgtgtgccctgaggaaccgcactgcggatcaaaaggtgctgtgcttgctggcctccctctttggcgggaagattgccgtgttggagatcaacccggccgcgctagtcagggctcagcagtgccccagcatggggcagagcctctcggtgccagccagctcctgtgtcctaccgacctctccactgtatctgggaattgccaaggagaagagtaccaaggctgctagtgaacagcgacgtgcaacgtgcccaagactgaccgctgttcctctggtgcctgttgcagtgggggtgcagagtggaccttcagcaattactgattgtgagaacatttttttccccttttttctctgctgaggaatttgaaagcagatcccgagcgtgtgattgtactcctgcacacttgagtgtgcatttctggaacatgtatgtttttacctagccaccatgacgttatatcaaaaccagtcattttttggaaccttgtattagcaaggccataataaattattcttgattgccttga

SEQ ID NO: 449134 - DNA, 2618 bp, Homo sapiens
tgggcctttctgttttggaggagtaaagcacgtttgctgtcagataaaatgcctgagtacccagggaagttgagccttctgctctctgtagaaacacatcccagaaccagcggtgttggtagggccaggactgccctgtccatccagcgtgacttgggcgtgcgccacacctggcctcatggtcaggtcctgagcacgtgtgcagctcgtgaatgccagggtccttgcgttcttccctcagatggctttctgttggtaaatgaagctggcacacggccacacagctacagcattgatggtgcaggcgtccgtccgcggagcacggcataaggagcggtctgtgacgccccagcacctctcccgtgcagcccctgtgcttgtcctcctggcatcttagggcactggtttcctgcattcgctttgctccccttgtgcacgttctgtcttcccagaagaagagagttagggaattaaaaggagagcgttcttccatgcgcatatcctcttctcagtttattcattgatgcagaaagcaggcagctggtcaccgggtgtgctgacggccaggtgagacagccacagagttaagttccagttcccagacatgcctgaacgtgagcttgtacacaaaggtctttgtcttcatgctactttgtattttcctgcgatttgaaaaaacctgtccacctcagtgctgagaacgtgaccttctgtgggtctcagcgtcactgtgggttcaatatggtcctgggccccctggtctgcggaggagctgggtctgcatgtcccagagctccatgcgtggttctggagtgcagcaaaagtgagggccactcacgtgaccctgaaaacctgctgagaagagggctgtgagcagacgtcccccgctcccacgggtgctgcccgcgccccggagaggcgccctggacggctcctgtgtggcatcccccgtgcccgcacgctgcccgcgccccggagaggcgccctggacggctcctgtgtggcatcccccgtgcccgcacgctgcccgcgccccggagaggcgccctggacggctcctgtgtggcatcccccgtgcccgcacgctgcccgcgccccggagaggcgccctggacggctcctgtgtggcatcccccgtgcccgcacgctgcccgcgccccggagaggcgccctggacggctcctgtgtggcatcccccgtgcttcttgtgctcccctttcctgtcatctttacacactgttgaaaaacctgaagatgttggcctttttcaaaacattttttagggcatgtgggacgtgctcttggctgtgaagctgtggggtgtgtgcagagagcctggggcctggggttcccagaggagcatcttggggaggcctgcacagtaggatcctgcccatgtgccctgagctgatgtgccagccgtgtgaaagtgctctgacaccgtgggccgtacggagggcctccagaggggatgttgaaggcaggagacagctgtgccgggagcctctgcaggccgtggagggcccgtcctgtgacgtgtctgccctccctgctccacctctggtgttgctgcttctgcgtcaggacccttgctgcagcgccatgtctgcatcttctttgcttttgtagctttggatcttcagtttgatggatggacaccattatcgtcgtgtggcacgggttgacctaaggaagaagacagagactttctccacaagaagggttaagtctgggctgtgcaaagaaagccagcttccctctacaagtgctctgggaaaaggagagcaggttgaagtaacatttcctgtactgagacttgcaccctgtgatctctcactcatcccaaattctgcatgtggatgtctttcttctgagaacacccgatgtgtgtggatcggaagctcagtgggcttattcgtatttaacctggcaaacctggaagtggaagctgctttgtattacaaggatttccagagcctcagcatcctgctggccggatcgtgtgccctgaggaaccgcactgcggatcaaaaggtgctgtgcttgctggcctccctctttggcgggaagattgccgtgttggagatcaacccggccgcgctagtcagggctcagcagtgccccagcatggggcagagcctctcggtgccagccagctcctgtgtcctaccgacctctccactgtatctgggaattgccaaggagaagagtaccaaggctgctagtgaacagcgacgtgctgcacggaacgtcatgaaggaccaacgcctggttttccatagtaaagttaggtcatctggttatgcgtcagcaccacatgtaactatgttttcaccaaagaccaacatcaagagtgaggggaaaggatcttcaaggagcaggagcacgtgcgcacgggaggcataccccgtggagtgcgctgtgcccaccaagcccggcccccaggtcgtgccgcccccacctgcacacgtgtatgctgcatccagtactcaggtgcgccacgtcctgcgggagctgggtagcatttcattgtaagagtctttgattctgcccactgtaaacatttttctattgtatcataattgtaaatatatttttaaaaaccttggttacttgaa

SEQ ID NO: 449135 - DNA, 1315 bp, Homo sapiens
atgatacacttgatctttgatttcatttatagtttaattaggatatgtagtatttttcaatattcatttatctaatgctcctaaattactgacagtttagagtaagttttaaatgaaatgacatcctaggcaacaatttttttttaaggaaacaagacatccatttacttgctgttttcatcactaagtccataattttattatttctggctgactcaggaatccttctgctccaagtgcaacgtcgattaaacggcagtgctgccctccctctaggctataaagcagccggagctgggccgtggtttaagcccaccaggccttctgtcgggaggtgggatgggattcctcgggacccatctgtggtggactcaccgggcagccttttggggtgatgtccccagccttcattgtgtttatggggttttcaacatttgtattcatgtgcaagttttactttttggtgaagaaattattttggaatagttcaaacttgactaacagaaatactgtaagtaaatattacgtgtaaagagataagtaaaactgacagttctcgggttaattggtaccaggcacttacaaagctaaattttccgatgttcctttcaccagcatatcctcttctcagtttattcattgatgcagaaagcaggcagctggtctcctgcgcattgcagatgccacatgcacccacccagcaaccttgtcctcacctggtctctggctgtccagagttgcttcctgttgacgacagctctcctcagaagagtaccaaggctgctagtgaacagcgacgtggtcagtacagggtgctgtgagatctaagaatacaaggctgatgcgttctcattgtggttagggctgctgcattgctttgcgaattcttatgttaaaatatgcattccgtacttccttccatccttctgtccttcatgtctctgcctctcgtgcgtgttccatgtccgctgtggtggggaacttgctgggtgcttcgcctcctgaattggccatcactcatgggattcagcaacgtgcccaagactgaccgctgttcctctggtgcctgttgcagtgggggtgcagagtggaccttcagcaattactgattgtgagaacatttttttccccttttttctctgctgaggaatttgaaagcagatcccgagcgtgtgattgtactcctgcacacttgagtgtgcatttctggaacatgtatgtttttacctagccaccatgacgttatatcaaaaccagtcattttttggaaccttgtattagcaaggccataataaattattcttgattgccttga

SEQ ID NO: 449136 - DNA, 2539 bp, Homo sapiens
tgggcctttctgttttggaggagtaaagcacgtttgctgtcagataaaatgcctgagtacccagggaagttgagccttctgctctctgtagaaacacatcccagaaccagcggtgttggtagggccaggactgccctgtccatccagcgtgacttgggcgtgcgccacacctggcctcatggtcaggtcctgagcacgtgtgcagctcgtgaatgccagggtccttgcgttcttccctcagatggctttctgttggtaaatgaagctggcacacggccacacagctacagcattgatggtgcaggcgtccgtccgcggagcacggcataaggagcggtctgtgacgccccagcacctctcccgtgcagcccctgtgcttgtcctcctggcatcttagggcactggtttcctgcattcgctttgctccccttgtgcacgttctgtcttcccagaagaagagagttagggaattaaaaggagagcgttcttccatgcgcatatcctcttctcagtttattcattgatgcagaaagcaggcagctggtcaccgggtgtgctgacggccaggtgagacagccacagagttaagttccagttcccagacatgcctgaacgtgagcttgtacacaaaggtctttgtcttcatgctactttgtattttcctgcgatttgaaaaaacctgtccacctcagtgctgagaacgtgaccttctgtgggtctcagcgtcactgtgggttcaatatggtcctgggccccctggtctgcggaggagctgggtctgcatgtcccagagctccatgcgtggttctggagtgcagcaaaagtgagggccactcacgtgaccctgaaaacctgctgagaagagggctgtgagcagacgtcccccgctcccacgggtgctgcccgcgccccggagaggcgccctggacggctcctgtgtggcatcccccgtgcccgcacgctgcccgcgccccggagaggcgccctggacggctcctgtgtggcatcccccgtgcccgcacgctgcccgcgccccggagaggcgccctggacggctcctgtgtggcatcccccgtgcccgcacgctgcccgcgccccggagaggcgccctggacggctcctgtgtggcatcccccgtgcccgcacgctgcccgcgccccggagaggcgccctggacggctcctgtgtggcatcccccgtgcttcttgtgctcccctttcctgtcatctttacacactgttgaaaaacctgaagatgttggcctttttcaaaacattttttagggcatgtgggacgtgctcttggctgtgaagctgtggggtgtgtgcagagagcctggggcctggggttcccagaggagcatcttggggaggcctgcacagtaggatcctgcccatgtgccctgagctgatgtgccagccgtgtgaaagtgctctgacaccgtgggccgtacggagggcctccagaggggatgttgaaggcaggagacagctgtgccgggagcctctgcaggccgtggagggcccgtcctgtgacgtgtctgccctccctgctccacctctggtgttgctgcttctgcgtcaggacccttgctgcagcgccatgtctgcatcttctttgcttttgtagctttggatcttcagtttgatggatggacaccattatcgtcgtgtggcacgggttgacctaaggaagaagacagagactttctccacaagaagggttaagtctgggctgtgcaaagaaagccagcttccctctacaagtgctctgggaaaaggagagcaggttgaagtaacatttcctgtactgagacttgcaccctgtgatctctcactcatcccaaattctgcatgtggatgtctttcttctgagaacacccgatgtgtgtggatcggaagctcagtgggcttattcgtatttaacctggcaaacctggaagtggaagctgctttgtattacaaggatttccagagcctcagcatcctgctggccggatcgtgtgccctgaggaaccgcactgcggatcaaaaggtgctgtgcttgctggcctccctctttggcgggaagattgccgtgttggagatcaacccggccgcgctagtcagggctcagcagtgccccagcatggggcagagcctctcggtgccagccagctcctgtgtcctaccgacctctccactgtatctgggaattgccaaggagaagagtaccaaggctgctagtgaacagcgacgtgtgtaactatgttttcaccaaagaccaacatcaagagtgaggggaaaggatcttcaaggagcaggagcacgtgcgcacgggaggcataccccgtggagtgcgctgtgcccaccaagcccggcccccaggtcgtgccgcccccacctgcacacgtgtatgctgcatccagtactcaggtgcgccacgtcctgcgggagctgggtagcatttcattgtaagagtctttgattctgcccactgtaaacatttttctattgtatcataattgtaaatatatttttaaaaaccttggttacttgaa

SEQ ID NO: 449137 - DNA, 339 bp, Homo sapiens
aaaaaaaaaaagaaaactcggagctctgccaatgctatttggaagaaggtttttcgtgctgttgcttctatcttgttgaaaacgaaatagttgatagtttattttaattgaaacactatttcataatagaatgtacattataaaacagcgcttttattaagaatatttttttcctacaaggataagaatacacttgacagttttcattttcagatactgttatgtccacagctgcaggaatcagtcatttggaactgtctttaaagtgtgtgtcactgaggcatttccatcgtatcgtcgtttgcgctcctagtttcatggggcttgtttctgtttcag

SEQ ID NO: 449138 - DNA, 420 bp, Homo sapiens
atgtaagtctatttaaaagagttatttcctgattttgaatataagagtctaaatatagacatatagataaatattcaagtttactggaatacgattatacatgtagatggggggaagcccacttcgtttcttgcttatgttttacttctaatctcactgtgaatgtctcccgatcaccgttacctgtggccttccctcagggaggcataccccgtggagtgcgctgtgcccaccaagcccggcccccaggtcgtgccgcccccacctgcacacgtgtatgctgcatccagtactcaggtgcgccacgtcctgcgggagctgggtagcatttcattgtaagagtctttgattctgcccactgtaaacatttttctattgtatcataattgtaaatatatttttaaaaaccttggttacttg

SEQ ID NO: 449139 - DNA, 344 bp, Homo sapiens
gtactgttagcttcacctgttgcaataatggcaacgttgttacctcttctaaagaatcctgtgtttatccaaaggtctgggaccattgtacaggatcattaatatacagttcatctgtgttatcaggtaaatttaaaactttcatgttttctgtaaataggttgtgtgtaacccactttttctagagcatattacagggcataagatggagctgggacattcgagtggatctgaatgaggcaatctcagacttacagcccttcactcccgtccacacagggagaggattcacttaacagtgaatgtccttgatgtttttcacttaaaattaaatggatgcttgg

SEQ ID NO: 449140 - DNA, 557 bp, Homo sapiens
tgggcctttctgttttggaggagtaaagcacgtttgctgtcagataaaatgcctgagtacccagggaagttgagccttctgctctctgtagaaacacatcccagaaccagcggtgttggtagggccaggactgccctgtccatccagcgtgacttgggcgtgcgccacacctggcctcatggtcaggtcctgagcacgtgtgcagctcgtgaatgccagggtccttgcgttcttccctcagatggctttctgttggtaaatgaagctggcacacggccacacagctacagcattgatggtgcaggcgtccgtccgcggagcacggcataaggagcggtctgtgacgccccagcacctctcccgtgcagcccctgtgcttgtcctcctggcatcttagggcactggtttcctgcattcgctttgctccccttgtgcacgttctgtcttcccagaagaagagagttagggaattaaaaggagagcgttcttccatgcggtaagtgacatgaaaatgccacttaaagcatatacagatactttggtgacctggtagagtt

SEQ ID NO: 449141 - DNA, 1462 bp, Homo sapiens
tgggcctttctgttttggaggagtaaagcacgtttgctgtcagataaaatgcctgagtacccagggaagttgagccttctgctctctgtagaaacacatcccagaaccagcggtgttggtagggccaggactgccctgtccatccagcgtgacttgggcgtgcgccacacctggcctcatggtcaggtcctgagcacgtgtgcagctcgtgaatgccagggtccttgcgttcttccctcagatggctttctgttggtaaatgaagctggcacacggccacacagctacagcattgatggtgcaggcgtccgtccgcggagcacggcataaggagcggtctgtgacgccccagcacctctcccgtgcagcccctgtgcttgtcctcctggcatcttagggcactggtttcctgcattcgctttgctccccttgtgcacgttctgtcttcccagaagaagagagttagggaattaaaaggagagcgttcttccatgcgcatatcctcttctcagtttattcattgatgcagaaagcaggcagctggtcaccgggtgtgctgacggccagctttggatcttcagtttgatggatggacaccattatcgtcgtgtggcacgggttgacctaaggaagaagacagagactttctccacaagaagggttaagtctgggctgtgcaaagaaagccagcttccctctacaagtgctctgggaaaaggagagcaggttgaagtaacatttcctgtactgagacttgcaccctgtgatctctcactcatcccaaattctgcatgtggatgtctttcttctgagaacacccgatgtgtgtggatcggaagctcagtgggcttattcgtatttaacctggcaaacctggaagtggaagctgctttgtattacaaggatttccagagcctcagcatcctgctggccggatcgtgtgccctgaggaaccgcactgcggatcaaaaggtgctgtgcttgctggcctccctctttggcgggaagattgccgtgttggagatcaacccggccgcgctagtcagggctcagcagtgccccagcatggggcagagcctctcggtgccagccagctcctgtgtcctaccgacctctccactgtatctgggaattgccaaggagaagagtaccaaggctgctagtgaacagcgacgtgcaacgtgcccaagactgaccgctgttcctctggtgcctgttgcagtgggggtgcagagtggaccttcagcaattactgattgtgagaacatttttttccccttttttctctgctgaggaatttgaaagcagatcccgagcgtgtgattgtactcctgcacacttgagtgtgcatttctggaacatgtatgtttttacctagccaccatgacgttatatcaaaaccagtcattttttggaaccttgtattagcaaggccataataaattattcttgattgccttga

SEQ ID NO: 449142 - DNA, 2753 bp, Homo sapiens
tgggcctttctgttttggaggagtaaagcacgtttgctgtcagataaaatgcctgagtacccagggaagttgagccttctgctctctgtagaaacacatcccagaaccagcggtgttggtagggccaggactgccctgtccatccagcgtgacttgggcgtgcgccacacctggcctcatggtcaggtcctgagcacgtgtgcagctcgtgaatgccagggtccttgcgttcttccctcagatggctttctgttggtaaatgaagctggcacacggccacacagctacagcattgatggtgcaggcgtccgtccgcggagcacggcataaggagcggtctgtgacgccccagcacctctcccgtgcagcccctgtgcttgtcctcctggcatcttagggcactggtttcctgcattcgctttgctccccttgtgcacgttctgtcttcccagaagaagagagttagggaattaaaaggagagcgttcttccatgcgcatatcctcttctcagtttattcattgatgcagaaagcaggcagctggtcaccgggtgtgctgacggccaggtgagacagccacagagttaagttccagttcccagacatgcctgaacgtgagcttgtacacaaaggtctttgtcttcatgctactttgtattttcctgcgatttgaaaaaacctgtccacctcagtgctgagaacgtgaccttctgtgggtctcagcgtcactgtgggttcaatatggtcctgggccccctggtctgcggaggagctgggtctgcatgtcccagagctccatgcgtggttctggagtgcagcaaaagtgagggccactcacgtgaccctgaaaacctgctgagaagagggctgtgagcagacgtcccccgctcccacgggtgctgcccgcgccccggagaggcgccctggacggctcctgtgtggcatcccccgtgcccgcacgctgcccgcgccccggagaggcgccctggacggctcctgtgtggcatcccccgtgcccgcacgctgcccgcgccccggagaggcgccctggacggctcctgtgtggcatcccccgtgcccgcacgctgcccgcgccccggagaggcgccctggacggctcctgtgtggcatcccccgtgcccgcacgctgcccgcgccccggagaggcgccctggacggctcctgtgtggcatcccccgtgcttcttgtgctcccctttcctgtcatctttacacactgttgaaaaacctgaagatgttggcctttttcaaaacattttttagggcatgtgggacgtgctcttggctgtgaagctgtggggtgtgtgcagagagcctggggcctggggttcccagaggagcatcttggggaggcctgcacagtaggatcctgcccatgtgccctgagctgatgtgccagccgtgtgaaagtgctctgacaccgtgggccgtacggagggcctccagaggggatgttgaaggcaggagacagctgtgccgggagcctctgcaggccgtggagggcccgtcctgtgacgtgtctgccctccctgctccacctctggtgttgctgcttctgcgtcaggacccttgctgcagcgccatgtctgcatcttctttgcttttgtagctttggatcttcagtttgatggatggacaccattatcgtcgtgtggcacgggttgacctaaggaagaagacagagactttctccacaagaagggttaagtctgggctgtgcaaagaaagccagcttccctctacaagtgctctgggaaaaggagagcaggttgaagtaacatttcctgtactgagacttgcaccctgtgatctctcactcatcccaaattctgcatgtggatgtctttcttctgagaacacccgatgtgtgtggatcggaagctcagtgggcttattcgtatttaacctggcaaacctggaagtggaagctgctttgtattacaaggatttccagagcctcagcatcctgctggccggatcgtgtgccctgaggaaccgcactgcggatcaaaaggtgctgtgcttgctggcctccctctttggcgggaagattgccgtgttggagatcaacccggccgcgctagtcagggctcagcagtgccccagcatggggcagagcctctcggtgccagccagctcctgtgtcctaccgacctctccactgtatctgggaattgccaaggagaagagtaccaaggctgctagtgaacagcgacgtggtcagtacagggtgctgtgagatctaagaatacaaggctgatgcgttctcattgtggttagggctgctgcattgctttgcgaattcttatgttaaaatatgcattccgtacttccttccatccttctgtccttcatgtctctgcctctcgtgcgtgttccatgtccgctgtggtggggaacttgctgggtgcttcgcctcctgaattggccatcactcatgggattcagcaacgtgcccaagactgaccgctgttcctctggtgcctgttgcagtgggggtgcagagtggaccttcagcaattactgattgtgagaacatttttttccccttttttctctgctgaggaatttgaaagcagatcccgagcgtgtgattgtactcctgcacacttgagtgtgcatttctggaacatgtatgtttttacctagccaccatgacgttatatcaaaaccagtcattttttggaaccttgtattagcaaggccataataaattattcttgattgccttga

SEQ ID NO: 449143 - DNA, 2574 bp, Homo sapiens
tgggcctttctgttttggaggagtaaagcacgtttgctgtcagataaaatgcctgagtacccagggaagttgagccttctgctctctgtagaaacacatcccagaaccagcggtgttggtagggccaggactgccctgtccatccagcgtgacttgggcgtgcgccacacctggcctcatggtcaggtcctgagcacgtgtgcagctcgtgaatgccagggtccttgcgttcttccctcagatggctttctgttggtaaatgaagctggcacacggccacacagctacagcattgatggtgcaggcgtccgtccgcggagcacggcataaggagcggtctgtgacgccccagcacctctcccgtgcagcccctgtgcttgtcctcctggcatcttagggcactggtttcctgcattcgctttgctccccttgtgcacgttctgtcttcccagaagaagagagttagggaattaaaaggagagcgttcttccatgcgcatatcctcttctcagtttattcattgatgcagaaagcaggcagctggtcaccgggtgtgctgacggccaggtgagacagccacagagttaagttccagttcccagacatgcctgaacgtgagcttgtacacaaaggtctttgtcttcatgctactttgtattttcctgcgatttgaaaaaacctgtccacctcagtgctgagaacgtgaccttctgtgggtctcagcgtcactgtgggttcaatatggtcctgggccccctggtctgcggaggagctgggtctgcatgtcccagagctccatgcgtggttctggagtgcagcaaaagtgagggccactcacgtgaccctgaaaacctgctgagaagagggctgtgagcagacgtcccccgctcccacgggtgctgcccgcgccccggagaggcgccctggacggctcctgtgtggcatcccccgtgcccgcacgctgcccgcgccccggagaggcgccctggacggctcctgtgtggcatcccccgtgcccgcacgctgcccgcgccccggagaggcgccctggacggctcctgtgtggcatcccccgtgcccgcacgctgcccgcgccccggagaggcgccctggacggctcctgtgtggcatcccccgtgcccgcacgctgcccgcgccccggagaggcgccctggacggctcctgtgtggcatcccccgtgcttcttgtgctcccctttcctgtcatctttacacactgttgaaaaacctgaagatgttggcctttttcaaaacattttttagggcatgtgggacgtgctcttggctgtgaagctgtggggtgtgtgcagagagcctggggcctggggttcccagaggagcatcttggggaggcctgcacagtaggatcctgcccatgtgccctgagctgatgtgccagccgtgtgaaagtgctctgacaccgtgggccgtacggagggcctccagaggggatgttgaaggcaggagacagctgtgccgggagcctctgcaggccgtggagggcccgtcctgtgacgtgtctgccctccctgctccacctctggtgttgctgcttctgcgtcaggacccttgctgcagcgccatgtctgcatcttctttgcttttgtagctttggatcttcagtttgatggatggacaccattatcgtcgtgtggcacgggttgacctaaggaagaagacagagactttctccacaagaagggttaagtctgggctgtgcaaagaaagccagcttccctctacaagtgctctgggaaaaggagagcaggttgaagtaacatttcctgtactgagacttgcaccctgtgatctctcactcatcccaaattctgcatgtggatgtctttcttctgagaacacccgatgtgtgtggatcggaagctcagtgggcttattcgtatttaacctggcaaacctggaagtggaagctgctttgtattacaaggatttccagagcctcagcatcctgctggccggatcgtgtgccctgaggaaccgcactgcggatcaaaaggtgctgtgcttgctggcctccctctttggcgggaagattgccgtgttggagatcaacccggccgcgctagtcagggctcagcagtgccccagcatggggcagagcctctcggtgccagccagctcctgtgtcctaccgacctctccactgtatctgggaattgccaaggagaagagtaccaaggctgctagtgaacagcgacgtgctgcacggaacgtcatgaaggaccaacgcctggttttccatagtaaagttaggtcatctggttatgcgtcagcaccacatgtaactatgttttcaccaaagaccaacatcaagagtgaggggaaaggatcttcaaggagcaggagcacgtgcgcacgggaggcataccccgtggagtgcgctgtgcccaccaagcccggcccccaggtcgtgccgcccccacctgcacacgtgtatgctgcatccagtactcaggagatgggcagtggctggcctgtgggttggccaaccatctgttactcgtttttgatgccagcctgactgggacacctgctg

SEQ ID NO: 449144 - DNA, 1693 bp, Homo sapiens
ctggtttatactaggtcgcgctaggggcagcgtgaccagccagggcggagagaggatgcttaactccttaggctcgaactcctcccttcctacccacctctctcccttctcgttcgggtattcaggacttccattccccagcccctgcctctccagctttctccttctgtcccataacccctgcgggtcgcgggctggacttccagtccctgcggtagcgagcagctgagggttaagggggcggggctgctgcatttttggggagtgagcgcatcctagtggctgccaagaggggcgcccgacagggacctcacaagcccccaagcaggggcaacaggtgttttggagattagagaccctagccttgttcctcaggctcctcttaaagaatctgacccctgagggtgctgggtagagtgaggtcgacaggagcggaaggtctggagtgggtggggcggagtgggagggacgcctagagatggcaggaggaagacctgggcgctcttaaccacccccaacgcccttgtctgcatgtctttttctctgtctcctccttttctgtttcttctcccagacaggtgaagaaacaagaaaactaagaaatccgagcggttggagggggagtctgtgtggatgggatggggacgccgggggaggggctgggccgctgctcccatgccctgatccggggagtcccagagagcctggcgtcgggggaaggtgcgggggctggccttcccgctctggatctggccaaagctcaaagggagcacggggtgctgggaggtaaactgaggcaacgactggggctacagctgctagaactgccacctgaggagtcattgccgctgggaccgctgcttggcgacacggccgtgatccaaggggacacggccctaatcacgcggccctggagccccgctcgtaggccagaggtcgatggagtccgcaaagccctgcaagacctggggctccgaattgtggaaataggagacgagaacgcgacgctggatggcactgacgttctcttcaccggccgggagtttttcgtaggcctctccaaatggaccaatcaccgaggagctgagatcgtggcggacacgttccgggacttcgccgtctccactgtgccagtctcgggtccctcccacctgcgcggtctctgcggcatggggggacctcgcactgttgtggcaggcagcagcgacgctgcccaaaaggctgtccgggcaatggcagtgctgacagatcacccatatgcctccctgaccctcccagatgacgcagctgctgactgtctctttcttcgtcctgggttgcctggtgtgccccctttcctcctgcaccgtggaggtggggatctgcccaacagccaggaggcactgcagaagctctctgatgtcaccctggtacctgtgtcctgctcagaactggagaaggctggcgccgggctcagctccctctgcttggtgctcagcacacgcccccacagctgagggcctggccttggggtactgctggccaggggtaggatagtataggaagtagaaggggaaggagggttagatagagaatgctgaataggcagtagttgggagagagcctcaatattgggggaggggagagtgtagggaaaaggatccactgggtgaatcctccctctcagaaccaataaaatagaattgacctttta

SEQ ID NO: 449145 - DNA, 1583 bp, Homo sapiens
gcccgcttagacaatgccccggagccgccagaccgtcgcgcccctgccccatcgtagtatatgagctcgcctacacaaggacccccgctaaaagccagagctcccagtccccgaggcttgaagacggggactcccttctccaccaactctgtcctcggggggtggggccccagccgagatcacagcgcgacaggagtgggggtggccgctggagacaggtgaagaaacaagaaaactaagaaatccgagcggttggagggggagtctgtgtggatgggatggggacgccgggggaggggctgggccgctgctcccatgccctgatccggggagtcccagagagcctggcgtcgggggaaggtgcgggggctggccttcccgctctggatctggccaaagctcaaagggagcacggggtgctgggaggtaaactgaggcaacgactggggctacagctgctagaactgccacctgaggagtcattgccgctgggaccgctgcttggcgacacggccgtgatccaaggggacacggccctaatcacgcggccctggagccccgctcgtaggccagaggtcgatggagtccgcaaagccctgcaagacctggggctccgaattgtggaaataggagacgagaacgcgacgctggatggcactgacgttctcttcaccggccgggagtttttcgtaggcctctccaaatggaccaatcaccgaggagctgagatcgtggcggacacgttccgggacttcgccgtctccactgtgccagtctcgggtccctcccacctgcgcggtctctgcggcatggggggacctcgcactgttgtggcaggcagcagcgacgctgcccaaaaggctgtccgggcaatggcagtgctgacagatcacccatatgcctccctgaccctcccagatgacgcagctgctgactgtctctttcttcgtcctgggttgcctggtgtgccccctttcctcctgcaccgtggaggtggggatctgcccaacagccaggaggcactgcagaagctctctgatgtcaccctggtacctgtgtcctgctcagaactggagaaggctggcgccgggctcagctccctctgcttggtgctcagcacacgcccccacagctgagggcctggccttggggtactgctggccaggggtaggatagtataggaagtagaaggggaaggagggttagatagagaatgctgaataggcagtagttgggagagagcctcaatattgggggaggggagagtgtagggaaaaggatccactgggtgaatcctccctctcagaaccaataaaatagaattgaccttttaaaaaaaaaaaaaaaaaaaaagggtcggggcccgcggccaggaaagcttctaaacccacgtgttggcgcgggcccagcggttaggaacgggccaacaggcggtcaagggacccgtcggcagtgggcggggtccccaaaaaagccggggccccgctggcaaccccggggcgggctctggctcccgcccgcgaatcccccgccgccgcgcggaaacacaccacagcgagagaaacgaagaaggacaagacgag

SEQ ID NO: 449146 - DNA, 1557 bp, Homo sapiens
ctggtttatactaggtcgcgctaggggcagcgtgaccagccagggcggagagaggatgcttaactccttaggctcgaactcctcccttcctacccacctctctcccttctcgttcgggtattcaggacttccattccccagcccctgcctctccagctttctccttctgtcccataacccctgcgggtcgcgggctggacttccagtccctgcggtagcgagcagctgagggttaagggggcggggctgctgcatttttggggagtgagcgcatcctagtggctgccaagaggggcgcccgacagggacctcacaagcccccaagcaggggcaacaggtgttttggagattagagaccctagccttgttcctcaggctcctcttaaagaatctgacccctgagggtgctgggtagagtgaggtcgacaggagcggaagacaggtgaagaaacaagaaaactaagaaatccgagcggttggagggggagtctgtgtggatgggatggggacgccgggggaggggctgggccgctgctcccatgccctgatccggggagtcccagagagcctggcgtcgggggaaggtgcgggggctggccttcccgctctggatctggccaaagctcaaagggagcacggggtgctgggaggtaaactgaggcaacgactggggctacagctgctagaactgccacctgaggagtcattgccgctgggaccgctgcttggcgacacggccgtgatccaaggggacacggccctaatcacgcggccctggagccccgctcgtaggccagaggtcgatggagtccgcaaagccctgcaagacctggggctccgaattgtggaaataggagacgagaacgcgacgctggatggcactgacgttctcttcaccggccgggagtttttcgtaggcctctccaaatggaccaatcaccgaggagctgagatcgtggcggacacgttccgggacttcgccgtctccactgtgccagtctcgggtccctcccacctgcgcggtctctgcggcatggggggacctcgcactgttgtggcaggcagcagcgacgctgcccaaaaggctgtccgggcaatggcagtgctgacagatcacccatatgcctccctgaccctcccagatgacgcagctgctgactgtctctttcttcgtcctgggttgcctggtgtgccccctttcctcctgcaccgtggaggtggggatctgcccaacagccaggaggcactgcagaagctctctgatgtcaccctggtacctgtgtcctgctcagaactggagaaggctggcgccgggctcagctccctctgcttggtgctcagcacacgcccccacagctgagggcctggccttggggtactgctggccaggggtaggatagtataggaagtagaaggggaaggagggttagatagagaatgctgaataggcagtagttgggagagagcctcaatattgggggaggggagagtgtagggaaaaggatccactgggtgaatcctccctctcagaaccaataaaatagaattgacctttta

SEQ ID NO: 449147 - DNA, 1092 bp, Homo sapiens
gcccgcttagacaatgccccggagccgccagaccgtcgcgcccctgccccatcgtagtatatgagctcgcctacacaaggacccccgctaaaagccagagctcccagtccccgaggcttgaagacggggactcccttctccaccaactctgtcctcggggggtggggccccagccgagatcacagcgcgacaggagtgggggtggccgctggagctgctagaactgccacctgaggagtcattgccgctgggaccgctgcttggcgacacggccgtgatccaaggggacacggccctaatcacgcggccctggagccccgctcgtaggccagaggtcgatggagtccgcaaagccctgcaagacctggggctccgaattgtggaaataggagacgagaacgcgacgctggatggcactgacgttctcttcaccggccgggagtttttcgtaggcctctccaaatggaccaatcaccgaggagctgagatcgtggcggacacgttccgggacttcgccgtctccactgtgccagtctcgggtccctcccacctgcgcggtctctgcggcatggggggacctcgcactgttgtggcaggcagcagcgacgctgcccaaaaggctgtccgggcaatggcagtgctgacagatcacccatatgcctccctgaccctcccagatgacgcagctgctgactgtctctttcttcgtcctgggttgcctggtgtgccccctttcctcctgcaccgtggaggtggggatctgcccaacagccaggaggcactgcagaagctctctgatgtcaccctggtacctgtgtcctgctcagaactggagaaggctggcgccgggctcagctccctctgcttggtgctcagcacacgcccccacagctgagggcctggccttggggtactgctggccaggggtaggatagtataggaagtagaaggggaaggagggttagatagagaatgctgaataggcagtagttgggagagagcctcaatattgggggaggggagagtgtagggaaaaggatccactgggtgaatcctccctctcagaaccaataaaatagaattgacctttta

SEQ ID NO: 449148 - DNA, 1612 bp, Homo sapiens
gcccgcttagacaatgccccggagccgccagaccgtcgcgcccctgccccatcgtagtatatgagctcgcctacacaaggacccccgctaaaagccagagctcccagtccccgaggcttgaagacggggactcccttctccaccaactctgtcctcggggggtggggccccagccgagatcacagcgcgacaggagtgggggtggccgctggagacaggtgaagaaacaagaaaactaagaaatccgagcggttggagggggagtctgtgtggatgggatggggacgccgggggaggggctgggccgctgctcccatgccctgatccggggagtcccagagagcctggcgtcgggggaaggtgcgggggctggccttcccgctctggatctggccaaagctcaaagggagcacggggtgctgggaggtaaactgaggcaacgactggggctacagctgctagaactgccacctgaggagtcattgccgctgggaccgctgcttggcgacacggccgtgatccaaggggacacggccctaatcacgcggccctggagccccgctcgtaggccagaggtcgatggagtccgcaaagccctgcaagacctggggctccgaattgtggaaataggagacgagaacgcgacgctggatggcactgacgttctcttcaccggtgaggctggggggaggcataggtcttggcacagggaagtagagtttgggagactcggccgtctggagccttgtttctaactcactcccgccctcaaacctccgcggcctcccggactcaggccgggagtttttcgtaggcctctccaaatggaccaatcaccgaggagctgagatcgtggcggacacgttccgggtgcggagcgggaccagcctagggagggagggggtgcaggtgggggtcggaagggcctgggcgcccgctgaggaaatgagaggcagagagcagcctatgtttgaagataccccatcacccctcccgcgcccctgaatacctcccttcgctctccctaggacttcgccgtctccactgtgccagtctcgggtccctcccacctgcgcggtctctgcggcatggggggacctcgcactgttgtggcaggcagcagcgacgctgcccaaaaggctgtccgggcaatggcagtgctgacagatcacccatatgcctccctgaccctcccagatgacgcagctgctgactgtctctttcttcgtcctgggttgcctggtgtgccccctttcctcctgcaccgtggaggtggggatctgcccaacagccaggaggcactgcagaagctctctgatgtcaccctggtacctgtgtcctgctcagaactggagaaggctggcgccgggctcagctccctctgcttggtgctcagcacacgcccccacagctgagggcctggccttggggtactgctggccaggggtaggatagtataggaagtagaaggggaaggagggttagatagagaatgctgaataggcagtagttgggagagagcctcaatattgggggaggggagagtgtagggaaaaggatccactgggtgaatcctccctctcagaaccaataaaatagaattgacctttta

SEQ ID NO: 449149 - DNA, 1292 bp, Homo sapiens
gcccgcttagacaatgccccggagccgccagaccgtcgcgcccctgccccatcgtagtatatgagctcgcctacacaaggacccccgctaaaagccagagctcccagtccccgaggcttgaagacggggactcccttctccaccaactctgtcctcggggggtggggccccagccgagatcacagcgcgacaggagtgggggtggccgctggagacaggtgaagaaacaagaaaactaagaaatccgagcggttggagggggagtctgtgtggatgggatggggacgccgggggaggggctgggccgctgctcccatgccctgatccggggagtcccagagagcctggcgtcgggggaaggtgcgggggctggccttcccgctctggatctggccaaagctcaaagggagcacggggtgctgggaggtaaactgaggcaacgactggggctacagctgctagaactgccacctgaggagtcattgccgctgggaccgctgcttggcgacacggccgtgatccaaggggacacggccctaatcacgcggccctggagccccgctcgtaggccagaggtcgatggagtccgcaaagccctgcaagacctggggctccgaattgtggaaataggagacgagaacgcgacgctggatggcactgacgttctcttcaccggccgggagtttttcgtaggcctctccaaatggaccaatcaccgaggagctgagatcgtggcggacacgttccgggacttcgccgtctccactgtgccagtctcgggtccctcccacctgcgcggtctctgcggcatggggggacctcgcactgttgtggcaggcagcagcgacgctgcccaaaaggctgtccggcctcccagatgacgcagctgctgactgtctctttcttcgtcctgggttgcctggtgtgccccctttcctcctgcaccgtggaggtggggatctgcccaacagccaggaggcactgcagaagctctctgatgtcaccctggtacctgtgtcctgctcagaactggagaaggctggcgccgggctcagctccctctgcttggtgctcagcacacgcccccacagctgagggcctggccttggggtactgctggccaggggtaggatagtataggaagtagaaggggaaggagggttagatagagaatgctgaataggcagtagttgggagagagcctcaatattgggggaggggagagtgtagggaaaaggatccactgggtgaatcctccctctcagaaccaataaaatagaattgacctttta

SEQ ID NO: 449150 - DNA, 1037 bp, Homo sapiens
gcccgcttagacaatgccccggagccgccagaccgtcgcgcccctgccccatcgtagtatatgagctcgcctacacaaggacccccgctaaaagccagagctcccagtccccgaggcttgaagacggggactcccttctccaccaactctgtcctcggggggtggggccccagccgagatcacagcgcgacaggagtgggggtggccgctggagacaggtgaagaaacaagaaaactaagaaatccgagcggttggagggggagtctgtgtggatgggatggggacgccgggggaggggctgggccgctgctcccatgccctgatccggggagtcccagagagcctggcgtcgggggaaggtgcgggggctggccttcccgctctggatctggccaaagctcaaagggagcacggggtgctgggaggtaaactgaggcaacgactggggctacagctgctagaactgccacctgaggagtcattgccgctgggaccgctgcttggcgacacggccgtgatccaaggggacacggccctaatcacgcggccctggagccccgctcgtaggccagaggtcgatggagtccgcaaagccctgcaagacctggggctccgaattgtggaaataggagacgagaacgcgacgctggatggcactgacgttctcttcaccggccgggagtttttcgtaggcctctccaaatggaccaatcaccgaggaggcactgcagaagctctctgatgtcaccctggtacctgtgtcctgctcagaactggagaaggctggcgccgggctcagctccctctgcttggtgctcagcacacgcccccacagctgagggcctggccttggggtactgctggccaggggtaggatagtataggaagtagaaggggaaggagggttagatagagaatgctgaataggcagtagttgggagagagcctcaatattgggggaggggagagtgtagggaaaaggatccactgggtgaatcctccctctcagaaccaataaaatagaattgacctttta

SEQ ID NO: 449151 - DNA, 366 bp, Homo sapiens
tcttggcactttgttgaaatgaatggactaaattcataacttggcctctggggcactgcagaagctctctgatgtcaccctggtacctgtgtcctgctcagaactggagaaggctggcgccgggctcagctccctctgcttggtgctcagcacacgcccccacagctgagggcctggccttggggtactgctggccaggggtaggatagtataggaagtagaaggggaaggagggttagatagagaatgctgaataggcagtagttgggagagagcctcaatattgggggaggggagagtgtagggaaaaggatccactgggtgaatcctccctctcagaaccaataaaatagaattgacctttta

SEQ ID NO: 449152 - DNA, 409 bp, Homo sapiens
tcagcctgaggtctcactcccctctccccactccatgtcttccctgtgcagggcactgcagaagctctctgatgtcaccctggtacctgtgtcctgctcagaactggagaaggctggcgccgggctcagctccctctgcttggtgctcagcacacgcccccacagctgagggcctggccttggggtactgctggccaggggtaggatagtataggaagtagaaggggaaggagggttagatagagaatgctgaataggcagtagttgggagagagcctcaatattgggggaggggagagtgtagggaaaaggatccactgggtgaatcctccctctcagaaccaataaaatagaattgaccttttagactgggctgtgactggtgtcttactggggcaaagggataggg

SEQ ID NO: 449153 - DNA, 1333 bp, Homo sapiens
gcccgcttagacaatgccccggagccgccagaccgtcgcgcccctgccccatcgtagtatatgagctcgcctacacaaggacccccgctaaaagccagagctcccagtccccgaggcttgaagacggggactcccttctccaccaactctgtcctcggggggtggggccccagccgagatcacagcgcgacaggagtgggggtggccgctggagacaggtgaagaaacaagaaaactaagaaatccgagcggttggagggggagtctgtgtggatgggatggggacgccgggggaggggctgggccgctgctcccatgccctgatccggggagtcccagagagcctggcgtcgggggaaggtgcgggggctggccttcccgctctggatctggccaaagctcaaagggagcacggggtgctgggaggtaaactgaggcaacgactggggctacagctgctagaactgccacctgaggagtcattgccgctgggaccgctgcttggcgacacggccgtgatccaaggggacacggccctaatcacgcggccctggagccccgctcgtaggccagaggtcgatggagtccgcaaagccctgcaagacctggggctccgaattgtggaaataggagacgagaacgcgacgctggatggcactgacgttctcttcaccggccgggagtttttcgtaggcctctccaaatggaccaatcaccgaggagctgagatcgtggcggacacgttccgggacttcgccgtctccactgtgccagtctcgggtccctcccacctgcgcggtctctgcggcatggggggacctcgcactgttgtggcaggcagcagcgacgctgcccaaaaggctgtccgggcaatggcagtgctgacagatcacccatatgcctccctgaccctcccagatgacgcagctgctgactgtctctttcttcgtcctgggttgcctggtgtgccccctttcctcctgcaccgtggaggtggggatctgcccaacagccaggaggcactgcagaagctctctgatgtcaccctggtacctgtgtcctgctcagaactggagaaggctggcgccgggctcagctccctctgcttggtgctcagcacacgcccccacagctgagggcctggccttggggtactgctggccaggggtaggatagtataggaagtagaaggggaaggagggttagatagagaatgctgaataggcagtagttgggagagagcctcaatattgggggaggggagagtgtagggaaaaggatccactgggtgaatcctccctctcagaaccaataaaatagaattgacctttta

SEQ ID NO: 449154 - DNA, 1236 bp, Homo sapiens
ctggtttatactaggtcgcgctaggggcagcgtgaccagccagggcggagagaggatgcttaactccttaggctcgaactcctcccttcctacccacctctctcccttctcgttcggacaggtgaagaaacaagaaaactaagaaatccgagcggttggagggggagtctgtgtggatgggatggggacgccgggggaggggctgggccgctgctcccatgccctgatccggggagtcccagagagcctggcgtcgggggaaggtgcgggggctggccttcccgctctggatctggccaaagctcaaagggagcacggggtgctgggaggtaaactgaggcaacgactggggctacagctgctagaactgccacctgaggagtcattgccgctgggaccgctgcttggcgacacggccgtgatccaaggggacacggccctaatcacgcggccctggagccccgctcgtaggccagaggtcgatggagtccgcaaagccctgcaagacctggggctccgaattgtggaaataggagacgagaacgcgacgctggatggcactgacgttctcttcaccggccgggagtttttcgtaggcctctccaaatggaccaatcaccgaggagctgagatcgtggcggacacgttccgggacttcgccgtctccactgtgccagtctcgggtccctcccacctgcgcggtctctgcggcatggggggacctcgcactgttgtggcaggcagcagcgacgctgcccaaaaggctgtccgggcaatggcagtgctgacagatcacccatatgcctccctgaccctcccagatgacgcagctgctgactgtctctttcttcgtcctgggttgcctggtgtgccccctttcctcctgcaccgtggaggtggggatctgcccaacagccaggaggcactgcagaagctctctgatgtcaccctggtacctgtgtcctgctcagaactggagaaggctggcgccgggctcagctccctctgcttggtgctcagcacacgcccccacagctgagggcctggccttggggtactgctggccaggggtaggatagtataggaagtagaaggggaaggagggttagatagagaatgctgaataggcagtagttgggagagagcctcaatattgggggaggggagagtgtagggaaaaggatccactgggtgaatcctccctctcagaaccaataaaatagaattgacctttta

SEQ ID NO: 449155 - DNA, 1387 bp, Homo sapiens
  misc_feature (188)..(188): n is a, c, g, or t
cctcgggggaatacgtatctaagaacctacgtccgtacatgagaggcaccgcgcgcgcctaaaagctcagatgcatccactaggtccactaggagtggtttgcactaacgaggatacctcgcctctctgacataatgttctggtattctcgagcgcgagattgagaggcccacaggccggaggagtcnaccacggcagccggactacgtggaagtcgagaggtgcccgaggaactggtggtagcatcgagcgttgcaatgtaacctcgagagatcatatctaagaagagacctgaaacggcgaggctcgaggtaatgctctgtgtggatgggatggggacgccgggggaggggctgggccgctgctcccatgccctgatccggggagtcccagagagcctggcgtcgggggaaggtgcgggggctggccttcccgctctggatctggccaaagctcaaagggagcacggggtgctgggaggtaaactgaggcaacgactggggctacagctgctagaactgccacctgaggagtcattgccgctgggaccgctgcttggcgacacggccgtgatccaaggggacacggccctaatcacgcggccctggagccccgctcgtaggccagaggtcgatggagtccgcaaagccctgcaagacctggggctccgaattgtggaaataggagacgagaacgcgacgctggatggcactgacgttctcttcaccggccgggagtttttcgtaggcctctccaaatggaccaatcaccgaggagctgagatcgtggcggacacgttccgggacttcgccgtctccactgtgccagtctcgggtccctcccacctgcgcggtctctgcggcatggggggacctcgcactgttgtggcaggcagcagcgacgctgcccaaaaggctgtccgggcaatggcagtgctgacagatcacccatatgcctccctgaccctcccagatgacgcagctgctgactgtctctttcttcgtcctgggttgcctggtgtgccccctttcctcctgcaccgtggaggtggggatctgcccaacagccaggaggcactgcagaagctctctgatgtcaccctggtacctgtgtcctgctcagaactggagaaggctggcgccgggctcagctccctctgcttggtgctcagcacacgcccccacagctgagggcctggccttggggtactgctggccaggggtaggatagtataggaagtagaaggggaaggagggttagatagagaatgctgaataggcagtagttgggagagagcctcaatattgggggaggggagagtgtagggaaaaggatccactgggtgaatcctccctctcagaaccaataaaatagaattgacctttta

SEQ ID NO: 449156 - DNA, 1814 bp, Homo sapiens
ctggtttatactaggtcgcgctaggggcagcgtgaccagccagggcggagagaggatgcttaactccttaggctcgaactcctcccttcctacccacctctctcccttctcgttcgggtattcaggacttccattccccagcccctgcctctccagctttctccttctgtcccataacccctgcgggtcgcgggctggacttccagtccctgcggtagcgagcagctgagggttaagggggcggggctgctgcatttttggggagtgagcgcatcctagtggctgccaagaggggcgcccgacagggacctcacaagcccccaagcaggggcaacaggtgttttggagattagagaccctagccttgttcctcaggctcctcttaaagaatctgacccctgagggtgctgggtagagtgaggtcgacaggagcggaaggtctggagtgggtggggcggagtgggagggacgcctagagatggcaggaggaagacctgggcgctcttaaccacccccaacgcccttgtctgcatgtctttttctctgtctcctccttttctgtttcttctcccagacaggtgaagaaacaagaaaactaagaaatccgagcggttggagggggagtctgtgtggatgggatggggacgccgggggaggggctgggccgctgctcccatgccctgatccggggagtcccagagagcctggcgtcgggggaaggtgcgggggctggccttcccgctctggatctggccaaagctcaaagggagcacggggtgctgggaggtaaactgaggcaacgactggggctacagctgctagaactgccacctgaggagtcattgccgctgggaccgctgcttggcgacacggccgtgatccaaggggacacggccctaatcacgcggccctggagccccgctcgtaggccagaggtcgatggagtccgcaaagccctgcaagacctggggctccgaattgtggaaataggagacgagaacgcgacgctggatggcactgacgttctcttcaccggtgaggctggggggaggcataggtcttggcacagggaagtagagtttgggagactcggccgtctggagccttgtttctaactcactcccgccctcaaacctccgcggcctcccggactcaggccgggagtttttcgtaggcctctccaaatggaccaatcaccgaggagctgagatcgtggcggacacgttccgggacttcgccgtctccactgtgccagtctcgggtccctcccacctgcgcggtctctgcggcatggggggacctcgcactgttgtggcaggcagcagcgacgctgcccaaaaggctgtccgggcaatggcagtgctgacagatcacccatatgcctccctgaccctcccagatgacgcagctgctgactgtctctttcttcgtcctgggttgcctggtgtgccccctttcctcctgcaccgtggaggtggggatctgcccaacagccaggaggcactgcagaagctctctgatgtcaccctggtacctgtgtcctgctcagaactggagaaggctggcgccgggctcagctccctctgcttggtgctcagcacacgcccccacagctgagggcctggccttggggtactgctggccaggggtaggatagtataggaagtagaaggggaaggagggttagatagagaatgctgaataggcagtagttgggagagagcctcaatattgggggaggggagagtgtagggaaaaggatccactgggtgaatcctccctctcagaaccaataaaatagaattgacctttta

SEQ ID NO: 449157 - DNA, 898 bp, Homo sapiens
gcccgcttagacaatgccccggagccgccagaccgtcgcgcccctgccccatcgtagtatatgagctcgcctacacaaggacccccgctaaaagccagagctcccagtccccgaggcttgaagacggggactcccttctccaccaactctgtcctcggggggtggggccccagccgagatcacagcgcgacaggagtgggggtggccgctggaggtcgatggagtccgcaaagccctgcaagacctggggctccgaattgtggaaataggagacgagaacgcgacgctggatggcactgacgttctcttcaccggacttcgccgtctccactgtgccagtctcgggtccctcccacctgcgcggtctctgcggcatggggggacctcgcactgttgtggcaggcagcagcgacgctgcccaaaaggctgtccgggcaatggcagtgctgacagatcacccatatgcctccctgaccctcccagatgacgcagctgctgactgtctctttcttcgtcctgggttgcctggtgtgccccctttcctcctgcaccgtggaggtggggatctgcccaacagccaggaggcactgcagaagctctctgatgtcaccctggtacctgtgtcctgctcagaactggagaaggctggcgccgggctcagctccctctgcttggtgctcagcacacgcccccacagctgagggcctggccttggggtactgctggccaggggtaggatagtataggaagtagaaggggaaggagggttagatagagaatgctgaataggcagtagttgggagagagcctcaatattgggggaggggagagtgtagggaaaaggatccactgggtgaatcctccctctcagaaccaataaaatagaattgacctttta

SEQ ID NO: 449158 - DNA, 2128 bp, Homo sapiens
cctccagctccgccaagtaggtgggatccactactttgcagaggaggaagccgttcaggcctccctctgtgcactttgcaaaagcctctgcccttccatctcgaatcccttggcgccgatcacacttcctctgcctggaaacctggagccgtctctcgcgagacgtcctccgccctgtagaaggccgtttcggttcttcgtgcgcggtagccgccccacttgcgggattccaaggcctcatcgagtgcgggtatctggctgtggattcgccgccgtcctgctggacgcctggaggctcgaaccccgccgcccccctaccccaggctttactcccaccccggcttccgcccactgtgctgcccttcctcggacctgggctgtcgggagagctggagatgttcacccttcctcaaaaggacttcagggctcccaccacctgtctgggccccacctgcatgcaggacctgggcagtagccatggggaagatctggaaggagaatgctccagaaaactggaccagaagctgccagagctccgtggagtgggtgatcctgccatgatctcctctaatacctcctacctgtcctctagaggaagaatgattaaatggttctgggattcagctgaggagggctacaggacctaccacatggatgagtatgatgaggacaagaaccccagtggcatcattaacttgggcaccagtgagaacaaactctgctttgacctgctgtcctggcggctgagtcagcgcgacatgcagagggtggagccatccctgctgcagtatgctgactggaggggacatctgttcctccgggaggaagtggccaagttcctgtctttctactgcaagagcccagtacccctcagaccagagaatgtggttgtcctgaatggtggtgcctcgctcttctctgctctggccacggtgctgtgtgaggccggggaggctttcctgatccccaccccttactatggcgctatcacacagcacgtgtgtctctatggcaacatccggctggcctatgtctacctggacagtgaggtcactgggctagacacacgccccttccagctcacagtggagaagctggagatggccctgagagaagctcactctgagggtgtgaaggtcaaaggcctcatcctcatcagcccccagaaccctctgggtgatgtatactcccctgaagagctacaggagtacctggtatttgccaagaggcacaggctgcatgtgattgtggatgaggtctacatgctgtccgtgtttgagaagtctgttgggtaccgcagtgtcctaagcctggaaaggctccctgacccccagaggacccatgtgatgtgggcaaccagcaaggacttcgggatgtctgggctccgctttggcacgctgtacacagaaaaccaggatgtggccactgccgtggcttccctctgccgctaccacggcctcagtggcttggtccagtaccagatggcacagctgctccgggaccgtgactggatcaaccaggtgtacctgccggaaaaccatgcccggctcaaggctgcccacacctatgtctcagaagagcttagggcattggggatccccttcttgagtcgtggggctggcttcttcatctgggttgacttgagaaagtacctgcccaagggcacctttgaggaggaaatgctgctctggcgccgctttttggacaacaaggtgctgctgtcctttggcaaggccttcgagtgtaaagagcctggttggtttcgctttgtcttctcagaccaggtccaccggctttgcctggggatgcagagggtccagcaggtgcttgcaggcaaatcccaagtggcagaagacccccgtccctctcagagccaggagccaagtgaccaacgcaggtgagctggtcattgtctcgtggccagagggcccagcagccactgtggacctggggcgttctggggctgcagaagactgactgtggatgtgccatttgccaggaaggtatctaacttggctttgtgcctgaagaactgtttcttgtctttcgctgtagcagtgggaaactccttaagctgtggttcagcctgggccctccctctctcctattaaacaaaactaggagagtc

SEQ ID NO: 449159 - DNA, 553 bp, Homo sapiens
gaggggacatctgttcctccgggaggaagtggccaagttcctgtctttctactgcaagacccccgtccctctcagagccaggagccaagtgaccaacgcaggtgagctggtcattgtctcgtggccagagggcccagcagccactgtggacctggggcgttctggggctgcagaagactgactgtggatgtgccatttgccaggaaggtatctaacttggctttgtgcctgaagaactgtttcttgtctttcgctgtagcagtgggaaactccttaagctgtggttcagcctgggccctccctctctcctattaaacaaaactaggagagtccatatgtctccattgtgagttatttagaatggaggagtcgtgactgcttctaaccagagcctcagcccccctgaggatgtgaaaagaaaacaaacaacttgtaccttctttctgatatcaccgtcattcctctttctttgtcaccaaggaaacgagtcaaaggaacagcacatacaggagagtttgtagaaaaataaaaaaaagtgataacttccaaactc

SEQ ID NO: 449160 - DNA, 2349 bp, Homo sapiens
cctccagctccgccaagtaggtgggatccactactttgcagaggaggaagccgttcaggcctccctctgtgcactttgcaaaagcctctgcccttccatctcgaatcccttggcgccgatcacacttcctctgcctggaaacctggagccgtctctcgcgagacgtcctccgccctgtagaaggccgtttcggttcttcgtgcgcggtagccgccccacttgcgggattccaaggcctcatcgagtgcgggtatctggctgtggattcgccgccgtcctgctggacgcctggaggctcgaaccccgccgcccccctaccccaggctttactcccaccccggcttccgcccactgtgctgcccttcctcggacctgggctgtcgggagagctggagatgttcacccttcctcaaaaggacttcagggctcccaccacctgtctgggccccacctgcatgcaggacctgggcagtagccatggggaagatctggaaggagaatgctccagaaaactggaccagaagctgccagagctccgtggagtgggtgatcctgccatgatctcctctaatacctcctacctgtcctctagaggaagaatgattaaatggttctgggattcagctgaggagggctacaggacctaccacatggatgagtatgatgaggacaagaaccccagtggcatcattaacttgggcaccagtgagaacaaactctgctttgacctgctgtcctggcggctgagtcagcgcgacatgcagagggtggagccatccctgctgcagtatgctgactggaggggacatctgttcctccgggaggaagtggccaagttcctgtctttctactgcaagagcccagtacccctcagaccagagaatgtggttgtcctgaatggtggtgcctcgctcttctctgctctggccacggtgctgtgtgaggccggggaggctttcctgatccccaccccttactatggcgctatcacacagcacgtgtgtctctatggcaacatccggctggcctatgtctacctggacagtgaggtcactgggctagacacacgccccttccagctcacagtggagaagctggagatggccctgagagaagctcactctgagggtgtgaaggtcaaaggcctcatcctcatcagcccccagaaccctctgggtgatgtatactcccctgaagagctacaggagtacctggtatttgccaagaggcacaggctgcatgtgattgtggatgaggtctacatgctgtccgtgtttgagaagtctgttgggtaccgcagtgtcctaagcctggaaaggctccctgacccccagaggacccatgtgatgtgggcaaccagcaaggacttcgggatgtctgggctccgctttggcacgctgtacacagaaaaccaggatgtggccactgccgtggcttccctctgccgctaccacggcctcagtggcttggtccagtaccagatggcacagctgctccgggaccgtgactggatcaaccaggtgtacctgccggaaaaccatgcccggctcaaggctgcccacacctatgtctcagaagagcttagggcattggggatccccttcttgagtcgtggggctggcttcttcatctgggttgacttgagaaagtacctgcccaagggcacctttgaggaggaaatgctgctctggcgccgctttttggacaacaaggtgctgctgtcctttggcaaggccttcgagtgtaaagagcctggttggtttcgctttgtcttctcagaccaggtccaccggctttgcctggggatgcagagggtccagcaggtgcttgcaggcaaatcccaagtggcagaagacccccgtccctctcagagccaggagccaagtgaccaacgcaggtgagctggtcattgtctcgtggccagagggcccagcagccactgtggacctggggcgttctggggctgcagaagactgactgtggatgtgccatttgccaggaaggtatctaacttggctttgtgcctgaagaactgtttcttgtctttcgctgtagcagtgggaaactccttaagctgtggttcagcctgggccctccctctctcctattaaacaaaactaggagagtccatatgtctccattgtgagttatttagaatggaggagtcgtgactgcttctaaccagagcctcagcccccctgaggatgtgaaaagaaaacaaacaacttgtaccttctttctgatatcaccgtcattcctctttctttgtcaccaaggaaacgagtcaaaggaacagcacatacaggagagtttgtagaaaaataaaaaaaagtgataacttccaaactc

SEQ ID NO: 449161 - DNA, 2195 bp, Homo sapiens
cctccagctccgccaagtaggtgggatccactactttgcagaggaggaagccgttcaggcctccctctgtgcactttgcaaaagcctctgcccttccatctcgaatcccttggcgccgatcacacttcctctgcctggaaacctggagccgtctctcgcgagacgtcctccgccctgtagaaggccgtttcggttcttcgtgcgcggtagccgccccacttgcgggattccaaggcctcatcgagtgcgggtatctggctgtggattcgccgccgtcctgctggacgcctggaggctcgaaccccgccgcccccctaccccaggctttactcccaccccggcttccgcccactgtgctgcccttcctcggacctgggctgtcgggagagctggagatgttcacccttcctcaaaaggacttcagggctcccaccacctgtctgggccccacctgcatgcaggacctgggcagtagccatggggaagatctggaaggagaatgctccagaaaactggaccagaagctgccagagctccgtggagtgggtgatcctgccatgatctcctctaatacctcctacctgtcctctagaggaagaatgattaaatggttctgggattcagctgaggagggctacaggacctaccacatggatgagtatgatgaggacaagaaccccagtggcatcattaacttgggcaccagtgagaacaaactctgctttgacctgctgtcctggcggctgagtcagcgcgacatgcagagggtggagccatccctgctgcagtatgctgactggaggggacatctgttcctccgggaggaagtggccaagttcctgtctttctactgcaagagcccagtacccctcagaccagagaatgtggttgtcctgaatggtggtgcctcgctcttctctgctctggccacggtgctgtgtgaggccggggaggctttcctgatccccaccccttactatggcgctatcacacagcacgtgtgtctctatggcaacatccggctggcctatgtctacctggacagtgaggtcactgggctagacacacgccccttccagctcacagtggagaagctggagatggccctgagagaagctcactctgagggtgtgaaggtcaaaggcctcatcctcatcagcccccagaaccctctgggtgatgtatactcccctgaagagctacaggagtacctggtatttgccaagaggcacaggctgcatgtgattgtggatgaggtctacatgctgtccgtgtttgagaagtctgttgggtaccgcagtgtcctaagcctggaaaggctccctgacccccagaggacccatgtgatgtgggcaaccagcaaggacttcgggatgtctgggctccgctttggcacgctgtacacagaaaaccaggatgtggccactgccgtggcttccctctgccgctaccacggcctcagtggcttggtccagtaccagatggcacagctgctccgggaccgtgactggatcaaccaggtgtacctgccggaaaaccatgcccggctcaaggctgcccacacctatgtctcagaagagcttagggcattggggatccccttcttgagtcgtggggctggcttcttcatctgggttgacttgagaaagggatgcagagggtccagcaggtgcttgcaggcaaatcccaagtggcagaagacccccgtccctctcagagccaggagccaagtgaccaacgcaggtgagctggtcattgtctcgtggccagagggcccagcagccactgtggacctggggcgttctggggctgcagaagactgactgtggatgtgccatttgccaggaaggtatctaacttggctttgtgcctgaagaactgtttcttgtctttcgctgtagcagtgggaaactccttaagctgtggttcagcctgggccctccctctctcctattaaacaaaactaggagagtccatatgtctccattgtgagttatttagaatggaggagtcgtgactgcttctaaccagagcctcagcccccctgaggatgtgaaaagaaaacaaacaacttgtaccttctttctgatatcaccgtcattcctctttctttgtcaccaaggaaacgagtcaaaggaacagcacatacaggagagtttgtagaaaaataaaaaaaagtgataacttccaaactc

SEQ ID NO: 449162 - DNA, 2124 bp, Homo sapiens
gcctgcacttgtggaggttcccattcctcccttccctcagttcctacccgccatctgcctcagaacaccacataatctcatcctaccctttacaccacaagacccccaggactcccaggcaatactctgctttaactcaggaaattttaacctggcatttggtaattgagatgttcacccttcctcaaaaggacttcagggctcccaccacctgtctgggccccacctgcatgcaggacctgggcagtagccatggggaagatctggaaggagaatgctccagaaaactggaccagaagctgccagagctccgtggagtgggtgatcctgccatgatctcctctaatacctcctacctgtcctctagaggaagaatgattaaatggttctgggattcagctgaggagggctacaggacctaccacatggatgagtatgatgaggacaagaaccccagtggcatcattaacttgggcaccagtgagaacaaactctgctttgacctgctgtcctggcggctgagtcagcgcgacatgcagagggtggagccatccctgctgcagtatgctgactggaggggacatctgttcctccgggaggaagtggccaagttcctgtctttctactgcaagagcccagtacccctcagaccagagaatgtggttgtcctgaatggtggtgcctcgctcttctctgctctggccacggtgctgtgtgaggccggggaggctttcctgatccccaccccttactatggcgctatcacacagcacgtgtgtctctatggcaacatccggctggcctatgtctacctggacagtgaggtcactgggctagacacacgccccttccagctcacagtggagaagctggagatggccctgagagaagctcactctgagggtgtgaaggtcaaaggcctcatcctcatcagcccccagaaccctctgggtgatgtatactcccctgaagagctacaggagtacctggtatttgccaagaggcacaggctgcatgtgattgtggatgaggtctacatgctgtccgtgtttgagaagtctgttgggtaccgcagtgtcctaagcctggaaaggctccctgacccccagaggacccatgtgatgtgggcaaccagcaaggacttcgggatgtctgggctccgctttggcacgctgtacacagaaaaccaggatgtggccactgccgtggcttccctctgccgctaccacggcctcagtggcttggtccagtaccagatggcacagctgctccgggaccgtgactggatcaaccaggtgtacctgccggaaaaccatgcccggctcaaggctgcccacacctatgtctcagaagagcttagggcattggggatccccttcttgagtcgtggggctggcttcttcatctgggttgacttgagaaagtacctgcccaagggcacctttgaggaggaaatgctgctctggcgccgctttttggacaacaaggtgctgctgtcctttggcaaggccttcgagtgtaaagagcctggttggtttcgctttgtcttctcagaccaggtccaccggctttgcctggggatgcagagggtccagcaggtgcttgcaggcaaatcccaagtggcagaagacccccgtccctctcagagccaggagccaagtgaccaacgcaggtgagctggtcattgtctcgtggccagagggcccagcagccactgtggacctggggcgttctggggctgcagaagactgactgtggatgtgccatttgccaggaaggtatctaacttggctttgtgcctgaagaactgtttcttgtctttcgctgtagcagtgggaaactccttaagctgtggttcagcctgggccctccctctctcctattaaacaaaactaggagagtccatatgtctccattgtgagttatttagaatggaggagtcgtgactgcttctaaccagagcctcagcccccctgaggatgtgaaaagaaaacaaacaacttgtaccttctttctgatatcaccgtcattcctctttctttgtcaccaaggaaacgagtcaaaggaacagcacatacaggagagtttgtagaaaaataaaaaaaagtgataacttccaaactc

SEQ ID NO: 449163 - DNA, 2179 bp, Homo sapiens
cctccagctccgccaagtaggtgggatccactactttgcagaggaggaagccgttcaggcctccctctgtgcactttgcaaaagcctctgcccttccatctcgaatcccttggcgccgatcacacttcctctgcctggaaacctggagccgtctctcgcgagacgtcctccgccctgtagaaggccgtttcggttcttcgtgcgcggtagccgccccacttgcgggattccaaggcctcatcgagtgcgggtatctggctgtggattcgccgccgtcctgctggacgcctggaggctcgaaccccgccgcccccctaccccaggctttactcccaccccggcttccgcccactgtgctgcccttcctcggacctgggctgtcgggagagctggagatgttcacccttcctcaaaaggacttcagggctcccaccacctgtctgggccccacctgcatgcaggacctgggcagtagccatggggaagatctggaaggagaatgctccagaaaactggaccagaagctgccagagctccgtggagtgggtgatcctgccatgatctcctctaatacctcctacctgtcctctagaggaagaatgattaaatggttctgggattcagctgaggagggctacaggacctaccacatggatgagtatgatgaggacaagaaccccagtggcatcattaacttgggcaccagtgagaacaaactctgctttgacctgctgtcctggcggctgagtcagcgcgacatgcagagggtggagccatccctgctgcagtatgctgactggaggggacatctgttcctccgggaggaagtggccaagttcctgtctttctactgcaagagcccagtacccctcagaccagagaatgtggttgtcctgaatggtggtgcctcgctcttctctgctctggccacggtgctgtgtgaggccggggaggctttcctgatccccaccccttactatggcgctatcacacagcacgtgtgtctctatggcaacatccggctggcctatgtctacctggacagtgaggtcactgggctagacacacgccccttccagctcacagtggagaagctggagatggccctgagagaagctcactctgagggtgtgaaggtcaaaggcctcatcctcatcagcccccagaaccctctgggtgatgtatactcccctgaagagctacaggagtacctggtatttgccaagaggcacaggctgcatgtgattgtggatgaggtctacatgctgtccgtgtttgagaagtctgttgggtaccgcagtgtcctaagcctggaaaggtgaggctccctgacacagctaactcccccagtccctattatcccacggagccctggccactttctggctcagcccacagggcatggcctgcccagagcaattccatttccacccagctggtcccactggtcctcagatctaatgagaagcagggacggttgggctagattagtgattttcaagttgttctgtggaatttctgagaactccaagaagaggcctcaggatcccttaagttagggctgagtggatggcaaattggcctctttgctgtttcctttacctccagagtcgctccagttttattcattcattcatttactcattcatgctctcattcactcagcacctctggagccccttacacacagagtgtgccaaacacctatggatatttaaatgttgggctttttcattaggtttactgtaagcaaagcatttgtggccaaaatacctttgggaacacttggagcagatcatcctcaaggcacactggcccatgcctgtaatcccagcactttgggaggccaaggtgggaggattgcatgagcccaggagtttgagaccatcctgggcaacatagtgagactctgtttctacgggaaagaaaaagaaagtggggaccagatcatgtgtgtagtctgtgaatctcaccttcaggggttctaacagttccggctgtttgttcagaaccttcagcccagccaagccctttccattagccttctcttcttgtcctcacaaagccttgaggagttgatggagcatggattgtgactctcatctattttttggattaggaaactgaggcacagaaaaaagtgattgtccacgatccttggttagtcattaaaaaaaaa

SEQ ID NO: 449164 - DNA, 1124 bp, Homo sapiens
cctccagctccgccaagtaggtgggatccactactttgcagaggaggaagccgttcaggcctccctctgtgcactttgcaaaagcctctgcccttccatctcgaatcccttggcgccgatcacacttcctctgcctggaaacctggagccgtctctcgcgagacgtcctccgccctgtagaaggccgtttcggttcttcgtgcgcggtagccgccccacttgcgggattccaaggcctcatcgagtgcgggtatctggctgtggattcgccgccgtcctgctggacgcctggaggctcgaaccccgccgcccccctaccccaggctttactcccaccccggcttccgcccactgtgctgcccttcctcggacctgggctgtcgggagagctggagatgttcacccttcctcaaaaggacttcagggctcccaccacctgtctgggccccacctgcatgcaggacctgggcagtagccatggggaagatctggaaggagaatgctccagaaaactggaccagaagctgccagagctccgtggagtgggtgatcctgccatgatctcctctaatacctcctacctgtcctctagaggaagaatgattaaatggttctgggattcagctgaggagggctacaggacctaccacatggatgagtatgatgaggacaagaaccccagtggcatcattaacttgggcaccagtgagaacaaactctgctttgacctgctgtcctggcggcctccgggaggaagtggccaagttcctgtctttctactgcaagagcccagtacccctcagaccagagaatgtggttgtcctgaatggtggtgcctcgctcttctctgctctggccacggtgctgtgtgaggccggggcacgtgtgtctctatggcaacatccggctggcctatgtctacctggacagtgaggtaagagtcttgacttcctaggtggaacctgggcctgcctgtggtcaagagtttcctgggtctgaatttgagggtggtccatgctgagggctctggggttgtgatgagtagggaatggagccttctgttgctgcatggctgcctgtgcctgggttccccagtggctccaaagttccagtctctgagatcc

SEQ ID NO: 449165 - DNA, 857 bp, Homo sapiens
aattttgaaagtgcaaaaggccaacccaaaattcaaccaacaaaggtaacctactggtatttgggtatattttttctctgggccttgtcctccgcctttatctgatgctgcagatgtaattctgtgttccgcttgtttgcttcatgttgtgttatgaacatgtccccctcaaatctccctgggagccttccagcgatcagccccctttgactgtgtggctctggccttggggaagagctgagggtctcctgccctaacggatggtttcagggtgtgaaggtcaaaggcctcatcctcatcagcccccagaaccctctgggtgatgtatactcccctgaagagctacaggagtacctggtatttgccaagaggtgaggcaccccacactggccccgacagagcgtctgggcagcctggggttccaatgcgggtttggtgcaggtttttctactctcttgaccccactgtgggctgctacttgcttgggcccttccttggcagtggagcggggaagcagggatttgtgggatgcccattcctctttatctttcactctttataacaatagctatcaattagcgcacactctaggggccaggcaccatgctaagcactttatgtgcctcatacaatcctcacaacaatgctatcatacaatcctcacaacaaccctttatgtgcctcatacaatcctcacaacaaccctcatacaatccttacaacaatccttacaacaatcctcacaacaaccctactgatgctgttatcacatccagctcactgagccttagagtggtcaagtgaggggtggatccagacttgaacctgggtctctccgactcgagcccttgtgcatg

SEQ ID NO: 449166 - DNA, 203 bp, Homo sapiens
gatattgatcttctggcctctttcacccaaacagactggatcaaccaggtgtacctgccggaaaaccatgcccggctcaaggctgcccacacctatgtctcagaagagcttagggcattggggatccccttcttgagtcgtggggctggcttcttcatctgggttgacttgagaaaggtaatgctggtggaggtgcgggctga

SEQ ID NO: 449167 - DNA, 655 bp, Homo sapiens
gtcacctgctctgtatgtgtggctttctgtttgaaaaaaacagaagaaagaatggtgttcttggaattacctccccaccctgtgggacgcatctgccctacacactaagtctctcctccccacccctgcctcactccaggcacaggctgcatgtgattgtggatgaggtctacatgctgtccgtgtttgagaagtctgttgggtaccgcagtgtcctaagcctggaaaggctacatgatccccagaggacccatgtgatgtgaccaccagcatggactctggatgcctgaagtccgtttgcacgcttgacaccagaaacacgatgtgccacctgcgtgccttaatatgccgatcaacgtagtgatctgtctcttctactcacatgtgacacctgctgcggatgagtgttgaaatccccagactcccttactactgccatgtcctttgagaataacgtctcccacacccttttggatctttaatgcttgctatttgcctttacgcccccccatctttaagacttcttgctgacttactctctatcatcacggttctcaacctctctaacaactctcgctttatcccccttatcaatcttctcctccttgaccgtccctctgcattgtactcacccctctatctctcttctaggccg

SEQ ID NO: 449168 - DNA, 1441 bp, Homo sapiens
gtcacctgctctgtatgtgtggctttctgtttgaaaaaaacagaagaaagaatggtgttcttggaaaaacaagtttggtaaccccgggctagaccccggcccctctggatttctgatgtattacctccccaccctgtgggacgcatctgccctacacactaagtctctcctccccacccctgcctcactccaggcacaggctgcatgtgattgtggatgaggtctacatgctgtccgtgtttgagaagtctgttgggtaccgcagtgtcctaagcctggaaaggctccctgacccccagaggacccatgtgatgtgggcaaccagcaaggacttcgggatgtctgggctccgctttggcacgctgtacacagaaaaccaggatgtggccactgccgtggcttccctctgccgctaccacggcctcagtggcttggtccagtaccagatggcacagctgctccgggaccgtgatgaggaaaatgaggaccagatactaccccactcactatagtagctaaaagttttaaaaatagtgacaacatcaagtgttgacaaagataaggagcagctggaagtctcatacactgctgtaggagtactggatcaaccaggtgtacctgccggaaaaccatgcccggctcaaggctgcccacacctatgtctcagaagagcttagggcattggggatccccttcttgagtcgtggggctggcttcttcatctgggttgacttgagaaagtacctgcccaagggcacctttgaggaggaaatgctgctctggcgccgctttttggacaacaaggtgctgctgtcctttggcaaggccttcgagtgtaaagagcctggttggtttcgctttgtcttctcagaccaggtccaccggctttgcctggggatgcagagggtccagcaggtgcttgcaggcaaatcccaagtggcagaagacccccgtccctctcagagccaggagccaagtgaccaacgcaggtgagctggtcattgtctcgtggccagagggcccagcagccactgtggacctggggcgttctggggctgcagaagactgactgtggatgtgccatttgccaggaaggtatctaacttggctttgtgcctgaagaactgtttcttgtctttcgctgtagcagtgggaaactccttaagctgtggttcagcctgggccctccctctctcctattaaacaaaactaggagagtccatatgtctccattgtgagttatttagaatggaggagtcgtgactgcttctaaccagagcctcagcccccctgaggatgtgaaaagaaaacaaacaacttgtaccttctttctgatatcaccgtcattcctctttctttgtcaccaaggaaacgagtcaaaggaacagcacatacaggagagtttgtagaaaaataaaaaaaagtgataacttccaaactc

SEQ ID NO: 449169 - DNA, 1391 bp, Homo sapiens
gtcacctgctctgtatgtgtggctttctgtttgaaaaaaacagaagaaagaatggtgttcttggaaaaacaagtttggtaaccccgggctagaccccggcccctctggatttctgatgtattacctccccaccctgtgggacgcatctgccctacacactaagtctctcctccccacccctgcctcactccaggcacaggctgcatgtgattgtggatgaggtctacatgctgtccgtgtttgagaagtctgttgggtaccgcagtgtcctaagcctggaaaggctccctgacccccagaggacccatgtgatgtgggcaaccagcaaggacttcgggatgtctgggctccgctttggcacgctgtacacagaaaaccaggatgtggccactgccgtggcttccctctgccgctaccacggcctcagtggcttggtccagtaccagatggcacagctgctccgggaccgtgatgaggaaaatgaggaccagatactaccccactcactatagtagctaaaagttttaaaaatagtgacaacatcaagtactggatcaaccaggtgtacctgccggaaaaccatgcccggctcaaggctgcccacacctatgtctcagaagagcttagggcattggggatccccttcttgagtcgtggggctggcttcttcatctgggttgacttgagaaagtacctgcccaagggcacctttgaggaggaaatgctgctctggcgccgctttttggacaacaaggtgctgctgtcctttggcaaggccttcgagtgtaaagagcctggttggtttcgctttgtcttctcagaccaggtccaccggctttgcctggggatgcagagggtccagcaggtgcttgcaggcaaatcccaagtggcagaagacccccgtccctctcagagccaggagccaagtgaccaacgcaggtgagctggtcattgtctcgtggccagagggcccagcagccactgtggacctggggcgttctggggctgcagaagactgactgtggatgtgccatttgccaggaaggtatctaacttggctttgtgcctgaagaactgtttcttgtctttcgctgtagcagtgggaaactccttaagctgtggttcagcctgggccctccctctctcctattaaacaaaactaggagagtccatatgtctccattgtgagttatttagaatggaggagtcgtgactgcttctaaccagagcctcagcccccctgaggatgtgaaaagaaaacaaacaacttgtaccttctttctgatatcaccgtcattcctctttctttgtcaccaaggaaacgagtcaaaggaacagcacatacaggagagtttgtagaaaaataaaaaaaagtgataacttccaaactc

SEQ ID NO: 449170 - DNA, 1685 bp, Homo sapiens
cctccagctccgccaagtaggtgggatccactactttgcagaggaggaagccgttcaggcctccctctgtgcactttgcaaaagcctctgcccttccatctcgaatcccttggcgccgatcacacttcctctgcctggaaacctggagccgtctctcgcgagacgtcctccgccctgtagaaggccgtttcggttcttcgtgcgcggtagccgccccacttgcgggattccaaggcctcatcgagtgcgggtatctggctgtggattcgccgccgtcctgctggacgcctggaggctcgaaccccgccgcccccctaccccaggctttactcccaccccggcttccgcccactgtgctgcccttcctcggacctgggctgtcgggagagctggagatgttcacccttcctcaaaaggacttcagggctcccaccacctgtctgggccccacctgcatgcaggacctgggcagtagccatggggaagatctggaaggagaatgctccagaaaactggaccagaagctgccagagctccgtggagtgggtgatcctgccatgatctcctctaatacctcctacctgtcctctagaggaagaatgattaaatggttctgggattcagctgaggagggctacaggacctaccacatggatgagtatgatgaggacaagaaccccagtggcatcattaacttgggcaccagtgagaacaaactctgctttgacctgctgtcctggcggctgagtcagcgcgacatgcagagggtggagccatccctgctgcagtatgctgactggaggggacatctgttcctccgggaggaagtggccaagttcctgtctttctactgcaagagcccagtacccctcagaccagagaatgtggttgtcctgaatggtggtgcctcgctcttctctgctctggccacggtgctgtgtgaggccggggaggctttcctgatccccaccccttactatggcgctatcacacagcacgtgtgtctctatggcaacatccggctggcctatgtctacctggacagtgaggtcactgggctagacacacgccccttccagctcacagtggagaagctggagatggccctgagagaagctcactctgagggtgtgaaggtcaaaggcctcatcctcatcagcccccagaaccctctgggtgatgtatactcccctgaagagctacaggagtacctggtatttgccaagaggcacaggctgcatgtgattgtggatgaggtctacatgctgtccgtgtttgagaagtctgttgggtaccgcagtgtcctaagcctggaaaggctccctgacccccagaggacccatgtgatgtgggcaaccagcaaggacttcgggatgtctgggctccgctttggcacgctgtacacagaaaaccaggatgtggccactgccgtggcttccctctgccgctaccacggcctcagtggcttggtccagtaccagatggcacagctgctccgggaccgtgactggatcaaccaggtgtacctgccggaaaaccatgcccggctcaaggctgcccacacctatgtctcagaagagcttagggcattggggatccccttcttgagtcgtggggctggcttcttcatctgggttgacttgagaaagattcagaggtcaagcactatgcagcatggtaccgct

SEQ ID NO: 449171 - DNA, 362 bp, Homo sapiens
aaaggcttggagagggactggggacagtggacagagggtctggggtgttctggccagaaagtgacaggccctcgcccactcctgcccccagaggctttcctgatccccaccccttactatggcgctatcacacagcacgtgtgtctctatggcaacatccggctggcctatgtctacctggacagtgaggtaagagtcttgacttcctaggtggaacctgggcctgcctgtggtcaagagtttcctgggtctgaatttgagggtggtccatgctgagggctctggggttgtgatgagtagggaatggagccttctgttgctgcatggctgcctgtgcctgggttccccagtggctccaaagt

SEQ ID NO: 449172 - DNA, 549 bp, Homo sapiens
acggggcactaagacaaaacaagccaataaagtcaccagcagtattactatcagcaccactgcaggataaccgaactcaaggcttaattaacggggcactaaacaaaacaaccaataaagtcaccagcagtattactatcacaccaacagccacacctcttcctcgacaatcacaaattacagtaagtaatatatataactgaccacgctcaccctcatccagtccatactgatatttttgcaaggaactcaatccttttttaatcatccctccatatcccccaagactgactgaactcgtactttgggaaggtttgtgcatgaactatacaagagtatctgaaactaactgttgcctgcatagtcatatcgagtgtgcacttactgtatatcttttcatttacatacttgtatggaaaatatttagtctgcacttgtataaatacatctttatgtatttcattttccataactcactttaatttgactgcaacttgtcttggtgaaatactttaacattataaaacagtaaataatttgttattttta

SEQ ID NO: 449173 - DNA, 450 bp, Homo sapiens
gcctcccagagtgctgggattacaggcgtgagccaccgcgcccggcctagaaggaggattgagggataaagagaaggtaagagttttgaaggtgatttcaactctttgaatccaagtagctgggagaatgggaataacacaactgagctaggatcacaggaaaagaagaaggtccaggtatgccggcatacctgaccttctggcatacctggaccatctagtcctaagccacacacctgggcagccacttcatataaaggttactccagaccatgtacaaaacacagccactcttgaaatcacaagtccaaccacagagagtcctcactcttacacgagtactgcagtgataccgaactgtggcacgccaaagcaaaggatctgtccacgaactcccccaaagataccctatttttatacagggtatctgtagaagtccagtaagccggg

SEQ ID NO: 449174 - DNA, 3349 bp, Homo sapiens
cgcagcgcggcactacagcggccccggcccggcccccgcccggccccggcgcaggcagttcagattaaagaagctaattgatcaagaaatcaagtctcaggaggagaaggagcaagaaaaggagaaaagggtcaccaccctgaaagaggagctgaccaagctgaagtcttttgctttgatggtggtggatgaacagcaaaggctgacggcacagctcacccttcaaagacagaaaatccaagagctgaccacaaatgcaaaggaaacacataccaaactagcccttgctgaagccagagttcaggaggaagagcagaaggcaaccagactagagaaggaactgcaaacgcagaccacaaagtttcaccaagaccaagacacaattatggcgaagctcaccaatgaggacagtcaaaatcgccagcttcaacaaaagctggcagcactcagccggcagattgatgagttagaagagacaaacaggtctttacgaaaagcagaagaggagctgcaagatataaaagaaaaaatcagtaagggagaatatggaaacgctggtatcatggctgaagtggaagaagctcataaaaatggaggagcagtgcagagatctcaataagaggcttgaaagggagacgttacagagtaaagactttaaactagaggttgaaaaactcagtaaaagaattatggctctggaaaagttagaagacgctttcaacaaaagcaaacaagaatgctactctctgaaatgcaatttagaaaaagaaaggatgaccacaaagcagttgtctcaagaactggagagtttaaaagtaaggatcaaagagctagaagccattgaaagtcggctagaaaagacagaattcactctaaaagaggatttaactaaactgaaaacattaactgtgatgtttgtagatgaacggaaaacaatgagtgaaaaattaaagaaaactgaagataaattacaagctgcttcttctcagcttcaagtggagcaaaataaagtaacaacagttactgagaagttaattgaggaaactaaaagggcgctcaagtccaaaaccgatgtagaagaaaagatgtacagcgtaaccaaggagagagatgatttaaaaaacaaattgaaagcggaagaagagaaaggaaatgatctcctgtcaagagttaatatgttgaaaaataggcttcaatcattggaagcaattgagaaagatttcctaaaaaacaaattaaatcaagactctgggaaatccacaacagcattacaccaagaaaacaataagattaaggagctctctcaagaagtggaaagactgaaactgaagctaaaggacatgaaagccattgaggatgacctcatgaaaacagaagatgaatatgagactctagaacgaaggtatgctaatgaacgagacaaagctcaatttttatctaaagagctagaacatgttaaaatggaacttgctaagtacaagttagcagaaaagacagagaccagccatgaacaatggcttttcaaaaggcttcaagaagaagaagctaagtcagggcacctctcaagagaagtggatgcattaaaagagaaaattcatgaatacatggcaactgaagacctaatatgtcacctccagggagatcactcagtcctgcaaaaaaaactaaatcaacaagaaaacaggaacagagatttaggaagagagattgaaaacctcactaaggagttagagaggtaccggcatttcagtaagagcctcaggcctagtctcaatggaagaagaatttccgatcctcaagtattttctaaagaagttcagacagaagcagtagacaatgaaccacctgattacaagagcctcattcctctggaacgtgcagtcatcaatggtcagttatatgaggagagtgagaatcaagacgaggaccctaatgatgagggatctgtgctgtccttcaaatgcagccagtctactccatgtcctgttaacagaaagctatggattccctggatgaaatccaaggagggccatcttcagaatggaaaaatgcaaactaaacccaatgccaactttgtgcaacctggagatctagtcctaagccacacacctgggcagccacttcatataaaggttactccagaccatgtacaaaacacagccactcttgaaatcacaagtccaaccacagagagtcctcactcttacacgagtactgcagtgataccgaactgtggcacgccaaagcaaaggataaccatcctccaaaacgcctccataacaccagtaaagtccaaaacctctaccgaagacctcatgaatttagaacaaggcatgtccccaattaccatggcaacctttgccagagcacagaccccagagtcttgtggttctctaactccagaaaggacaatgtcccctattcaggttttggctgtgactggttcagctagctctcctgagcagggacgctccccagaaccaacagaaatcagtgccaagcatgcgatattcagagtctccccagaccggcagtcatcatggcagtttcagcgttcaaacagcaatagctcaagtgtgataactactgaggataataaaatccacattcacttaggaagtccttacatgcaagctgtagccagcccttcagcaccactgcaggataaccgaactcaaggcttaattaacggggcactaaacaaaacaaccaataaagtcaccagcagtattactatcacaccaacagccacacctcttcctcgacaatcacaaattacagtaagtaatatatataactgaccacgctcaccctcatccagtccatactgatatttttgcaaggaactcaatccttttttaatcatccctccatatcccccaagactgactgaactcgtactttgggaaggtttgtgcatgaactatacaagagtatctgaaactaactgttgcctgcatagtcatatcgagtgtgcacttactgtatatcttttcatttacatacttgtatggaaaatatttagtctgcacttgtataaatacatctttatgtatttcattttccataactcactttaatttgactgcaacttgtcttggtgaaatactttaacattataaaacagtaaataatttgttatttttaccattgcttgctgaattttcttttggtcattctgtgttatatttctgcatgtacaatagaattttgtcttttgcttatagtctctattaattcttccttaaaaacaaacaggacctatgtcccatttatggtcaacttctaatcacatattagaggagagaaaagtggttcaaataaataaaaattacatctctttgatttc

SEQ ID NO: 449175 - DNA, 712 bp, Homo sapiens
atcagagcaccgatttcgagtggcccgaacaatgaacatagtgccaagcatgcgatattcagagtctccccagaccggcagtcatcatggcagtttcagcgttcaaacagcaatagctcaagtgtgataactactgaggataataaaatccacattcacttaggaagtccttacatgcaagctgtagccagccctgtgagacctgccagcccttcagcaccactgcaggataaccgaactcaaggcttaattaacggggcactaaacaaaacaaccaataaagtcaccagcagtattactatcacaccaacagccacacctcttcctcgacaatcacaaattacagtaagtaatatatataactgaccacgctcaccctcatccagtccatactgatatttttgcaaggaactcaatccttttttaatcatccctccatatcccccaagactgactgaactcgtactttgggaaggtttgtgcatgaactatacaagagtatctgaaactaactgttgcctgcatagtcatatcgagtgtgcacttactgtatatcttttcatttacatacttgtatggaaaatatttagtctgcacttgtataaatacatctttatgtatttcattttccataactcactttaatttgactgcaacttgtcttggtgaaatactttaacattataaaacagtaaataatttgttattttta

SEQ ID NO: 449176 - DNA, 2996 bp, Homo sapiens
cgcagcgcggcactacagcggccccggcccggcccccgcccggccccggcgcaggcagttcagattaaagaagctaattgatcaagaaatcaagtctcaggaggagaaggagcaagaaaaggagaaaagggtcaccaccctgaaagaggagctgaccaagctgaagtcttttgctttgatggtggtggatgaacagcaaaggctgacggcacagctcacccttcaaagacagaaaatccaagagctgaccacaaatgcaaaggaaacacataccaaactagcccttgctgaagccagagttcaggaggaagagcagaaggcaaccagactagagaaggaactgcaaacgcagaccacaaagtttcaccaagaccaagacacaattatggcgaagctcaccaatgaggacagtcaaaatcgccagcttcaacaaaagctggcagcactcagccggcagattgatgagttagaagagacaaacaggtctttacgaaaagcagaagaggagctgcaagatataaaagaaaaaatcagtaagggagaatatggaaacgctggtatcatggctgaagtggaagagctcaggaaacgtgtgctagatatggaagggaaagatgaagagctcataaaaatggaggagcagtgcagagatctcaataagaggcttgaaagggagacgttacagagtaaagactttaaactagaggttgaaaaactcagtaaaagaattatggctctggaaaagttagaagacgctttcaacaaaagcaaacaagaatgctactctctgaaatgcaatttagaaaaagaaaggatgaccacaaagcagttgtctcaagaactggagagtttaaaagtaaggatcaaagagctagaagccattgaaagtcggctagaaaagacagaattcactctaaaagaggatttaactaaactgaaaacattaactgtgatgtttgtagatgaacggaaaacaatgagtgaaaaattaaagaaaactgaagataaattacaagctgcttcttctcagcttcaagtggagcaaaataaagtaacaacagttactgagaagttaattgaggaaactaaaagggcgctcaagtccaaaaccgatgtagaagaaaagatgtacagcgtaaccaaggagagagatgatttaaaaaacaaattgaaagcggaagaagagaaaggaaatgatctcctgtcaagagttaatatgttgaaaaataggcttcaatcattggaagcaattgagaaagatttcctaaaaaacaaattaaatcaagactctgggaaatccacaacagcattacaccaagaaaacaataagattaaggagctctctcaagaagtggaaagactgaaactgaagctaaaggacatgaaagccattgaggatgacctcatgaaaacagaagatgaatatgagactctagaacgaaggtatgctaatgaacgagacaaagctcaatttttatctaaagagctagaacatgttaaaatggaacttgctaagtacaagttagcagaaaagacagagaccagccatgaacaatggcttttcaaaaggcttcaagaagaagaagctaagtcagggcacctctcaagagaagtggatgcattaaaagagaaaattcatgaatacatggcaactgaagacctaatatgtcacctccagggagatcactcagtcctgcaaaaaaaactaaatcaacaagaaaacaggaacagagatttaggaagagagattgaaaacctcactaaggagttagagaggtaccggcatttcagtaagagcctcaggcctagtctcaatggaagaagaatttccgatcctcaagtattttctaaagaagttcagacagaagcagtagacaatgaaccacctgattacaagagcctcattcctctggaacgtgcagtcatcaatggtcagttatatgaggagagtgagaatcaagacgaggaccctaatgatgagggatctgtgctgtccttcaaatgcagccagtctactccatgtcctgttaacagaaagctatggattccctggatgaaatccaaggagggccatcttcagaatggaaaaatgcaaactaaacccaatgccaactttgtgcaacctggagatctagtcctaagccacacacctgggcagccacttcatataaaggttactccagaccatgtacaaaacacagccactcttgaaatcacaagtccaaccacagagagtcctcactcttacacgagtactgcagtgataccgaactgtggcacgccaaagcaaaggataaccatcctccaaaacgcctccataacaccagtaaagtccaaaacctctaccgaagacctcatgaatttagaacaaggcatgtccccaattaccatggcaacctttgccagagcacagaccccagagtcttgtggttctctaactccagaaaggacaatgtcccctattcaggttttggctgtgactggttcagctagctctcctgagcagggacgctccccagaaccaacagaaatcagtgccaagcatgcgatattcagagtctccccagaccggcagtcatcatggcagtttcagcgttcaaacagcaatagctcaagtgtgataactactgaggataataaaatccacattcacttaggaagtccttacatgcaagctgtagccagccctgtgagacctgccagcccttcagcaccactgcaggataaccgaactcaaggctcatggacaatgaccgaagcctaaacgcactaagcaaggcccgggatcgaacccacatccgtaatggatactattagggatcttaacccactgagccacaatgggaacttccaacattctttggtactgtgacatttttatcattaaaatgtctctttctgtgcttaattgcgaaaaaatcaaccttgatatgaaaccttgaaattattgtaatttaaaaatattaaatcctgatatgccattcttgcaggggatc

SEQ ID NO: 449177 - DNA, 3147 bp, Homo sapiens
cgcagcgcggcactacagcggccccggcccggcccccgcccggccccggcgcaggcagttcagattaaagaagctaattgatcaagaaatcaagtctcaggaggagaaggagcaagaaaaggagaaaagggtcaccaccctgaaagaggagctgaccaagctgaagtcttttgctttgatggtggtggatgaacagcaaaggctgacggcacagctcacccttcaaagacagaaaatccaagagctgaccacaaatgcaaaggaaacacataccaaactagcccttgctgaagccagagttcaggaggaagagcagaaggcaaccagactagagaaggaactgcaaacgcagaccacaaagtttcaccaagaccaagacacaattatggcgaagctcaccaatgaggacagtcaaaatcgccagcttcaacaaaagctggcagcactcagccggcagattgatgagttagaagagacaaacaggtctttacgaaaagcagaagaggagctgcaagatataaaagaaaaaatcagtaagggagaatatggaaacgctggtatcatggctgaagtggaagaagctcataaaaatggaggagcagtgcagagatctcaataagaggcttgaaagggagacgttacagagtaaagactttaaactagaggttgaaaaactcagtaaaagaattatggctctggaaaagttagaagacgctttcaacaaaagcaaacaagaatgctactctctgaaatgcaatttagaaaaagaaaggatgaccacaaagcagttgtctcaagaactggagagtttaaaagtaaggatcaaagagctagaagccattgaaagtcggctagaaaagacagaattcactctaaaagaggatttaactaaactgaaaacattaactgtgatgtttgtagatgaacggaaaacaatgagtgaaaaattaaagaaaactgaagataaattacaagctgcttcttctcagcttcaagtggagcaaaataaagtaacaacagttactgagaagttaattgaggaaactaaaagggcgctcaagtccaaaaccgatgtagaagaaaagatgtacagcgtaaccaaggagagagatgatttaaaaaacaaattgaaagcggaagaagagaaaggaaatgatctcctgtcaagagttaatatgttgaaaaataggcttcaatcattggaagcaattgagaaagatttcctaaaaaacaaattaaatcaagactctgggaaatccacaacagcattacaccaagaaaacaataagattaaggagctctctcaagaagtggaaagactgaaactgaagctaaaggacatgaaagccattgaggatgacctcatgaaaacagaagatgaatatgagactctagaacgaaggtatgctaatgaacgagacaaagctcaatttttatctaaagagctagaacatgttaaaatggaacttgctaagtacaagttagcagaaaagacagagaccagccatgaacaatggcttttcaaaaggcttcaagaagaagaagctaagtcagggcacctctcaagagaagtggatgcattaaaagagaaaattcatgaatacatggcaactgaagacctaatatgtcacctccagggagatcactcagtcctgcaaaaaaaactaaatcaacaagaaaacaggaacagagatttaggaagagagattgaaaacctcactaaggagttagagaggtaccggcatttcagtaagagcctcaggcctagtctcaatggaagaagaatttccgatcctcaagtattttctaaagaagttcagacagaagcagtagacaatgaaccacctgattacaagagcctcattcctctggaacgtgcagtcatcaatggtcagttatatgaggagagtgagaatcaagacgaggaccctaatgatgagggatctgtgctgtccttcaaatgcagccagtctactccatgtcctgttaacagaaagctatggattccctggatgaaatccaaggagggccatcttcagaatggaaaaatgcaaactaaacccaatgccaactttgtgcaacctggagatctagtcctaagccacacacctgggcagccacttcatataaaggttactccagaccatgtacaaaacacagccactcttgaaatcacaagtccaaccacagagagtcctcactcttacacgagtactgcagtgataccgaactgtggcacgccaaagcaaaggataaccatcctccaaaacgcctccataacaccagtaaagtccaaaacctctaccgaagacctcatgaatttagaacaaggcatgtccccaattaccatggcaacctttgccagagcacagaccccagagtcttgtggttctctaactccagaaaggacaatgtcccctattcaggttttggctgtgactggttcagctagctctcctgagcagggacgctccccagaaccaacagaaatcagtgccaagcatgcgatattcagagtctccccagaccggcagtcatcatggcagtttcagcgttcaaacagcaatagctcaagtgtgataactactgaggataataaaatccacattcacttaggaagtccttacatgcaagctgtagccagcccttcagcaccactgcaggataaccgaactcaaggcttaattaacggggcactaaacaaaacaaccaataaagtcaccagcagtattactatcacaccaacagccacacctcttcctcgacaatcacaaattacagtaagtaatatatataactgaccacgctcaccctcatccagtccatactgatatttttgcaaggaactcaatccttttttaatcatccctccatatcccccaagactgactgaactcgtactttgggaaggtttgtgcatgaactatacaagagtatctgaaactaactgttgcctgcatagtcatatcgagtgtgcacttactgtatatcttttcatttacatacttgtatggaaaatatttagtctgcacttgtataaatacatctttatgtatttcattttccataactcactttaatttgactgcaacttgtcttggtgaaatactttaacattataaaacagtaaataatttgttattttta

SEQ ID NO: 449178 - DNA, 3206 bp, Homo sapiens
cgcagcgcggcactacagcggccccggcccggcccccgcccggccccggcgcaggcagttcagattaaagaagctaattgatcaagaaatcaagtctcaggaggagaaggagcaagaaaaggagaaaagggtcaccaccctgaaagaggagctgaccaagctgaagtcttttgctttgatggtggtggatgaacagcaaaggctgacggcacagctcacccttcaaagacagaaaatccaagagctgaccacaaatgcaaaggaaacacataccaaactagcccttgctgaagccagagttcaggaggaagagcagaaggcaaccagactagagaaggaactgcaaacgcagaccacaaagtttcaccaagaccaagacacaattatggcgaagctcaccaatgaggacagtcaaaatcgccagcttcaacaaaagctggcagcactcagccggcagattgatgagttagaagagacaaacaggtctttacgaaaagcagaagaggagctgcaagatataaaagaaaaaatcagtaagggagaatatggaaacgctggtatcatggctgaagtggaagagctcaggaaacgtgtgctagatatggaagggaaagatgaagagctcataaaaatggaggagcagtgcagagatctcaataagaggcttgaaagggagacgttacagagtaaagactttaaactagaggttgaaaaactcagtaaaagaattatggctctggaaaagttagaagacgctttcaacaaaagcaaacaagaatgctactctctgaaatgcaatttagaaaaagaaaggatgaccacaaagcagttgtctcaagaactggagagtttaaaagtaaggatcaaagagctagaagccattgaaagtcggctagaaaagacagaattcactctaaaagaggatttaactaaactgaaaacattaactgtgatgtttgtagatgaacggaaaacaatgagtgaaaaattaaagaaaactgaagataaattacaagctgcttcttctcagcttcaagtggagcaaaataaagtaacaacagttactgagaagttaattgaggaaactaaaagggcgctcaagtccaaaaccgatgtagaagaaaagatgtacagcgtaaccaaggagagagatgatttaaaaaacaaattgaaagcggaagaagagaaaggaaatgatctcctgtcaagagttaatatgttgaaaaataggcttcaatcattggaagcaattgagaaagatttcctaaaaaacaaattaaatcaagactctgggaaatccacaacagcattacaccaagaaaacaataagattaaggagctctctcaagaagtggaaagactgaaactgaagctaaaggacatgaaagccattgaggatgacctcatgaaaacagaagatgaatatgagactctagaacgaaggtatgctaatgaacgagacaaagctcaatttttatctaaagagctagaacatgttaaaatggaacttgctaagtacaagttagcagaaaagacagagaccagccatgaacaatggcttttcaaaaggcttcaagaagaagaagctaagtcagggcacctctcaagagaagtggatgcattaaaagagaaaattcatgaatacatggcaactgaagacctaatatgtcacctccagggagatcactcagtcctgcaaaaaaaactaaatcaacaagaaaacaggaacagagatttaggaagagagattgaaaacctcactaaggagttagagaggtaccggcatttcagtaagagcctcaggcctagtctcaatggaagaagaatttccgatcctcaagtattttctaaagaagttcagacagaagcagtagacaatgaaccacctgattacaagagcctcattcctctggaacgtgcagtcatcaatggtcagttatatgaggagagtgagaatcaagacgaggaccctaatgatgagggatctgtgctgtccttcaaatgcagccagtctactccatgtcctgttaacagaaagctatggattccctggatgaaatccaaggagggccatcttcagaatggaaaaatgcaaactaaacccaatgccaactttgtgcaacctggagatctagtcctaagccacacacctgggcagccacttcatataaaggttactccagaccatgtacaaaacacagccactcttgaaatcacaagtccaaccacagagagtcctcactcttacacgagtactgcagtgataccgaactgtggcacgccaaagcaaaggataaccatcctccaaaacgcctccataacaccagtaaagtccaaaacctctaccgaagacctcatgaatttagaacaaggcatgtccccaattaccatggcaacctttgccagagcacagaccccagagtcttgtggttctctaactccagaaaggacaatgtcccctattcaggttttggctgtgactggttcagctagctctcctgagcagggacgctccccagaaccaacagaaatcagtgccaagcatgcgatattcagagtctccccagaccggcagtcatcatggcagtttcagcgttcaaacagcaatagctcaagtgtgataactactgaggataataaaatccacattcacttaggaagtccttacatgcaagctgtagccagccctgtgagacctgccagcccttcagcaccactgcaggataaccgaactcaaggcttaattaacggggcactaaacaaaacaaccaataaagtcaccagcagtattactatcacaccaacagccacacctcttcctcgacaatcacaaattacagtaagtaatatatataactgaccacgctcaccctcatccagtccatactgatatttttgcaaggaactcaatccttttttaatcatccctccatatcccccaagactgactgaactcgtactttgggaaggtttgtgcatgaactatacaagagtatctgaaactaactgttgcctgcatagtcatatcgagtgtgcacttactgtatatcttttcatttacatacttgtatggaaaatatttagtctgcacttgtataaatacatctttatgtatttcattttccataactcactttaatttgactgcaacttgtcttggtgaaatactttaacattataaaacagtaaataatttgttattttta

SEQ ID NO: 449179 - DNA, 1191 bp, Homo sapiens
cgcagcgcggcactacagcggccccggcccggcccccgcccggccccggcgcaggcagttcagattaaagaagctaattgatcaagaaatcaagtctcaggaggagaaggagcaagaaaaggagaaaagggtcaccaccctgaaagaggagctgaccaagctgaagtcttttgctttgatggtggtggatgaacagcaaaggctgacggcacagctcacccttcaaagacagaaaatccaagagctgaccacaaatgcaaaggaaacacataccaaactagcccttgctgaagccagagttcaggaggaagagcagaaggcaaccagactagagaaggaactgcaaacgcagaccacaaagtttcaccaagaccaagacacaattatggcgaagctcaccaatgaggacagtcaaaatcgccagcttcaacaaaagctggcagcactcagccggcagattgatgagttagaagagacaaacaggtctttacgaaaagcagaagaggagctgcaagatataaaagaaaaaatcagtaagggagaatatggaaacgctggtatcatggctgaagtggaagagctcaggaaacgtgtgctagatatggaagggaaagatgaagagctcataaaaatggaggagcagtgcagagatctcaataagaggcttgaaagggagacgttacagagtaaagactttaaactagaggttgaaaaactcagtaaaagaattatggctctggaaaagttagaagacgctttcaacaaaagcaaacaagaatgctactctctgaaatgcaatttagaaaaagaaaggatgaccacaaagcagttgtctcaagaactggagagtttaaaagtaaggatcaaagagctagaagccattgaaagtcggctagaaaagacagaattcactctaaaagaggatttaactaaactgaaaacattaactgtgatgtttgtagatgaactatacaagagtatctgaaactaactgttgcctgcatagtcatatcgagtgtgcacttactgtatatcttttcatttacatacttgtatggaaaatatttagtctgcacttgtataaatacatctttatgtatttcattttccataactcactttaatttgactgcaacttgtcttggtgaaatactttaacattataaaacagtaaataatttgttattttta

SEQ ID NO: 449180 - DNA, 662 bp, Homo sapiens
gggagccgacgtcccgacgcctcccgcccccgcagttccttggagagcttggagccgcgcgccggagggaataggaaagcttggttacaacccgggacacccggagcttcaggatggttcgtactaagacatggaccctgaagaagcactttgttggctatcctactaatagtgactttgagttgaagacatctgagctcccacccttaaaaaatggagaggtcctgcttgaagctttgttcctcaccgtggatccctacatgagagtggcagccaaaagattgaaggaaggtgatacaatgatggggcagcaagtggccaagtaattatttccatttgtcccagtgcttggaaaatatgtctcctctttacctcctgctgggtcctgtctctgtccattgctcctacaatttcttcagcctatgttgttgactcactgtgtgatcttggaatcaacttgggaaattctgtctccttcctaactagctggaaaggagggaaggatgtgaaattgtcattttttcagcttcactttgccatccttacttttaattactaaaaaaaaaaacgtatttgtccaggtcatgatttattgcgggatctggccagcagcccacaatgcaacagggttctctctttgttcccaggtggatcggcaggtt

SEQ ID NO: 449181 - DNA, 770 bp, Homo sapiens
atacgcgcacacacacacacaaacgcactcagatttcccggaccctggttttcctcctgtgaccctttcggggccgggctctcaccctaaagaagcagccccgccctggggtggccccaccctctcttgggacctgtcataagtcggaccccgggcgcccggctgcgcagtcccagccgccttccccaggcagtggaaccttcgggctcctgagcttcaggatggttcgtactaagacatggaccctgaagaagcactttgttggctatcctactaatagtgactttgagttgaagacatctgagctcccacccttaaaaaatggagaggtcctgcttgaagctttgttcctcaccgtggatccctacatgagagtggcagccaaaagattgaaggaaggtgatacaatgatggggcagcaagtggccaagtaattatttccatttgtcccagtgcttggaaaatatgtctcctctttacctcctgctgggtcctgtctctgtccattgctcctacaatttcttcagcctatgttgttgactcactgtgtgatcttggaatcaacttgggaaattctgtctccttcctaactagctggaaaggagggaaggatgtgaaattgtcattttttcagcttcactttgccatccttacttttaattactaaaaaaaaaaacgtatttgtccaggtcatgatttattgcgggatctggccagcagcccacaatgcaacagggttctctctttgttcccaggtggatcggcaggtt

SEQ ID NO: 449182 - DNA, 716 bp, Homo sapiens
atacgcgcacacacacacacaaacgcactcagatttcccggaccctggttttcctcctgtgaccctttcggggccgggctctcaccctaaagaagcagccccgccctggggtggccccaccctctcttgggacctgtcataagtcggaccccgggcgcccggctgcgcagtcccagccgccttccccaggcagtggaaccttcgggctcctgagcttcaggatggttcgtactaagacatggaccctgaagaagcactttgttggctatcctactaatagtgactttgagttgaagacatctgagctcccacccttaaaaaatggagaggtcctgcttgaagctttgttcctcaccgtggatccctacatgagagtggcagccaaaagattgaaggaaggtgatacaatgatggggcagcaagtggccaagtaattatttccatttgtcccagtgcttggaaaatttcttcagcctatgttgttgactcactgtgtgatcttggaatcaacttgggaaattctgtctccttcctaactagctggaaaggagggaaggatgtgaaattgtcattttttcagcttcactttgccatccttacttttaattactaaaaaaaaaaacgtatttgtccaggtcatgatttattgcgggatctggccagcagcccacaatgcaacagggttctctctttgttcccaggtggatcggcaggtt

SEQ ID NO: 449183 - DNA, 1758 bp, Homo sapiens
atacgcgcacacacacacacaaacgcactcagatttcccggaccctggttttcctcctgtgaccctttcggggccgggctctcaccctaaagaagcagccccgccctggggtggccccaccctctcttgggacctgtcataagtcggaccccgggcgcccggctgcgcagtcccagccgccttccccaggcagtggaaccttcgggctcctgagcttcaggatggttcgtactaagacatggaccctgaagaagcactttgttggctatcctactaatagtgactttgagttgaagacatctgagctcccacccttaaaaaatggagaggtcctgcttgaagctttgttcctcaccgtggatccctacatgagagtggcagccaaaagattgaaggaaggtgatacaatgatggggcagcaagtggccaaagttgtggaaagtaaaaatgtagccctaccaaaaggaactattgtactggcttctccaggctggacaacgcactccatttctgatgggaaagatctggaaaagctgctgacagagtggccagacacaataccactgtctttggctctggggacagttggcatgccaggcctgactgcctactttggcctacttgaaatctgtggtgtgaagggtggagaaacagtgatggttaatgcagcagctggagctgtgggctcagtcgtggggcagattgcaaagctcaagggctgcaaagttgttggagcagtagggtctgatgaaaaggttgcctaccttcaaaagcttggatttgatgtcgtctttaactacaagacggtagagtctttggaagaaaccttgaagaaagcgtctcctgatggttatgattgttattttgataatgtaggtggagagttttcaaacactgttatcggccagatgaagaaatttggaaggattgccatatgtggagccatctctacatataacagaaccggcccacttcccccaggcccacccccagagattgttatctatcaggagcttcgcatggaagcttttgtcgtctaccgctggcaaggagatgcccgccaaaaagctctgaaggacttgctgaaatgggtcttagagggtaaaatccagtacaaggaatatatcattgaaggatttgaaaacatgccagctgcatttatgggaatgctgaaaggagataatttggggaagacaatagtgaaagcatgaaaaagaggacacatggaatctggaggccatttagatgattagttaatttgtttttcaccatttagcaaaaatgtatactaccttaaatgtcttaagaaatagtactcataatgagtttgagctacttaataaaatacatttaagtggtatgtaattagtgatggaggatggaagtttcaaagtcaacaacaaccagtcacctcactgttcactacagcttcttctgagttgtggtagaaaataatggctttgaagtgtgaaaattttccaaacactgtatgttttcattcataagtgggagctgaacaatgagaacacatggacatagggaggggaacaacacacgctggggcctgtggaagccggggtgagggagggagagcatcaggataaatagctaatgccttcgggggctaatacctaggtgatgggttgacaggtgaagcaaaccaccatggcacacgtttacctatgtaacaaacctgcacattccacacaattatcccggaactgaaaataaaataaaattaaattaaaaaaaaaagtt

SEQ ID NO: 449184 - DNA, 1756 bp, Homo sapiens
gggagccgacgtcccgacgcctcccgcccccgcagttccttggagagcttggagccgcgcgccggagggaataggaaagcttggttacaacccgggacacccggagcttcaggatggttcgtactaagacatggaccctgaagaagcactttgttggctatcctactaatagtgactttgagttgaagacatctgagctcccacccttaaaaaatggagaggtcctgcttgaagctttgttcctcaccgtggatccctacatgagagtggcagccaaaagattgaaggaaggtgatacaatgatggggcagcaagtggccaaagttgtggaaagtaaaaatgtagccctaccaaaaggaactattgtactggcttctccaggctggacaacgcactccatttctgatgggaaagatctggaaaagctgctgacagagtggccagacacaataccactgtctttggctctggggacagttggcatgccaggcctgactgcctactttggcctacttgaaatctgtggtgtgaagggtggagaaacagtgatggttaatgcagcagctggagctgtgggctcagtcgtggggcagattgcaaagctcaagggctgcaaagttgttggagcagtagggtctgatgaaaaggttgcctaccttcaaaagcttggatttgatgtcgtctttaactacaagacggtagagtctttggaagaaaccttgaagaaagcgtctcctgatggttatgattgttattttgataatgtaggtggagagttttcaaacactgttatcggccagatgaagaaatttggaaggattgccatatgtggagccatctctacatataacagaaccggcccacttcccccaggcccacccccagagattgttatctatcaggagcttcgcatggaagcttttgtcgtctaccgctggcaaggagatgcccgccaaaaagctctgaaggacttgctgaaatgggtcttagagcttccctactttgtaattgactgacttcaagcaaataatcttgtctataaatccatgaagagtgctaagccatcactggaatacattagcgaaaaacttgtatcagggtaaaatccagtacaaggaatatatcattgaaggatttgaaaacatgccagctgcatttatgggaatgctgaaaggagataatttggggaagacaatagtgaaagcatgaaaaagaggacacatggaatctggaggccatttagatgattagttaatttgtttttcaccatttagcaaaaatgtatactaccttaaatgtcttaagaaatagtactcataatgagtttgagctacttaataaaatacatttaagtggtatgtaattagtgatggaggatggaagtttcaaagtcaacaacaaccagtcacctcactgttcactacagcttcttctgagttgtggtagaaaataatggctttgaagtgtgaaaattttccaaacactgtatgttttcattcataagtgggagctgaacaatgagaacacatggacatagggaggggaacaacacacgctggggcctgtggaagccggggtgagggagggagagcatcaggataaatagctaatgccttcgggggctaatacctaggtgatgggttgacaggtgaagcaaaccaccatggcacacgtttacctatgtaacaaacctgcacattccacacaattatcccggaactgaaaataaaataaaattaaattaaaaaaaaaagtt

SEQ ID NO: 449185 - DNA, 1807 bp, Homo sapiens
atacgcgcacacacacacacaaacgcactcagatttcccggaccctggttttcctcctgtgaccctttcggggccgggctctcaccctaaagaagcagccccgccctggggtggccccaccctctcttgggacctgtcataagtcggaccccgggcgcccggctgcgcagtcccagccgccttccccaggcagtggaaccttcgggctcctgagcttcaggatggttcgtactaagacatggaccctgaagaagcactttgttggctatcctactaatagtgactttgagttgaagacatctgagctcccacccttaaaaaatggagaggtcctgcttgaagctttgttcctcaccgtggatccctacatgagagttgtggaaagtaaaaatgtagccctaccaaaaggaactattgtactggcttctccaggctggacaacgcactccatttctgatgggaaagatctggaaaagctgctgacagagtggccagacacaataccactgtctttggctctggggacagttggcatgccaggcctgactgcctactttggcctacttgaaatctgtggtgtgaagggtggagaaacagtgatggttaatgcagcagctggagctgtgggctcagtcgtggggcagattgcaaagctcaagggctgcaaagttgttggagcagtagggtctgatgaaaaggttgcctaccttcaaaagcttggatttgatgtcgtctttaactacaagacggtagagtctttggaagaaaccttgaagaaagcgtctcctgatggttatgattgttattttgataatgtaggtggagagttttcaaacactgttatcggccagatgaagaaatttggaaggattgccatatgtggagccatctctacatataacagaaccggcccacttcccccaggcccacccccagagattgttatctatcaggagcttcgcatggaagcttttgtcgtctaccgctggcaaggagatgcccgccaaaaagctctgaaggacttgctgaaatgggtcttagagcttccctactttgtaattgactgacttcaagcaaataatcttgtctataaatccatgaagagtgctaagccatcactggaatacattagcgaaaaacttgtatcagggtaaaatccagtacaaggaatatatcattgaaggatttgaaaacatgccagctgcatttatgggaatgctgaaaggagataatttggggaagacaatagtgaaagcatgaaaaagaggacacatggaatctggaggccatttagatgattagttaatttgtttttcaccatttagcaaaaatgtatactaccttaaatgtcttaagaaatagtactcataatgagtttgagctacttaataaaatacatttaagtggtatgtaattagtgatggaggatggaagtttcaaagtcaacaacaaccagtcacctcactgttcactacagcttcttctgagttgtggtagaaaataatggctttgaagtgtgaaaattttccaaacactgtatgttttcattcataagtgggagctgaacaatgagaacacatggacatagggaggggaacaacacacgctggggcctgtggaagccggggtgagggagggagagcatcaggataaatagctaatgccttcgggggctaatacctaggtgatgggttgacaggtgaagcaaaccaccatggcacacgtttacctatgtaacaaacctgcacattccacacaattatcccggaactgaaaataaaataaaattaaattaaaaaaaaaagtt

SEQ ID NO: 449186 - DNA, 1519 bp, Homo sapiens
caacactaaccacacagcatcctgactcccttgaaagggaagacatgtcacatgccttaatgccttaatgtgctttatctttcagagttgtggaaagtaaaaatgtagccctaccaaaaggaactattgtactggcttctccaggctggacaacgcactccatttctgatgggaaagatctggaaaagctgctgacagagtggccagacacaataccactgtctttggctctggggacagttggcatgccaggcctgactgcctactttggcctacttgaaatctgtggtgtgaagggtggagaaacagtgatggttaatgcagcagctggagctgtgggctcagtcgtggggcagattgcaaagctcaagggctgcaaagttgttggagcagtagggtctgatgaaaaggttgcctaccttcaaaagcttggatttgatgtcgtctttaactacaagacggtagagtctttggaagaaaccttgaagaaagcgtctcctgatggttatgattgttattttgataatgtaggtggagagttttcaaacactgttatcggccagatgaagaaatttggaaggattgccatatgtggagccatctctacatataacagaaccggcccacttcccccaggcccacccccagagattgttatctatcaggagcttcgcatggaagcttttgtcgtctaccgctggcaaggagatgcccgccaaaaagctctgaaggacttgctgaaatgggtcttagagcttccctactttgtaattgactgacttcaagcaaataatcttgtctataaatccatgaagagtgctaagccatcactggaatacattagcgaaaaacttgtatcagggtaaaatccagtacaaggaatatatcattgaaggatttgaaaacatgccagctgcatttatgggaatgctgaaaggagataatttggggaagacaatagtgaaagcatgaaaaagaggacacatggaatctggaggccatttagatgattagttaatttgtttttcaccatttagcaaaaatgtatactaccttaaatgtcttaagaaatagtactcataatgagtttgagctacttaataaaatacatttaagtggtatgtaattagtgatggaggatggaagtttcaaagtcaacaacaaccagtcacctcactgttcactacagcttcttctgagttgtggtagaaaataatggctttgaagtgtgaaaattttccaaacactgtatgttttcattcataagtgggagctgaacaatgagaacacatggacatagggaggggaacaacacacgctggggcctgtggaagccggggtgagggagggagagcatcaggataaatagctaatgccttcgggggctaatacctaggtgatgggttgacaggtgaagcaaaccaccatggcacacgtttacctatgtaacaaacctgcacattccacacaattatcccggaactgaaaataaaataaaattaaattaaaaaaaaaagtt

SEQ ID NO: 449187 - DNA, 944 bp, Homo sapiens
atattaaccgtatgtccaatacggtccatccctcttttgaatattgttaaaatttatttcagcccacccccagagattgttatctatcaggagcttcgcatggaagcttttgtcgtctaccgctggcaaggagatgcccgccaaaaagctctgaaggacttgctgaaatgggtcttagagcttccctactttgtaattgactgacttcaagcaaataatcttgtctataaatccatgaagagtgctaagccatcactggaatacattagcgaaaaacttgtatcagggtaaaatccagtacaaggaatatatcattgaaggatttgaaaacatgccagctgcatttatgggaatgctgaaaggagataatttggggaagacaatagtgaaagcatgaaaaagaggacacatggaatctggaggccatttagatgattagttaatttgtttttcaccatttagcaaaaatgtatactaccttaaatgtcttaagaaatagtactcataatgagtttgagctacttaataaaatacatttaagtggtatgtaattagtgatggaggatggaagtttcaaagtcaacaacaaccagtcacctcactgttcactacagcttcttctgagttgtggtagaaaataatggctttgaagtgtgaaaattttccaaacactgtatgttttcattcataagtgggagctgaacaatgagaacacatggacatagggaggggaacaacacacgctggggcctgtggaagccggggtgagggagggagagcatcaggataaatagctaatgccttcgggggctaatacctaggtgatgggttgacaggtgaagcaaaccaccatggcacacgtttacctatgtaacaaacctgcacattccacacaattatcccggaactgaaaataaaataaaattaaattaaaaaaaaaagtt

SEQ ID NO: 449188 - DNA, 934 bp, Homo sapiens
ttatcaggttttaaacaaaattacattcatccaatactacattaactttgagcccacccccagagattgttatctatcaggagcttcgcatggaagcttttgtcgtctaccgctggcaaggagatgcccgccaaaaagctctgaaggacttgctgaaatgggtcttagagcttccctactttgtaattgactgacttcaagcaaataatcttgtctataaatccatgaagagtgctaagccatcactggaatacattagcgaaaaacttgtatcagggtaaaatccagtacaaggaatatatcattgaaggatttgaaaacatgccagctgcatttatgggaatgctgaaaggagataatttggggaagacaatagtgaaagcatgaaaaagaggacacatggaatctggaggccatttagatgattagttaatttgtttttcaccatttagcaaaaatgtatactaccttaaatgtcttaagaaatagtactcataatgagtttgagctacttaataaaatacatttaagtggtatgtaattagtgatggaggatggaagtttcaaagtcaacaacaaccagtcacctcactgttcactacagcttcttctgagttgtggtagaaaataatggctttgaagtgtgaaaattttccaaacactgtatgttttcattcataagtgggagctgaacaatgagaacacatggacatagggaggggaacaacacacgctggggcctgtggaagccggggtgagggagggagagcatcaggataaatagctaatgccttcgggggctaatacctaggtgatgggttgacaggtgaagcaaaccaccatggcacacgtttacctatgtaacaaacctgcacattccacacaattatcccggaactgaaaataaaataaaattaaattaaaaaaaaaagtt

SEQ ID NO: 449189 - DNA, 689 bp, Homo sapiens
  misc_feature (31)..(31): n is a, c, g, or t
gcggccgctcccacttcagcaagtccttcanggtaaaatccagtacaaggaatatatcattgaaggatttgaaaacatgccagctgcatttatgggaatgctgaaaggagataatttggggaagacaatagtgaaagcatgaaaaagaggacacatggaatctggaggccatttagatgattagttaatttgtttttcaccatttagcaaaaatgtatactaccttaaatgtcttaagaaatagtactcataatgagtttgagctacttaataaaatacatttaagtggtatgtaattagtgatggaggatggaagtttcaaagtcaacaacaaccagtcacctcactgttcactacagcttcttctgagttgtggtagaaaataatggctttgaagtgtgaaaattttccaaacactgtatgttttcattcataagtgggagctgaacaatgagaacacatggacatagggaggggaacaacacacgctggggcctgtggaagccggggtgagggagggagagcatcaggataaatagctaatgccttcgggggctaatacctaggtgatgggttgacaggtgaagcaaaccaccatggcacacgtttacctatgtaacaaacctgcacattccacacaattatcccggaactgaaaataaaataaaattaaattaaaaaaaaaagtt

SEQ ID NO: 449190 - DNA, 724 bp, Homo sapiens
atacgcgcacacacacacacaaacgcactcagatttcccggaccctggttttcctcctgtgaccctttcggggccgggctctcaccctaaagaagcagccccgccctggggtggccccaccctctcttgggacctgtcataagtcggaccccgggcgcccggctgcgcagtcccagccgccttccccaggcagtggaaccttcgggctcctgagcttcaggatggttcgtactaagacatggaccctgaagaagcactttgttggctatcctactaatagtgactttgagttgaagacatctgagctcccacccttaaaaaatggagagtggcagccaaaagattgaaggaaggtgatacaatgatggggcagcaagtggccaagtaattatttccatttgtcccagtgcttggaaaatatgtctcctctttacctcctgctgggtcctgtctctgtccattgctcctacaatttcttcagcctatgttgttgactcactgtgtgatcttggaatcaacttgggaaattctgtctccttcctaactagctggaaaggagggaaggatgtgaaattgtcattttttcagcttcactttgccatccttacttttaattactaaaaaaaaaaacgtatttgtccaggtcatgatttattgcgggatctggccagcagcccacaatgcaacagggttctctctttgttcccaggtggatcggcaggtt

SEQ ID NO: 449191 - DNA, 402 bp, Homo sapiens
tgagcatggtacctcatgggtggtttctcaacccttgtccctgtctcacccctcctgtctagtggtgctcagtgtctattgttcctctcaggccttgagtttctaattgcctatggaatgctttattttgtagaggtcctgcttgaagctttgttcctcaccgtggatccctacatgaggtattatttatttcgcccctcaaaatgctaatgctgtgttaaatgctatctggaagtagttcatcttctaaaatatccaactgacttaaaacattgtcactttccttctgtttctcccagccagtatcagtgataagattcatgcacgctcgtcttttgcaggcaaaggtctaagtagcttagtgagggatcacctcagtccctttgtcccaaccatctccta

SEQ ID NO: 449192 - DNA, 311 bp, Homo sapiens
atcattgagaatattaaattaagttttaaaatttgttgttgctttgatacaggtaaaatccagtacaaggaatatatcattgaaggatttgaaaacatgccagctgcatttatgggaatgctgaaaggagataatttggggaagacaatagtgaaagcatgaaaaagaggacacatggaatctggaggccatttagatgattagttaatttgtttttcaccatttagcaaaaatgtatactaccttaaatgtcttaagaaatagtactcataatgagtttgagctacttaataaaatacatttaagtggta

SEQ ID NO: 449193 - DNA, 1416 bp, Homo sapiens
atacgcgcacacacacacacaaacgcactcagatttcccggaccctggttttcctcctgtgaccctttcggggccgggctctcaccctaaagaagcagccccgccctggggtggccccaccctctcttgggacctgtcataagtcggaccccgggcgcccggctgcgcagtcccagccgccttccccaggcagtggaaccttcgggctcctgagcttcaggatggttcgtactaagacatggaccctgaagaagcactttgttggctatcctactaatagtgactttgagttgaagacatctgagctcccacccttaaaaaatggagaggtcctgcttgaagctttgttcctcaccgtggatccctacatgagagtggcagccaaaagattgaaggaaggtgatacaatgatggggcagcaagtggccaaagttgtggaaagtaaaaatgtagccctaccaaaaggaactattgtactggcttctccaggctggacaacgcactccatttctgatgggaaagatctggaaaagctgctgacagagtggccagacacaataccactgtctttggctctggggacagttggcatgccaggcctgactgcctactttggcctacttgaaatctgtggtgtgaagggtggagaaacagtgatggttaatgcagcagctggagctgtgggctcagtcgtggggcagattgcaaagctcaagggctgcaaagttgttggagcagtagggtctgatgaaaaggttgcctaccttcaaaagcttggatttgatgtcgtctttaactacaagacggtagagtctttggaagaaaccttgaagaaagcgtctcctgatggttatgattgttattttgataatgtaggtggagagttttcaaacactgttatcggccagatgaagaaatttggaaggattgccatatgtggagccatctctacatataacagaaccggcccacttcccccaggcccacccccagagattgttatctatcaggagcttcgcatggaagcttttgtcgtctaccgctggcaaggagatgcccgccaaaaagctctgaaggacttgctgaaatgggtcttagagggtaaaatccagtacaaggaatatatcattgaaggatttgaaaacatgccagctgcatttatgggaatgctgaaaggagataatttggggaagacaatagtgaaagcatgaaaaagaggacacatggaatctggaggccatttagatgattagttaatttgtttttcaccatttagcaaaaatgtatactaccttaaatgtcttaagaaatagtactcataatgagtttgagctacttaataaaatacatttaagtggtaaaaaaacaaagaaacacgcctctggaatataaagacatcggccctctgggcctaaa

SEQ ID NO: 449194 - DNA, 1983 bp, Homo sapiens
atacgcgcacacacacacacaaacgcactcagatttcccggaccctggttttcctcctgtgaccctttcggggccgggctctcaccctaaagaagcagccccgccctggggtggccccaccctctcttgggacctgtcataagtcggaccccgggcgcccggctgcgcagtcccagccgccttccccaggcagtggaaccttcgggctcctgagcttcaggatggttcgtactaagacatggaccctgaagaagcactttgttggctatcctactaatagtgactttgagttgaagacatctgagctcccacccttaaaaaatggagaggtcctgcttgaagctttgttcctcaccgtggatccctacatgagagtggcagccaaaagattgaaggaaggtgatacaatgatggggcagcaagtggccaaccagttattataataccattggtagaaatcgtctatggatctttactggaatttcagtgaccttacagatttatttagaggaaactgacatctttacaatttctctctccaaacacaagagttgtggaaagtaaaaatgtagccctaccaaaaggaactattgtactggcttctccaggctggacaacgcactccatttctgatgggaaagatctggaaaagctgctgacagagtggccagacacaataccactgtctttggctctggggacagttggcatgccaggcctgactgcctactttggcctacttgaaatctgtggtgtgaagggtggagaaacagtgatggttaatgcagcagctggagctgtgggctcagtcgtggggcagattgcaaagctcaagggctgcaaagttgttggagcagtagggtctgatgaaaaggttgcctaccttcaaaagcttggatttgatgtcgtctttaactacaagacggtagagtctttggaagaaaccttgaagaaagcgtctcctgatggttatgattgttattttgataatgtaggtggagagttttcaaacactgttatcggccagatgaagaaatttggaaggattgccatatgtggagccatctctacatataacagaaccggcccacttcccccaggcccacccccagagattgttatctatcaggagcttcgcatggaagcttttgtcgtctaccgctggcaaggagatgcccgccaaaaagctctgaaggacttgctgaaatgggtcttagagcttccctactttgtaattgactgacttcaagcaaataatcttgtctataaatccatgaagagtgctaagccatcactggaatacattagcgaaaaacttgtatcagggtaaaatccagtacaaggaatatatcattgaaggatttgaaaacatgccagctgcatttatgggaatgctgaaaggagataatttggggaagacaatagtgaaagcatgaaaaagaggacacatggaatctggaggccatttagatgattagttaatttgtttttcaccatttagcaaaaatgtatactaccttaaatgtcttaagaaatagtactcataatgagtttgagctacttaataaaatacatttaagtggtatgtaattagtgatggaggatggaagtttcaaagtcaacaacaaccagtcacctcactgttcactacagcttcttctgagttgtggtagaaaataatggctttgaagtgtgaaaattttccaaacactgtatgttttcattcataagtgggagctgaacaatgagaacacatggacatagggaggggaacaacacacgctggggcctgtggaagccggggtgagggagggagagcatcaggataaatagctaatgccttcgggggctaatacctaggtgatgggttgacaggtgaagcaaaccaccatggcacacgtttacctatgtaacaaacctgcacattccacacaattatcccggaactgaaaataaaataaaattaaattaaaaaaaaaagtt

SEQ ID NO: 449195 - DNA, 1618 bp, Homo sapiens
atggattgcttgaattcaggagttcaagaccagcctgggaaacatggcaaaaccctgtctcttaaaaaaaccaaacatctcattctttatttttttaaattttgtgtctcaatgactagccagttattataataccattggtagaaatcgtctatggatctttactggaatttcagtgaccttacagatttatttagaggaaactgacatctttacaatttctctctccaaacacaagagttgtggaaagtaaaaatgtagccctaccaaaaggaactattgtactggcttctccaggctggacaacgcactccatttctgatgggaaagatctggaaaagctgctgacagacctgactgcctactttggcctacttgaaatctgtggtgtgaagggtggagaaacagtgatggttaatgcagcagctggagctgtgggctcagtcgtggggcagattgcaaagctcaagggctgcaaagttgttggagcagtagggtctgatgaaaaggttgcctaccttcaaaagcttggatttgatgtcgtctttaactacaagacggtagagtctttggaagaaaccttgaagaaagcgtctcctgatggttatgattgttattttgataatgtaggtggagagttttcaaacactgttatcggccagatgaagaaatttggaaggattgccatatgtggagccatctctacatataacagaaccggcccacttcccccaggcccacccccagagattgttatctatcaggagcttcgcatggaagcttttgtcgtctaccgctggcaaggagatgcccgccaaaaagctctgaaggacttgctgaaatgggtcttagagcttccctactttgtaattgactgacttcaagcaaataatcttgtctataaatccatgaagagtgctaagccatcactggaatacattagcgaaaaacttgtatcagggtaaaatccagtacaaggaatatatcattgaaggatttgaaaacatgccagctgcatttatgggaatgctgaaaggagataatttggggaagacaatagtgaaagcatgaaaaagaggacacatggaatctggaggccatttagatgattagttaatttgtttttcaccatttagcaaaaatgtatactaccttaaatgtcttaagaaatagtactcataatgagtttgagctacttaataaaatacatttaagtggtatgtaattagtgatggaggatggaagtttcaaagtcaacaacaaccagtcacctcactgttcactacagcttcttctgagttgtggtagaaaataatggctttgaagtgtgaaaattttccaaacactgtatgttttcattcataagtgggagctgaacaatgagaacacatggacatagggaggggaacaacacacgctggggcctgtggaagccggggtgagggagggagagcatcaggataaatagctaatgccttcgggggctaatacctaggtgatgggttgacaggtgaagcaaaccaccatggcacacgtttacctatgtaacaaacctgcacattccacacaattatcccggaactgaaaataaaataaaattaaattaaaaaaaaaagtt

SEQ ID NO: 449196 - DNA, 2517 bp, Homo sapiens
ctcttctctaagctgcacagcctgaatagaagggctggtccagcggcggcggaggctggcgctgtcctgagagggagggctctgtgcggaagagatgaatcggacaaagggtgatgaggaggagtattggaacagctccaagttcaaggcttttacctttgacgatgaagacgatgagctttcacagttaaaggagtccaagcgggcggtgaacagcctccgagacttcgtggatgatgatgacgatgatgacctggagcgagtcagctggagtggggaacctgtgggaagtatctcatggtccatcagagagactgctggtaatagcggctcaacccacgaggggcgtgaacagctaaagagccgaaacagcttctcctcctatgcacaactacccaagcctacttctacctactccctgagcagcttttttagaggtagaactagacctggaagtttccagtccctttctgatgctctgtcagacacacctgccaaaagctatgctccagagctggggagacccaaaggggagtatagggattacagcaatgactggagccccagtgatacagtgcgacgtctccggaagggcaaggtttgctcactagagagattccgctccttacaggacaaactacaactcctagaagaggcagtaagcatgcatgatggaaacgtcattactgcagttctgattttcctgaagaggacactgagcaaagagatcctcttccgagagctggaggtgcgacaggttgccctgagacatcttattcacttccttaaggaaataggggatcaaaagttgcttttagacctcttcaggttcctagatagaacagaagagcttgcgctatctcattatcgagagcatttgaacattcaggaccctgacaaacgaaaagaatttcttaaaacctgtgttggtttgccattttcagcagaagattccgcacacatacaggaccattacacgctcctggaacgtcagatcattattgaggcaaatgatcgccatctagaatcagcaggacagactgagatcttccgaaagcacccccgcaaagcctccatcctcaacatgccactagtgacaacacttttctactcctgcttctatcactacacagaggctgaggggacattcagcagtcccgtcaacctgaagaagacatttaagatcccagataaacagtatgtgctgacagccctggctgctcgtgccaagcttcgagcctggaatgatgtagatgccctattcaccacaaagaactggctgggctataccaagaagagagcacccattggcttccatcgggttgtcgaaattttgcacaagaacaatgcccctgtgcagatattacaggagtatgtcaatctggtggaagatgtggacacgaagttgaacttagccactaagttcaagtgccatgatgtcgtcattgatacctaccgggacctgaaggatcgtcaacagttgctagcatacaggagtaaggtagataaaggatcagcagaggaggagaagattgatgctcttctcagcagctcgcaaattcgatggaagaattaagtggcattgactaccttgaagcctgcctcatttcctcctctcctgcctgtgaaagcagagagagctcttctttgggagagctgcggcatcacatcgcttgggcccattacccatgggcagtgccagctactcttgacacagataacttcagactgatcttctgtccaaggaacatcatctgaggatcgagatctaaagctttgagtcatgagaatgattctctccacctggtgctcatatgaaggtgggagtgatttctagattgggcccctactgggtaagatctcacttggtctgagaaaagtgactgctccagaaaggaagaggtatgggagtcatagggtggctactgcattccactcagctaattatgatccaggacttggcgctggacattggcagttctgctctgaatgaagtcagaacagaaccaaaatggcctcaggaaggaatgccagtgtttcccaagacctcctggagatgcactcacaccagactgcacagacccctccacattatgccacacacggcctagacgttgtgtttcctcagccattttccctctgctgccccagtttactctgtccaaaaccctaaggttcttctctcacttgaacacagacgaccttgcttgggtgatgagacatcccctttatctcttcctctactgctggccaagacccgtcactttataagaagctcagatgcagcagtgctggagagctctctctttatgcaaaaatctcatttcaccaggagctttcagaagtttcacctgggctaaattcagcagcatttctgttaggatatttagatggaggttttattttcacacttggattcttgctctgtaccaatatttgcctccttttctgtgactgaactgggtttttctgacatgcctagactcctaataaaggtatttcttccttggtgccttc

SEQ ID NO: 449197 - DNA, 2788 bp, Homo sapiens
ctcttctctaagctgcacagcctgaatagaagggctggtccagcggcggcggaggctggcgctgtcctgagagggagggctctgtgcggaagagtcagggcgacccttgggcgctggagtacgcttgggactggggctgcgagtgagcaccagcgattggttcggaagcggacatttggttcagaacgagcatttaactctgccagggatccgctgggctctgacgactgcggtagatccatggcttcctggacgttcacccgtagagtcatcctagcttaactcttgttccctggtctcagttcacaagcctcacctgtatcttcctggctcggaagataattgaaaccaagtctgacttctcaatgaatcggacaaagggtgatgaggaggagtattggaacagctccaagttcaaggcttttacctttgacgatgaagacgatgagctttcacagttaaaggagtccaagcgggcggtgaacagcctccgagacttcgtggatgatgatgacgatgatgacctggagcgagtcagctggagtggggaacctgtgggaagtatctcatggtccatcagagagactgctggtaatagcggctcaacccacgaggggcgtgaacagctaaagagccgaaacagcttctcctcctatgcacaactacccaagcctacttctacctactccctgagcagcttttttagaggtagaactagacctggaagtttccagtccctttctgatgctctgtcagacacacctgccaaaagctatgctccagagctggggagacccaaaggggagtatagggattacagcaatgactggagccccagtgatacagtgcgacgtctccggaagggcaaggtttgctcactagagagattccgctccttacaggacaaactacaactcctagaagaggcagtaagcatgcatgatggaaacgtcattactgcagttctgattttcctgaagaggacactgagcaaagagatcctcttccgagagctggaggtgcgacaggttgccctgagacatcttattcacttccttaaggaaataggggatcaaaagttgcttttagacctcttcaggttcctagatagaacagaagagcttgcgctatctcattatcgagagcatttgaacattcaggaccctgacaaacgaaaagaatttcttaaaacctgtgttggtttgccattttcagcagaagattccgcacacatacaggaccattacacgctcctggaacgtcagatcattattgaggcaaatgatcgccatctagaatcagcaggacagactgagatcttccgaaagcacccccgcaaagcctccatcctcaacatgccactagtgacaacacttttctactcctgcttctatcactacacagaggctgaggggacattcagcagtcccgtcaacctgaagaagacatttaagatcccagataaacagtatgtgctgacagccctggctgctcgtgccaagcttcgagcctggaatgatgtagatgccctattcaccacaaagaactggctgggctataccaagaagagagcacccattggcttccatcgggttgtcgaaattttgcacaagaacaatgcccctgtgcagatattacaggagtatgtcaatctggtggaagatgtggacacgaagttgaacttagccactaagttcaagtgccatgatgtcgtcattgatacctaccgggacctgaaggatcgtcaacagttgctagcatacaggagtaaggtagataaaggatcagcagaggaggagaagattgatgctcttctcagcagctcgcaaattcgatggaagaattaagtggcattgactaccttgaagcctgcctcatttcctcctctcctgcctgtgaaagcagagagagctcttctttgggagagctgcggcatcacatcgcttgggcccattacccatgggcagtgccagctactcttgacacagataacttcagactgatcttctgtccaaggaacatcatctgaggatcgagatctaaagctttgagtcatgagaatgattctctccacctggtgctcatatgaaggtgggagtgatttctagattgggcccctactgggtaagatctcacttggtctgagaaaagtgactgctccagaaaggaagaggtatgggagtcatagggtggctactgcattccactcagctaattatgatccaggacttggcgctggacattggcagttctgctctgaatgaagtcagaacagaaccaaaatggcctcaggaaggaatgccagtgtttcccaagacctcctggagatgcactcacaccagactgcacagacccctccacattatgccacacacggcctagacgttgtgtttcctcagccattttccctctgctgccccagtttactctgtccaaaaccctaaggttcttctctcacttgaacacagacgaccttgcttgggtgatgagacatcccctttatctcttcctctactgctggccaagacccgtcactttataagaagctcagatgcagcagtgctggagagctctctctttatgcaaaaatctcatttcaccaggagctttcagaagtttcacctgggctaaattcagcagcatttctgttaggatatttagatggaggttttattttcacacttggattcttgctctgtaccaatatttgcctccttttctgtgactgaactgggtttttctgacatgcctagactcctaataaaggtatttcttccttggtgccttc

SEQ ID NO: 449198 - DNA, 2211 bp, Homo sapiens
ctcttctctaagctgcacagcctgaatagaagggctggtccagcggcggcggaggctggcgctgtcctgagagggagggctctgtgcggaagagatgaatcggacaaagggtgatgaggaggagtattggaacagctccaagttcaaggcttttacctttgacgatgaagacgatgagctttcacagttaaaggagtccaagcgggcggtgaacagcctccgagacttcgtggatgatgatgacgatgatgacctggagcgagtcagctggagtggggaacctgtgggaagtatctcatggtccatcagagagactgctggtaatagcggctcaacccacgaggggcgtgaacagctaaagagccgaaacagcttctcctcctatgcacaactacccaagcctacttctacctactccctgagcagcttttttagaggtagaactagacctggaagtttccagtccctttctgatgctctgtcagacacacctgccaaaagctatgctccagagctggggagacccaaaggggagtatagggattacagcaatgactggagccccagtgatacagtgcgacgtctccggaagggcaaggtttgctcactagagagattccgctccttacaggacaaactacaactcctagaagaggcagtaagcatgcatgatggaaacgtcattactgcagttctgattttcctgaagaggacactgagcaaagagatcctcttccgagagctggaggtgcgacaggttgccctgagacatcttattcacttccttaaggaaataggggatcaaaagttgcttttagacctcttcaggttcctagatagaacagaagagcttgcgctatctcattatcgagagcatttgaacattcaggaccctgacaaacgaaaagaatttcttaaaacctgtgttggtttgccattttcagcagaagattccgcacacatacaggaccattacacgctcctggaacgtcagatcattattgaggcaaatgatcgccatctagaatcagcaggacagactgagatcttccgaaagcacccccgcaaagcctccatcctcaacatgccactagtgacaacacttttctactcctgcttctatcactacacagaggctgaggggacattcagcagtcccgtcaacctgaagaagacatttaagatcccagataaacagtatgtgctgacagccctggctgctcgtgccaagcttcgagcctggaatgatgtagatgccctattcaccacaaagaactggctgggctataccaagaagagagcacccattggcttccatcgggttgtcgaaattttgcacaagaacaatgcccctgtgcagatattacaggagtatgtcaatctggtggaagatgtggacacgaagttgaacttagccactaagttcaagtgccatgatgtcgtcattgatacctaccgggacctgaaggatcgtcaacagttgctagcatacaggagtaaggtagataaaggatcagcagaggaggagaagattgatgctcttctcagcagctcgcaaattcgatggaagaattaagtggcattgactaccttgaagcctgcctcatttcctcctctcctgcctgtgaaagcagagagagctcttctttgggagagctgcggcatcacatcgcttgggcccattacccatgggcagtgccagctactcttgacacagataacttcagactgatcttctgtccaaggaacatcatctgaggatcgagatctaaagctttgagtcatgagaatgattctctccacctggtgctcatatgaaggtgggagtgatttctagattgggcccctactgggtaagatctcacttggtctgagaaaagtgactgctccagaaaggaagaggtatgggagtcatagggtggctactgcattccactcagctaattatgatccaggacttggcgctggacattggcagttctgctctgaatgaagtcagaacagaaccaaaatggcctcaggaaggaatgccagtgtttcccaagacctcctggagatgcactcacaccagactgcacagacccctccacattatgccacacacagcagcatctacaaacatgttcaaaatcgattggcttaaacaccctttaacatcctcccccaaatattcccaattatcccacactttaaaaattcaacctttaactt

SEQ ID NO: 449199 - DNA, 436 bp, Homo sapiens
ctggtctcagttcacaagcctcacctgtatcttcctggctcggaagataattgaaaccaagtctgacttctcagtaggtggtttttggagttttctgaggcagggagcatgttgtggttttcttgctgattcttctgttttcctttgtaaagttcctgttctcccctgaggtctctcaccctgccttgtgggctgtcagtaaacaagagacgataaagacaaacctctgaagtattttaaatcatgttgaagcacctgtcactcttaagagtgacaatcgtacctgattactttataactctagagccactagatcattatctatacttgccaagtaaacctagcttctcatttggcgttataaatacaaattgatggcagttgtctactgccattgcatggttaaaaagattccagaaatcctctggtagattat

SEQ ID NO: 449200 - DNA, 2612 bp, Homo sapiens
  misc_feature (2260)..(2260): n is a, c, g, or t
  misc_feature (2325)..(2326): n is a, c, g, or t
  misc_feature (2346)..(2346): n is a, c, g, or t
ctcttctctaagctgcacagcctgaatagaagggctggtccagcggcggcggaggctggcgctgtcctgagagggagggctctgtgcggaagagatgaatcggacaaagggtgatgaggaggagtattggaacagctccaagttcaaggcttttacctttgacgatgaagacgatgagctttcacagttaaaggagtccaagcgggcggtgaacagcctccgagacttcgtggatgatgatgacgatgatgacctggagcgagtcagctggagtggggaacctgtgggaagtatctcatggtccatcagagagactgctggtaatagcggctcaacccacgaggggcgtgaacagctaaagagccgaaacagcttctcctcctatgcacaactacccaagcctacttctacctactccctgagcagcttttttagaggtagaactagacctggaagtttccagtccctttctgatgctctgtcagacacacctgccaaaagctatgctccagagctggggagacccaaaggggagtatagggattacagcaatgactggagccccagtgatacagtgcgacgtctccggaagggcaaggtttgctcactagagagattccgctccttacaggacaaactacaactcctagaagaggcagtaagcatgcatgatggaaacgtcattactgcagttctgattttcctgaagaggacactgagcaaagagatcctcttccgagagctggaggtgcgacaggttgccctgagacatcttattcacttccttaaggaaataggggatcaaaagttgcttttagacctcttcaggttcctagatagaacagaagagcttgcgctatctcattatcgagagcatttgaacattcaggaccctgacaaacgaaaagaatttcttaaaacctgtgttggtttgccattttcagcagaagattccgcacacatacaggaccattacacgctcctggaacgtcagatcattattgaggcaaatgatcgccatctagaatcagcaggacagactgagatcttccgaaagcacccccgcaaagcctccatcctcaacatgccactagtgacaacacttttctactcctgcttctatcactacacagaggctgaggggacattcagcagtcccgtcaacctgaagaagacatttaagatcccagataaacagtatgtgctgacagccctggctgctcgtgccaagcttcgagcctggaatgatgtagatgccctattcaccacaaagaactggctgggctataccaagaagagagcacccattggcttccatcgggttgtcgaaattttgcacaagaacaatgcccctgtgcagatattacaggagtatgtcaatctggtggaagatgtggacacgaagttgaacttagccactaagttcaagtgccatgatgtcgtcattgatacctaccgggacctgaaggatcgtcaacagttgctagcatacaggagtaaggtagataaaggatcagcagaggaggagaagattgatgctcttctcagcagctcgcaaattcgatggaagaattaagtggcattgactaccttgaagcctgcctcatttcctcctctcctgcctgtgaaagcagagagagctcttctttgggagagctgcggcatcacatcgcttgggcccattacccatgggcagtgccagctactcttgacacagataacttcagactgatcttctgtccaaggaacatcatctgaggatcgagatctaaagctttgagtcatgagaatgattctctccacctggtgctcatatgaaggtgggagtgatttctagattgggcccctactgggtaagatctcacttggtctgagaaaagtgactgctccagaaaggaagaggtatgggagtcatagggtggctactgcattccactcagctaattatgatccaggacttggcgctggacattggcagttctgctctgaatgaagtcagaacagaaccaaaatggcctcaggaaggaatgccagtgtttcccaagacctcctggagatgcactcacaccagactgcacagacccctccacattatgccacacacggcctagacgttgtgtttcctcagccattttccctctgctgccccagtttactctgtccaaaaccctaaggttcttctctcacttgaacacagacgaccttgcttgggtgatgagacatcccttattttttttttttggcccccccccctttttgntcccttttaaaaaaaaccttttgggggggcctttgggtgggtcccacccaaaaaaagggggaaannccccctttgggttgcccaancctttttttaaataaaaaggaaagctcagatgcagcagtgctggagagctctctctttatgcaaaaatctcatttcaccaggagctttcagaagtttcacctgggctaaattcagcagcatttctgttaggatatttagatggaggttttattttcacacttggattcttgctctgtaccaatatttgcctccttttctgtgactgaactgggtttttctgacatgcctagactcctaataaaggtatttcttccttggtgccttc

SEQ ID NO: 449201 - DNA, 1092 bp, Homo sapiens
ctcttctctaagctgcacagcctgaatagaagggctggtccagcggcggcggaggctggcgctgtcctgagagggagggctctgtgcggaagagatgaatcggacaaagggtgatgaggaggagtattggaacagctccaagttcaaggcttttacctttgacgatgaagacgatgagctttcacagttaaaggagtccaagcgggcggtgaacagcctccgagacttcgtggatgatgatgacgatgatgacctggagcgagtcagctggagtggggaacctgtgggaagtatctcatggtccatcagagagactgctggtaatagcggctcaacccacgaggggcgtgaacagctaaagagccgaaacagcttctcctcctatgcacaactacccaagcctacttctacctactccctgagcagcttttttagaggtagaactagacctggaagtttccagtccctttctgatgctctgtcagacacacctgccaaaagctatgctccagagctggggagacccaaaggggagtatagggattacagcaatgactggagccccagtgatacagtgcgacgtctccggaagggcaaggtttgctcactagagagattccgctccttacaggacaaactacaactcctagaagaggcagtaagcatgcatgatggaaacgtcattactgcagttctgattttcctgaagaggacactgagcaaagagatcctcttccgagagctggaggtgcgacaggttgccctgagacatcttattcacttccttaaggaaataggggatcaaaagttgcttttagacctcttcaggttcctagatagaacagaagagcttgcggtcctggttgttaggagttttggggttttggcttctcacaaagaaaatgttgaaggctaagaggataagaaaccagatataggtcaagaaggaagataggtcaagttgatgatacacccaatacacgttttggctgagaattcaatggccaggtgttaagattaaattttggcagattttcacaatcatggaatgaactcctggaatacaagaataaatctgaaattttaccaaaa

SEQ ID NO: 449202 - DNA, 3207 bp, Homo sapiens
tcaatcgcatatgtgtaaaatgaaggggctggacagagtgatgagtgttctacctgggatggaggccctgggaggtggagaccatggctgtcttgtagtaggcatgtcttaggtatttactgaatggcccgttctggtcctcccaccagcctcttagcagccttttctgcatctcttctaacttcgtgtagatgcctgggcctttgtaactattctctcaactcaccattcatctttcttggagacgttaaaactatccactggattcaatacaactctgctttccactaaaaattctttaaaatgtccctcaacctttttcgtactgtaaccatatgggaggtgatacagtgcctttcctttgtgattaaggtcacggtagtcacttggaaggatcctttaagcttccagaaatgacttaatctctaagatattgcaaattgttcttcactcagtgagttggttttgtttccaagtccgacttctgagtacagcaagtgaggtggcttcgggcagtcagctcctgaaccccctaaaaagaaagggcagggcctgcagtggacagcagccagacagggaggaagactcactgccaagtcagggttctctgccttgattccctcaggatgcacgttgactgagggccccaggggttgccctctcgaaggcgtgtccagagctacgtacctttcctgggactcagcagtaactttaaacgcttgtgctcatgtgaagagcacattggcaggcaagtgcctgactaatgttattttcaggatgaccttttacccattcagatctaccatgtgtaaaaggaaaactatactcctggcactagattcctgcaggcagcccacctcctgagtcatccagacactgacagagaacagccatgctggcagctggtggttagtcctggagtcggagggcagcactgggaaagaaaaataattacctggagataatgtaatcatcgtacattttacaagtaatggtgctttaaaaaaatctcctcaaggtcaaactgatcctcctaatcagtttacatcatggaagagagaattacatcttaaatggattacttcagcagcttcagttaatttatacaaaaatcaaccaactcattaagcctctctattggttaatgattctagcagccagttgaaatggaagaagagaatgaattctagtttaaagtgaagtcttagattgtggcatgattaaaacaaaacagggccaggtgtggtggcttacgcctgtaatcccagcattttgggaggctgaggcgggaggatcacctgaggtcaggagttcgagaccagcctggccaacatgatgaaaccccatctctactaaaaatacgaaaattagccgggtgtggtggagggcacctgtaatcccagctacttgggaggctgaggcaggagaatcacttgaacctgggaggcagagattgcagtgagctgagattgcgccactgcattccagcctgggctacagagcgacactccgtctcaaaaataaataaataaaaataaaacaatacctttaaattatgtgcatgtattctagtcttctggtttctgaagactgtaatgccatccttggtaaagctgaacagtctagttagattatttctaaggtcttcatttctacattatgttcattacctacatttgcatttatcaatgtagtggaaatatcttttaaataaatcaaacttaactgaatgttcttccttacaactgcttttgttgttgatgaagtgagcaacattgtaaaagaggctatagaaagcgcaattggtggtaacgcttatcaacacagcaaagtgaaccagtggaccacaaatgtagtagaacaaactttaagccaactcaccaagctgggaaaaccatttaaatacatcggtaatggagtcttgtttcttttatatttgcgggatggttttttaacactgatcagaggggcatccagtaccagaaacaacagctaacgtggctcaactcaaggaaggctcctggtgggagtcggtcgtgtgtgtagtatacgttagcgtacgcttgaccatttggctgctggtacaattgcagatcgtatgtgaagcgggatcttacaggaggtcccatcagatgcttttagaacaagtgaagcatagaggaagtgtggacagcccccagctgacagtggctcaacttagaatttttcaactttgatggatttaccagggtattaagtgcatttgcaacttacattttcatatattgttgatttatgatgggtttatgggatgttgtaagtcaaggagcacctataatttgtcaatatagtgagacaaggcaatctgtccctataatttttatcgagaacatcaaccacgtggagctacatacattgtacgtttgctaaaagtggacagaatgacatttgtgttacccagtagacttctctaacaaaaatttgttttaacttaagtgacctgtgtaattatgcagaagaatggagctggattacacacagcaagttcctgcttctgggacagctctactgacggtatgattttcattcatgtttgtgaagttttgttgtgtgaaatatatgactggaagtttcctatctttgaatgcaatgcatgtttatcaccttttaaaacatttaataatagacttgccaaggttctttgtgtagcatagagatgggtacttgaatgttggccttattgtgagtaaaacgtcgtcccccagctttccctgccgtaaatgctgctctcttccctcccgcagggagctgcactgtgcgatgggagaataagaccatgtactgcatcgtcagtgccttcggactgtctatttgacctgcagtccagcctatggcctttctccttttgtctctagttcatcctctaaccaccagccatgaattcagtgaactcttttctcattctctttgttttgtggcactttcacaatgtagaggaaaaaaccaaatgaccgcactgtgatgtgaatggcaccgaagtcagatgagtatccctgtaggtcacctgcagcctgcgttgccacttgtcttaactctgaatatttcatttcaaaggtgctaaaatctgaaatctgctagtgtgaaacttgctctactctctgaaatgattcaaatacactaattttccatactttatacttttgttagaataaattattcaaatctaaa

SEQ ID NO: 449203 - DNA, 2412 bp, Homo sapiens
tcaatcgcatatgtgtaaaatgaaggggctggacagagtgatgagtgttctacctgggatggaggccctgggaggtggagaccatggctgtcttgtagtaggcatgtcttaggtatttactgaatggcccgttctggtcctcccaccagcctcttagcagccttttctgcatctcttctaacttcgtgtagatgcctgggcctttgtaactattctctcaactcaccattcatctttcttggagacgttaaaactatccactggattcaatacaactctgctttccactaaaaattctttaaaatgtccctcaacctttttcgtactgtaaccatatgggaggtgatacagtgcctttcctttgtgattaaggtcacggtagtcacttggaaggatcctttaagcttccagaaatgacttaatctctaagatattgcaaattgttcttcactcagtgagttggttttgtttccaagtccgacttctgagtacagcaagtgaggtggcttcgggcagtcagctcctgaaccccctaaaaagaaagggcagggcctgcagtggacagcagccagacagggaggaagactcactgccaagtcagggttctctgccttgattccctcaggatgcacgttgactgagggccccaggggttgccctctcgaaggcgtgtccagagctacgtacctttcctgggactcagcagtaactttaaacgcttgtgctcatgtgaagagcacattggcaggcaagtgcctgactaatgttattttcaggatgaccttttacccattcagatctaccatgtgtaaaaggaaaactatactcctggcactagattcctgcaggcagcccacctcctgagtcatccagacactgacagagaacagccatgctggcagctggtggttagtcctggagtcggagggcagcactgggaaagaaaaataattacctggagataatgtaatcatcgtacattttacaagtaatggtgctttaaaaaaatctcctcaaggtcaaactgatcctcctaatcagtttacatcatggaagagagaattacatcttaaatggattacttcagcagcttcagttaatttatacaaaaatcaaccaactcattaagcctctctattggttaatgattctagcagccagttgaaatggaagaagagaatgaattctagtttaaagtgaagtcttagattgtggcatgattaaaacaaaacagggccaggtgtggtggcttacgcctgtaatcccagcattttgggaggctgaggcgggaggatcacctgaggtcaggagttcgagaccagcctggccaacatgatgaaaccccatctctactaaaaatacgaaaattagccgggtgtggtggagggcacctgtaatcccagctacttgggaggctgaggcaggagaatcacttgaacctgggaggcagagattgcagtgagctgagattgcgccactgcattccagcctgggctacagagcgacactccgtctcaaaaataaataaataaaaataaaacaatacctttaaattatgtgcatgtattctagtcttctggtttctgaagactgtaatgccatccttggtaaagctgaacagtctagttagattatttctaaggtcttcatttctacattatgttcattacctacatttgcatttatcaatgtagtggaaatatcttttaaataaatcaaacttaactgaatgttcttccttacaactgcttttgttgttgatgaagtgagcaacattgtaaaagaggctatagaaagcgcaattggtggtaacgcttatcaacacagcaaagtgaaccagtggaccacaaatgtagtagaacaaactttaagccaactcaccaagctgggaaaaccatttaaatacatcgtgacctgtgtaattatgcagaagaatggagctggattacacacagcaagttcctgcttctgggacagctctactgacgggagctgcactgtgcgatgggagaataagaccatgtactgcatcgtcagtgccttcggactgtctatttgacctgcagtccagcctatggcctttctccttttgtctctagttcatcctctaaccaccagccatgaattcagtgaactcttttctcattctctttgttttgtggcactttcacaatgtagaggaaaaaaccaaatgaccgcactgtgatgtgaatggcaccgaagtcagatgagtatccctgtaggtcacctgcagcctgcgttgccacttgtcttaactctgaatatttcatttcaaaggtgctaaaatctgaaatctgctagtgtgaaacttgctctactctctgaaatgattcaaatacactaattttccatactttatacttttgttagaataaattattcaaatctaaa

SEQ ID NO: 449204 - DNA, 755 bp, Homo sapiens
aatgtcacgcaggacactgccacgcacatgacagcgaagaccatgacggcgcacccgagctcgctgccacctaaatggctgcggaggactgcttttgttgttgatgaagtgagcaacattgtaaaagaggctatagaaagcgcaattggtggtaacgcttatcaacacagcaaagtgaaccagtggaccacaaatgtagtagaacaaactttaagccaactcaccaagctgggaaaaccatttaaatacatcgtgacctgtgtaattatgcagaagaatggagctggattacacacagcaagttcctgcttctgggacagctctactgacgggagctgcactgtgcgatgggagaataagaccatgtactgcatcgtcagtgccttcggactgtctatttgacctgcagtccagcctatggcctttctccttttgtctctagttcatcctctaaccaccagccatgaattcagtgaactcttttctcattctctttgttttgtggcactttcacaatgtagaggaaaaaaccaaatgaccgcactgtgatgtgaatggcaccgaagtcagatgagtatccctgtaggtcacctgcagcctgcgttgccacttgtcttaactctgaatatttcatttcaaaggtgctaaaatctgaaatctgctagtgtgaaacttgctctactctctgaaatgattcaaatacactaattttccatactttatacttttgttagaataaattattcaaatctaaa

SEQ ID NO: 449205 - DNA, 1238 bp, Homo sapiens
  misc_feature (1238)..(1238): n is a, c, g, or t
tgcgcagtccgcgccactcagggagccggaggcgacgcgccggaggaaagatggaagactaccaggctgcggaggagactgcttttgttgttgatgaagtgagcaacattgtaaaagaggctatagaaagcgcaattggtggtaacgcttatcaacacagcaaagtgaaccagtggaccacaaatgtagtagaacaaactttaagccaactcaccaagctgggaaaaccatttaaatacatcgtgacctgtgtaattatgcagaagaatggagctggattacacacagcaagttcctgcttctgggacagctctactgacgggagctgcactgtgcgatgggagaataagaccatgtactgcatcgtcagtgccttcggactgtctatttgacctgcagtccagcctatggcctttctccttttgtctctagttcatcctctaaccaccagccatgaattcagtgaactcttttctcattctctttgttttgtggcactttcacaatgtagaggaaaaaaccaaatgaccgcactgtgatgtgaatggcaccgaagtcagatgagtatccctgtaggtcacctgcagcctgcgttgccacttgtcttaactctgaatatttcatttcaaaggtgctaaaatctgaaatctgctagtgtgaaacttgctctactctctgaaatgattcaaatacactaattttccatactttatacttttgttagaataaattattcaaatctaaaaaaaaaaaaaaaaaaaacaaacaaacaacaccttgtgggccgccttaggagcctttcagaaaaacgggttttctaaaagcccacattcgggtttgggcccgcggggcgccccaattatatggtaactgtgtaacccactgtggggccaaataagcgtgttgtccccctaagggagagaactccgggcgcacatcgagacgaaaggggcgctgggagtttttcctcccaccaattaataaaaaagcgcgccggggcggggaaacacacgagaagcgtgtctcggagaacccaaactctccagaaatgggggagtctcccagagggggcacactacacggggagactcctttctcaacaacgggggggagtcccaaacggaagacctccgaattttctaaaatttaacacgcccgggccctggggggcgaacccactagacacctgaccagccaacacacacaacacaacaacagccacaacacctcaaatcatn

SEQ ID NO: 449206 - DNA, 1310 bp, Homo sapiens
tgcgcagtccgcgccactcagggagccggaggcgacgcgccggaggaaagatggaagactaccaggctgcggaggagactgcttttgttgttgatgaagtgagcaacattgtaaaagaggctatagaaagcgcaattggtggtaacgcttatcaacacagcaaagtgaaccagtggaccacaaatgtagtagaacaaactttaagccaactcaccaagctgggaaaaccatttaaatacatcggtaatggagtcttgtttcttttatatttgcgggatggttttttaacactgatcagaggggcatccagtaccagaaacaacagctaacgtggctcaactcaaggaaggctcctggtgggagtcggtcgtgtgtgtagtatacgttagcgtacgcttgaccatttggctgctggtacaattgcagatcgtatgtgaagcgggatcttacaggaggtcccatcagatgcttttagaacaagtgaagcatagaggaagtgtggacagcccccagctgacagtggctcaacttagaatttttcaactttgatggatttaccagggtattaagtgcatttgcaacttacattttcatatattgttgatttatgatgggtttatgggatgttgtaagtcaaggagcacctataatttgtcaatatagtgagacaaggcaatctgtccctataatttttatcgagaacatcaaccacgtggagctacatacattgtacgtttgctaaaagtggacagaatgacatttgtgttacccagtagacttctctaacaaaaatttgttttaacttaagtgacctgtgtaattatgcagaagaatggagctggattacacacagcaagttcctgcttctgggacagctctactgacgggagctgcactgtgcgatgggagaataagaccatgtactgcatcgtcagtgccttcggactgtctatttgacctgcagtccagcctatggcctttctccttttgtctctagttcatcctctaaccaccagccatgaattcagtgaactcttttctcattctctttgttttgtggcactttcacaatgtagaggaaaaaaccaaatgaccgcactgtgatgtgaatggcaccgaagtcagatgagtatccctgtaggtcacctgcagcctgcgttgccacttgtcttaactctgaatatttcatttcaaaggtgctaaaatctgaaatctgctagtgtgaaacttgctctactctctgaaatgattcaaatacactaattttccatactttatacttttgttagaataaattattcaaatctaaa

SEQ ID NO: 449207 - DNA, 2977 bp, Homo sapiens
tcaatcgcatatgtgtaaaatgaaggggctggacagagtgatgagtgttctacctgggatggaggccctgggaggtggagaccatggctgtcttgtagtaggcatgtcttaggtatttactgaatggcccgttctggtcctcccaccagcctcttagcagccttttctgcatctcttctaacttcgtgtagatgcctgggcctttgtaactattctctcaactcaccattcatctttcttggagacgttaaaactatccactggattcaatacaactctgctttccactaaaaattctttaaaatgtccctcaacctttttcgtactgtaaccatatgggaggtgatacagtgcctttcctttgtgattaaggtcacggtagtcacttggaaggatcctttaagcttccagaaatgacttaatctctaagatattgcaaattgttcttcactcagtgagttggttttgtttccaagtccgacttctgagtacagcaagtgaggtggcttcgggcagtcagctcctgaaccccctaaaaagaaagggcagggcctgcagtggacagcagccagacagggaggaagactcactgccaagtcagggttctctgccttgattccctcaggatgcacgttgactgagggccccaggggttgccctctcgaaggcgtgtccagagctacgtacctttcctgggactcagcagtaactttaaacgcttgtgctcatgtgaagagcacattggcaggcaagtgcctgactaatgttattttcaggatgaccttttacccattcagatctaccatgtgtaaaaggaaaactatactcctggcactagattcctgcaggcagcccacctcctgagtcatccagacactgacagagaacagccatgctggcagctggtggttagtcctggagtcggagggcagcactgggaaagaaaaataattacctggagataatgtaatcatcgtacattttacaagtaatggtgctttaaaaaaatctcctcaaggtcaaactgatcctcctaatcagtttacatcatggaagagagaattacatcttaaatggattacttcagcagcttcagttaatttatacaaaaatcaaccaactcattaagcctctctattggttaatgattctagcagccagttgaaatggaagaagagaatgaattctagtttaaagtgaagtcttagattgtggcatgattaaaacaaaacagggccaggtgtggtggcttacgcctgtaatcccagcattttgggaggctgaggcgggaggatcacctgaggtcaggagttcgagaccagcctggccaacatgatgaaaccccatctctactaaaaatacgaaaattagccgggtgtggtggagggcacctgtaatcccagctacttgggaggctgaggcaggagaatcacttgaacctgggaggcagagattgcagtgagctgagattgcgccactgcattccagcctgggctacagagcgacactccgtctcaaaaataaataaataaaaataaaacaatacctttaaattatgtgcatgtattctagtcttctggtttctgaagactgtaatgccatccttggtaaagctgaacagtctagttagattatttctaaggtcttcatttctacattatgttcattacctacatttgcatttatcaatgtagtggaaatatcttttaaataaatcaaacttaactgaatgttcttccttacaactgcttttgttgttgatgaagtgagcaacattgtaaaagaggctatagaaagcgcaattggtggtaacgcttatcaacacagcaaagtgaaccagtggaccacaaatgtagtagaacaaactttaagccaactcaccaagctgggaaaaccatttaaatacatcggtaatggagtcttgtttcttttatatttgcgggatggttttttaacactgatcagaggggcatccagtaccagaaacaacagctaacgtggctcaactcaaggaaggctcctggtgggagtcggtcgtgtgtgtagtatacgttagcgtacgcttgaccatttggctgctggtacaattgcagatcgtatgtgaagcgggatcttacaggaggtcccatcagatgcttttagaacaagtgaagcatagaggaagtgtggacagcccccagctgacagtggctcaacttagaatttttcaactttgatggatttaccagggtattaagtgcatttgcaacttacattttcatatattgttgatttatgatgggtttatgggatgttgtaagtcaaggagcacctataatttgtcaatatagtgagacaaggcaatctgtccctataatttttatcgagaacatcaaccacgtggagctacatacattgtacgtttgctaaaagtggacagaatgacatttgtgttacccagtagacttctctaacaaaaatttgttttaacttaagtgacctgtgtaattatgcagaagaatggagctggattacacacagcaagttcctgcttctgggacagctctactgacgggagctgcactgtgcgatgggagaataagaccatgtactgcatcgtcagtgccttcggactgtctatttgacctgcagtccagcctatggcctttctccttttgtctctagttcatcctctaaccaccagccatgaattcagtgaactcttttctcattctctttgttttgtggcactttcacaatgtagaggaaaaaaccaaatgaccgcactgtgatgtgaatggcaccgaagtcagatgagtatccctgtaggtcacctgcagcctgcgttgccacttgtcttaactctgaatatttcatttcaaaggtgctaaaatctgaaatctgctagtgtgaaacttgctctactctctgaaatgattcaaatacactaattttccatactttatacttttgttagaataaattattcaaatctaaa

SEQ ID NO: 449208 - DNA, 669 bp, Homo sapiens
  misc_feature (646)..(646): n is a, c, g, or t
tgcgcagtccgcgccactcagggagccggaggcgacgcgccggaggaaagatggaagactaccaggctgcggaggagactgcttttgttgttgatgaagtgagcaacattgtaaaagaggctatagaaagcgcaattggtggtaacgcttatcaacacagcaaagtgaaccagtggaccacaaatgtagtagaacaaactttaagccaactcaccaagctgggaaaaccatttaaatacatcgtgacctgtgtaattatgcagaagaatggagctggattacacacagcaagttcctgcttctgggacagctctactgacgggagctgcactgtgcgatgggagaataagaccatgtactgcatcgtcagtgccttcggactgtctatttgacctgcagtccagcctatggcctttctccttttgtctctagttcatcctctaaccaccagccatgaattcagtgaactcttttctcattctctttgttttgtggcactttcacaatgtagaggaaaaaaccaaatgaccgcactgtgatgtgaatggcaccgaagtcagatgagtatccctgtaggtcacctgcagcctgcgttgccacttgtcttaactctgaatatttcatttcaaaggtgcttacacttttnccatacttatacttctggtagat

SEQ ID NO: 449209 - DNA, 683 bp, Homo sapiens
tgcgcagtccgcgccactcagggagccggaggcgacgcgccggaggaaagatggaagactaccaggctgcggaggagactgcttttgttgttgatgaagtgagcaacattgtaaaagaggctatagaaagcgcaattggtggtaacgcttatcaacacagcaaagtgaaccagtggaccacaaatgtagtagaacaaactttaagccaactcaccaagctgggaaaaccatttaaatacatcgtgacctgtgtaattatgcagaagaatggagctggattacacacagcaagttcctgcttctgggacagctctactgacgggagctgcactgtgcgatgggagaataagaccatgtactgcatcgtcagtgccttcggactgtctatttgacctgcagtccagcctatggcctttctccttttgtctctagttcatcctctaaccaccagccatgaattcagtgaactcttttctcattctctttgttttgtggcactttcacaatgtagaggaacacctgcagcctgcgttgccacttgtcttaactctgaatatttcatttcaaaggtgctaaaatctgaaatctgctagtgtgaaacttgctctactctctgaaatgattcaaatacactaattttccatactttatacttttgttagaataaattattcaaatctaaa

SEQ ID NO: 449210 - DNA, 2033 bp, Homo sapiens
  misc_feature (2033)..(2033): n is a, c, g, or t
tgcgcagtccgcgccactcagggagccggaggcgacgcgccggaggaaagatggaagactaccaggctgcggaggagactgcttttgttgttgatgaagtgagcaacattgtaaaagaggctatagaaagcgcaattggtggtaacgcttatcaacacagcaaagtgaaccagtggaccacaaatgtagtagaacaaactttaagccaactcaccaagctgggaaaaccatttaaatacatcggtaatggagtcttgtttcttttatatttgcgggatggttttttaacactgatcagaggggcatccagtaccagaaacaacagctaacgtggctcaactcaaggaaggctcctggtgggagtcggtcgtgtgtgtagtatacgttagcgtacgcttgaccatttggctgctggtacaattgcagatcgtatgtgaagcgggatcttacaggaggtcccatcagatgcttttagaacaagtgaagcatagaggaagtgtggacagcccccagctgacagtggctcaacttagaatttttcaactttgatggatttaccagggtattaagtgcatttgcaacttacattttcatatattgttgatttatgatgggtttatgggatgttgtaagtcaaggagcacctataatttgtcaatatagtgagacaaggcaatctgtccctataatttttatcgagaacatcaaccacgtggagctacatacattgtacgtttgctaaaagtggacagaatgacatttgtgttacccagtagacttctctaacaaaaatttgttttaacttaagtgacctgtgtaattatgcagaagaatggagctggattacacacagcaagttcctgcttctgggacagctctactgacggtatgattttcattcatgtttgtgaagttttgttgtgtgaaatatatgactggaagtttcctatctttgaatgcaatgcatgtttatcaccttttaaaacatttaataatagacttgccaaggttctttgtgtagcatagagatgggtacttgaatgttggccttattgtgagtaaaacgtcgtcccccagctttccctgccgtaaatgctgctctcttccctcccgcagggagctgcactgtgcgatgggagaataagaccatgtactgcatcgtcagtgccttcggactgtctatttgacctgcagtccagcctatggcctttctccttttgtctctagttcatcctctaaccaccagccatgaattcagtgaactcttttctcattctctttgttttgtggcactttcacaatgtagaggaaaaaaccaaatgaccgcactgtgatgtgaatggcaccgaagtcagatgagtatccctgtaggtcacctgcagcctgcgttgccacttgtcttaactctgaatatttcatttcaaaggtgctaaaatctgaaatctgctagtgtgaaacttgctctactctctgaaatgattcaaatacactaattttccatactttatacttttgttagaataaattattcaaatctaaaaaaaaaaaaaaaaaaaacaaacaaacaacaccttgtgggccgccttaggagcctttcagaaaaacgggttttctaaaagcccacattcgggtttgggcccgcggggcgccccaattatatggtaactgtgtaacccactgtggggccaaataagcgtgttgtccccctaagggagagaactccgggcgcacatcgagacgaaaggggcgctgggagtttttcctcccaccaattaataaaaaagcgcgccggggcggggaaacacacgagaagcgtgtctcggagaacccaaactctccagaaatgggggagtctcccagagggggcacactacacggggagactcctttctcaacaacgggggggagtcccaaacggaagacctccgaattttctaaaatttaacacgcccgggccctggggggcgaacccactagacacctgaccagccaacacacacaacacaacaacagccacaacacctcaaatcatn

SEQ ID NO: 449211 - DNA, 745 bp, Homo sapiens
tgcgcagtccgcgccactcagggagccggaggcgacgcgccggaggaaagatggaagactaccaggctgcggaggagactgcttttgttgttgatgaagtgagcaacattgtaaaagaggctatagaaagcgcaattggtggtaacgcttatcaacacagcaaagtgaaccagtggaccacaaatgtagtagaacaaactttaagccaactcaccaagctgggaaaaccatttaaatacatcgtgacctgtgtaattatgcagaagaatggagctggattacacacagcaagttcctgcttctgggacagctctactgacgggagctgcactgtgcgatgggagaataagaccatgtactgcatcgtcagtgccttcggactgtctatttgacctgcagtccagcctatggcctttctccttttgtctctagttcatcctctaaccaccagccatgaattcagtgaactcttttctcattctctttgttttgtggcactttcacaatgtagaggaaaaaaccaaatgaccgcactgtgatgtgaatggcaccgaagtcagatgagtatccctgtaggtcacctgcagcctgcgttgccacttgtcttaactctgaatatttcatttcaaaggtgctaaaatctgaaatctgctagtgtgaaacttgctctactctctgaaatgattcaaatacactaattttccatactttatacttttgttagaataaattattcaaatctaaa

SEQ ID NO: 449212 - DNA, 703 bp, Homo sapiens
tgcgcagtccgcgccactcagggagccggaggcgacgcgccggaggaaagatggaagactaccaggctgcggaggaggctatagaaagcgcaattggtggtaacgcttatcaacacagcaaagtgaaccagtggaccacaaatgtagtagaacaaactttaagccaactcaccaagctgggaaaaccatttaaatacatcgtgacctgtgtaattatgcagaagaatggagctggattacacacagcaagttcctgcttctgggacagctctactgacgggagctgcactgtgcgatgggagaataagaccatgtactgcatcgtcagtgccttcggactgtctatttgacctgcagtccagcctatggcctttctccttttgtctctagttcatcctctaaccaccagccatgaattcagtgaactcttttctcattctctttgttttgtggcactttcacaatgtagaggaaaaaaccaaatgaccgcactgtgatgtgaatggcaccgaagtcagatgagtatccctgtaggtcacctgcagcctgcgttgccacttgtcttaactctgaatatttcatttcaaaggtgctaaaatctgaaatctgctagtgtgaaacttgctctactctctgaaatgattcaaatacactaattttccatactttatacttttgttagaataaattattcaaatctaaa

SEQ ID NO: 449213 - DNA, 691 bp, Homo sapiens
tgcgcagtccgcgccactcagggagccggaggcgacgcgccggaggaaagatggaagactaccaggctgcggaggagactgcttttgttgttgatgaagtgagcaacattgtaaaagaggctatagaaagcgcaattggtggtaacgcttatcaacacagcaaagtgaaccagtggaccacaaatgtagtagaacaaactttaagccaactcaccaagctgggattacacacagcaagttcctgcttctgggacagctctactgacgggagctgcactgtgcgatgggagaataagaccatgtactgcatcgtcagtgccttcggactgtctatttgacctgcagtccagcctatggcctttctccttttgtctctagttcatcctctaaccaccagccatgaattcagtgaactcttttctcattctctttgttttgtggcactttcacaatgtagaggaaaaaaccaaatgaccgcactgtgatgtgaatggcaccgaagtcagatgagtatccctgtaggtcacctgcagcctgcgttgccacttgtcttaactctgaatatttcatttcaaaggtgctaaaatctgaaatctgctagtgtgaaacttgctctactctctgaaatgattcaaatacactaattttccatactttatacttttgttagaataaattattcaaatctaaa

SEQ ID NO: 449214 - DNA, 985 bp, Homo sapiens
aatgtcacgcaggacactgccacgcacatgacagcgaagaccatgacggcgcacccgagctcgctgccacctaaatggctgcggaggactgcttttgttgttgatgaagtgagcaacattgtaaaagaggctatagaaagcgcaattggtggtaacgcttatcaacacagcaaagtgaaccagtggaccacaaatgtagtagaacaaactttaagccaactcaccaagctgggaaaaccatttaaatacatcgtgacctgtgtaattatgcagaagaatggagctggattacacacagcaagttcctgcttctgggacagctctactgacggtatgattttcattcatgtttgtgaagttttgttgtgtgaaatatatgactggaagtttcctatctttgaatgcaatgcatgtttatcaccttttaaaacatttaataatagacttgccaaggttctttgtgtagcatagagatgggtacttgaatgttggccttattgtgagtaaaacgtcgtcccccagctttccctgccgtaaatgctgctctcttccctcccgcagggagctgcactgtgcgatgggagaataagaccatgtactgcatcgtcagtgccttcggactgtctatttgacctgcagtccagcctatggcctttctccttttgtctctagttcatcctctaaccaccagccatgaattcagtgaactcttttctcattctctttgttttgtggcactttcacaatgtagaggaaaaaaccaaatgaccgcactgtgatgtgaatggcaccgaagtcagatgagtatccctgtaggtcacctgcagcctgcgttgccacttgtcttaactctgaatatttcatttcaaaggtgctaaaatctgaaatctgctagtgtgaaacttgctctactctctgaaatgattcaaatacactaattttccatactttatacttttgttagaataaattattcaaatctaaa

SEQ ID NO: 449215 - DNA, 618 bp, Homo sapiens
tgcgcagtccgcgccactcagggagccggaggcgacgcgccggaggaaagatggaagactaccaggctgcggaggagactgcttttgttgttgatgaagtgagcaacattgtaaaagaggctatagaaagcgcaattggtggtaacgcttatcaacacagcaaagtgaaccagtggaccacaaatgtagtagaacaaactttaagccaactcaccaagctgggaaaaccatttaaatacatcgtgacctgtgtaattatgcagaagaatggagctggattacacacagcaagttcctgcttctgggacagctctactgacgggagctgcactgtgcgatgggagaataagaccatgtactgcatcgtcagtgccttcggactgtctatttgacctgcagtccagcctatggcctttctccttttgtctctagttcatcctctaaccaccagcacctgcagcctgcgttgccacttgtcttaactctgaatatttcatttcaaaggtgctaaaatctgaaatctgctagtgtgaaacttgctctactctctgaaatgattcaaatacactaattttccatactttatacttttgttagaataaattattcaaatctaaa

SEQ ID NO: 449216 - DNA, 440 bp, Homo sapiens
tcggcctgcatcacgcgtgagggggcgcgcggtgctggaagctgccgcacctgcggggagccgagccgccggcgctcgacgcgcgcgctctcgcgagacccgcgggatcacgtgacgcccgggcgcggcgcagctcacgtgacaagcgctgccggccgcggtgtcttcttcgtgccggcgtcgcagtggccgggcctcttgcgtctggtaacgccgctggctggcacttttttaaatataaaaatgggtgttatttttatttttttttgtaaagtgatttttggtcttctgttgacattcggggtgatcctgttctgcgctgtgtacaatgtgagatcggtgcgttctcctgatgttttgccgtggcttggggattgtacacgggaccagctcacgtaatgcattgcctgtaacaatgtaataaaaagcctctttctttt

SEQ ID NO: 449217 - DNA, 2591 bp, Homo sapiens
tcggcctgcatcacgcgtgagggggcgcgcggtgctggaagctgccgcacctgcggggagccgagccgccggcgctcgacgcgcgcgctctcgcgagacccgcgggatcacgtgacgcccgggcgcggcgcagctcacgtgacaagcgctgccggccgcggtgtcttcttcgtgccggcgtcgcagtggccgggcctcttgcgtctggtaacgccgctgtctctaacgccagcccttggcgcccgcgccccgccaccgcagcgcccggcagtccgcggcccaaccgccgcccgcgcccccgctctccgcaccgtacccggccgcctcgcgccatggcggcccccggcagcgcccggcgacccctgctgctgctactgctgttgctgctgctcggcctcatgcattgtgcgtcagcagcaatgtttatggtgaaaaatggcaacgggaccgcgtgcataatggccaacttctctgctgccttctcagtgaactacgacaccaagagtggccctaagaacatgacctttgacctgccatcagatgccacagtggtgctcaaccgcagctcctgtggaaaagagaacacttctgaccccagtctcgtgattgcttttggaagaggacatacactcactctcaatttcacgagaaatgcaacacgttacagcgtccagctcatgagttttgtttataacttgtcagacacacaccttttccccaatgcgagctccaaagaaatcaagactgtggaatctataactgacatcagggcagatatagataaaaaatacagatgtgttagtggcacccaggtccacatgaacaacgtgaccgtaacgctccatgatgccaccatccaggcgtacctttccaacagcagcttcagcaggggagagacacgctgtgaacaagacaggccttccccaaccacagcgccccctgcgccacccagcccctcgccctcacccgtgcccaagagcccctctgtggacaagtacaacgtgagcggcaccaacgggacctgcctgctggccagcatggggctgcagctgaacctcacctatgagaggaaggacaacacgacggtgacaaggcttctcaacatcaaccccaacaagacctcggccagcgggagctgcggcgcccacctggtgactctggagctgcacagcgagggcaccaccgtcctgctcttccagttcgggatgaatgcaagttctagccggtttttcctacaaggaatccagttgaatacaattcttcctgacgccagagaccctgcctttaaagctgccaacggctccctgcgagcgctgcaggccacagtcggcaattcctacaagtgcaacgcggaggagcacgtccgtgtcacgaaggcgttttcagtcaatatattcaaagtgtgggtccaggctttcaaggtggaaggtggccagtttggctctgtggaggagtgtctgctggacgagaacagcatgctgatccccatcgctgtgggtggtgccctggcggggctggtcctcatcgtcctcatcgcctacctcgtcggcaggaagaggagtcacgcaggctaccagactatctagcctggtgcacgcaggcacagcagctgcaggggcctctgttcctttctctgggcttagggtcctgtcgaaggggaggcacactttctggcaaacgtttctcaaatctgcttcatccaatgtgaagttcatcttgcagcatttactatgcacaacagagtaactatcgaaatgacggtgttaattttgctaactgggttaaatattttgctaactggttaaacattaatatttaccaaagtaggattttgagggtgggggtgctctctctgagggggtgggggtgccgctgtctctgaggggtgggggtgccgctgtctctgaggggtgggggtgccgctctctctgagggggtgggggtgccgctttctctgagggggtgggggtgccgctctctctgagggggtgggggtgctgctctctccgaggggtggaatgccgctgtctctgaggggtgggggtgccgctctaaattggctccatatcatttgagtttagggttctggtgtttggtttcttcattctttactgcactcagatttaagccttacaaagggaaagcctctggccgtcacacgtaggacgcatgaaggtcactcgtggtgaggctgacatgctcacacattacaacagtagagagggaaaatcctaagacagaggaactccagagatgagtgtctggagcgcttcagttcagctttaaaggccaggacgggccacacgtggctggcggcctcgttccagtggcggcacgtccttgggcgtctctaatgtctgcagctcaagggctggcacttttttaaatataaaaatgggtgttatttttatttttttttgtaaagtgatttttggtcttctgttgacattcggggtgatcctgttctgcgctgtgtacaatgtgagatcggtgcgttctcctgatgttttgccgtggcttggggattgtacacgggaccagctcacgtaatgcattgcctgtaacaatgtaataaaaagcctctttctttt

SEQ ID NO: 449218 - DNA, 2188 bp, Homo sapiens
cgccggcgctgccggggggccgccatggcgcgaggcggccgggtacgcgtgcataatggccaacttctctgctgccttctcagtgaactacgacaccaagagtggccctaagaacatgacctttgacctgccatcagatgccacagtggtgctcaaccgcagctcctgtggaaaagagaacacttctgaccccagtctcgtgattgcttttggaagaggacatacactcactctcaatttcacgagaaatgcaacacgttacagcgtccagctcatgagttttgtttataacttgtcagacacacaccttttccccaatgcgagctccaaagaaatcaagactgtggaatctataactgacatcagggcagatatagataaaaaatacagatgtgttagtggcacccaggtccacatgaacaacgtgaccgtaacgctccatgatgccaccatccaggcgtacctttccaacagcagcttcagcaggggagagacacgctgtgaacaagacaggccttccccaaccacagcgccccctgcgccacccagcccctcgccctcacccgtgcccaagagcccctctgtggacaagtacaacgtgagcggcaccaacgggacctgcctgctggccagcatggggctgcagctgaacctcacctatgagaggaaggacaacacgacggtgacaaggcttctcaacatcaaccccaacaagacctcggccagcgggagctgcggcgcccacctggtgactctggagctgcacagcgagggcaccaccgtcctgctcttccagttcgggatgaatgcaagttctagccggtttttcctacaaggaatccagttgaatacaattcttcctgacgccagagaccctgcctttaaagctgccaacggctccctgcgagcgctgcaggccacagtcggcaattcctacaagtgcaacgcggaggagcacgtccgtgtcacgaaggcgttttcagtcaatatattcaaagtgtgggtccaggctttcaaggtggaaggtggccagtttggctctgtggaggagtgtctgctggacgagaacagcatgctgatccccatcgctgtgggtggtgccctggcggggctggtcctcatcgtcctcatcgcctacctcgtcggcaggaagaggagtcacgcaggctaccagactatctagcctggtgcacgcaggcacagcagctgcaggggcctctgttcctttctctgggcttagggtcctgtcgaaggggaggcacactttctggcaaacgtttctcaaatctgcttcatccaatgtgaagttcatcttgcagcatttactatgcacaacagagtaactatcgaaatgacggtgttaattttgctaactgggttaaatattttgctaactggttaaacattaatatttaccaaagtaggattttgagggtgggggtgctctctctgagggggtgggggtgccgctgtctctgaggggtgggggtgccgctgtctctgaggggtgggggtgccgctctctctgagggggtgggggtgccgctttctctgagggggtgggggtgccgctctctctgagggggtgggggtgctgctctctccgaggggtggaatgccgctgtctctgaggggtgggggtgccgctctaaattggctccatatcatttgagtttagggttctggtgtttggtttcttcattctttactgcactcagatttaagccttacaaagggaaagcctctggccgtcacacgtaggacgcatgaaggtcactcgtggtgaggctgacatgctcacacattacaacagtagagagggaaaatcctaagacagaggaactccagagatgagtgtctggagcgcttcagttcagctttaaaggccaggacgggccacacgtggctggcggcctcgttccagtggcggcacgtccttgggcgtctctaatgtctgcagctcaagggctggcacttttttaaatataaaaatgggtgttatttttatttttttttgtaaagtgatttttggtcttctgttgacattcggggtgatcctgttctgcgctgtgtacaatgtgagatcggtgcgttctcctgatgttttgccgtggcttggggattgtacacgggaccagctcacgtaatgcattgcctgtaacaatgtaataaaaagcctctttctttt

SEQ ID NO: 449219 - DNA, 1765 bp, Homo sapiens
ggaccataactagtctcgagtagtgcgtatctttccaacaggtgttgacgagggagagggagagacacgcggtgaggatgagaggccttgcccaatcagaatgaaggcgccccctgcgccacccagcccctcgccctcacccgtgcccaagagcccctctgtggacaagtacaacgtgagcggcaccaacgggacctgcctgctggccagcatggggctgcagctgaacctcacctatgagaggaaggacaacacgacggtgacaaggcttctcaacatcaaccccaacaagacctcggccagcgggagctgcggcgcccacctggtgactctggagctgcacagcgagggcaccaccgtcctgctcttccagttcgggatgaatgcaagttctagccggtttttcctacaaggaatccagttgaatacaattcttcctgacgccagagaccctgcctttaaagctgccaacggctccctgcgagcgctgcaggccacagtcggcaattcctacaagtgcaacgcggaggagcacgtccgtgtcacgaaggcgttttcagtcaatatattcaaagtgtgggtccaggctttcaaggtggaaggtggccagtttggctctgtggaggagtgtctgctggacgagaacagcatgctgatccccatcgctgtgggtggtgccctggcggggctggtcctcatcgtcctcatcgcctacctcgtcggcaggaagaggagtcacgcaggctaccagactatctagcctggtgcacgcaggcacagcagctgcaggggcctctgttcctttctctgggcttagggtcctgtcgaaggggaggcacactttctggcaaacgtttctcaaatctgcttcatccaatgtgaagttcatcttgcagcatttactatgcacaacagagtaactatcgaaatgacggtgttaattttgctaactgggttaaatattttgctaactggttaaacattaatatttaccaaagtaggattttgagggtgggggtgctctctctgagggggtgggggtgccgctgtctctgaggggtgggggtgccgctgtctctgaggggtgggggtgccgctctctctgagggggtgggggtgccgctttctctgagggggtgggggtgccgctctctctgagggggtgggggtgctgctctctccgaggggtggaatgccgctgtctctgaggggtgggggtgccgctctaaattggctccatatcatttgagtttagggttctggtgtttggtttcttcattctttactgcactcagatttaagccttacaaagggaaagcctctggccgtcacacgtaggacgcatgaaggtcactcgtggtgaggctgacatgctcacacattacaacagtagagagggaaaatcctaagacagaggaactccagagatgagtgtctggagcgcttcagttcagctttaaaggccaggacgggccacacgtggctggcggcctcgttccagtggcggcacgtccttgggcgtctctaatgtctgcagctcaagggctggcacttttttaaatataaaaatgggtgttatttttatttttttttgtaaagtgatttttggtcttctgttgacattcggggtgatcctgttctgcgctgtgtacaatgtgagatcggtgcgttctcctgatgttttgccgtggcttggggattgtacacgggaccagctcacgtaatgcattgcctgtaacaatgtaataaaaagcctctttctttt

SEQ ID NO: 449220 - DNA, 2441 bp, Homo sapiens
tcggcctgcatcacgcgtgagggggcgcgcggtgctggaagctgccgcacctgcggggagccgagccgccggcgctcgacgcgcgcgctctcgcgagacccgcgggatcacgtgacgcccgggcgcggcgcagctcacgtgacaagcgctgccggccgcggtgtcttcttcgtgccggcgtcgcagtggccgggcctcttgcgtctggtaacgccgctgtctctaacgccagcccttggcgcccgcgccccgccaccgcagcgcccggcagtccgcggcccaaccgccgcccgcgcccccgctctccgcaccgtacccggccgcctcgcgccatggcggcccccggcagcgcccggcgacccctgctgctgctactgctgttgctgctgctcggcctcatgcattgtgcgtcagcagcaatgtttatggtgaaaaatggcaacgggaccgcgtgcataatggccaacttctctgctgccttctcagtgaactacgacaccaagagtggccctaagaacatgacctttgacctgccatcagatgccacagtggtgctcaaccgcagctcctgtggaaaagagaacacttctgaccccagtctcgtgattgcttttggaagaggacatacactcactctcaatttcacgagaaatgcaacacgttacagcgtccagctcatgagttttgtttataacttgtcagacacacaccttttccccaatgcgagctccaaagaaatcaagactgtggaatctataactgacatcagggcagatatagataaaaaatacagatgtgttagtggcacccaggtccacatgaacaacgtgaccgtaacgctccatgatgccaccatccaggcgtacctttccaacagcagcttcagcaggggagagacacgctgtgaacaagacaggccttccccaaccacagcgccccctgcgccacccagcccctcgccctcacccgtgcccaagagcccctctgtggacaagtacaacgtgagcggcaccaacgggacctgcctgctggccagcatggggctgcagctgaacctcacctatgagaggaaggacaacacgacggtgacaaggcttctcaacatcaaccccaacaagacctcggccagcgggagctgcggcgcccacctggtgactctggagctgcacagcgagggcaccaccgtcctgctcttccagttcgggatgaatgcaagttctagccggtttttcctacaaggaatccagttgaatacaattcttcctgacgccagagaccctgcctttaaagctgccaacggctccctgcgagcgctgcaggccacagtcggcaattcctacaagtgcaacgcggaggagcacgtccgtgtcacgaaggcgttttcagtcaatatattcaaagtgtgggtccaggctttcaaggtggaaggtggccagtttggctctgtggaggagtgtctgctggacgagaacagcatgctgatccccatcgctgtgggtggtgccctggcggggctggtcctcatcgtcctcatcgcctacctcgtcggcaggaagaggagtcacgcaggctaccagactatctagcctggtgcacgcaggcacagcagctgcaggggcctctgttcctttctctgggcttagggtcctgtcgaaggggaggcacactttctggcaaacgtttctcaaatctgcttcatccaatgtgaagttcatcttgcagcatttactatgcacaacagagtaactatcgaaatgacggtgttaattttgctaactgggttaaatattttgctaactggttaaacattaatatttaccaaagtaggattttgagggtgggggtgctctctctgagggggtgggggtgccgcgctgtctctgaggggtgggggtgccgctctaaattggctccatatcatttgagtttagggttctggtgtttggtttcttcattctttactgcactcagatttaagccttacaaagggaaagcctctggccgtcacacgtaggacgcatgaaggtcactcgtggtgaggctgacatgctcacacattacaacagtagagagggaaaatcctaagacagaggaactccagagatgagtgtctggagcgcttcagttcagctttaaaggccaggacgggccacacgtggctggcggcctcgttccagtggcggcacgtccttgggcgtctctaatgtctgcagctcaagggctggcacttttttaaatataaaaatgggtgttatttttatttttttttgtaaagtgatttttggtcttctgttgacattcggggtgatcctgttctgcgctgtgtacaatgtgagatcggtgcgttctcctgatgttttgccgtggcttggggattgtacacgggaccagctcacgtaatgcattgcctgtaacaatgtaataaaaagcctctttctttt

SEQ ID NO: 449221 - DNA, 1624 bp, Homo sapiens
gagcaagactctcagagaagggtctggaaggaactaaccaaaattttcattccccagagatacacaacgccttttatagacaagatcttttgcagttttgttctaatactagaaatgtaggaagtcaggtttattacccaatgaccattcacgtttgatgataaatgtgtgaatctactggggttaaagatcatctttctatgaatctgctccgtgattaaagatcatttttctttttaagaatgcaagttctagccggtttttcctacaaggaatccagttgaatacaattcttcctgacgccagagaccctgcctttaaagctgccaacggctccctgcgagcgctgcaggccacagtcggcaattcctacaagtgcaacgcggaggagcacgtccgtgtcacgaaggcgttttcagtcaatatattcaaagtgtgggtccaggctttcaaggtggaaggtggccagtttggctctgtggaggagtgtctgctggacgagaacagcatgctgatccccatcgctgtgggtggtgccctggcggggctggtcctcatcgtcctcatcgcctacctcgtcggcaggaagaggagtcacgcaggctaccagactatctagcctggtgcacgcaggcacagcagctgcaggggcctctgttcctttctctgggcttagggtcctgtcgaaggggaggcacactttctggcaaacgtttctcaaatctgcttcatccaatgtgaagttcatcttgcagcatttactatgcacaacagagtaactatcgaaatgacggtgttaattttgctaactgggttaaatattttgctaactggttaaacattaatatttaccaaagtaggattttgagggtgggggtgctctctctgagggggtgggggtgccgctgtctctgaggggtgggggtgccgctgtctctgaggggtgggggtgccgctctctctgagggggtgggggtgccgctttctctgagggggtgggggtgccgctctctctgagggggtgggggtgctgctctctccgaggggtggaatgccgctgtctctgaggggtgggggtgccgctctaaattggctccatatcatttgagtttagggttctggtgtttggtttcttcattctttactgcactcagatttaagccttacaaagggaaagcctctggccgtcacacgtaggacgcatgaaggtcactcgtggtgaggctgacatgctcacacattacaacagtagagagggaaaatcctaagacagaggaactccagagatgagtgtctggagcgcttcagttcagctttaaaggccaggacgggccacacgtggctggcggcctcgttccagtggcggcacgtccttgggcgtctctaatgtctgcagctcaagggctggcacttttttaaatataaaaatgggtgttatttttatttttttttgtaaagtgatttttggtcttctgttgacattcggggtgatcctgttctgcgctgtgtacaatgtgagatcggtgcgttctcctgatgttttgccgtggcttggggattgtacacgggaccagctcacgtaatgcattgcctgtaacaatgtaataaaaagcctctttctttt

SEQ ID NO: 449222 - DNA, 1751 bp, Homo sapiens
gcgccacacatatccctcgcagctcgacccgtgtccaagcatcacccgtctgttgtgaatctgatgtacaagctggtgtaccgtgtacctgacgtcggatctgactatgccttgaggcagctagtggcggtctgtattatgaacctcatcatatgagaaggaatggataacatcgagggtttacgatggcttgcatcacattatctaactcgctgaatgatgaacctacggttgaagcgggagtactgtagacgcccatctcatggtgatctctggatgcatgcatcagcgtatgggacacctagctcgtataccttgtgtcttatccatgattctggcgattgtagactgtcacatgtttctaagcacgttttgctcctacgagggaatgtccagattgaaatacctaattttattccatgaacgctcaagatgaccctgcctttaaagctgccaacggctccctgcgagcgctgcaggccacagtcggcaattcctacaagtgcaacgcggaggagcacgtccgtgtcacgaaggcgttttcagtcaatatattcaaagtgtgggtccaggctttcaaggtggaaggtggccagtttggctctgtggaggagtgtctgctggacgagaacagcatgctgatccccatcgctgtgggtggtgccctggcggggctggtcctcatcgtcctcatcgcctacctcgtcggcaggaagaggagtcacgcaggctaccagactatctagcctggtgcacgcaggcacagcagctgcaggggcctctgttcctttctctgggcttagggtcctgtcgaaggggaggcacactttctggcaaacgtttctcaaatctgcttcatccaatgtgaagttcatcttgcagcatttactatgcacaacagagtaactatcgaaatgacggtgttaattttgctaactgggttaaatattttgctaactggttaaacattaatatttaccaaagtaggattttgagggtgggggtgctctctctgagggggtgggggtgccgctgtctctgaggggtgggggtgccgctgtctctgaggggtgggggtgccgctctctctgagggggtgggggtgccgctttctctgagggggtgggggtgccgctctctctgagggggtgggggtgctgctctctccgaggggtggaatgccgctgtctctgaggggtgggggtgccgctctaaattggctccatatcatttgagtttagggttctggtgtttggtttcttcattctttactgcactcagatttaagccttacaaagggaaagcctctggccgtcacacgtaggacgcatgaaggtcactcgtggtgaggctgacatgctcacacattacaacagtagagagggaaaatcctaagacagaggaactccagagatgagtgtctggagcgcttcagttcagctttaaaggccaggacgggccacacgtggctggcggcctcgttccagtggcggcacgtccttgggcgtctctaatgtctgcagctcaagggctggcacttttttaaatataaaaatgggtgttatttttatttttttttgtaaagtgatttttggtcttctgttgacattcggggtgatcctgttctgcgctgtgtacaatgtgagatcggtgcgttctcctgatgttttgccgtggcttggggattgtacacgggaccagctcacgtaatgcattgcctgtaacaatgtaataaaaagcctctttctttt

SEQ ID NO: 449223 - DNA, 1420 bp, Homo sapiens
aacaacatatctggaaatagatgaccttatttcatattcattacagtcttgtatgttagaagaggtattctatgctggtatacttataagaaagaaagaggagtcttaaaaactcaagcatgttacatactagaatggaattggagcaccagaattaaaatttttccatggggaatttcacagcagtaaggctactcagtcactcattgagttcagagtttgtaatcacccccacatggtgctaaaaacttaaacctccaaagtgttcccaggactggaggagtgtctgctggacgagaacagcatgctgatccccatcgctgtgggtggtgccctggcggggctggtcctcatcgtcctcatcgcctacctcgtcggcaggaagaggagtcacgcaggctaccagactatctagcctggtgcacgcaggcacagcagctgcaggggcctctgttcctttctctgggcttagggtcctgtcgaaggggaggcacactttctggcaaacgtttctcaaatctgcttcatccaatgtgaagttcatcttgcagcatttactatgcacaacagagtaactatcgaaatgacggtgttaattttgctaactgggttaaatattttgctaactggttaaacattaatatttaccaaagtaggattttgagggtgggggtgctctctctgagggggtgggggtgccgctgtctctgaggggtgggggtgccgctgtctctgaggggtgggggtgccgctctctctgagggggtgggggtgccgctttctctgagggggtgggggtgccgctctctctgagggggtgggggtgctgctctctccgaggggtggaatgccgctgtctctgaggggtgggggtgccgctctaaattggctccatatcatttgagtttagggttctggtgtttggtttcttcattctttactgcactcagatttaagccttacaaagggaaagcctctggccgtcacacgtaggacgcatgaaggtcactcgtggtgaggctgacatgctcacacattacaacagtagagagggaaaatcctaagacagaggaactccagagatgagtgtctggagcgcttcagttcagctttaaaggccaggacgggccacacgtggctggcggcctcgttccagtggcggcacgtccttgggcgtctctaatgtctgcagctcaagggctggcacttttttaaatataaaaatgggtgttatttttatttttttttgtaaagtgatttttggtcttctgttgacattcggggtgatcctgttctgcgctgtgtacaatgtgagatcggtgcgttctcctgatgttttgccgtggcttggggattgtacacgggaccagctcacgtaatgcattgcctgtaacaatgtaataaaaagcctctttctttt

SEQ ID NO: 449224 - DNA, 1256 bp, Homo sapiens
acgtgcttcagactccgcctgtggacgtttagtcgcttccgtgtgggctggggcgacgcccctgttcctctgcaaggagctgtttcttcttgccggtctgagattctagagtggaggagtgtctgctggacgagaacagcatgctgatccccatcgctgtgggtggtgccctggcggggctggtcctcatcgtcctcatcgcctacctcgtcggcaggaagaggagtcacgcaggctaccagactatctagcctggtgcacgcaggcacagcagctgcaggggcctctgttcctttctctgggcttagggtcctgtcgaaggggaggcacactttctggcaaacgtttctcaaatctgcttcatccaatgtgaagttcatcttgcagcatttactatgcacaacagagtaactatcgaaatgacggtgttaattttgctaactgggttaaatattttgctaactggttaaacattaatatttaccaaagtaggattttgagggtgggggtgctctctctgagggggtgggggtgccgctgtctctgaggggtgggggtgccgctgtctctgaggggtgggggtgccgctctctctgagggggtgggggtgccgctttctctgagggggtgggggtgccgctctctctgagggggtgggggtgctgctctctccgaggggtggaatgccgctgtctctgaggggtgggggtgccgctctaaattggctccatatcatttgagtttagggttctggtgtttggtttcttcattctttactgcactcagatttaagccttacaaagggaaagcctctggccgtcacacgtaggacgcatgaaggtcactcgtggtgaggctgacatgctcacacattacaacagtagagagggaaaatcctaagacagaggaactccagagatgagtgtctggagcgcttcagttcagctttaaaggccaggacgggccacacgtggctggcggcctcgttccagtggcggcacgtccttgggcgtctctaatgtctgcagctcaagggctggcacttttttaaatataaaaatgggtgttatttttatttttttttgtaaagtgatttttggtcttctgttgacattcggggtgatcctgttctgcgctgtgtacaatgtgagatcggtgcgttctcctgatgttttgccgtggcttggggattgtacacgggaccagctcacgtaatgcattgcctgtaacaatgtaataaaaagcctctttctttt

SEQ ID NO: 449225 - DNA, 1137 bp, Homo sapiens
aggacagccccgggcctgcctccgctggctcaaccacatccagccccaggctttgctcacggtttgtgggctaaatggtagcagatggaagaagtagtttcctagtgccgcccccaccccaaccccatacatcctggtgcacgcaggcacagcagctgcaggggcctctgttcctttctctgggcttagggtcctgtcgaaggggaggcacactttctggcaaacgtttctcaaatctgcttcatccaatgtgaagttcatcttgcagcatttactatgcacaacagagtaactatcgaaatgacggtgttaattttgctaactgggttaaatattttgctaactggttaaacattaatatttaccaaagtaggattttgagggtgggggtgctctctctgagggggtgggggtgccgctgtctctgaggggtgggggtgccgctgtctctgaggggtgggggtgccgctctctctgagggggtgggggtgccgctttctctgagggggtgggggtgccgctctctctgagggggtgggggtgctgctctctccgaggggtggaatgccgctgtctctgaggggtgggggtgccgctctaaattggctccatatcatttgagtttagggttctggtgtttggtttcttcattctttactgcactcagatttaagccttacaaagggaaagcctctggccgtcacacgtaggacgcatgaaggtcactcgtggtgaggctgacatgctcacacattacaacagtagagagggaaaatcctaagacagaggaactccagagatgagtgtctggagcgcttcagttcagctttaaaggccaggacgggccacacgtggctggcggcctcgttccagtggcggcacgtccttgggcgtctctaatgtctgcagctcaagggctggcacttttttaaatataaaaatgggtgttatttttatttttttttgtaaagtgatttttggtcttctgttgacattcggggtgatcctgttctgcgctgtgtacaatgtgagatcggtgcgttctcctgatgttttgccgtggcttggggattgtacacgggaccagctcacgtaatgcattgcctgtaacaatgtaataaaaagcctctttctttt

SEQ ID NO: 449226 - DNA, 3092 bp, Homo sapiens
tcggcctgcatcacgcgtgagggggcgcgcggtgctggaagctgccgcacctgcggggagccgagccgccggcgctcgacgcgcgcgctctcgcgagacccgcgggatcacgtgacgcccgggcgcggcgcagctcacgtgacaagcgctgccggccgcggtgtcttcttcgtgccggcgtcgcagtggccgggcctcttgcgtctggtaacgccgctgtctctaacgccagcccttggcgcccgcgccccgccaccgcagcgcccggcagtccgcggcccaaccgccgcccgcgcccccgctctccgcaccgtacccggccgcctcgcgccatggcggcccccggcagcgcccggcgacccctgctgctgctactgctgttgctgctgctcggcctcatgcattgtgcgtcagcagcaatgtttatggtgaaaaatggcaacgggaccgcgtgcataatggccaacttctctgctgccttctcagtgaactacgacaccaagagtggccctaagaacatgacctttgacctgccatcagatgccacagtggtgctcaaccgcagctcctgtggaaaagagaacacttctgaccccagtctcgtgattgcttttggaagaggacatacactcactctcaatttcacgagaaatgcaacacgttacagcgtccagctcatgagttttgtttataacttgtcagacacacaccttttccccaatgcgagctccaaagaaatcaagactgtggaatctataactgacatcagggcagatatagataaaaaatacagatgtgttagtggcacccaggtccacatgaacaacgtgaccgtaacgctccatgatgccaccatccaggcgtacctttccaacagcagcttcagcaggggagagacacgctgtgaacaagacaggccttccccaaccacagcgccccctgcgccacccagcccctcgccctcacccgtgcccaagagcccctctgtggacaagtacaacgtgagcggcaccaacgggacctgcctgctggccagcatggggctgcagctgaacctcacctatgagaggaaggacaacacgacggtgacaaggcttctcaacatcaaccccaacaagacctcggccagcgggagctgcggcgcccacctggtgactctggagctgcacagcgagggcaccaccgtcctgctcttccagttcgggatgaatgcaagttctagccggtttttcctacaaggaatccagttgaatacaattcttcctgacgccagagaccctgcctttaaagctgccaacggctccctgcgagcgctgcaggccacagtcggcaattcctacaagtgcaacgcggaggagcacgtccgtgtcacgaaggcgttttcagtcaatatattcaaagtgtgggtccaggctttcaaggtggaaggtggccagtttggctctgtggaggagtgtctgctggacgagaacagcatgctgatccccatcgctgtgggtggtgccctggcggggctggtcctcatcgtcctcatcgcctacctcgtcggcaggaagaggagtcacgcaggctaccagactatctagcctggtgcacgcaggcacagcagctgcaggggcctctgttcctttctctgggcttagggtcctgtcgaaggggaggcacactttctggcaaacgtttctcaaatctgcttcatccaatgtgaagttcatcttgcagcatttactatgcacaacagagtaactatcgaaatgacggtgttaattttgctaactgggttaaatattttgctaactggttaaacattaatatttaccaaagtaggattttgagggtgggggtgctctctctgagggggtgggggtgccgctgtctctgaggggtgggggtgccgctgtctctgaggggtgggggtgccgctctctctgagggggtgggggtgccgctttctctgagggggtgggggtgccgctctctctgagggggtgggggtgctgctctctccgaggggtggaatgccgctgtctctgaggggtgggggtgccgctctaaattggctccatatcatttgagtttagggttctggtgtttggtttcttcattctttactgcactcagatttaagccttacaaagggaaagcctctggccgtcacacgtaggacgcatgaaggtcactcgtggtgaggctgacatgctcacacattacaacagtagagagggaaaatcctaagacagaggaactccagagatgagtgtctggagcgcttcagttcagctttaaaggccaggacgggccacacgtggctggcggcctcgttccagtggcggcacgtccttgggcgtctctaatgtctgcagctcaagggctggcacttttttaaatataaaaatgggtgttatttttatttttttttgtaaagtgatttttggtcttctgttgacattcggggtgatcctgttctgcgctgtgtacaatgtgagatcggtgcgttctcctgatgttttgccgtggcttggggattgtacacgggaccagctcacgtaatgcattgcctgtaacaatgtaataaaaagcctctttcttttggggtgggccttgtccttctgtcagctaaaatgggagctcatgagagaaggacgtcagggaaacggggttgagggtggtctcggtgcagagagaagggtgtcagggaaacggggggtgagggtggtcttggtgccagacgtagggaatggtgttgggagtggcccgagtgcctggcacagttgtctggttcattcatgtaacatgataatttttaaatcattaaaaaaattacctttcatacagataccatggaatactatgcagccataaagaggtatgagatcttgtcccctgcagggacacggatagagctggaagccattattctcagcaaactaacacaggagcagaaaaccagacaccacttgttctcacttgtaagtgggagcttctgatgagaacacatggacacaaggaggggaacatcacacactggggcccgttgggtcgggggcagggagagcatcaggaagaatagctaagggatgctggcttcatac

SEQ ID NO: 449227 - DNA, 2738 bp, Homo sapiens
tcggcctgcatcacgcgtgagggggcgcgcggtgctggaagctgccgcacctgcggggagccgagccgccggcgctcgacgcgcgcgctctcgcgagacccgcgggatcacgtgacgcccgggcgcggcgcagctcacgtgacaagcgctgccggccgcggtgtcttcttcgtgccggcgtcgcagtggccgggcctcttgcgtctggtaacgccgctgtctctaacgccagcccttggcgcccgcgccccgccaccgcagcgcccggcagtccgcggcccaaccgccgcccgcgcccccgctctccgcaccgtacccggccgcctcgcgccatggcggcccccggcagcgcccggcgacccctgctgctgctactgctgttgctgctgctcggcctcatgcattgtgcgtcagcagcaatgtttatggtgaaaaatggcaacgggaccgcgtgcataatggccaacttctctgctgccttctcagtgaactacgacaccaagagtggccctaagaacatgacctttgacctgccatcagatgccacagtggtgctcaaccgcagctcctgtggaaaagagaacacttctgaccccagtctcgtgattgcttttggaagaggacatacactcactctcaatttcacgagaaatgcaacacgttacagcgtccagctcatgagttttgtttataacttgtcagacacacaccttttccccaatgcgagctccaaagaaatcaagactgtggaatctataactgacatcagggcagatatagataaaaaatacagatgtgttagtggcacccaggtccacatgaacaacgtgaccgtaacgctccatgatgccaccatccaggcgtacctttccaacagcagcttcagcaggggagagacacgctgtgaacaagacaggccttccccaaccacagcgccccctgcgccacccagcccctcgccctcacccgtgcccaagagcccctctgtggacaagtacaacgtgagcggcaccaacgggacctgcctgctggccagcatggggctgcagctgaacctcacctatgagaggaaggacaacacgacggtgacaaggcttctcaacatcaaccccaacaagacctcggccagcgggagctgcggcgcccacctggtgactctggagctgcacagcgagggcaccaccgtcctgctcttccagttcgggatgaatgcaagttctagccggtttttcctacaaggaatccagttgaatacaattcttcctgacgccagagaccctgcctttaaagctgccaacggctccctgcgagcgctgcaggccacagtcggcaattcctacaagtgcaacgcggaggagcacgtccgtgtcacgaaggcgttttcagtcaatatattcaaagtgtgggtccaggctttcaaggtggaaggtggccagtttggctctgtggaggagtgtctgctggacgagaacagcatgctgatccccatcgctgtgggtggtgccctggcggggctggtcctcatcgtcctcatcgcctacctcgtcggcaggaagaggagtcacgcaggctaccagactatctagcctggtgcacgcaggcacagcagctgcaggggcctctgttcctttctctgggcttagggtcctgtcgaaggggaggcacactttctggcaaacgtttctcaaatctgcttcatccaatgtgaagttcatcttgcagcatttactatgcacaacagagtaactatcgaaatgacggtgttaattttgctaactgggttaaatattttgctaactggttaaacattaatatttaccaaagtaggattttgagggtgggggtgctctctctgagggggtgggggtgccgctgtctctgaggggtgggggtgccgctgtctctgaggggtgggggtgccgctctctctgagggggtgggggtgccgctttctctgagggggtgggggtgccgctctctctgagggggtgggggtgctgctctctccgaggggtggaatgccgctgtctctgaggggtgggggtgccgctctaaattggctccatatcatttgagtttagggttctggtgtttggtttcttcattctttactgcactcagatttaagccttacaaagggaaagcctctggccgtcacacgtaggacgcatgaaggtcactcgtggtgaggctgacatgctcacacattacaacagtagagagggaaaatcctaagacagaggaactccagagatgagtgtctggagcgcttcagttcagctttaaaggccaggacgggccacacgtggctggcggcctcgttccagtggcggcacgtccttgggcgtctctaatgtctgcagctcaagggctggcacttttttaaatataaaaatgggtgttatttttatttttttttgtaaagtgatttttggtcttctgttgacattcggggtgatcctgttctgcgctgtgtacaatgtgagatcggtgcgttctcctgatgttttgccgtggcttggggattgtacacgggaccagctcacgtaatgcattgcctgtaacaatgtaataaaaagcctctttcttttacaaaaaaaaaaaaaaaaacccgggggctctatttgcggggggggggaaaaagaggttcaagggggcctgttctctttgtttcctacccctttttgtaaaggggaaacgggggccccaaggggcgaaatcgaaccgtcggaaaggag

SEQ ID NO: 449228 - DNA, 2620 bp, Homo sapiens
tcggcctgcatcacgcgtgagggggcgcgcggtgctggaagctgccgcacctgcggggagccgagccgccggcgctcgacgcgcgcgctctcgcgagacccgcgggatcacgtgacgcccgggcgcggcgcagctcacgtgacaagcgctgccggccgcggtgtcttcttcgtgccggcgtcgcagtggccgggcctcttgcgtctggtaacgccgctgtctctaacgccagcccttggcgcccgcgccccgccaccgcagcgcccggcagtccgcggcccaaccgccgcccgcgcccccgctctccgcaccgtacccggccgcctcgcgccatggcggcccccggcagcgcccggcgacccctgctgctgctactgctgttgctgctgctcggcctcatgcattgtgcgtcagcagcaatgtttatggtgaaaaatggcaacgggaccgcgtgcataatggccaacttctctgctgccttctcagtgaactacgacaccaagagtggccctaagaacatgacctttgacctgccatcagatgccacagtggtgctcaaccgcagctcctgtggaaaagagaacacttctgaccccagtctcgtgattgcttttggaagaggacatacactcactctcaatttcacgagaaatgcaacacgttacagcgtccagctcatgagttttgtttataacttgtcagacacacaccttttccccaatgcgagctccaaagaaatcaagactgtggaatctataactgacatcagggcagatatagataaaaaatacagatgtgttagtggcacccaggtccacatgaacaacgtgaccgtaacgctccatgatgccaccatccaggcgtacctttccaacagcagcttcagcaggggagagacacgctgtgaacaagacaggccttccccaaccacagcgccccctgcgccacccagcccctcgccctcacccgtgcccaagagcccctctgtggacaagtacaacgtgagcggcaccaacgggacctgcctgctggccagcatggggctgcagctgaacctcacctatgagaggaaggacaacacgacggtgacaaggcttctcaacatcaaccccaacaagacctcggccagcgggagctgcggcgcccacctggtgactctggagctgcacagcgagggcaccaccgtcctgctcttccagttcgggatgaatgcaagttctagccggtttttcctacaaggaatccagttgaatacaattcttcctgacgccagagaccctgcctttaaagctgccaacggctccctgcgagcgctgcaggccacagtcggcaattcctacaagtgcaacgcggaggagcacgtccgtgtcacgaaggcgttttcagtcaatatattcaaagtgtgggtccaggctttcaaggtggaaggtggccagtttggctctgtggaggagtgtctgctggacgagaacagcatgctgatccccatcgctgtgggtggtgccctggcggggctggtcctcatcgtcctcatcgcctacctcgtcggcaggaagaggagtcacgcaggctaccagactatctagcctggtgcacgcaggcacagcagctgcaggggcctctgttcctttctctgggcttagggtcctgtcgaaggggaggcacactttctggcaaacgtttctcaaatctgcttcatccaatgtgaagttcatcttgcagcatttactatgcacaacagagtaactatcgaaatgacggtgttaattttgctaactgggttaaatattttgctaactggttaaacattaatatttaccaaagtaggattttgagggtgggggtgctctctctgagggggtgggggtgccgctgtctctgaggggtgggggtgccgctgtctctgaggggtgggggtgccgctctctctgagggggtgggggtgccgctttctctgagggggtgggggtgccgctctctctgagggggtgggggtgctgctctctccgaggggtggaatgccgctgtctctgaggggtgggggtgccgctctaaattggctccatatcatttgagtttagggttctggtgtttggtttcttcattctttactgcactcagatttaagccttacaaagggaaagcctctggccgtcacacgtaggacgcatgaaggtcactcgtggtgaggctgacatgctcacacattacaacagtagagagggaaaatcctaagacagaggaactccagagatgagtgtctggagcgcttcagttcagctttaaaggccaggacgggccacacgtggctggcggcctcgttccagtggcggcacgtccttgggcgtctctaatgtctgcagctcaagggctggcacttttttaaatataaaaatgggtgttatttttatttttttttgtaaagtgatttttggtcttctgttgacattcggggtgatcctgttctgcgctgtgtacaatgtgagatcggtgcgttctcctgatgttttgccgtggcttggggattgtacacgggaccagctacgaatactgcgtgtaccatgtatcacctgtgttttgggtggtgtgggggggtggggggggggtggggttgggggga

SEQ ID NO: 449229 - DNA, 2664 bp, Homo sapiens
tcggcctgcatcacgcgtgagggggcgcgcggtgctggaagctgccgcacctgcggggagccgagccgccggcgctcgacgcgcgcgctctcgcgagacccgcgggatcacgtgacgcccgggcgcggcgcagctcacgtgacaagcgctgccggccgcggtgtcttcttcgtgccggcgtcgcagtggccgggcctcttgcgtctggtaacgccgctgtctctaacgccagcccttggcgcccgcgccccgccaccgcagcgcccggcagtccgcggcccaaccgccgcccgcgcccccgctctccgcaccgtacccggccgcctcgcgccatggcggcccccggcagcgcccggcgacccctgctgctgctactgctgttgctgctgctcggcctcatgcattgtgcgtcagcagcaatgtttatggtgaaaaatggcaacgggaccgcgtgcataatggccaacttctctgctgccttctcagtgaactacgacaccaagagtggccctaagaacatgacctttgacctgccatcagatgccacagtggtgctcaaccgcagctcctgtggaaaagagaacacttctgaccccagtctcgtgattgcttttggaagaggacatacactcactctcaatttcacgagaaatgcaacacgttacagcgtccagctcatgagttttgtttataacttgtcagacacacaccttttccccaatgcgagctccaaagaaatcaagactgtggaatctataactgacatcagggcagatatagataaaaaatacagatgtgttagtggcacccaggtccacatgaacaacgtgaccgtaacgctccatgatgccaccatccaggcgtacctttccaacagcagcttcagcaggggagagacacgctgtgaacaagacaggccttccccaaccacagcgccccctgcgccacccagcccctcgccctcacccgtgcccaagagcccctctgtggacaagtacaacgtgagcggcaccaacgggacctgcctgctggccagcatggggctgcagctgaacctcacctatgagaggaaggacaacacgacggtgacaaggcttctcaacatcaaccccaacaagacctcggccagcgggagctgcggcgcccacctggtgactctggagctgcacagcgagggcaccaccgtcctgctcttccagttcgggatgaatgcaagttctagccggtttttcctacaaggaatccagttgaatacaattcttcctgacgccagagaccctgcctttaaagctgccaacggctccctgcgagcgctgcaggccacagtcggcaattcctacaagtgcaacgcggaggagcacgtccgtgtcacgaaggcgttttcagtcaatatattcaaagtgtgggtccaggctttcaaggtggaaggtggccagtttggctctgtggaggagtgtctgctggacgagaacagcatgctgatccccatcgctgtgggtggtgccctggcggggctggtcctcatcgtcctcatcgcctacctcgtcggcaggaagaggagtcacgcaggctaccagactatctagcctggtgcacgcaggcacagcagctgcaggggcctctgttcctttctctgggcttagggtcctgtcgaaggggaggcacactttctggcaaacgtttctcaaatctgcttcatccaatgtgaagttcatcttgcagcatttactatgcacaacagagtaactatcgaaatgacggtgttaattttgctaactgggttaaatattttgctaactggttaaacattaatatttaccaaagtaggattttgagggtgggggtgctctctctgagggggtgggggtgccgctgtctctgaggggtgggggtgccgctgtctctgaggggtgggggtgccgctctctctgagggggtgggggtgccgctttctctgagggggtgggggtgccgctctctctgagggggtgggggtgctgctctctccgaggggtggaatgccgctgtctctgaggggtgggggtgccgctctaaattggctccatatcatttgagtttagggttctggtgtttggtttcttcattctttactgcactcagatttaagccttacaaagggaaagcctctggccgtcacacgtaggacgcatgaaggtcactcgtggtgaggctgacatgctcacacattacaacagtagagagggaaaatcctaagacagaggaactccagagatgagtgtctggagcgcttcagttcagctttaaaggccaggacgggccacacgtggctggcggcctcgttccagtggcggcacgtccttgggcgtctctaatgtctgcagctcaagggctggcacttttttaaatataaaaatgggtgttatttttatttttttttgtaaagtgatttttggtcttctgttgacattcggggtgatcctgttctgcgctgtgtacaatgtgagatcggtgcgttctcctgatgtacaaaaaaaaaaaaaaaaaaaaaaaaaaaaaaaaaaaaaaaaaaagaaggggggggggggaaaaaagatctccccgaggggggccaagttaaggcagcgacccgtgtttcgggtaacgagggggtcccctataggggagtcaatataaacaagggag

SEQ ID NO: 449230 - DNA, 2532 bp, Homo sapiens
tcggcctgcatcacgcgtgagggggcgcgcggtgctggaagctgccgcacctgcggggagccgagccgccggcgctcgacgcgcgcgctctcgcgagacccgcgggatcacgtgacgcccgggcgcggcgcagctcacgtgacaagcgctgccggccgcggtgtcttcttcgtgccggcgtcgcagtggccgggcctcttgcgtctggtaacgccgctgtctctaacgccagcccttggcgcccgcgccccgccaccgcagcgcccggcagtccgcggcccaaccgccgcccgcgcccccgctctccgcaccgtacccggccgcctcgcgccatggcggcccccggcagcgcccggcgacccctgctgctgctactgctgttgctgctgctcggcctcatgcattgtgcgtcagcagcaatgtttatggtgaaaaatggcaacgggaccgcgtgcataatggccaacttctctgctgccttctcagtgaactacgacaccaagagtggccctaagaacatgacctttgacctgccatcagatgccacagtggtgctcaaccgcagctcctgtggaaaagagaacacttctgaccccagtctcgtgattgcttttggaagaggacatacactcactctcaatttcacgagaaatgcaacacgttacagcgtccagctcatgagttttgtttataacttgtcagacacacaccttttccccaatgcgagctccaaagaaatcaagactgtggaatctataactgacatcagggcagatatagataaaaaatacagatgtgttagtggcacccaggtccacatgaacaacgtgaccgtaacgctccatgatgccaccatccaggcgtacctttccaacagcagcttcagcaggggagagacacgctgtgaacaagacaggccttccccaaccacagcgccccctgcgccacccagcccctcgccctcacccgtgcccaagagcccctctgtggacaagtacaacgtgagcggcaccaacgggacctgcctgctggccagcatggggctgcagctgaacctcacctatgagaggaaggacaacacgacggtgacaaggcttctcaacatcaaccccaacaagacctcggccagcgggagctgcggcgcccacctggtgactctggagctgcacagcgagggcaccaccgtcctgctcttccagttcgggatgaatgcaagttctagccggtttttcctacaaggaatccagttgaatacaattcttcctgacgccagagaccctgcctttaaagctgccaacggctccctgcgagcgctgcaggccacagtcggcaattcctacaagtgcaacgcggaggagcacgtccgtgtcacgaaggcgttttcagtcaatatattcaaagtgtgggtccaggctttcaaggtggaaggtggccagtttggctctgtggaggagtgtctgctggacgagaacagcatgctgatccccatcgctgtgggtggtgccctggcggggctggtcctcatcgtcctcatcgcctacctcgtcggcaggaagaggagtcacgcaggctaccagactatctagcctggtgcacgcaggcacagcagctgcaggggcctctgttcctttctctgggcttagggtcctgtcgaaggggaggcacactttctggcaaacgtttctcaaatctgcttcatccaatgtgaagttcatcttgcagcatttactatgcacaacagagtaactatcgaaatgacggtgttaattttgctaactgggttaaatattttgctaactggttaaacattaatatttaccaaagtaggattttgagggtgggggtgctctctctgagggggtgggggtgccgctgtctctgaggggtgggggtgccgctgtctctgaggggtgggggtgccgctctctctgagggggtgggggtgccgctttctctgagggggtgggggtgccgctctctctgagggggtgggggtgctgctctctccgaggggtggaatgccgctgtctctgaggggtgggggtgccgctctaaattggctccatatcatttgagtttagggttctggtgtttggtttcttcattctttactgcactcagatttaagccttacaaagggaaagcctctggccgtcacacgtaggacgcatgaaggtcactcgtggtgaggctgacatgctcacacattacaacagtagagagggaaaatcctaagacagaggaactccagagatgagtgtctggagcgcttcagttcagctttaaaggccaggacgggccacacgtggctggcggcctcgttccagtggcggcacgtccttgggcgtctctaatgtctgcagctcaagggctggcacttttttaaatataaaaatgggtgttattaaaagaaagagagcttttggtcatcatggtgacaaggcgaggcatcacgtgacgtgcgctgcggacaactatagatcaggccgtctcaaatgtgggcacgaccgaggacaccagggccgcgctaca

SEQ ID NO: 449231 - DNA, 2305 bp, Homo sapiens
tcggcctgcatcacgcgtgagggggcgcgcggtgctggaagctgccgcacctgcggggagccgagccgccggcgctcgacgcgcgcgctctcgcgagacccgcgggatcacgtgacgcccgggcgcggcgcagctcacgtgacaagcgctgccggccgcggtgtcttcttcgtgccggcgtcgcagtggccgggcctcttgcgtctggtaacgccgctgtctctaacgccagcccttggcgcccgcgccccgccaccgcagcgcccggcagtccgcggcccaaccgccgcccgcgcccccgctctccgcaccgtacccggccgcctcgcgccatggcggcccccggcagcgcccggcgacccctgctgctgctactgctgttgctgctgctcggcctcatgcattgtgcgtcagcagcaatgtttatggtgaaaaatggcaacgggaccgcgtgcataatggccaacttctctgctgccttctcagtgaactacgacaccaagagtggccctaagaacatgacctttgacctgccatcagatgccacagtggtgctcaaccgcagctcctgtggaaaagagaacacttctgaccccagtctcgtgattgcttttggaagaggacatacactcactctcaatttcacgagaaatgcaacacgttacagcgtccagctcatgagttttgtttataacttgtcagacacacaccttttccccaatgcgagctccaaagaaatcaagactgtggaatctataactgacatcagggcagatatagataaaaaatacagatgtgttagtggcacccaggtccacatgaacaacgtgaccgtaacgctccatgatgccaccatccaggcgtacctttccaacagcagcttcagcaggggagagacacgctgtgaacaagacaggccttccccaaccacagcgccccctgcgccacccagcccctcgccctcacccgtgcccaagagcccctctgtggacaagtacaacgtgagcggcaccaacgggacctgcctgctggccagcatggggctgcagctgaacctcacctatgagaggaaggacaacacgacggtgacaaggcttctcaacatcaaccccaacaagacctcggccagcgggagctgcggcgcccacctggtgactctggagctgcacagcgagggcaccaccgtcctgctcttccagttcgggatgaatgcaagttctagccggtttttcctacaaggaatccagttgaatacaattcttcctgacgccagagaccctgcctttaaagctgccaacggctccctgcgagcgctgcaggccacagtcggcaattcctacaagtgcaacgcggaggagcacgtccgtgtcacgaaggcgttttcagtcaatatattcaaagtgtgggtccaggctttcaaggtggaaggtggccagtttggctctgtggaggagtgtctgctggacgagaacagcatgctgatccccatcgctgtgggtggtgccctggcggggctggtcctcatcgtcctcatcgcctacctcgtcggcaggaagaggagtcacgcaggctaccagactatctagcctggtgcacgcaggcacagcagctgcaggggcctctgttcctttctctgggcttagggtcctgtcgaaggggaggcacactttctggcaaacgtttctcaaatctgcttcatccaatgtgaagttcatcttgcagcatttactatgcacaacagagtaactatcgaaatgacggtgttaattttgctaactgggttaaatattttgctaactggttaaacattaatatttaccaaagtaggattttgagggtgggggtgctctctctgagggggtgggggtgccgctgtctctgaggggtgggggtgccgctgtctctgaggggtgggggtgccgctctctctgagggggtgggggtgccgctttctctgagggggtgggggtgccgctctctctgagggggtgggggtgctgctctctccgaggggtggaatgccgctgtctctgaggggtgggggtgccgctctaaattggctccatatcatttgagtttagggttctggtgtttggtttcttcattctttactgcactcagatttaagccttacaaagggaaagcctctggccgtcacacgtaggacgcatgaaggtcactcgtggtgaggctgacatgctcacacattacaacagtagagagggaaaatcctaagacagaggaactccagagatgagtgtctggagcgcttcagttcagcacctttccggtccgtacatcgcat

SEQ ID NO: 449232 - DNA, 1892 bp, Homo sapiens
tcggcctgcatcacgcgtgagggggcgcgcggtgctggaagctgccgcacctgcggggagccgagccgccggcgctcgacgcgcgcgctctcgcgagacccgcgggatcacgtgacgcccgggcgcggcgcagctcacgtgacaagcgctgccggccgcggtgtcttcttcgtgccggcgtcgcagtggccgggcctcttgcgtctggtaacgccgctgtctctaacgccagcccttggcgcccgcgccccgccaccgcagcgcccggcagtccgcggcccaaccgccgcccgcgcccccgctctccgcaccgtacccggccgcctcgcgccatggcggcccccggcagcgcccggcgacccctgctgctgctactgctgttgctgctgctcggcctcatgcattgtgcgtcagcagcaatgtttatggtgaaaaatggcaacgggaccgcgtgcataatggccaacttctctgctgccttctcagtgaactacgacaccaagagtggccctaagaacatgacctttgacctgccatcagatgccacagtggtgctcaaccgcagctcctgtggaaaagagaacacttctgaccccagtctcgtgattgcttttggaagaggacatacactcactctcaatttcacgagaaatgcaacacgttacagcgtccagctcatgagttttgtttataacttgtcagacacacaccttttccccaatgcgagctccaaagaaatcaagactgtggaatctataactgacatcagggcagatatagataaaaaatacagatgtgttagtggcacccaggtccacatgaacaacgtgaccgtaacgctccatgatgccaccatccaggcgtacctttccaacagcagcttcagcaggggagagacacgctgtgaacaagacaggccttccccaaccacagcgccccctgcgccacccagcccctcgccctcacccgtgcccaagagcccctctgtggacaagtacaacgtgagcggcaccaacgggacctgcctgctggccagcatggggctgcagctgaacctcacctatgagaggaaggacaacacgacggtgacaaggcttctcaacatcaaccccaacaagacctcggccagcgggagctgcggcgcccacctggtgactctggagctgcacagcgagggcaccaccgtcctgctcttccagttcgggatgaatgcaagttctagccggtttttcctacaaggaatccagttgaatacaattcttcctgacgccagagaccctgcctttaaagctgccaacggctccctgcgagcgctgcaggccacagtcggcaattcctacaagtgcaacgcggaggagcacgtccgtgtcacgaaggcgttttcagtcaatatattcaaagtgtgggtccaggctttcaaggtggaaggtggccagtttggctctgtggaggagtgtctgctggacgagaacagcatgctgatccccatcgctgtgggtggtgccctggcggggctggtcctcatcgtcctcatcgcctacctcgtcggcaggaagaggagtcacgcaggctaccagactatctagcctggtgcacgcaggcacagcagctgcaggggcctctgttcctttctctgggcttagggtcctgtcgaaggggaggcacactttggctggcacttttttaaatataaaaatgggtgttatttttatttttttttgtaaagtgatttttggtcttctgttgacattcggggtgatcctgttctgcgctgtgtacaatgtgagatcggtgcgttctcctgatgttttgccgtggcttggggattgtacacgggaccagctcacgtaatgcattgcctgtaacaatgtaataaaaagcctctttctttt

SEQ ID NO: 449233 - DNA, 1511 bp, Homo sapiens
tcggcctgcatcacgcgtgagggggcgcgcggtgctggaagctgccgcacctgcggggagccgagccgccggcgctcgacgcgcgcgctctcgcgagacccgcgggatcacgtgacgcccgggcgcggcgcagctcacgtgacaagcgctgccggccgcggtgtcttcttcgtgccggcgtcgcagtggccgggcctcttgcgtctggtaacgccgctgtctctaacgccagcccttggcgcccgcgccccgccaccgcagcgcccggcagtccgcggcccaaccgccgcccgcgcccccgctctccgcaccgtacccggccgcctcgcgccatggcggcccccggcagcgcccggcgacccctgctgctgctactgctgttgctgctgctcggcctcatgcattgtgcgtcagcagcaatgtttatggtgaaaaatggcaacgggaccgcgtgcataatggccaacttctctgctgccttctcagtgaactacgacaccaagagtggccctaagaacatgacctttgacctgccatcagatgccacagtggtgctcaaccgcagctcctgtggaaaagagaacacttctgaccccagtctcgtgattgcttttggaagaggacatacactcactctcaatttcacgagaaatgcaacacgttacagcgtccagctcatgagttttgtttataacttgtcagacacacaccttttccccaatgcgagctccaaagaaatcaagactgtggaatctataactgacatcagggcagatatagataaaaaatacagatgtgttagtggcacccaggtccacatgaacaacgtgaccgtaacgctccatgatgccaccatccaggcgtacctttccaacagcagcttcagcaggggagagacacgctgtgaacaagacaggccttccccaaccacagcgccccctgcgccacccagcccctcgccctcacccgtgcccaagagcccctctgtggacaagtacaacgtgagcggcaccaacgggacctgcctgctggccagcatggggctgcagctgaacctcacctatgagaggaaggacaacacgacggtgacaaggcttctcaacatcaaccccaacaagacctcggccagcgggagctgcggcgcccacctggtgactctggagctgcacagcgagggcaccaccgtcctgctcttccagttcgggatgaatgcaagttctagccggtttttcctacaaggaatccagttgaatacaattcttcctgacgccagagaccctgcctttaaagctgccaacggctccctgcgagcgctgcaggccacagtcggcaattcctacaagtgcaacgcggaggagcacgtccgtgtcacgaaggcgttttcagtcaatatattcaaagtgtgggtccaggctttcaaggtggaaggtggccagtttggctctgtggaggagtgtctgctgacgagacagatacagatcccatgccgccgggatcctcagagtcacctc

SEQ ID NO: 449234 - DNA, 505 bp, Homo sapiens
tcggcctgcatcacgcgtgagggggcgcgcggtgctggaagctgccgcacctgcggggagccgagccgccggcgctcgacgcgcgcgctctcgcgagacccgcgggatcacgtgacgcccgggcgcggcgcagctcacgtgacaagcgctgccggccgcggtgtcttcttcgtgccggcgtcgcagtggccgggcctcttgcgtctggtaacgccgctgtctctaacgccagcccttggcgcccgcgccccgccaccgcagcgcccggcagtccgcggcccaaccgccgcccgcgcccccgctctccgcaccgtacccggccgcctcgcgccatggcggcccccggcagcgcccggcgacccctgctgctgctactgctgttgctgctgctcggtctcatgcattgtgcgtcagcagcaatgtgttatggcgatgaactacgacaccaagagtggccctaagaacatgaactttgacctgtcattagatgccacagggtgctccc

SEQ ID NO: 449235 - DNA, 206 bp, Homo sapiens
acccaatgaccattcacgtttgatgataaatgtgtgaatctactggggttaaagatcatctttctatgaatctgctccgtgattaaagatcatttttctttttaagaatgcaagttctagccggtttttcctacaaggaatccagttgaatacaattcttcctgacgccagaggtgagaacccacaatctctgcgagccccgcccc

SEQ ID NO: 449236 - DNA, 399 bp, Homo sapiens
tcctggtggtgctgctgtcctggtggtgtgcactgctgttgctgctgctcgcctcatgcattgtgcgtcagcagcaatgtttatggtgaaaaatggcaacgggaccgcgtgcataatggccaacttctctgctgccttctcagtgaactacgacaccaagagtggccctaagaacatgacctttgacctgccatcagatgccacagtggtgctcaaccgcagctcctgtggaaaagagaacacttctgaccccagtctcgtgattgcttttggaagaggacatacactcactctcaatttcacgagaaatgcaacacgttacagcaccagcacgaattcccttagcaccagcacgaattcccttagcaccagcacaatagcaccagcacgaattccctt

SEQ ID NO: 449237 - DNA, 2248 bp, Homo sapiens
tcctggtggtgctgctgtcctggtggtgtgcactgctgttgctgctgctcgcctcatgcattgtgcgtcagcagcaatgtttatggtgaaaaatggcaacgggaccgcgtgcataatggccaacttctctgctgccttctcagtgaactacgacaccaagagtggccctaagaacatgacctttgacctgccatcagatgccacagtggtgctcaaccgcagctcctgtggaaaagagaacacttctgaccccagtctcgtgattgcttttggaagaggacatacactcactctcaatttcacgagaaatgcaacacgttacagcgtccagctcatgagttttgtttataacttgtcagacacacaccttttccccaatgcgagctccaaagaaatcaagactgtggaatctataactgacatcagggcagatatagataaaaaatacagatgtgttagtggcacccaggtccacatgaacaacgtgaccgtaacgctccatgatgccaccatccaggcgtacctttccaacagcagcttcagcaggggagagacacgctgtgaacaagacaggccttccccaaccacagcgccccctgcgccacccagcccctcgccctcacccgtgcccaagagcccctctgtggacaagtacaacgtgagcggcaccaacgggacctgcctgctggccagcatggggctgcagctgaacctcacctatgagaggaaggacaacacgacggtgacaaggcttctcaacatcaaccccaacaagacctcggccagcgggagctgcggcgcccacctggtgactctggagctgcacagcgagggcaccaccgtcctgctcttccagttcgggatgaatgcaagttctagccggtttttcctacaaggaatccagttgaatacaattcttcctgacgccagagaccctgcctttaaagctgccaacggctccctgcgagcgctgcaggccacagtcggcaattcctacaagtgcaacgcggaggagcacgtccgtgtcacgaaggcgttttcagtcaatatattcaaagtgtgggtccaggctttcaaggtggaaggtggccagtttggctctgtggaggagtgtctgctggacgagaacagcatgctgatccccatcgctgtgggtggtgccctggcggggctggtcctcatcgtcctcatcgcctacctcgtcggcaggaagaggagtcacgcaggctaccagactatctagcctggtgcacgcaggcacagcagctgcaggggcctctgttcctttctctgggcttagggtcctgtcgaaggggaggcacactttctggcaaacgtttctcaaatctgcttcatccaatgtgaagttcatcttgcagcatttactatgcacaacagagtaactatcgaaatgacggtgttaattttgctaactgggttaaatattttgctaactggttaaacattaatatttaccaaagtaggattttgagggtgggggtgctctctctgagggggtgggggtgccgctgtctctgaggggtgggggtgccgctgtctctgaggggtgggggtgccgctctctctgagggggtgggggtgccgctttctctgagggggtgggggtgccgctctctctgagggggtgggggtgctgctctctccgaggggtggaatgccgctgtctctgaggggtgggggtgccgctctaaattggctccatatcatttgagtttagggttctggtgtttggtttcttcattctttactgcactcagatttaagccttacaaagggaaagcctctggccgtcacacgtaggacgcatgaaggtcactcgtggtgaggctgacatgctcacacattacaacagtagagagggaaaatcctaagacagaggaactccagagatgagtgtctggagcgcttcagttcagctttaaaggccaggacgggccacacgtggctggcggcctcgttccagtggcggcacgtccttgggcgtctctaatgtctgcagctcaagggctggcacttttttaaatataaaaatgggtgttatttttatttttttttgtaaagtgatttttggtcttctgttgacattcggggtgatcctgttctgcgctgtgtacaatgtgagatcggtgcgttctcctgatgttttgccgtggcttggggattgtacacgggaccagctcacgtaatgcattgcctgtaacaatgtaataaaaagcctctttctttt

SEQ ID NO: 449238 - DNA, 1684 bp, Homo sapiens
tgtgtaaggcatgcagcttgatgctgaggtgattaaggatccccttgccaagacctcacccgtgcccaagagcccctctgtggacaagtacaacgtgagcggcaccaacgggacctgcctgctggccagcatggggctgcagctgaacctcacctatgagaggaaggacaacacgacggtgacaaggcttctcaacatcaaccccaacaagacctcggccagcgggagctgcggcgcccacctggtgactctggagctgcacagcgagggcaccaccgtcctgctcttccagttcgggatgaatgcaagttctagccggtttttcctacaaggaatccagttgaatacaattcttcctgacgccagagaccctgcctttaaagctgccaacggctccctgcgagcgctgcaggccacagtcggcaattcctacaagtgcaacgcggaggagcacgtccgtgtcacgaaggcgttttcagtcaatatattcaaagtgtgggtccaggctttcaaggtggaaggtggccagtttggctctgtggaggagtgtctgctggacgagaacagcatgctgatccccatcgctgtgggtggtgccctggcggggctggtcctcatcgtcctcatcgcctacctcgtcggcaggaagaggagtcacgcaggctaccagactatctagcctggtgcacgcaggcacagcagctgcaggggcctctgttcctttctctgggcttagggtcctgtcgaaggggaggcacactttctggcaaacgtttctcaaatctgcttcatccaatgtgaagttcatcttgcagcatttactatgcacaacagagtaactatcgaaatgacggtgttaattttgctaactgggttaaatattttgctaactggttaaacattaatatttaccaaagtaggattttgagggtgggggtgctctctctgagggggtgggggtgccgctgtctctgaggggtgggggtgccgctgtctctgaggggtgggggtgccgctctctctgagggggtgggggtgccgctttctctgagggggtgggggtgccgctctctctgagggggtgggggtgctgctctctccgaggggtggaatgccgctgtctctgaggggtgggggtgccgctctaaattggctccatatcatttgagtttagggttctggtgtttggtttcttcattctttactgcactcagatttaagccttacaaagggaaagcctctggccgtcacacgtaggacgcatgaaggtcactcgtggtgaggctgacatgctcacacattacaacagtagagagggaaaatcctaagacagaggaactccagagatgagtgtctggagcgcttcagttcagctttaaaggccaggacgggccacacgtggctggcggcctcgttccagtggcggcacgtccttgggcgtctctaatgtctgcagctcaagggctggcacttttttaaatataaaaatgggtgttatttttatttttttttgtaaagtgatttttggtcttctgttgacattcggggtgatcctgttctgcgctgtgtacaatgtgagatcggtgcgttctcctgatgttttgccgtggcttggggattgtacacgggaccagctcacgtaatgcattgcctgtaacaatgtaataaaaagcctctttctttt

SEQ ID NO: 449239 - DNA, 2015 bp, Homo sapiens
tcggcctgcatcacgcgtgagggggcgcgcggtgctggaagctgccgcacctgcggggagccgagccgccggcgctcgacgcgcgcgctctcgcgagacccgcgggatcacgtgacgcccgggcgcggcgcagctcacgtgacaagcgctgccggccgcggtgtcttcttcgtgccggcgtcgcagtggccgggcctcttgcgtctggtaacgccgctgtctctaacgccagcccttggcgcccgcgccccgccaccgcagcgcccggcagtccgcggcccaaccgccgcccgcgcccccgctctccgcaccgtacccggccgcctcgcgccatggcggcccccggcagcgcccggcgacccctgctgctgctactgctgttgctgctgctcggcctcatgcattgtgcgtcagcagcaatgtttatggtgaaaaatggcaacgggaccgcgtgcataatggccaacttctctgctgccttctcagtgaactacgacaccaagagtggccctaagaacatgacctttgacctgccatcagatgccacagtggtgctcaaccgcagctcctgtggaaaagagaacacttctgaccccagtctcgtgattgcttttggaagaggacatacactcactctcaatttcacgagaaatgcaacacgttacagcgtccagctcatgagttttgtttataacttgtcagacacacaccttttccccaatgcgagctccaaagaaatcaagactgtggaatctataactgacatcagggcagatatagataaaaaatacagatgtgttagtggcacccaggtccacatgaacaacgtgaccgtaacgctccatgatgccaccatccaggcgtacctttccaacagcagcttcagcaggggagagacacgctgtgaacaagacaggccttccccaaccacagcgccccctgcgccacccagcccctcgccctcacccgtgcccaagagcccctctgtggacaagtacaacgtgagcggcaccaacgggacctgcctgctggccagcatggggctgcagctgaacctctgggcttagggtcctgtcgaaggggaggcacactttctggcaaacgtttctcaaatctgcttcatccaatgtgaagttcatcttgcagcatttactatgcacaacagagtaactatcgaaatgacggtgttaattttgctaactgggttaaatattttgctaactggttaaacattaatatttaccaaagtaggattttgagggtgggggtgctctctctgagggggtgggggtgccgctgtctctgaggggtgggggtgccgctgtctctgaggggtgggggtgccgctctctctgagggggtgggggtgccgctttctctgagggggtgggggtgccgctctctctgagggggtgggggtgctgctctctccgaggggtggaatgccgctgtctctgaggggtgggggtgccgctctaaattggctccatatcatttgagtttagggttctggtgtttggtttcttcattctttactgcactcagatttaagccttacaaagggaaagcctctggccgtcacacgtaggacgcatgaaggtcactcgtggtgaggctgacatgctcacacattacaacagtagagagggaaaatcctaagacagaggaactccagagatgagtgtctggagcgcttcagttcagctttaaaggccaggacgggccacacgtggctggcggcctcgttccagtggcggcacgtccttgggcgtctctaatgtctgcagctcaagggctggcacttttttaaatataaaaatgggtgttatttttatttttttttgtaaagtgatttttggtcttctgttgacattcggggtgatcctgttctgcgctgtgtacaatgtgagatcggtgcgttctcctgatgttttgccgtggcttggggattgtacacgggaccagctcacgtaatgcattgcctgtaacaatgtaataaaaagcctctttctttt

SEQ ID NO: 449240 - DNA, 2830 bp, Homo sapiens
tcggcctgcatcacgcgtgagggggcgcgcggtgctggaagctgccgcacctgcggggagccgagccgccggcgctcgacgcgcgcgctctcgcgagacccgcgggatcacgtgacgcccgggcgcggcgcagctcacgtgacaagcgctgccggccgcggtgtcttcttcgtgccggcgtcgcagtggccgggcctcttgcgtctggtaacgccgctgtctctaacgccagcccttggcgcccgcgccccgccaccgcagcgcccggcagtccgcggcccaaccgccgcccgcgcccccgctctccgcaccgtacccggccgcctcgcgccatggcggcccccggcagcgcccggcgacccctgctgctgctactgctgttgctgctgctcggcctcatgcattgtgcgtcagcagcaatgtttatggtgaaaaatggcaacgggaccgcgtgcataatggccaacttctctgctgccttctcagtgaactacgacaccaagagtggccctaagaacatgacctttgacctgccatcagatgccacagtggtgctcaaccgcagctcctgtggaaaagagaacacttctgaccccagtctcgtgattgcttttggaagaggacatacactcactctcaatttcacgagaaatgcaacacgttacagcgtccagctcatgagttttgtttataacttgtcagacacacaccttttccccaatgcgagctccaaagaaatcaagactgtggaatctataactgacatcagggcagatatagataaaaaatacagatgtgttagtggcacccaggtccacatgaacaacgtgaccgtaacgctccatgatgccaccatccaggcgtacctttccaacagcagcttcagcaggggagagacacgctgtgaacaagacaggccttccccaaccacagcgccccctgcgccacccagcccctcgccctcacccgtgcccaagagcccctctgtggacaagtacaacgtgagcggcaccaacgggacctgcctgctggccagcatggggctgcagctgaacctcacctatgagaggaaggacaacacgacggtgacaaggcttctcaacatcaaccccaacaagacctcggccagcgggagctgcggcgcccacctggtgactctggagctgcacagcgagggcaccaccgtcctgctcttccagttcgggatgaatgcaagttctagccggtttttcctacaaggaatccagttgaatacaattcttcctgacgccagagaccctgcctttaaagctgccaacggctccctgcgagcgctgcaggccacagtcggcaattcctacaagtgcaacgcggaggagcacgtccgtgtcacgaaggcgttttcagtcaatatattcaaagtgtgggtccaggctttcaaggtggaaggtggccagtttggctctgtggaggagtgtctgctggacgagaacagcatgctgatccccatcgctgtgggtggtgccctggcggggctggtcctcatcgtcctcatcgcctacctcgtcggcaggaagaggagtcacgcaggctaccagactatctagcctggtgcacgcaggcacagcagctgcaggggcctctgttcctttctctgggcttagggtcctgtcgaaggggaggcacactttctggcaaacgtttctcaaatctgcttcatccaatgtgaagttcatcttgcagcatttactatgcacaacagagtaactatcgaaatgacggtgttaattttgctaactgggttaaatattttgctaactggttaaacattaatatttaccaaagtaggattttgagggtgggggtgctctctctgagggggtgggggtgccgctgtctctgaggggtgggggtgccgctgtctctgaggggtgggggtgccgctctctctgagggggtgggggtgccgctttctctgagggggtgggggtgccgctctctctgagggggtgggggtgctgctctctccgaggggtggaatgccgctgtctctgaggggtgggggtgccgctctaaattggctccatatcatttgagtttagggttctggtgtttggtttcttcattctttactgcactcagatttaagccttacaaagggaaagcctctggccgtcacacgtaggacgcatgaaggtcactcgtggtgaggctgacatgctcacacattacaacagtagagagggaaaatcctaagacagaggaactccagagatgagtgtctggagcgcttcagttcagctttaaaggccaggacgggccacacgtggctggcggcctcgttccagtggcggcacgtccttgggcgtctctaatgtctgcagctcaagggctggcacttttttaaatataaaaatgggtgttatttttatttttttttgtaaagtgatttttggtcttctgttgacattcggggtgatcctgttctgcgctgtgtacaatgtgagatcggtgcgttctcctgatgttttgccgtggcttggggattgtacacgggaccagctcacgtaatgcattgcctgtaacaatgtaataaaaagcctctttcttttggggtgggccttgtccttctgtcagctaaaatgggagctcatgagagaaggacgtcagggaaacggggttgagggtggtctcggtgcagagagaagggtgtcagggaaacggggggtgagggtggtcttggtgccagacgtagggaatggtgttgggagtggcccgagtgcctggcacagttgtctggttcattcatgtaacatgataatttttaaatcattaaaaaaattacctttca

SEQ ID NO: 449241 - DNA, 2644 bp, Homo sapiens
tcggcctgcatcacgcgtgagggggcgcgcggtgctggaagctgccgcacctgcggggagccgagccgccggcgctcgacgcgcgcgctctcgcgagacccgcgggatcacgtgacgcccgggcgcggcgcagctcacgtgacaagcgctgccggccgcggtgtcttcttcgtgccggcgtcgcagtggccgggcctcttgcgtctggtaacgccgctgtctctaacgccagcccttggcgcccgcgccccgccaccgcagcgcccggcagtccgcggcccaaccgccgcccgcgcccccgctctccgcaccgtacccggccgcctcgcgccatggcggcccccggcagcgcccggcgacccctgctgctgctactgctgttgctgctgctcggcctcatgcattgtgcgtcagcagcaatgtttatggtgaaaaatggcaacgggaccgcgtgcataatggccaacttctctgctgccttctcagtgaactacgacaccaagagtggccctaagaacatgacctttgacctgccatcagatgccacagtggtgctcaaccgcagctcctgtggaaaagagaacacttctgaccccagtctcgtgattgcttttggaagaggacatacactcactctcaatttcacgagaaatgcaacacgttacagcgtccagctcatgagttttgtttataacttgtcagacacacaccttttccccaatgcgagctccaaagaaatcaagactgtggaatctataactgacatcagggcagatatagataaaaaatacagatgtgttagtggcacccaggtccacatgaacaacgtgaccgtaacgctccatgatgccaccatccaggcgtacctttccaacagcagcttcagcaggggagagacacgctgtgaacaagacaggccttccccaaccacagcgccccctgcgccacccagcccctcgccctcacccgtgcccaagagcccctctgtggacaagtacaacgtgagcggcaccaacgggacctgcctgctggccagcatggggctgcagctgaacctcacctatgagaggaaggacaacacgacggtgacaaggcttctcaacatcaaccccaacaagacctcggccagcgggagctgcggcgcccacctggtgactctggagctgcacagcgagggcaccaccgtcctgctcttccagttcgggatgaatgcaagttctagccggtttttcctacaaggaatccagttgaatacaattcttcctgacgccagagaccctgcctttaaagctgccaacggctccctgcgagcgctgcaggccacagtcggcaattcctacaagtgcaacgcggaggagcacgtccgtgtcacgaaggcgttttcagtcaatatattcaaagtgtgggtccaggctttcaaggtggaaggtggccagtttggctctgtggaggagtgtctgctggacgagaacagcatgctgatccccatcgctgtgggtggtgccctggcggggctggtcctcatcgtcctcatcgcctacctcgtcggcaggaagaggagtcacgcaggctaccagactatctagcctggtgcacgcaggcacagcagctgcaggggcctctgttcctttctctgggcttagggtcctgtcgaaggggaggcacactttctggcaaacgtttctcaaatctgcttcatccaatgtgaagttcatcttgcagcatttactatgcacaacagagtaactatcgaaatgacggtgttaattttgctaactgggttaaatattttgctaactggttaaacattaatatttaccaaagtaggattttgagggtgggggtgctctctctgagggggtgggggtgccgctgtctctgaggggtgggggtgccgctgtctctgaggggtgggggtgccgctctctctgagggggtgggggtgccgctttctctgagggggtgggggtgccgctctctctgagggggtgggggtgctgctctctccgaggggtggaatgccgctgtctctgaggggtgggggtgccgctctaaattggctccatatcatttgagtttagggttctggtgtttggtttcttcattctttactgcactcagatttaagccttacaaagggaaagcctctggccgtcacacgtaggacgcatgaaggtcactcgtggtgaggctgacatgctcacacattacaacagtagagagggaaaatcctaagacagaggaactccagagatgagtgtctggagcgcttcagttcagctttaaaggccaggacgggccacacgtggctggcggcctcgttccagtggcggcacgtccttgggcgtctctaatgtctgcagctcaagggctggcacttttttaaatataaaaatgggtgttatttttatttttttttgtaaagtgatttttggtcttctgttgacattcggggtgatcctgttctgcgctgtgtacaatgtgagatcggtgcgttctcctgatgttttgccgtggcttggggattgtacacgggaccagctcacgtaatgcattgcctgtaacaatgtaataaaaagcctctttcttttaaaaaaccctggggggggcccgtccccatttgccctatggggcggtttctccc

SEQ ID NO: 449242 - DNA, 2655 bp, Homo sapiens
tcggcctgcatcacgcgtgagggggcgcgcggtgctggaagctgccgcacctgcggggagccgagccgccggcgctcgacgcgcgcgctctcgcgagacccgcgggatcacgtgacgcccgggcgcggcgcagctcacgtgacaagcgctgccggccgcggtgtcttcttcgtgccggcgtcgcagtggccgggcctcttgcgtctggtaacgccgctgtctctaacgccagcccttggcgcccgcgccccgccaccgcagcgcccggcagtccgcggcccaaccgccgcccgcgcccccgctctccgcaccgtacccggccgcctcgcgccatggcggcccccggcagcgcccggcgacccctgctgctgctactgctgttgctgctgctcggcctcatgcattgtgcgtcagcagcaatgtttatggtgaaaaatggcaacgggaccgcgtgcataatggccaacttctctgctgccttctcagtgaactacgacaccaagagtggccctaagaacatgacctttgacctgccatcagatgccacagtggtgctcaaccgcagctcctgtggaaaagagaacacttctgaccccagtctcgtgattgcttttggaagaggacatacactcactctcaatttcacgagaaatgcaacacgttacagcgtccagctcatgagttttgtttataacttgtcagacacacaccttttccccaatgcgagctccaaagaaatcaagactgtggaatctataactgacatcagggcagatatagataaaaaatacagatgtgttagtggcacccaggtccacatgaacaacgtgaccgtaacgctccatgatgccaccatccaggcgtacctttccaacagcagcttcagcaggggagagacacgctgtgaacaagacaggccttccccaaccacagcgccccctgcgccacccagcccctcgccctcacccgtgcccaagagcccctctgtggacaagtacaacgtgagcggcaccaacgggacctgcctgctggccagcatggggctgcagctgaacctcacctatgagaggaaggacaacacgacggtgacaaggcttctcaacatcaaccccaacaagacctcggccagcgggagctgcggcgcccacctggtgactctggagctgcacagcgagggcaccaccgtcctgctcttccagttcgggatgaatgcaagttctagccggtttttcctacaaggaatccagttgaatacaattcttcctgacgccagagaccctgcctttaaagctgccaacggctccctgcgagcgctgcaggccacagtcggcaattcctacaagtgcaacgcggaggagcacgtccgtgtcacgaaggcgttttcagtcaatatattcaaagtgtgggtccaggctttcaaggtggaaggtggccagtttggctctgtggaggagtgtctgctggacgagaacagcatgctgatccccatcgctgtgggtggtgccctggcggggctggtcctcatcgtcctcatcgcctacctcgtcggcaggaagaggagtcacgcaggctaccagactatctagcctggtgcacgcaggcacagcagctgcaggggcctctgttcctttctctgggcttagggtcctgtcgaaggggaggcacactttctggcaaacgtttctcaaatctgcttcatccaatgtgaagttcatcttgcagcatttactatgcacaacagagtaactatcgaaatgacggtgttaattttgctaactgggttaaatattttgctaactggttaaacattaatatttaccaaagtaggattttgagggtgggggtgctctctctgagggggtgggggtgccgctgtctctgaggggtgggggtgccgctgtctctgaggggtgggggtgccgctctctctgagggggtgggggtgccgctttctctgagggggtgggggtgccgctctctctgagggggtgggggtgctgctctctccgaggggtggaatgccgctgtctctgaggggtgggggtgccgctctaaattggctccatatcatttgagtttagggttctggtgtttggtttcttcattctttactgcactcagatttaagccttacaaagggaaagcctctggccgtcacacgtaggacgcatgaaggtcactcgtggtgaggctgacatgctcacacattacaacagtagagagggaaaatcctaagacagaggaactccagagatgagtgtctggagcgcttcagttcagctttaaaggccaggacgggccacacgtggctggcggcctcgttccagtggcggcacgtccttgggcgtctctaatgtctgcagctcaagggctggcacttttttaaatataaaaatgggtgttatttttatttttttttgtaaagtgatttttggtcttctgttgacattcggggtgatcctgttctgcgctgtgtacaatgtgagatcggtgcgttctcctgatgttttgccgtggcttggggattgtacacgggaccagctcacgtaatgcattgcctgtaacaatgtaataaaaagcctctttcttttaaaattaaacttgagcaagtttttgcatgcggccggaatttgagcttactgggccatttgccct

SEQ ID NO: 449243 - DNA, 3050 bp, Homo sapiens
tcggcctgcatcacgcgtgagggggcgcgcggtgctggaagctgccgcacctgcggggagccgagccgccggcgctcgacgcgcgcgctctcgcgagacccgcgggatcacgtgacgcccgggcgcggcgcagctcacgtgacaagcgctgccggccgcggtgtcttcttcgtgccggcgtcgcagtggccgggcctcttgcgtctggtaacgccgctgtctctaacgccagcccttggcgcccgcgccccgccaccgcagcgcccggcagtccgcggcccaaccgccgcccgcgcccccgctctccgcaccgtacccggccgcctcgcgccatggcggcccccggcagcgcccggcgacccctgctgctgctactgctgttgctgctgctcggcctcatgcattgtgcgtcagcagcaatgtttatggtgaaaaatggcaacgggaccgcgtgcataatggccaacttctctgctgccttctcagtgaactacgacaccaagagtggccctaagaacatgacctttgacctgccatcagatgccacagtggtgctcaaccgcagctcctgtggaaaagagaacacttctgaccccagtctcgtgattgcttttggaagaggacatacactcactctcaatttcacgagaaatgcaacacgttacagcgtccagctcatgagttttgtttataacttgtcagacacacaccttttccccaatgcgagctccaaagaaatcaagactgtggaatctataactgacatcagggcagatatagataaaaaatacagatgtgttagtggcacccaggtccacatgaacaacgtgaccgtaacgctccatgatgccaccatccaggcgtacctttccaacagcagcttcagcaggggagagacacgctgtgaacaagacaggccttccccaaccacagcgccccctgcgccacccagcccctcgccctcacccgtgcccaagagcccctctgtggacaagtacaacgtgagcggcaccaacgggacctgcctgctggccagcatggggctgcagctgaacctcacctatgagaggaaggacaacacgacggtgacaaggcttctcaacatcaaccccaacaagacctcggccagcgggagctgcggcgcccacctggtgactctggagctgcacagcgagggcaccaccgtcctgctcttccagttcgggatgaatgcaagttctagccggtttttcctacaaggaatccagttgaatacaattcttcctgacgccagagaccctgcctttaaagctgccaacggctccctgcgagcgctgcaggccacagtcggcaattcctacaagtgcaacgcggaggagcacgtccgtgtcacgaaggcgttttcagtcaatatattcaaagtgtgggtccaggctttcaaggtggaaggtggccagtttggctctgtggaggagtgtctgctggacgagaacagcatgctgatccccatcgctgtgggtggtgccctggcggggctggtcctcatcgtcctcatcgcctacctcgtcggcaggaagaggagtcacgcaggctaccagactatctagcctggtgcacgcaggcacagcagctgcaggggcctctgttcctttctctgggcttagggtcctgtcgaaggggaggcacactttctggcaaacgtttctcaaatctgcttcatccaatgtgaagttcatcttgcagcatttactatgcacaacagagtaactatcgaaatgacggtgttaattttgctaactgggttaaatattttgctaactggttaaacattaatatttaccaaagtaggattttgagggtgggggtgctctctctgagggggtgggggtgccgctgtctctgaggggtgggggtgccgctgtctctgaggggtgggggtgccgctctctctgagggggtgggggtgccgctttctctgagggggtgggggtgccgctctctctgagggggtgggggtgctgctctctccgaggggtggaatgccgctgtctctgaggggtgggggtgccgctctaaattggctccatatcatttgagtttagggttctggtgtttggtttcttcattctttactgcactcagatttaagccttacaaagggaaagcctctggccgtcacacgtaggacgcatgaaggtcactcgtggtgaggctgacatgctcacacattacaacagtagagagggaaaatcctaagacagaggaactccagagatgagtgtctggagcgcttcagttcagctttaaaggccaggacgggccacacgtggctggcggcctcgttccagtggcggcacgtccttgggcgtctctaatgtctgcagctcaagggctggcacttttttaaatataaaaatgggtgttatattcggggtgatcctgttctgcgctgtgtacaatgtgagatcggtgcgttctcctgatgttttgccgtggcttggggattgtacacgggaccagctcacgtaatgcattgcctgtaacaatgtaataaaaagcctctttcttttggggtgggccttgtccttctgtcagctaaaatgggagctcatgagagaaggacgtcagggaaacggggttgagggtggtctcggtgcagagagaagggtgtcagggaaacggggggtgagggtggtcttggtgccagacgtagggaatggtgttgggagtggcccgagtgcctggcacagttgtctggttcattcatgtaacatgataatttttaaatcattaaaaaaattacctttcatacagataccatggaatactatgcagccataaagaggtatgagatcttgtcccctgcagggacacggatagagctggaagccattattctcagcaaactaacacaggagcagaaaaccagacaccacttgttctcacttgtaagtgggagcttctgatgagaacacatggacacaaggaggggaacatcacacactggggcccgttgggtcgggggcagggagagcatcaggaagaatagctaagggatgctggcttcatac

SEQ ID NO: 449244 - DNA, 2471 bp, Homo sapiens
tcggcctgcatcacgcgtgagggggcgcgcggtgctggaagctgccgcacctgcggggagccgagccgccggcgctcgacgcgcgcgctctcgcgagacccgcgggatcacgtgacgcccgggcgcggcgcagctcacgtgacaagcgctgccggccgcggtgtcttcttcgtgccggcgtcgcagtggccgggcctcttgcgtctggtaacgccgctgtctctaacgccagcccttggcgcccgcgccccgccaccgcagcgcccggcagtccgcggcccaaccgccgcccgcgcccccgctctccgcaccgtacccggccgcctcgcgccatggcggcccccggcagcgcccggcgacccctgctgctgctactgctgttgctgctgctcggcctcatgcattgtgcgtcagcagcaatgtttatggtgaaaaatggcaacgggaccgcgtgcataatggccaacttctctgctgccttctcagtgaactacgacaccaagagtggccctaagaacatgacctttgacctgccatcagatgccacagtggtgctcaaccgcagctcctgtggaaaagagaacacttctgaccccagtctcgtgattgcttttggaagaggacatacactcactctcaatttcacgagaaatgcaacacgttacagcgtccagctcatgagttttgtttataacttgtcagacacacaccttttccccaatgcgagctccaaagaaatcaagactgtggaatctataactgacatcagggcagatatagataaaaaatacagatgtgttagtggcacccaggtccacatgaacaacgtgaccgtaacgctccatgatgccaccatccaggcgtacctttccaacagcagcttcagcaggggagagacacgctgtgaacaagacaggccttccccaaccacagcgccccctgcgccacccagcccctcgccctcacccgtgcccaagagcccctctgtggacaagtacaacgtgagcggcaccaacgggacctgcctgctggccagcatggggctgcagctgaacctcacctatgagaggaaggacaacacgacggtgacaaggcttctcaacatcaaccccaacaagacctcggccagcgggagctgcggcgcccacctggtgactctggagctgcacagcgagggcaccaccgtcctgctcttccagttcgggatgaatgcaagttctagccggtttttcctacaaggaatccagttgaatacaattcttcctgacgccagagaccctgcctttaaagctgccaacggctccctgcgagcgctgcaggccacagtcggcaattcctacaagtgcaacgcggaggagcacgtccgtgtcacgaaggcgttttcagtcaatatattcaaagtgtgggtccaggctttcaaggtggaaggtggccagtttggctctgtggaggagtgtctgctggacgagaacagcatgctgatccccatcgctgtgggtggtgccctggcggggctggtcctcatcgtcctcatcgcctacctcgtcggcaggaagaggagtcacgcaggctaccagactatctagcctggtgcacgcaggcacagcagctgcaggggcctctgttcctttctctgggcttagggtcctgtcgaaggggaggcacactttctggcaaacgtttctcaaatctgcttcatccaatgtgaagttcatcttgcagcatttactatgcacaacagagtaactatcgaaatgacggtgttaattttgctaactgggttaaatattttgctaactggttaaacattaatatttaccaaagtaggattttgagggtgggggtgctctctctgagggggtgggggtgccgctgtctctgaggggtgggggtgccgctgtctctgaggggtgggggtgccgctctctctgagggggtgggggtgccgctttctctgagggggtgggggtgccgctctctctgagggggtgggggtgctgctctctccgaggggtggaatgccgctgtctctgaggggtgggggtgccgctctaaattggctccatatcatttgagtttagggttctggtgtttggtttcttcattctttactgcactcagatttaagccttacaaagggaaagcctctggccgtcacacgtaggacgcatgaaggtcactcgtggtgaggctgacatgctcacacattacaacagtagagagggaaaatcctaagacagaggaactccagagatgagtgtctggagcgcttcagttcagctttaaaggccaggacgggccacacgtggctggcggcctcgttccagtggcggcacgtccttgggcgtctctaatgtctgcagctcaagggctggcacttttttaaatataaaaatgggtgttatggtggaggaggagagcagcgtggttagctaacggttattgcttttgtggcaaatccaatgtaatga

SEQ ID NO: 449245 - DNA, 2308 bp, Homo sapiens
tcggcctgcatcacgcgtgagggggcgcgcggtgctggaagctgccgcacctgcggggagccgagccgccggcgctcgacgcgcgcgctctcgcgagacccgcgggatcacgtgacgcccgggcgcggcgcagctcacgtgacaagcgctgccggccgcggtgtcttcttcgtgccggcgtcgcagtggccgggcctcttgcgtctggtaacgccgctgtctctaacgccagcccttggcgcccgcgccccgccaccgcagcgcccggcagtccgcggcccaaccgccgcccgcgcccccgctctccgcaccgtacccggccgcctcgcgccatggcggcccccggcagcgcccggcgacccctgctgctgctactgctgttgctgctgctcggcctcatgcattgtgcgtcagcagcaatgtttatggtgaaaaatggcaacgggaccgcgtgcataatggccaacttctctgctgccttctcagtgaactacgacaccaagagtggccctaagaacatgacctttgacctgccatcagatgccacagtggtgctcaaccgcagctcctgtggaaaagagaacacttctgaccccagtctcgtgattgcttttggaagaggacatacactcactctcaatttcacgagaaatgcaacacgttacagcgtccagctcatgagttttgtttataacttgtcagacacacaccttttccccaatgcgagctccaaagaaatcaagactgtggaatctataactgacatcagggcagatatagataaaaaatacagatgtgttagtggcacccaggtccacatgaacaacgtgaccgtaacgctccatgatgccaccatccaggcgtacctttccaacagcagcttcagcaggggagagacacgctgtgaacaagacaggccttccccaaccacagcgccccctgcgccacccagcccctcgccctcacccgtgcccaagagcccctctgtggacaagtacaacgtgagcggcaccaacgggacctgcctgctggccagcatggggctgcagctgaacctcacctatgagaggaaggacaacacgacggtgacaaggcttctcaacatcaaccccaacaagacctcggccagcgggagctgcggcgcccacctggtgactctggagctgcacagcgagggcaccaccgtcctgctcttccagttcgggatgaatgcaagttctagccggtttttcctacaaggaatccagttgaatacaattcttcctgacgccagagaccctgcctttaaagctgccaacggctccctgcgagcgctgcaggccacagtcggcaattcctacaagtgcaacgcggaggagcacgtccgtgtcacgaaggcgttttcagtcaatatattcaaagtgtgggtccaggctttcaaggtggaaggtggccagtttggctctgtggaggagtgtctgctggacgagaacagcatgctgatccccatcgctgtgggtggtgccctggcggggctggtcctcatcgtcctcatcgcctacctcgtcggcaggaagaggagtcacgcaggctaccagactatctagcctggtgcacgcaggcacagcagctgcaggggcctctgttcctttctctgggcttagggtcctgtcgaaggggaggcacactttctggcaaacgtttctcaaatctgcttcatccaatgtgaagttcatcttgcagcatttactatgcacaacagagtaactatcgaaatgacggtgttaattttgctaactgggttaaatattttgctaactggttaaacattaatatttaccaaagtaggattttgagggtgggggtgctctctctgagggggtgggggtgccgctgtctctgaggggtgggggtgccgctgtctctgaggggtgggggtgccgctctctctgagggggtgggggtgccgctttctctgagggggtgggggtgccgctctctctgagggggtgggggtgctgctctctccgaggggtggaatgccgctgtctctgaggggtgggggtgccgctctaaattggctccatatcatttgagtttagggttctggtgtttggtttcttcattctttactgcactcagatttaagccttacaaagggaaagcctctggccgtcacacgtaggacgcatgaaggtcactcgtggtgaggctgacatgctcacacattacaacagtagagagggaaaatcctaagacagaggaactccagagatgagtgtctggagcgcttcagttcagcaccgcgcctgggatcctctagatccac

SEQ ID NO: 449246 - DNA, 1105 bp, Homo sapiens
tcggcctgcatcacgcgtgagggggcgcgcggtgctggaagctgccgcacctgcggggagccgagccgccggcgctcgacgcgcgcgctctcgcgagacccgcgggatcacgtgacgcccgggcgcggcgcagctcacgtgacaagcgctgccggccgcggtgtcttcttcgtgccggcgtcgcagtggccgggcctcttgcgtctggtaacgccgctgtctctaacgccagcccttggcgcccgcgccccgccaccgcagcgcccggcagtccgcggcccaaccgccgcccgcgcccccgctctccgcaccgtacccggccgcctcgcgccatggcggcccccggcagcgcccggcgacccctgctgctgctactgctgttgctgctgctcggcctcatgcattgtgcgtcagcagcaatgtttatggtgaaaaatggcaacgggaccgcgtgcataatggccaacttctctgctgccttctcagtgaactacgacaccaagagtggccctaagaacatgacctttgacctgccatcagatgccacagtggtgctcaaccgcagctcctgtggaaaagagaacacttctgaccccagtctcgtgattgcttttggaagaggacatacactcactctcaatttcacgagaaatgcaacacgttacagcgtccagctcatgagttttgtttataacttgtcagacacacaccttttccccaatgcgagctccaaagaaatcaagactgtggaatctataactgacatcagggcagatatagataaaaaatacagatgtgttagtggcacccaggtccacatgaacaacgtgaccgtaacgctccatgatgccaccatccaggcgtacctttccaacagcagcttcagcaggggagagacacgctgtgaacaagacaggccttccccaaccacagcgccccctgcgccacccagcccctcgccctcacccgtgcccaagagcccctctgtggacaagtacaacgtgagcggcaccaacgggacctgcctgctggccagcatggggctgcagctgaacctcacctatgagaggaaggacaacacggtagggctggggcctcacctggg

SEQ ID NO: 449247 - DNA, 503 bp, Homo sapiens
ctgggagcccctggtaccatttgagagtaagggaatcattttaagaaacagtggtggcgcttctcccatgaacgttgaatacaacactgtcatctgatgtgcacagaggccctggacgcagcacagctgtccggccacagcccctgattccagacgggggagagacgtgtgtggtttcctcgccgtgcagagagcaccagtctctgcagcggcttccccaagtgacaattccagctagagctggaaccttccgccagggttcctctttgccttttggctgatgtgggggagtggtggggagagaggcctgtttgcaggcccctgtgtgagcagagccctgacaccatccgtctgtcttggcagtggaggagtgtctgctggacgagaacagcatgctgatccccatcgctgtgggtggtgccctggcggggctggtcctcatcgtcctcatcgcctacctcgtcggcaggaagaggagtcacgcaggctaccagactatctag

SEQ ID NO: 449248 - DNA, 1390 bp, Homo sapiens
caaaagattttctttaatatcataaaatattttcatggacaagtgagctagcaaacacacatgcaccaatgtgccttttgacaagagtaccccctaccccgactcccacaccaaaatggacatgagattggagaaatgaatacagcagatggaacagatagaagaaaaaaaaatcagtaaaaaggatggaatataactttgtgcttggttattttcctatgtcgcaacaaaacaagacatttcggtgcaaatagttaatctttcctctttttttccatttgtcgaaaatatcattttatattccctaatctatatagctgaaaaagggttgtattttcttagctgaatatgaatacctcttaaacataaattagttcctctccagtgaagtatcttattttaccaatccatttcaggaaagaggttctgctgccgtaaaggcagaaattttatttttatcccttttatttgaatgagagatttgaaaatcgaattatgtaaatatttcaatgcatctgctattattttgtggagtttattaaactactttaaaaaaaaaaaaaaaaaaaatggagcctctcgggaggcgggtaacgttatagtatttgtcagaagttggggtctccgtgggcattgtgatccgtcccaggcagtggattaggaggccagaaggagatcccttccacggtgctaggctgagatggatcctctcagggcccaacagctggctgcggagctggaggtggagatgatggccgatatgtacaacagaatgaccagtgcctgccaccggaagtgtgtgcctcctcactacaaggaagcagagctctccaagggcgagtctgtgtgcctggaccgatgtgtctctaagtacctggacatccatgagcggatgggcaaaaagttgacagagttgtctatgcaggatgaagagctgatgaagagggtgcagcagagctctgggcctgcatgaggtccctgtcagtatacaccctggggtgtaccccaccccttcccactttaataaacgtgctccctgttgggtgtcatctgtgaagactgccaggcctaggctctctgtagagagtcttcaagatcccggagtggtagcgctgtctcctggtgaaggagtatttgtcacactggaatgtgactgtgtgtgtatgtatgtgtatatatatatatatatatatatataaacaagtttgttgacacctacaaaaaaaatataaaaccactacaacaaaaaaaacgcggcgcttcatttccggggcgcgaaacaaagggttttgaaagggccctcggtccaaggtgtatcggaacccccttttttgacaaaggtgaactgggcgggcccaatagaggggcgaaaatcgaaaacggtacttac

SEQ ID NO: 449249 - DNA, 1422 bp, Homo sapiens
agcagtaatcgcacaacgtcccgtggagcactgcttctcaaatttggctgtacatacgaatcacctggggaattttaaattgtattgctgcctgaggaattttaaactgtactcccagagattctgatttaattgaaatgaggtgagtcctgggcactgggatgtttaaaaacgttccaggtgattttaacgcgaaacaaaaacagaaccgctgtttgggggcgttcttccttctccacgcctgatttgcgcacaggagtcggctgtctggaacgggggtgaggttcacaggtgtctgtcgccacgcctcttcctacagaaccaataaactgaagccgctcggtgacatcccaaaggacttgaattctgatcgggctgcagacgctctgcaccccgcccaagcttctatggtactttgggtgtcctctctaggcactgggcaagtcgccttcctcttcgcccggcgccagccgctccttctctatgatcgccgagttcccggcgccgtctcgttggtatttaattccggaagcgagtttgaatcaaagaagaggcgggactttcctcccggaagtaacccacgtgcttccgctggagcctcttggagcctctcgggaggcgggtaacgttatagtatttgtcagaagttggggtctccgtgggcattgtgatccgtcccaggcagtggattaggaggccagaaggagatcccttccacggtgctaggctgagatggatcctctcagggcccaacagctggctgcggagctggaggtggagatgatggccgatatgtacaacagaatgaccagtgcctgccaccggaagtgtgtgcctcctcactacaaggaagcagagctctccaagggcgagtctgtgtgcctggaccgatgtgtctctaagtacctggacatccatgagcggatgggcaaaaagttgacagagttgtctatgcaggatgaagagctgatgaagagggtgcagcagagctctgggcctgcatgaggtccctgtcagtatacaccctggggtgtaccccaccccttcccactttaataaacgtgctccctgttgggtgtcatctgtgaagactgccaggcctaggctctctgtagagagtcttcaagatcccggagtggtagcgctgtctcctggtgaaggagtatttgtcacactggaatgtgactgtgtgtgtatgtatgtgtatatatatatatatatatatatataaacaagtttgttgacacctacaaaaaaaatataaaaccactacaacaaaaaaaacgcggcgcttcatttccggggcgcgaaacaaagggttttgaaagggccctcggtccaaggtgtatcggaacccccttttttgacaaaggtgaactgggcgggcccaatagaggggcgaaaatcgaaaacggtacttac

SEQ ID NO: 449250 - DNA, 1283 bp, Homo sapiens
caaaagattttctttaatatcataaaatattttcatggacaagtgagctagcaaacacacatgcaccaatgtgccttttgacaagagtaccccctaccccgactcccacaccaaaatggacatgagattggagaaatgaatacagcagatggaacagatagaagaaaaaaaaatcagtaaaaaggatggaatataactttgtgcttggttattttcctatgtcgcaacaaaacaagacatttcggtgcaaatagttaatctttcctctttttttccatttgtcgaaaatatcattttatattccctaatctatatagctgaaaaagggttgtattttcttagctgaatatgaatacctcttaaacataaattagttcctctccagtgaagtatcttattttaccaatccatttcaggaaagaggttctgctgccgtaaaggcagaaattttatttttatcccttttatttgaatgagagatttgaaaatcgaattatgtaaatatttcaatgcatctgctattattttgtggagtttattaaactactttaaaaaaaaaaaaaaaaaaaatggagcctctcgggaggcgggtaacgttatagtatttgtcagaagttggggtctccgtgggcattgtgatccgtcccaggcagtggattaggaggccagaaggagatcccttccacggtgctaggctgagatggatcctctcagggcccaacagctggctgcggagctggaggtggagatgatggccgatatgtacaacagaatgaccagtgcctgccaccggaagtgtgtgcctcctcactacaaggaagcagagctctccaagggcgagtctgtgtgcctggaccgatgtgtctctaagtacctggacatccatgagcggatgggcaaaaagttgacagagttgtctatgcaggatgaagagctgatgaagagggtgcagcagagctctgggcctgcatgaggtccctgtcagtatacaccctggggtgtaccccaccccttcccactttaataaacgtgctccctgttgggtgtcatctgtgaagactgccaggcctaggctctctgtagagagtcttcaagatcccggagtggtagcgctgtctcctggtgaaggagtatttgtcacactggaatgtgactgtgtgtgtatgtatgtgtatatatatatatatatatatatatatatatataaacaagtttgttgacacctactatgtgcaaagcagtgtgcttggcatttgagagtaaagaaaacagacacagcccct

SEQ ID NO: 449251 - DNA, 1845 bp, Homo sapiens
agcagtaatcgcacaacgtcccgtggagcactgcttctcaaatttggctgtacatacgaatcacctggggaattttaaattgtattgctgcctgaggaattttaaactgtactcccagagattctgatttaattgaaatgaggtgagtcctgggcactgggatgtttaaaaacgttccaggtgattttaacgcgaaacaaaaacagaaccgctgtttgggggcgttcttccttctccacgcctgatttgcgcacaggagtcggctgtctggaacgggggtgaggttcacaggtgtctgtcgccacgcctcttcctacagaaccaataaactgaagccgctcggtgacatcccaaaggacttgaattctgatcgggctgcagacgctctgcaccccgcccaagcttctatggtactttgggtgtcctctctaggcactgggcaagtcgccttcctcttcgcccggcgccagccgctccttctctatgatcgccgagttcccggcgccgtctcgttggtatttaattccggaagcgagtttgaatcaaagaagaggcgggactttcctcccggaagtaacccacgtgcttccgctggagcctcttggagcctctcgggaggcgggtaacgttatagtatttgtcagaagttggggtctccgtgggcattgtgatccgtcccaggcagtggtaagtgacacatgacctctgaattcaatgtggccctgatgatggcgtcgccatttcagaggtgtagcctttgggctgggtcccggtcgcctctgttcagcgtatgatcccattcccagggccctggaggttcaggttcgtgggttagagagttctcctccggtcctcgatctcctgaatagaggtgacctccaggaactggggcatcagagatccggggctcgatttccaggctcgccatagacgtcctgtgcgaccttgggctaggcctcagtttccacatccgtgaaatggggtggttaagctcactgaggttagtggcccgtggtggtctggcgccctgtgagtcctctgtatcctctagccccaggggtaggagagtgaacggcggcggtgggtgctgatggtgatgtctgctcccaggattaggaggccagaaggagatcccttccacggtgctaggctgagatggatcctctcagggcccaacagctggctgcggagctggaggtggagatgatggccgatatgtacaacagaatgaccagtgcctgccaccggaagtgtgtgcctcctcactacaaggaagcagagctctccaagggcgagtctgtgtgcctggaccgatgtgtctctaagtacctggacatccatgagcggatgggcaaaaagttgacagagttgtctatgcaggatgaagagctgatgaagagggtgcagcagagctctgggcctgcatgaggtccctgtcagtatacaccctggggtgtaccccaccccttcccactttaataaacgtgctccctgttgggtgtcatctgtgaagactgccaggcctaggctctctgtagagagtcttcaagatcccggagtggtagcgctgtctcctggtgaaggagtatttgtcacactggaatgtgactgtgtgtgtatgtatgtgtatatatatatatatatatatatataaacaagtttgttgacacctacaaaaaaaatataaaaccactacaacaaaaaaaacgcggcgcttcatttccggggcgcgaaacaaagggttttgaaagggccctcggtccaaggtgtatcggaacccccttttttgacaaaggtgaactgggcgggcccaatagaggggcgaaaatcgaaaacggtacttac

SEQ ID NO: 449252 - DNA, 1337 bp, Homo sapiens
agcagtaatcgcacaacgtcccgtggagcactgcttctcaaatttggctgtacatacgaatcacctggggaattttaaattgtattgctgcctgaggaattttaaactgtactcccagagattctgatttaattgaaatgaggtgagtcctgggcactgggatgtttaaaaacgttccaggtgattttaacgcgaaacaaaaacagaaccgctgtttgggggcgttcttccttctccacgcctgatttgcgcacaggagtcggctgtctggaacgggggtgaggttcacaggtgtctgtcgccacgcctcttcctacagaaccaataaactgaagccgctcggtgacatcccaaaggacttgaattctgatcgggctgcagacgctctgcaccccgcccaagcttctatggtactttgggtgtcctctctaggcactgggcaagtcgccttcctcttcgcccggcgccagccgctccttctctatgatcgccgagttcccggcgccgtctcgttggtatttaattccggaagcgagtttgaatcaaagaagaggcgggactttcctcccggaagtaacccacgtgcttccgctggagcctctgattaggaggccagaaggagatcccttccacggtgctaggctgagatggatcctctcagggcccaacagctggctgcggagctggaggtggagatgatggccgatatgtacaacagaatgaccagtgcctgccaccggaagtgtgtgcctcctcactacaaggaagcagagctctccaagggcgagtctgtgtgcctggaccgatgtgtctctaagtacctggacatccatgagcggatgggcaaaaagttgacagagttgtctatgcaggatgaagagctgatgaagagggtgcagcagagctctgggcctgcatgaggtccctgtcagtatacaccctggggtgtaccccaccccttcccactttaataaacgtgctccctgttgggtgtcatctgtgaagactgccaggcctaggctctctgtagagagtcttcaagatcccggagtggtagcgctgtctcctggtgaaggagtatttgtcacactggaatgtgactgtgtgtgtatgtatgtgtatatatatatatatatatatatataaacaagtttgttgacacctacaaaaaaaatataaaaccactacaacaaaaaaaacgcggcgcttcatttccggggcgcgaaacaaagggttttgaaagggccctcggtccaaggtgtatcggaacccccttttttgacaaaggtgaactgggcgggcccaatagaggggcgaaaatcgaaaacggtacttac

SEQ ID NO: 449253 - DNA, 1079 bp, Homo sapiens
agcagtaatcgcacaacgtcccgtggagcactgcttctcaaatttggctgtacatacgaatcacctggggaattttaaattgtattgctgcctgaggaattttaaactgtactcccagagattctgatttaattgaaatgaggtgagtcctgggcactgggatgtttaaaaacgttccaggtgattttaacgcgaaacaaaaacagaaccgctgtttgggggcgttcttccttctccacgcctgatttgcgcacaggagtcggctgtctggaacgggggtgaggttcacaggtgtctgtcgccacgcctcttcctacagaaccaataaactgaagccgctcggtgacatcccaaaggacttgaattctgatcgggctgcagacgctctgcaccccgcccaagcttctatggtactttgggtgtcctctctaggcactgggcaagtcgccttcctcttcgcccggcgccagccgctccttctctatgatcgccgagttcccggcgccgtctcgttggtatttaattccggaagcgagtttgaatcaaagaagaggcgggactttcctcccggaagtaacccacgtgcttccgctggagcctcttggagcctctcgggaggcgggtaacgttatagtatttgtcagaagttggggtctccgtgggcattgtgatccgtcccaggcagtggattaggaggccagaaggagatcccttccacggtgctaggctgagatggatcctctcagggcccaacagctggctgcggagctggaggtggagatgatggccgatatgtacaacagaatgaccagtgcctgccaccggaagtgtgtgcctcctcactacaaggaagcagagctctccaagggcgagtctgtgtgcctggaccgatgtgtctctaagtacctggacatccatgagcggatgggcaaaaagttgacagagttgtctatgcaggatgaagagctgatgaagagggtgcagcagagctctgggcctgcatgaggtccctgtcagtatacaccctggggtgtaccccaccccttcccactttaataaacgtgctccctgttgggtgt

SEQ ID NO: 449254 - DNA, 2475 bp, Homo sapiens
tccctaagaacccggaagtggtggagccaacggccagccagacctgtggcagtcccagccccagggtgctctccgcggtcggccatttatcggtgaagcaacagccccttgacgtcaagcttgacgcattggagataaagtccgaggaggtgaactaacctttgaacgtgccagtaagtaagatggcgagaaaagcaagagagagtgggaccgatcgatagcgcagcggtcggcttggcgccctttcagcgtgcgcagtgaacgtgcgctcggagcggtagattgggcaggattcgcgcctccatttttccaggagagagcgggataccaagagaaccggaccagctgctggcagggaaactgtcttccttttctccaagatgtacagaaccaaagtgggcttgaaggaccgccagcagctctacaagctgatcattagccagctgctatatgacggctacatcagcatcgccaatggcctcatcaatgaaatcaagcctcagtctgtgtgtgcaccctcggagcagctcctgcatctcatcaaactcggaatggaaaacgatgacaccgcagttcagtatgcaattggtcgttcagatactgttgcccctggcacagggattgacctggaatttgatgcagatgttcagactatgtccccagaggcttctgagtacgaaacatgctatgtcacatcacataaaggaccatgccgtgtagctacctatagtagagatggacagttaatagctactgggtctgctgatgcttcgataaagatacttgacacagagaggatgttggccaaaagtgccatgccaatagaggtcatgatgaatgagaccgcacaacaaaatatggaaaaccacccagtgattcgaactctttatgaccatgtggatgaagtcacgtgccttgctttccacccaacagaacagatcctggcttctggttcaagggattatactcttaaattatttgattattccaaaccatcagcaaaaagagccttcaaatacattcaggaagctgaaatgttacgttccatctcttttcatccttctggagactttatacttgtcggaactcagcatcctactcttcgcctttatgatatcaacacctttcaatgttttgtctcttgcaatcctcaagatcaacacaccgatgctatatgttccgttaattacaattctagtgccaatatgtacgtaactggaagcaaggacggctgcatcaaattatgggatggtgtttcaaatcgatgcatcacaacttttgagaaagcacatgacggtgctgaagtttgttctgccattttttccaaaaattctaaatacattctctcaagtggaaaagactctgtagctaaactttgggaaatatcaacgggacgaacactggtcagatacacgggcgcgggtttaagtggacgccaggtgcaccggacacaggctgtgtttaaccacaccgaggactatgtgttgctgcccgacgagaggacgatcagtctttgctgctgggactcgaggacagccgagcggagaaacctgctgtcgttggggcacaacaatattgtacgctgcatagtgcactcccccaccaaccccgggttcatgacgtgcagcgatgacttcagagcgcggttttggtaccggagatcgaccactgactgagccaccctctccgtagggttctttctcgaggactctaccctcctcccccacgtcctgtctcagctgcagtcgtaagtccgtgcaccatccttgacgttttgctgccacctctgtccacattcttcttggatttgtataaaagaatctttttttaccttgatgtagaatcatggtggaaaaagttggaaacacagatctgtgcagttctacattcactgattattacagtgtgattttcatcggttttgtaagtacaggacttgccgtttcttttgatctcttgattgaaggaggatagggcattaaagtgcttttgacatgaggaattttcatttggttcttctgtcaactttcttgcttattctgctgaaccctctgtgtatttcccttccaggtatatttgaacagataagcaggcatgcagctctgagactcctgagttttatgccattatcaaaagcattttcaagaatccctcaattctatcctgaaatgatgttattctgataataaagctcagatctgcaactttattgttatatatttttcacttctgtaaaattaatggccagtttttcctgacaatttataggaacagtatctttcaacatactccctacattatccttcaatatctgcaatacttgtctttagtaactgtatttctggtaagattatgatttcatgagaaacaattgaaaatatatccgatctaattaaattaggtcagcctgctattgctctcaggtgttgcctgtcttcacgaatgattagtatcgattgacctctttcttaggtg

SEQ ID NO: 449255 - DNA, 2553 bp, Homo sapiens
tccctaagaacccggaagtggtggagccaacggccagccagacctgtggcagtcccagccccagggtgctctccgcggtcggccatttatcggtgaagcaacagccccttgacgtcaagcttgacgcattggagataaagtccgaggaggtgaactaacctttgaacgtgccagtaagtaagatggcgagaaaagcaagagagagtgggaccgatcgatagcgcagcggtcggcttggcgccctttcagcgtgcgcagtgaacgtgcgctcggagcggtagattgggcaggattcgcgcctccatttttccaggagagagcgggataccaagagaaccggaccagctgctggcagggaaactgtcttccttttctccaagatgtacagaaccaaagtgggcttgaaggaccgccagcagctctacaagctgatcattagccagctgctatatgacggctacatcagcatcgccaatggcctcatcaatgaaatcaagcctcagtctgtgtgtgcaccctcggagcagctcctgcatctcatcaaactcggaatggaaaacgatgacaccgcagttcagtatgcaattggtcgttcagatactgttgcccctggcacagggattgacctggaatttgatgcagatgttcagactatgtccccagaggcttctgagtacgaaacatgctatgtcacatcacataaaggaccatgccgtgtagctacctatagtagagatggacagttaatagctactgggtctgctgatgcttcgataaagatacttgacacagagaggatgttggccaaaagtgccatgccaatagaggtcatgatgaatgagaccgcacaacaaaatatggaaaaccacccagtgattcgaactctttatgaccatgtggatgaagtcacgtgccttgctttccacccaacagaacagatcctggcttctggttcaagggattatactcttaaattatttgattattccaaaccatcagcaaaaagagccttcaaatacattcaggaagctgaaatgttacgttccatctcttttcatccttctggagactttatacttgtcggaactcagcatcctactcttcgcctttatgatatcaacacctttcaatgttttgtctcttgcaatcctcaagatcaacacaccgatgctatatgttccgttaattacaattctagtgccaatatgtacgtaactggaagcaaggacggctgcatcaaattatgggatggtgtttcaaatcgatgcatcacaacttttgagaaagcacatgacggtgctgaagtttgttctgccattttttccaaaaattctaaatacattctctcaagtggaaaagactctgtagctaaactttgggaaatatcaacgggacgaacactggtcagatacacgggcgcgggtttaagtggacgccaggtgcaccggacacaggctgtgtttaaccacaccgaggactatgtgttgctgcccgacgagaggacgatcagtctttgctgctgggactcgaggacagccgagcggagaaacctgctgtcgttggggcacaacaatattgtacgctgcatagtgcactcccccaccaaccccgggttcatgacgtgcagcgatgacttcagagcgcggttttggtaccggagatcgaccactgactgagccaccctctccgtagggttctttctcgaggactctaccctcctcccccacgtcctgtctcagctgcagtcgtaagtccgtgcaccatccttgacgttttgctgccacctctgtccacattcttcttggatttgtataaaagaatctttttttaccttgatgtagaatcatggtggaaaaagttggaaacacagatctgtgcagttctacattcactgattattacagtgtgattttcatcggttttgtaagtacaggacttgccgtttcttttgatctcttgattgaaggaggatagggcattaaagtgcttttgacatgaggaattttcatttggttcttctgtcaactttcttgcttattctgctgaaccctctgtgtatttcccttccaggtatatttgaacagataagcaggcatgcagctctgagactcctgagttttatgccattatcaaaagcattttcaagaatccctcaattctatcctgaaatgatgttattctgataataaagctcagatctgcaaaaaaaaaaaaaaagggcggccgccctttttttttttttttttttaccaaaagccaaaccattcatatgtatggatttcataaacatttattgatccttttttgaggtaagtataaatacctttacatggctacccttctaacgcttgaaaaatcaatttcaagggactctttaatcagttaaataatctgctttagaaggcacaaatgatcatacttcagattaaaatacaggtaagtattcagggataaaatggtacaaaaaaggctgtaactcttttacttcacattgatcacagacagaacttacatcctttcagaaagatgatgtatcagcactgaacatttctc

SEQ ID NO: 449256 - DNA, 1998 bp, Homo sapiens
tccctaagaacccggaagtggtggagccaacggccagccagacctgtggcagtcccagccccagggtgctctccgcggtcggccatttatcggtgaagcaacagccccttgacgtcaagcttgacgcattggagataaagtccgaggaggtgaactaacctttgaacgtgccagtaagtaagatggcgagaaaagcaagagagagtgggaccgatcgatagcgcagcggtcggcttggcgccctttcagcgtgcgcagtgaacgtgcgctcggagcggtagattgggcaggattcgcgcctccatttttccaggagagagcgggataccaagagaaccggaccagctgctggcagggaaactgtcttccttttctccaagatgtacagaaccaaagtgggcttgaaggaccgccagcagctctacaagctgatcattagccagctgctatatgacggctacatcagcatcgccaatggcctcatcaatgaaatcaagcctcagtctgtgtgtgcaccctcggagcagctcctgcatctcatcaaactcggaatggaaaacgatgacaccgcagttcagtatgcaattggtcgttcagatactgttgcccctggcacagggattgacctggaatttgatgcagatgttcagactatgtccccagaggcttctgagtacgaaacatgctatgtcacatcacataaaggaccatgccgtgtagctacctatagtagagatggacagttaatagctactgggtctgctgatgcttcgataaagatacttgacacagagaggatgttggccaaaagtgccatgccaatagaggtcatgatgaatgagaccgcacaacaaaatatggaaaaccacccagtgattcgaactctttatgaccatgtggatgaagtcacgtgccttgctttccacccaacagaacagatcctggcttctggttcaagggattatactcttaaattatttgattattccaaaccatcagcaaaaagagccttcaaatacattcaggaagctgaaatgttacgttccatctcttttcatccttctggagactttatacttgtcggaactcagcatcctactcttcgcctttatgatatcaacacctttcaatgttttgtctcttgcaatcctcaagatcaacacaccgatgctatatgttccgttaattacaattctagtgccaatatgtacgtaactggaagcaaggacggctgcatcaaattatgggatggtgtttcaaatcgatgcatcacaacttttgagaaagcacatgacggtgctgaagtttgttctgccattttttccaaaaattctaaatacattctctcaagtggaaaagactctgtagctaaactttgggaaatatcaacgggacgaacactggtcagatacacgggcgcgggtttaagtggacgccaggtgcaccggacacaggctgtgtttaaccacaccgaggactatgtgttgctgcccgacgagaggacgatcagtctttgctgctgggactcgaggacagccgagcggagaaacctgctgtcgttggggcacaacaatattgtacgctgcatagtgcactcccccaccaaccccgggttcatgacgtgcagcgatgacttcagagcgcggttttggtaccggagatcgaccactgactgagccaccctctccgtagggttctttctcgaggactctaccctcctcccccacgtcctgtctcagctgcagtcgtaagtccgtgcaccatccttgacgttttgctgccacctctgtccacattcttcttggatttgtataaaagaatctttttttaccttgatgtagaatcatggtggaaaaagttggaaacacagatctgtgcagttctacattcactgattattacagtgtgattttcatcggttttgtaagtacaggacttgccgtttcttttgatctcttgattgaaggaggatagggcattaaagtgcttttgacatga

SEQ ID NO: 449257 - DNA, 2398 bp, Homo sapiens
tccctaagaacccggaagtggtggagccaacggccagccagacctgtggcagtcccagccccagggtgctctccgcggtcggccatttatcggtgaagcaacagccccttgacgtcaagcttgacgcattggagataaagtccgaggaggtgaactaacctttgaacgtgccagtaagtaagatggcgagaaaagcaagagagagtgggaccgatcgatagcgcagcggtcggcttggcgccctttcagcgtgcgcagtgaacgtgcgctcggagcggtagattgggcaggattcgcgcctccatttttccaggagagagcgggataccaagagaaccggaccagctgctggcagggaaactgtcttccttttctccaagatgtacagaaccaaagtgggcttgaaggaccgccagcagctctacaagctgatcattagccagctgctatatgacggctacatcagcatcgccaatggcctcatcaatgaaatcaagcctcagtctgtgtgtgcaccctcggagcagctcctgcatctcatcaaactcggaatggaaaacgatgacaccgcagttcagtatgcaattggtcgttcagatactgttgcccctggcacagggattgacctggaatttgatgcagatgttcagactatgtccccagaggcttctgagtacgaaacatgctatgtcacatcacataaaggaccatgccgtgtagctacctatagtagagatggacagttaatagctactgggtctgctgatgcttcgataaagatacttgacacagagaggatgttggccaaaagtgccatgccaatagaggtcatgatgaatgagaccgcacaacaaaatatggaaaaccacccagtgattcgaactctttatgaccatgtggatgaagtcacgtgccttgctttccacccaacagaacagatcctggcttctggttcaagggattatactcttaaattatttgattattccaaaccatcagcaaaaagagccttcaaatacattcaggaagctgaaatgttacgttccatctcttttcatccttctggagactttatacttgtcggaactcagcatcctactcttcgcctttatgatatcaacacctttcaatgttttgtctcttgcaatcctcaagatcaacacaccgatgctatatgttccgttaattacaattctagtgccaatatgtacgtaactggaagcaaggacggctgcatcaaattatgggatggtgtttcaaatcgatgcatcacaacttttgagaaagcacatgacggtgctgaagtttgttctgccattttttccaaaaattctaaatacattctctcaagtggaaaagactctgtagctaaactttgggaaatatcaacgggacgaacactggtcagatacacgggcgcgggtttaagtggacgccaggtgcaccggacacaggctgtgtttaaccacaccgaggactatgtgttgctgcccgacgagaggacgatcagtctttgctgctgggactcgaggacagccgagcggagaaacctgctgtcgttggggcacaacaatattgtacgctgcatagtgcactcccccaccaaccccgggttcatgacgtgcagcgatgacttcagagcgcggttttggtaccggagatcgaccactgactgagccaccctctccgtagggttctttctcgaggactctaccctcctcccccacgtcctgtctcagctgcagtcgtaagtccgtgcaccatccttgacgttttgctgccacctctgtccacattcttcttggatttgtataaaagaatctttttttaccttgatgtagaatcatggtggaaaaagttggaaacacagatctgtgcagttctacattcactgattattacagtgtgattttcagtatatttgaacagataagcaggcatgcagctctgagactcctgagttttatgccattatcaaaagcattttcaagaatccctcaattctatcctgaaatgatgttattctgataataaagctcagatctgcaaaaaaaaaaaaaaagggcggccgccctttttttttttttttttttaccaaaagccaaaccattcatatgtatggatttcataaacatttattgatccttttttgaggtaagtataaatacctttacatggctacccttctaacgcttgaaaaatcaatttcaagggactctttaatcagttaaataatctgctttagaaggcacaaatgatcatacttcagattaaaatacaggtaagtattcagggataaaatggtacaaaaaaggctgtaactcttttacttcacattgatcacagacagaacttacatcctttcagaaagatgatgtatcagcactgaacatttctc

SEQ ID NO: 449258 - DNA, 1848 bp, Homo sapiens
tccctaagaacccggaagtggtggagccaacggccagccagacctgtggcagtcccagccccagggtgctctccgcggtcggccatttatcggtgaagcaacagccccttgacgtcaagcttgacgcattggagataaagtccgaggaggtgaactaacctttgaacgtgccagtaagtaagatggcgagaaaagcaagagagagtgggaccgatcgatagcgcagcggtcggcttggcgccctttcagcgtgcgcagtgaacgtgcgctcggagcggtagattgggcaggattcgcgcctccatttttccaggagagagcgggataccaagagaaccggaccagctgctggcagggaaactgtcttccttttctccaagatgtacagaaccaaagtgggcttgaaggaccgccagcagctctacaagctgatcattagccagctgctatatgacggctacatcagcatcgccaatggcctcatcaatgaaatcaagcctcagtctgtgtgtgcaccctcggagcagctcctgcatctcatcaaactcggaatggaaaacgatgacaccgcagttcagtatgcaattggtcgttcagatactgttgcccctggcacagggattgacctggaatttgatgcagatgttcagactatgtccccagaggcttctgagtacgaaacatgctatgtcacatcacataaaggaccatgccgtgtagctacctatagtagagatggacagttaatagctactgggtctgctgatgcttcgataaagatacttgacacagagaggatgttggccaaaagtgccatgccaatagaggtcatgatgaatgagaccgcacaacaaaatatggaaaaccacccagtgattcgaactctttatgaccatgtggatgaagtcacgtgccttgctttccacccaacagaacagatcctggcttctggttcaagggattatactcttaaattatttgattattccaaaccatcagcaaaaagagccttcaaatacattcaggaagctgaaatgttacgttccatctcttttcatccttctggagactttatacttgtcggaactcagcatcctactcttcgcctttatgatatcaacacctttcaatgttttgtctcttgcaatcctcaagatcaacacaccgatgctatatgttccgttaattacaattctagtgccaatatgtacgtaactggaagcaaggacggctgcatcaaattatgggatggtgtttcaaatcgatgcatcacaacttttgagaaagcacatgacggtgctgaagtttgttctgccattttttccaaaaattctaaatacattctctcaagtggaaaagactctgtagctaaactttgggaaatatcaacgggacgaacactggtcagatacacgggcgcgggtttaagtggacgccaggtgcaccggacacaggctgtgtttaaccacaccgaggactatgtgttgctgcccgacgagaggacgatcagtctttgctgctgggactcgaggacagccgagcggagaaacctgctgtcgttggggcacaacaatattgtacgctgcatagtgcactcccccaccaaccccgggttcatgacgtgcagcgatgacttcagagcgcggttttggtaccggagatcgaccactgactgagccaccctctccgtagggttctttctcgaggactctaccctcctcccccacgtcctgtctcagctgcagtcgtaagtccgtgcaccatctcggttttgtaagtacaggacttgccgtttcttttgatctcttgattgaaggaggatagggcattaaagtgcttttgacatga

SEQ ID NO: 449259 - DNA, 2230 bp, Homo sapiens
tccctaagaacccggaagtggtggagccaacggccagccagacctgtggcagtcccagccccagggtgctctccgcggtcggccatttatcggtgaagcaacagccccttgacgtcaagcttgacgcattggagataaagtccgaggaggtgaactaacctttgaacgtgccagtaagtaagatggcgagaaaagcaagagagagtgggaccgatcgatagcgcagcggtcggcttggcgccctttcagcgtgcgcagtgaacgtgcgctcggagcggtagattgggcaggattcgcgcctccatttttccaggagagagcgggataccaagagaaccggaccagctgctggcagggaaactgtcttccttttctccaagatgtacagaaccaaagtgggcttgaaggaccgccagcagctctacaagctgatcattagccagctgctatatgacggctacatcagcatcgccaatggcctcatcaatgaaatcaagcctcagtctgtgtgtgcaccctcggagcagctcctgcatctcatcaaactcggaatggaaaacgatgacaccgcagttcagtatgcaattggtcgttcagatactgttgcccctggcacagggattgacctggaatttgatgcagatgttcagactatgtccccagaggcttctgagtacgaaacatgctatgtcacatcacataaaggaccatgccgtgtagctacctatagtagagatggacagttaatagctactgggtctgctgatgcttcgataaagatacttgacacagagaggatgttggccaaaagtgccatgccaatagaggtcatgatgaatgagaccgcacaacaaaatatggaaaaccacccagtgattcgaactctttatgaccatgtggatgaagtcacgtgccttgctttccacccaacagaacagatcctggcttctggttcaagggattatactcttaaattatttgattattccaaaccatcagcaaaaagagccttcaaatacattcaggaagctgaaatgttacgttccatctcttttcatccttctggagactttatacttgtcggaactcagcatcctactcttcgcctttatgatatcaacacctttcaatgttttgtctcttgcaatcctcaagatcaacacaccgatgctatatgttccgttaattacaattctagtgccaatatgtacgtaactggaagcaaggacggctgcatcaaattatgggatggtgtttcaaatcgatgcatcacaacttttgagaaagcacatgacggtgctgaagtttgttctgccattttttccaaaaattctaaatacattctctcaagtggaaaagactctgtagctaaactttgggaaatatcaacgggacgaacactggtcagatacacgggcgcgggtttaagtggacgccaggtgcaccggacacaggctgtgtttaaccacaccgaggactatgtgttgctgcccgacgagaggacgatcagtctttgctgctgggactcgaggacagccgagcggagaaacctgctgtcgttggggcacaacaatattgtacgctgcatagtgcactcccccaccaaccccgggttcatgacgtgcagcgatgacttcagagcgcggttttggtaccggagatcgaccactgactgagccaccctctccgtagggttctttctcgaggactctaccctcctcccccacgtcctgtctcagctgcagtcgtatatttgaacagataagcaggcatgcagctctgagactcctgagttttatgccattatcaaaagcattttcaagaatccctcaattctatcctgaaatgatgttattctgataataaagctcagatctgcaaaaaaaaaaaaaaagggcggccgccctttttttttttttttttttaccaaaagccaaaccattcatatgtatggatttcataaacatttattgatccttttttgaggtaagtataaatacctttacatggctacccttctaacgcttgaaaaatcaatttcaagggactctttaatcagttaaataatctgctttagaaggcacaaatgatcatacttcagattaaaatacaggtaagtattcagggataaaatggtacaaaaaaggctgtaactcttttacttcacattgatcacagacagaacttacatcctttcagaaagatgatgtatcagcactgaacatttctc

SEQ ID NO: 449260 - DNA, 1764 bp, Homo sapiens
tccctaagaacccggaagtggtggagccaacggccagccagacctgtggcagtcccagccccagggtgctctccgcggtcggccatttatcggtgaagcaacagccccttgacgtcaagcttgacgcattggagataaagtccgaggaggtgaactaacctttgaacgtgccagtaagtaagatggcgagaaaagcaagagagagtgggaccgatcgatagcgcagcggtcggcttggcgccctttcagcgtgcgcagtgaacgtgcgctcggagcggtagattgggcaggattcgcgcctccatttttccaggagagagcgggataccaagagaaccggaccagctgctggcagggaaactgtcttccttttctccaagatgtacagaaccaaagtgggcttgaaggaccgccagcagctctacaagctgatcattagccagctgctatatgacggctacatcagcatcgccaatggcctcatcaatgaaatcaagcctcagtctgtgtgtgcaccctcggagcagctcctgcatctcatcaaactcggaatggaaaacgatgacaccgcagttcagtatgcaattggtcgttcagatactgttgcccctggcacagggattgacctggaatttgatgcagatgttcagactatgtccccagaggcttctgagtacgaaacatgctatgtcacatcacataaaggaccatgccgtgtagctacctatagtagagatggacagttaatagctactgggtctgctgatgcttcgataaagatacttgacacagagaggatgttggccaaaagtgccatgccaatagaggtcatgatgaatgagaccgcacaacaaaatatggaaaaccacccagtgattcgaactctttatgaccatgtggatgaagtcacgtgccttgctttccacccaacagaacagatcctggcttctggttcaagggattatactcttaaattatttgattattccaaaccatcagcaaaaagagccttcaaatacattcaggaagctgaaatgttacgttccatctcttttcatccttctggagactttatacttgtcggaactcagcatcctactcttcgcctttatgatatcaacacctttcaatgttttgtctcttgcaatcctcaagatcaacacaccgatgctatatgttccgttaattacaattctagtgccaatatgtacgtaactggaagcaaggacggctgcatcaaattatgggatggtgtttcaaatcgatgcatcacaacttttgagaaagcacatgacggtgctgaagtttgttctgccattttttccaaaaattctaaatacattctctcaagtggaaaagactctgtagctaaactttgggaaatatcaacgggacgaacactggtcagatacacgggcgcgggtttaagtggacgccaggtgcaccggacacaggctgtgtttaaccacaccgaggactatgtgttgctgcccgacgagaggacgatcagtctttgctgctgggactcgaggacagccgagcggagaaacctgctgtcgttggggcacaacaatattgtacgctgcatagtgcactcccccaccaaccccgggttcatgacgtgcagcgatgacttcagagcgcggttttggtaccggagatcgaccactgactgagccaccctctccgtagggttctttctcgaggactctaccctcctcccccacctctccccgtgtccaacctcggtaccgagctcgattc

SEQ ID NO: 449261 - DNA, 2443 bp, Homo sapiens
tccctaagaacccggaagtggtggagccaacggccagccagacctgtggcagtcccagccccagggtgctctccgcggtcggccatttatcggtgaagcaacagccccttgacgtcaagcttgacgcattggagataaagtccgaggaggtgaactaacctttgaacgtgccagtaagtaagatggcgagaaaagcaagagagagtgggaccgatcgatagcgcagcggtcggcttggcgccctttcagcgtgcgcagtgaacgtgcgctcggagcggtagattgggcaggattcgcgcctccatttttccaggagagagcgggataccaagagaaccggaccagctgatgtacagaaccaaagtgggcttgaaggaccgccagcagctctacaagctgatcattagccagctgctatatgacggctacatcagcatcgccaatggcctcatcaatgaaatcaagcctcagtctgtgtgtgcaccctcggagcagctcctgcatctcatcaaactcggaatggaaaacgatgacaccgcagttcagtatgcaattggtcgttcagatactgttgcccctggcacagggattgacctggaatttgatgcagatgttcagactatgtccccagaggcttctgagtacgaaacatgctatgtcacatcacataaaggaccatgccgtgtagctacctatagtagagatggacagttaatagctactgggtctgctgatgcttcgataaagatacttgacacagagaggatgttggccaaaagtgccatgccaatagaggtcatgatgaatgagaccgcacaacaaaatatggaaaaccacccagtgattcgaactctttatgaccatgtggatgaagtcacgtgccttgctttccacccaacagaacagatcctggcttctggttcaagggattatactcttaaattatttgattattccaaaccatcagcaaaaagagccttcaaatacattcaggaagctgaaatgttacgttccatctcttttcatccttctggagactttatacttgtcggaactcagcatcctactcttcgcctttatgatatcaacacctttcaatgttttgtctcttgcaatcctcaagatcaacacaccgatgctatatgttccgttaattacaattctagtgccaatatgtacgtaactggaagcaaggacggctgcatcaaattatgggatggtgtttcaaatcgatgcatcacaacttttgagaaagcacatgacggtgctgaagtttgttctgccattttttccaaaaattctaaatacattctctcaagtggaaaagactctgtagctaaactttgggaaatatcaacgggacgaacactggtcagatacacgggcgcgggtttaagtggacgccaggtgcaccggacacaggctgtgtttaaccacaccgaggactatgtgttgctgcccgacgagaggacgatcagtctttgctgctgggactcgaggacagccgagcggagaaacctgctgtcgttggggcacaacaatattgtacgctgcatagtgcactcccccaccaaccccgggttcatgacgtgcagcgatgacttcagagcgcggttttggtaccggagatcgaccactgactgagccaccctctccgtagggttctttctcgaggactctaccctcctcccccacgtcctgtctcagctgcagtcgtaagtccgtgcaccatccttgacgttttgctgccacctctgtccacattcttcttggatttgtataaaagaatctttttttaccttgatgtagaatcatggtggaaaaagttggaaacacagatctgtgcagttctacattcactgattattacagtgtgattttcatcggttttgtaagtacaggacttgccgtttcttttgatctcttgattgaaggaggatagggcattaaagtgcttttgacatgaggaattttcatttggttcttctgtcaactttcttgcttattctgctgaaccctctgtgtatttcccttccaggtatatttgaacagataagcaggcatgcagctctgagactcctgagttttatgccattatcaaaagcattttcaagaatccctcaattctatcctgaaatgatgttattctgataataaagctcagatctgcaactttattgttatatatttttcacttctgtaaaattaatggccagtttttcctgacaatttataggaacagtatctttcaacatactccctacattatccttcaatatctgcaatacttgtctttagtaactgtatttctggtaagattatgatttcatgagaaacaattgaaaatatatccgatctaattaaattaggtcagcctgctattgctctcaggtgttgcctgtcttcacgaatgattagtatcgattgacctctttcttaggtg

SEQ ID NO: 449262 - DNA, 2413 bp, Homo sapiens
tccctaagaacccggaagtggtggagccaacggccagccagacctgtggcagtcccagccccagggtgctctccgcggtcggccatttatcggtgaagcaacagccccttgacgtcaagcttgacgcattggagataaagtccgaggaggtgaactaacctttgaacgtgccagtaagtaagatggcgagaaaagcaagagagagtgggaccgatcgatagcgcagcggtcggcttggcgccctttcagcgtgcgcagtgaacgtgcgctcggagcggtagattgggcaggattcgcgcctccatttttccaggagagagcgggataccaagagaaccggaccagctgctggcagggaaactgtcttccttttctccaagatgtacagaaccaaagtgggcttgaaggaccgccagcagctctacaagctgatcattagccagctgctatatgacggctacatcagcatcgccaatggcctcatcaatgaaatcaagcctcagtctgtgtgtgcaccctcggagcagctcctgcatctcatcaaactcggaatggaaaacgatgacaccgcagttcagtatgcaattggtcgttcagatactgttgcccctggcacagggattgacctggaatttgatgcagatgttcagactatgtccccagaggcttctgagtacgaaacatgctatgtcacatcacataaaggaccatgccgtgtagctacctatagtagagatgttggccaaaagtgccatgccaatagaggtcatgatgaatgagaccgcacaacaaaatatggaaaaccacccagtgattcgaactctttatgaccatgtggatgaagtcacgtgccttgctttccacccaacagaacagatcctggcttctggttcaagggattatactcttaaattatttgattattccaaaccatcagcaaaaagagccttcaaatacattcaggaagctgaaatgttacgttccatctcttttcatccttctggagactttatacttgtcggaactcagcatcctactcttcgcctttatgatatcaacacctttcaatgttttgtctcttgcaatcctcaagatcaacacaccgatgctatatgttccgttaattacaattctagtgccaatatgtacgtaactggaagcaaggacggctgcatcaaattatgggatggtgtttcaaatcgatgcatcacaacttttgagaaagcacatgacggtgctgaagtttgttctgccattttttccaaaaattctaaatacattctctcaagtggaaaagactctgtagctaaactttgggaaatatcaacgggacgaacactggtcagatacacgggcgcgggtttaagtggacgccaggtgcaccggacacaggctgtgtttaaccacaccgaggactatgtgttgctgcccgacgagaggacgatcagtctttgctgctgggactcgaggacagccgagcggagaaacctgctgtcgttggggcacaacaatattgtacgctgcatagtgcactcccccaccaaccccgggttcatgacgtgcagcgatgacttcagagcgcggttttggtaccggagatcgaccactgactgagccaccctctccgtagggttctttctcgaggactctaccctcctcccccacgtcctgtctcagctgcagtcgtaagtccgtgcaccatccttgacgttttgctgccacctctgtccacattcttcttggatttgtataaaagaatctttttttaccttgatgtagaatcatggtggaaaaagttggaaacacagatctgtgcagttctacattcactgattattacagtgtgattttcatcggttttgtaagtacaggacttgccgtttcttttgatctcttgattgaaggaggatagggcattaaagtgcttttgacatgaggaattttcatttggttcttctgtcaactttcttgcttattctgctgaaccctctgtgtatttcccttccaggtatatttgaacagataagcaggcatgcagctctgagactcctgagttttatgccattatcaaaagcattttcaagaatccctcaattctatcctgaaatgatgttattctgataataaagctcagatctgcaactttattgttatatatttttcacttctgtaaaattaatggccagtttttcctgacaatttataggaacagtatctttcaacatactccctacattatccttcaatatctgcaatacttgtctttagtaactgtatttctggtaagattatgatttcatgagaaacaattgaaaatatatccgatctaattaaattaggtcagcctgctattgctctcaggtgttgcctgtcttcacgaatgattagtatcgattgacctctttcttaggtg

SEQ ID NO: 449263 - DNA, 1714 bp, Homo sapiens
tacggaacgggaaccagagtcaacctagttaacccggtttcaggtagcgaggctgggtggcgtgaggtcatgatgaatgagaccgcacaacaaaatatggaaaaccacccagtgattcgaactctttatgaccatgtggatgaagtcacgtgccttgctttccacccaacagaacagatcctggcttctggttcaagggattatactcttaaattatttgattattccaaaccatcagcaaaaagagccttcaaatacattcaggaagctgaaatgttacgttccatctcttttcatccttctggagactttatacttgtcggaactcagcatcctactcttcgcctttatgatatcaacacctttcaatgttttgtctcttgcaatcctcaagatcaacacaccgatgctatatgttccgttaattacaattctagtgccaatatgtacgtaactggaagcaaggacggctgcatcaaattatgggatggtgtttcaaatcgatgcatcacaacttttgagaaagcacatgacggtgctgaagtttgttctgccattttttccaaaaattctaaatacattctctcaagtggaaaagactctgtagctaaactttgggaaatatcaacgggacgaacactggtcagatacacgggcgcgggtttaagtggacgccaggtgcaccggacacaggctgtgtttaaccacaccgaggactatgtgttgctgcccgacgagaggacgatcagtctttgctgctgggactcgaggacagccgagcggagaaacctgctgtcgttggggcacaacaatattgtacgctgcatagtgcactcccccaccaaccccgggttcatgacgtgcagcgatgacttcagagcgcggttttggtaccggagatcgaccactgactgagccaccctctccgtagggttctttctcgaggactctaccctcctcccccacgtcctgtctcagctgcagtcgtaagtccgtgcaccatccttgacgttttgctgccacctctgtccacattcttcttggatttgtataaaagaatctttttttaccttgatgtagaatcatggtggaaaaagttggaaacacagatctgtgcagttctacattcactgattattacagtgtgattttcatcggttttgtaagtacaggacttgccgtttcttttgatctcttgattgaaggaggatagggcattaaagtgcttttgacatgaggaattttcatttggttcttctgtcaactttcttgcttattctgctgaaccctctgtgtatttcccttccaggtatatttgaacagataagcaggcatgcagctctgagactcctgagttttatgccattatcaaaagcattttcaagaatccctcaattctatcctgaaatgatgttattctgataataaagctcagatctgcaactttattgttatatatttttcacttctgtaaaattaatggccagtttttcctgacaatttataggaacagtatctttcaacatactccctacattatccttcaatatctgcaatacttgtctttagtaactgtatttctggtaagattatgatttcatgagaaacaattgaaaatatatccgatctaattaaattaggtcagcctgctattgctctcaggtgttgcctgtcttcacgaatgattagtatcgattgacctctttcttaggtg

SEQ ID NO: 449264 - DNA, 2460 bp, Homo sapiens
tccctaagaacccggaagtggtggagccaacggccagccagacctgtggcagtcccagccccagggtgctctccgcggtcggccatttatcggtgaagcaacagccccttgacgtcaagcttgacgcattggagataaagtccgaggaggtgaactaacctttgaacgtgccagtaagtaagatggcgagaaaagcaagagagagtgggaccgatcgatagcgcagcggtcggcttggcgccctttcagcgtgcgcagtgaacgtgcgctcggagcggtagattgggcaggattcgcgcctccatttttccaggagagagcgggataccaagagaaccggaccagctgctggcagggaaactgtcttccttttctccaagatgtacagaaccaaagtgggcttgaaggaccgccagcagctctacaagctgatcattagccagctgctatatgacggctacatcagcatcgccaatggcctcatcaatgaaatcaagcctcagtctgtgtgtgcaccctcggagcagctcctgcatctcatcaaactcggtagattgtgaacacaaatccatacgtcccatggcaaggaatggaaaacgatgacaccgcagttcagtatgcaattggtcgttcagatactgttgcccctggcacagggattgacctggaatttgatgcagatgttcagactatgtccccagaggcttctgagtacgaaacatgctatgtcacatcacataaaggaccatgccgtgtagctacctatagtagagatggacagttaatagctactgggtctgctgatgcttcgataaagatacttgacacagagaggatgttggccaaaagtgccatgccaatagaggtcatgatgaatgagaccgcacaacaaaatatggcttgctttccacccaacagaacagatcctggcttctggttcaagggattatactcttaaattatttgattattccaaaccatcagcaaaaagagccttcaaatacattcaggaagctgaaatgttacgttccatctcttttcatccttctggagactttatacttgtcggaactcagcatcctactcttcgcctttatgatatcaacacctttcaatgttttgtctcttgcaatcctcaagatcaacacaccgatgctatatgttccgttaattacaattctagtgccaatatgtacgtaactggaagcaaggacggctgcatcaaattatgggatggtgtttcaaatcgatgcatcacaacttttgagaaagcacatgacggtgctgaagtttgttctgccattttttccaaaaattctaaatacattctctcaagtggaaaagactctgtagctaaactttgggaaatatcaacgggacgaacactggtcagatacacgggcgcgggtttaagtggacgccaggtgcaccggacacaggctgtgtttaaccacaccgaggactatgtgttgctgcccgacgagaggacgatcagtctttgctgctgggactcgaggacagccgagcggagaaacctgctgtcgttggggcacaacaatattgtacgctgcatagtgcactcccccaccaaccccgggttcatgacgtgcagcgatgacttcagagcgcggttttggtaccggagatcgaccactgactgagccaccctctccgtagggttctttctcgaggactctaccctcctcccccacgtcctgtctcagctgcagtcgtaagtccgtgcaccatccttgacgttttgctgccacctctgtccacattcttcttggatttgtataaaagaatctttttttaccttgatgtagaatcatggtggaaaaagttggaaacacagatctgtgcagttctacattcactgattattacagtgtgattttcatcggttttgtaagtacaggacttgccgtttcttttgatctcttgattgaaggaggatagggcattaaagtgcttttgacatgaggaattttcatttggttcttctgtcaactttcttgcttattctgctgaaccctctgtgtatttcccttccaggtatatttgaacagataagcaggcatgcagctctgagactcctgagttttatgccattatcaaaagcattttcaagaatccctcaattctatcctgaaatgatgttattctgataataaagctcagatctgcaactttattgttatatatttttcacttctgtaaaattaatggccagtttttcctgacaatttataggaacagtatctttcaacatactccctacattatccttcaatatctgcaatacttgtctttagtaactgtatttctggtaagattatgatttcatgagaaacaattgaaaatatatccgatctaattaaattaggtcagcctgctattgctctcaggtgttgcctgtcttcacgaatgattagtatcgattgacctctttcttaggtg

SEQ ID NO: 449265 - DNA, 2341 bp, Homo sapiens
  misc_feature (2296)..(2296): n is a, c, g, or t
tccctaagaacccggaagtggtggagccaacggccagccagacctgtggcagtcccagccccagggtgctctccgcggtcggccatttatcggtgaagcaacagccccttgacgtcaagcttgacgcattggagataaagtccgaggaggtgaactaacctttgaacgtgccagtaagtaagatggcgagaaaagcaagagagagtgggaccgatcgatagcgcagcggtcggcttggcgccctttcagcgtgcgcagtgaacgtgcgctcggagcggtagattgggcaggattcgcgcctccatttttccaggagagagcgggataccaagagaaccggaccagctgctggcagggaaactgtcttccttttctccaagatgtacagaaccaaagtgggcttgaaggaccgccagcagctctacaagctgatcattagccagctgctatatgacggctacatcagcatcgccaatggcctcatcaatgaaatcaagcctcagtctgtgtgtgcaccctcggagcagctcctgcatctcatcaaactcggaatggaaaacgatgacaccgcagttcagtatgcaattggtcgttcagatactgttgcccctggcacagggattgacctggaatttgatgcagatgttcagactatgtccccagaggcttctgagtacgaaacatgctatgtcacatcacataaaggaccatgccgtgtagctacctatagtagagatggacagttaatagctactgggtctgctgatgcttcgataaagatacttgacacagagaggatgttggccaaaagtgccatgccaatagaggtcatgatgaatgagaccgcacaacaaaatatggaaaaccacccagtgattcgaactctttatgaccatgtggatgaagtcacgtgccttgctttccacccaacagaacagatcctggcttctggttcaagggattatactcttaaattatttgattattccaaaccatcagcaaaaagagccttcaaatacattcaggaagctgaaatgttacgttccatctcttttcatccttctggagactttatacttgtcggaactcagcatcctactcttcgcctttatgatatcaacacctttcaatgttttgtctcttgcaatcctcaagatcaacacaccgatgctatatgttccgttaattacaattctagtgccaatatgtacgtaactggaagcaaggacggctgcatcaaattatgggatggtgtttcaaatcgatgcatcacaacttttgagaaagcacatgacggtgctgaagtttgttctgccattttttccaaaaattctaaatacattctctcaagtggaaaagactctgtagctaaactttgggaaatatcaacgggacgaacactggtcagatacacgggcgcgggtttaagtggacgccaggtgcaccggacacaggctgtgtttaaccacaccgaggactatgtgttgctgcccgacgagaggacgatcagtctttgctgctgggactcgaggacagccgagcggagaaacctgctgtcgttggggcacaacaatattgtacgctgcatagtgcactcccccaccaaccccgggttcatgacgtgcagcgatgacttcagagcgcggttttggtaccggagatcgaccactgactgagccaccctctccgtagggttctttctcgaggactctaccctcctcccccacgtcctgtctcagctgcagtcgtaagtccgtgcaccatccttgacgttttgctgccacctctgtccacattcttcttggatttgtataaaagaatctttttttaccttgatgtagaatcatggtggaaaaagttggaaacacagatctgtgcagttctacattcactgattattacagtgtgattttcatcggttttgtaagtacaggacttgccgtttcttttgatctcttgattgaaggaggatagggcattaaagtgcttttgacatgaggaattttcatttggttcttctgtcaactttcttgcttattctgctgaaccctctgtgtatttcccttccaggtatatttgaacagataagcaggcatgcagctctgagactcctgagttttatgccattatcaaaagcattttcaagaatccctcaattctatcctgaaatgatgttattctgataataaagctcagatctgcaactttattgttatatatttttcacttctgtaaaattaatggccagtttttcctgacaatttataggaacagtatctttcaacatactcctaantttcttatatttggaactggttttgacgttttgggagagttgttc

SEQ ID NO: 449266 - DNA, 2445 bp, Homo sapiens
tccctaagaacccggaagtggtggagccaacggccagccagacctgtggcagtcccagccccagggtgctctccgcggtcggccatttatcggtgaagcaacagccccttgacgtcaagcttgacgcattggagataaagtccgaggaggtgaactaacctttgaacgtgccagtaagtaagatggcgagaaaagcaagagagagtgggaccgatcgatagcgcagcggtcggcttggcgccctttcagcgtgcgcagtgaacgtgcgctcggagcggtagattgggcaggattcgcgcctccatttttccaggagagagcgggataccaagagaaccggaccagctgctggcagggaaactgtcttccttttctccaagatgtacagaaccaaagtgggcttgaaggaccgccagcagctctacaagctgatcattagccagctgctatatgacggctacatcagcatcgccaatggcctcatcaatgaaatcaagcctcagtctgtgtgtgcaccctcggagcagctcctgcatctcatcaaactcggaatggaaaacgatgacaccgcagttcagtatgcaattggtcgttcagatactgttgcccctggcacagggattgacctggaatttgatgcagatgttcagactatgtccccagaggcttctgagtacgaaacatgctatgtcacatcacataaaggaccatgccgtgtagctacctatagtagagatggacagttaatagctactgggtctgctgatgcttcgataaagatacttgacacagagaggatgttggccaaaagtgccatgccaatagaggtcatgatgaatgagaccgcacaacaaaatatggaaaaccacccagtgattcgaactctttatgaccatgtggatgaagtcacgtgccttgctttccacccaacagaacagatcctggcttctggttcaagggattatactcttaaattatttgattattccaaaccatcagcaaaaagagccttcaaatacattcagcatccttctggagactttatacttgtcggaactcagcatcctactcttcgcctttatgatatcaacacctttcaatgttttgtctcttgcaatcctcaagatcaacacaccgatgctatatgttccgttaattacaattctagtgccaatatgtacgtaactggaagcaaggacggctgcatcaaattatgggatggtgtttcaaatcgatgcatcacaacttttgagaaagcacatgacggtgctgaagtttgttctgccattttttccaaaaattctaaatacattctctcaagtggaaaagactctgtagctaaactttgggaaatatcaacgggacgaacactggtcagatacacgggcgcgggtttaagtggacgccaggtgcaccggacacaggctgtgtttaaccacaccgaggactatgtgttgctgcccgacgagaggacgatcagtctttgctgctgggactcgaggacagccgagcggagaaacctgctgtcgttggggcacaacaatattgtacgctgcatagtgcactcccccaccaaccccgggttcatgacgtgcagcgatgacttcagagcgcggttttggtaccggagatcgaccactgactgagccaccctctccgtagggttctttctcgaggactctaccctcctcccccacgtcctgtctcagctgcagtcgtaagtccgtgcaccatccttgacgttttgctgccacctctgtccacattcttcttggatttgtataaaagaatctttttttaccttgatgtagaatcatggtggaaaaagttggaaacacagatctgtgcagttctacattcactgattattacagtgtgattttcatcggttttgtaagtacaggacttgccgtttcttttgatctcttgattgaaggaggatagggcattaaagtgcttttgacatgaggaattttcatttggttcttctgtcaactttcttgcttattctgctgaaccctctgtgtatttcccttccaggtatatttgaacagataagcaggcatgcagctctgagactcctgagttttatgccattatcaaaagcattttcaagaatccctcaattctatcctgaaatgatgttattctgataataaagctcagatctgcaactttattgttatatatttttcacttctgtaaaattaatggccagtttttcctgacaatttataggaacagtatctttcaacatactccctacattatccttcaatatctgcaatacttgtctttagtaactgtatttctggtaagattatgatttcatgagaaacaattgaaaatatatccgatctaattaaattaggtcagcctgctattgctctcaggtgttgcctgtcttcacgaatgattagtatcgattgacctctttcttaggtg

SEQ ID NO: 449267 - DNA, 2300 bp, Homo sapiens
tccctaagaacccggaagtggtggagccaacggccagccagacctgtggcagtcccagccccagggtgctctccgcggtcggccatttatcggtgaagcaacagccccttgacgtcaagcttgacgcattggagataaagtccgaggaggtgaactaacctttgaacgtgccactggcagggaaactgtcttccttttctccaagatgtacagaaccaaagtgggcttgaaggaccgccagcagctctacaagctgatcattagccagctgctatatgacggctacatcagcatcgccaatggcctcatcaatgaaatcaagcctcagtctgtgtgtgcaccctcggagcagctcctgcatctcatcaaactcggaatggaaaacgatgacaccgcagttcagtatgcaattggtcgttcagatactgttgcccctggcacagggattgacctggaatttgatgcagatgttcagactatgtccccagaggcttctgagtacgaaacatgctatgtcacatcacataaaggaccatgccgtgtagctacctatagtagagatggacagttaatagctactgggtctgctgatgcttcgataaagatacttgacacagagaggatgttggccaaaagtgccatgccaatagaggtcatgatgaatgagaccgcacaacaaaatatggaaaaccacccagtgattcgaactctttatgaccatgtggatgaagtcacgtgccttgctttccacccaacagaacagatcctggcttctggttcaagggattatactcttaaattatttgattattccaaaccatcagcaaaaagagccttcaaatacattcaggaagctgaaatgttacgttccatctcttttcatccttctggagactttatacttgtcggaactcagcatcctactcttcgcctttatgatatcaacacctttcaatgttttgtctcttgcaatcctcaagatcaacacaccgatgctatatgttccgttaattacaattctagtgccaatatgtacgtaactggaagcaaggacggctgcatcaaattatgggatggtgtttcaaatcgatgcatcacaacttttgagaaagcacatgacggtgctgaagtttgttctgccattttttccaaaaattctaaatacattctctcaagtggaaaagactctgtagctaaactttgggaaatatcaacgggacgaacactggtcagatacacgggcgcgggtttaagtggacgccaggtgcaccggacacaggctgtgtttaaccacaccgaggactatgtgttgctgcccgacgagaggacgatcagtctttgctgctgggactcgaggacagccgagcggagaaacctgctgtcgttggggcacaacaatattgtacgctgcatagtgcactcccccaccaaccccgggttcatgacgtgcagcgatgacttcagagcgcggttttggtaccggagatcgaccactgactgagccaccctctccgtagggttctttctcgaggactctaccctcctcccccacgtcctgtctcagctgcagtcgtaagtccgtgcaccatccttgacgttttgctgccacctctgtccacattcttcttggatttgtataaaagaatctttttttaccttgatgtagaatcatggtggaaaaagttggaaacacagatctgtgcagttctacattcactgattattacagtgtgattttcatcggttttgtaagtacaggacttgccgtttcttttgatctcttgattgaaggaggatagggcattaaagtgcttttgacatgaggaattttcatttggttcttctgtcaactttcttgcttattctgctgaaccctctgtgtatttcccttccaggtatatttgaacagataagcaggcatgcagctctgagactcctgagttttatgccattatcaaaagcattttcaagaatccctcaattctatcctgaaatgatgttattctgataataaagctcagatctgcaactttattgttatatatttttcacttctgtaaaattaatggccagtttttcctgacaatttataggaacagtatctttcaacatactccctacattatccttcaatatctgcaatacttgtctttagtaactgtatttctggtaagattatgatttcatgagaaacaattgaaaatatatccgatctaattaaattaggtcagcctgctattgctctcaggtgttgcctgtcttcacgaatgattagtatcgattgacctctttcttaggtg

SEQ ID NO: 449268 - DNA, 2577 bp, Homo sapiens
tccctaagaacccggaagtggtggagccaacggccagccagacctgtggcagtcccagccccagggtgctctccgcggtcggccatttatcggtgaagcaacagccccttgacgtcaagcttgacgcattggagataaagtccgaggaggtgaactaacctttgaacgtgccagtaagtaagatggcgagaaaagcaagagagagtgggaccgatcgatagcgcagcggtcggcttggcgccctttcagcgtgcgcagtgaacgtgcgctcggagcggtagattgggcaggattcgcgcctccatttttccaggagagagcgggataccaagagaaccggaccagctggtactgggacacggggagagtagctggtgcggtcggctggggcatttagagaaaaccacagaaacgactggggcgagactggaagagtcgagagttagcaagctggcagggaaactgtcttccttttctccaagatgtacagaaccaaagtgggcttgaaggaccgccagcagctctacaagctgatcattagccagctgctatatgacggctacatcagcatcgccaatggcctcatcaatgaaatcaagcctcagtctgtgtgtgcaccctcggagcagctcctgcatctcatcaaactcggaatggaaaacgatgacaccgcagttcagtatgcaattggtcgttcagatactgttgcccctggcacagggattgacctggaatttgatgcagatgttcagactatgtccccagaggcttctgagtacgaaacatgctatgtcacatcacataaaggaccatgccgtgtagctacctatagtagagatggacagttaatagctactgggtctgctgatgcttcgataaagatacttgacacagagaggatgttggccaaaagtgccatgccaatagaggtcatgatgaatgagaccgcacaacaaaatatggaaaaccacccagtgattcgaactctttatgaccatgtggatgaagtcacgtgccttgctttccacccaacagaacagatcctggcttctggttcaagggattatactcttaaattatttgattattccaaaccatcagcaaaaagagccttcaaatacattcaggaagctgaaatgttacgttccatctcttttcatccttctggagactttatacttgtcggaactcagcatcctactcttcgcctttatgatatcaacacctttcaatgttttgtctcttgcaatcctcaagatcaacacaccgatgctatatgttccgttaattacaattctagtgccaatatgtacgtaactggaagcaaggacggctgcatcaaattatgggatggtgtttcaaatcgatgcatcacaacttttgagaaagcacatgacggtgctgaagtttgttctgccattttttccaaaaattctaaatacattctctcaagtggaaaagactctgtagctaaactttgggaaatatcaacgggacgaacactggtcagatacacgggcgcgggtttaagtggacgccaggtgcaccggacacaggctgtgtttaaccacaccgaggactatgtgttgctgcccgacgagaggacgatcagtctttgctgctgggactcgaggacagccgagcggagaaacctgctgtcgttggggcacaacaatattgtacgctgcatagtgcactcccccaccaaccccgggttcatgacgtgcagcgatgacttcagagcgcggttttggtaccggagatcgaccactgactgagccaccctctccgtagggttctttctcgaggactctaccctcctcccccacgtcctgtctcagctgcagtcgtaagtccgtgcaccatccttgacgttttgctgccacctctgtccacattcttcttggatttgtataaaagaatctttttttaccttgatgtagaatcatggtggaaaaagttggaaacacagatctgtgcagttctacattcactgattattacagtgtgattttcatcggttttgtaagtacaggacttgccgtttcttttgatctcttgattgaaggaggatagggcattaaagtgcttttgacatgaggaattttcatttggttcttctgtcaactttcttgcttattctgctgaaccctctgtgtatttcccttccaggtatatttgaacagataagcaggcatgcagctctgagactcctgagttttatgccattatcaaaagcattttcaagaatccctcaattctatcctgaaatgatgttattctgataataaagctcagatctgcaactttattgttatatatttttcacttctgtaaaattaatggccagtttttcctgacaatttataggaacagtatctttcaacatactccctacattatccttcaatatctgcaatacttgtctttagtaactgtatttctggtaagattatgatttcatgagaaacaattgaaaatatatccgatctaattaaattaggtcagcctgctattgctctcaggtgttgcctgtcttcacgaatgattagtatcgattgacctctttcttaggtg

SEQ ID NO: 449269 - DNA, 2422 bp, Homo sapiens
tccctaagaacccggaagtggtggagccaacggccagccagacctgtggcagtcccagccccagggtgctctccgcggtcggccatttatcggtgaagcaacagccccttgacgtcaagcttgacgcattggagataaagtccgaggaggtgaactaacctttgaacgtgccagtaagtaagatggcgagaaaagcaagagagagtgggaccgatcgatagcgcagcggtcggcttggcgccctttcagcgtgcgcagtgaacgtgcgctcggagcggtagattgggcaggattcgcgcctccatttttccaggagagagcgggataccaagagaaccggaccagctgctggcagggaaactgtcttccttttctccaagatgtacagaaccaaagtgggcttgaaggaccgccagcagctctacaagctgatcattagccagctgctatatgacggctacatcagcatcgccaatggcctcatcaatgaaatcaagcctcagtctgtgtgtgcaccctcggagcagctcctgcatctcatcaaactcggaatggaaaacgatgacaccgcagttcagtatgcaattggtcgttcagatactgttgcccctggcacagggattgacctggaatttgatgcagatgttcagactatgtccccagaggcttctgagtacgaaacatgctatgtcacatcacataaaggaccatgccgtgtagctacctatagtagagatggacagttaatagctactgggtctgctgatgcttcgataaagatacttgacacagagaggatgttggccaaaagtgccatgccaatagaggtcatgatgaatgagaccgcacaacaaaatatggcttgctttccacccaacagaacagatcctggcttctggttcaagggattatactcttaaattatttgattattccaaaccatcagcaaaaagagccttcaaatacattcaggaagctgaaatgttacgttccatctcttttcatccttctggagactttatacttgtcggaactcagcatcctactcttcgcctttatgatatcaacacctttcaatgttttgtctcttgcaatcctcaagatcaacacaccgatgctatatgttccgttaattacaattctagtgccaatatgtacgtaactggaagcaaggacggctgcatcaaattatgggatggtgtttcaaatcgatgcatcacaacttttgagaaagcacatgacggtgctgaagtttgttctgccattttttccaaaaattctaaatacattctctcaagtggaaaagactctgtagctaaactttgggaaatatcaacgggacgaacactggtcagatacacgggcgcgggtttaagtggacgccaggtgcaccggacacaggctgtgtttaaccacaccgaggactatgtgttgctgcccgacgagaggacgatcagtctttgctgctgggactcgaggacagccgagcggagaaacctgctgtcgttggggcacaacaatattgtacgctgcatagtgcactcccccaccaaccccgggttcatgacgtgcagcgatgacttcagagcgcggttttggtaccggagatcgaccactgactgagccaccctctccgtagggttctttctcgaggactctaccctcctcccccacgtcctgtctcagctgcagtcgtaagtccgtgcaccatccttgacgttttgctgccacctctgtccacattcttcttggatttgtataaaagaatctttttttaccttgatgtagaatcatggtggaaaaagttggaaacacagatctgtgcagttctacattcactgattattacagtgtgattttcatcggttttgtaagtacaggacttgccgtttcttttgatctcttgattgaaggaggatagggcattaaagtgcttttgacatgaggaattttcatttggttcttctgtcaactttcttgcttattctgctgaaccctctgtgtatttcccttccaggtatatttgaacagataagcaggcatgcagctctgagactcctgagttttatgccattatcaaaagcattttcaagaatccctcaattctatcctgaaatgatgttattctgataataaagctcagatctgcaactttattgttatatatttttcacttctgtaaaattaatggccagtttttcctgacaatttataggaacagtatctttcaacatactccctacattatccttcaatatctgcaatacttgtctttagtaactgtatttctggtaagattatgatttcatgagaaacaattgaaaatatatccgatctaattaaattaggtcagcctgctattgctctcaggtgttgcctgtcttcacgaatgattagtatcgattgacctctttcttaggtg

SEQ ID NO: 449270 - DNA, 2513 bp, Homo sapiens
tccctaagaacccggaagtggtggagccaacggccagccagacctgtggcagtcccagccccagggtgctctccgcggtcggccatttatcggtgaagcaacagccccttgacgtcaagcttgacgcattggagataaagtccgaggaggtgaactaacctttgaacgtgccagtaagtaagatggcgagaaaagcaagagagagtgggaccgatcgatagcgcagcggtcggcttggcgccctttcagcgtgcgcagtgaacgtgcgctcggagcggtagattgggcaggattcgcgcctccatttttccaggagagagcgggataccaagagaaccggaccagctgctggcagggaaactgtcttccttttctccaagatgtacagaaccaaagtgggcttgaaggaccgccagcagctctacaagctgatcattagccagctgctatatgacggctacatcagcatcgccaatggcctcatcaatgaaatcaagcctcagtctgtgtgtgcaccctcggagcagctcctgcatctcatcaaactcggtagattgtgaacacaaatccatacgtcccatggcaaggaatggaaaacgatgacaccgcagttcagtatgcaattggtcgttcagatactgttgcccctggcacagggattgacctggaatttgatgcagatgttcagactatgtccccagaggcttctgagtacgaaacatgctatgtcacatcacataaaggaccatgccgtgtagctacctatagtagagatggacagttaatagctactgggtctgctgatgcttcgataaagatacttgacacagagaggatgttggccaaaagtgccatgccaatagaggtcatgatgaatgagaccgcacaacaaaatatggaaaaccacccagtgattcgaactctttatgaccatgtggatgaagtcacgtgccttgctttccacccaacagaacagatcctggcttctggttcaagggattatactcttaaattatttgattattccaaaccatcagcaaaaagagccttcaaatacattcaggaagctgaaatgttacgttccatctcttttcatccttctggagactttatacttgtcggaactcagcatcctactcttcgcctttatgatatcaacacctttcaatgttttgtctcttgcaatcctcaagatcaacacaccgatgctatatgttccgttaattacaattctagtgccaatatgtacgtaactggaagcaaggacggctgcatcaaattatgggatggtgtttcaaatcgatgcatcacaacttttgagaaagcacatgacggtgctgaagtttgttctgccattttttccaaaaattctaaatacattctctcaagtggaaaagactctgtagctaaactttgggaaatatcaacgggacgaacactggtcagatacacgggcgcgggtttaagtggacgccaggtgcaccggacacaggctgtgtttaaccacaccgaggactatgtgttgctgcccgacgagaggacgatcagtctttgctgctgggactcgaggacagccgagcggagaaacctgctgtcgttggggcacaacaatattgtacgctgcatagtgcactcccccaccaaccccgggttcatgacgtgcagcgatgacttcagagcgcggttttggtaccggagatcgaccactgactgagccaccctctccgtagggttctttctcgaggactctaccctcctcccccacgtcctgtctcagctgcagtcgtaagtccgtgcaccatccttgacgttttgctgccacctctgtccacattcttcttggatttgtataaaagaatctttttttaccttgatgtagaatcatggtggaaaaagttggaaacacagatctgtgcagttctacattcactgattattacagtgtgattttcatcggttttgtaagtacaggacttgccgtttcttttgatctcttgattgaaggaggatagggcattaaagtgcttttgacatgaggaattttcatttggttcttctgtcaactttcttgcttattctgctgaaccctctgtgtatttcccttccaggtatatttgaacagataagcaggcatgcagctctgagactcctgagttttatgccattatcaaaagcattttcaagaatccctcaattctatcctgaaatgatgttattctgataataaagctcagatctgcaactttattgttatatatttttcacttctgtaaaattaatggccagtttttcctgacaatttataggaacagtatctttcaacatactccctacattatccttcaatatctgcaatacttgtctttagtaactgtatttctggtaagattatgatttcatgagaaacaattgaaaatatatccgatctaattaaattaggtcagcctgctattgctctcaggtgttgcctgtcttcacgaatgattagtatcgattgacctctttcttaggtg

SEQ ID NO: 449271 - DNA, 2416 bp, Homo sapiens
tccctaagaacccggaagtggtggagccaacggccagccagacctgtggcagtcccagccccagggtgctctccgcggtcggccatttatcggtgaagcaacagccccttgacgtcaagcttgacgcattggagataaagtccgaggaggtgaactaacctttgaacgtgccagtaagtaagatggcgagaaaagcaagagagagtgggaccgatcgatagcgcagcggtcggcttggcgccctttcagcgtgcgcagtgaacgtgcgctcggagcggtagattgggcaggattcgcgcctccatttttccaggagagagcgggataccaagagaaccggaccagctgctggcagggaaactgtcttccttttctccaagatgtacagaaccaaagtgggcttgaaggaccgccagcagctctacaagctgatcattagccagctgctatatgacggctacatcagcatcgccaatggcctcatcaatgaaatcaagcctcagtctgtgtgtgcaccctcggagcagctcctgcatctcatcaaactcgcctggcacagggattgacctggaatttgatgcagatgttcagactatgtccccagaggcttctgagtacgaaacatgctatgtcacatcacataaaggaccatgccgtgtagctacctatagtagagatggacagttaatagctactgggtctgctgatgcttcgataaagatacttgacacagagaggatgttggccaaaagtgccatgccaatagaggtcatgatgaatgagaccgcacaacaaaatatggaaaaccacccagtgattcgaactctttatgaccatgtggatgaagtcacgtgccttgctttccacccaacagaacagatcctggcttctggttcaagggattatactcttaaattatttgattattccaaaccatcagcaaaaagagccttcaaatacattcaggaagctgaaatgttacgttccatctcttttcatccttctggagactttatacttgtcggaactcagcatcctactcttcgcctttatgatatcaacacctttcaatgttttgtctcttgcaatcctcaagatcaacacaccgatgctatatgttccgttaattacaattctagtgccaatatgtacgtaactggaagcaaggacggctgcatcaaattatgggatggtgtttcaaatcgatgcatcacaacttttgagaaagcacatgacggtgctgaagtttgttctgccattttttccaaaaattctaaatacattctctcaagtggaaaagactctgtagctaaactttgggaaatatcaacgggacgaacactggtcagatacacgggcgcgggtttaagtggacgccaggtgcaccggacacaggctgtgtttaaccacaccgaggactatgtgttgctgcccgacgagaggacgatcagtctttgctgctgggactcgaggacagccgagcggagaaacctgctgtcgttggggcacaacaatattgtacgctgcatagtgcactcccccaccaaccccgggttcatgacgtgcagcgatgacttcagagcgcggttttggtaccggagatcgaccactgactgagccaccctctccgtagggttctttctcgaggactctaccctcctcccccacgtcctgtctcagctgcagtcgtaagtccgtgcaccatccttgacgttttgctgccacctctgtccacattcttcttggatttgtataaaagaatctttttttaccttgatgtagaatcatggtggaaaaagttggaaacacagatctgtgcagttctacattcactgattattacagtgtgattttcatcggttttgtaagtacaggacttgccgtttcttttgatctcttgattgaaggaggatagggcattaaagtgcttttgacatgaggaattttcatttggttcttctgtcaactttcttgcttattctgctgaaccctctgtgtatttcccttccaggtatatttgaacagataagcaggcatgcagctctgagactcctgagttttatgccattatcaaaagcattttcaagaatccctcaattctatcctgaaatgatgttattctgataataaagctcagatctgcaactttattgttatatatttttcacttctgtaaaattaatggccagtttttcctgacaatttataggaacagtatctttcaacatactccctacattatccttcaatatctgcaatacttgtctttagtaactgtatttctggtaagattatgatttcatgagaaacaattgaaaatatatccgatctaattaaattaggtcagcctgctattgctctcaggtgttgcctgtcttcacgaatgattagtatcgattgacctctttcttaggtg

SEQ ID NO: 449272 - DNA, 1002 bp, Homo sapiens
tcgagctcggtaccggctcattgtgtactggcgtggcgctttgggtggactcgggaggctctttgtgaggccctttgcgtggctcgttggggcacaacaatattgtacgctgcatagtgcactcccccaccaaccccgggttcatgacgtgcagcgatgacttcagagcgcggttttggtaccggagatcgaccactgactgagccaccctctccgtagggttctttctcgaggactctaccctcctcccccacgtcctgtctcagctgcagtcgtaagtccgtgcaccatccttgacgttttgctgccacctctgtccacattcttcttggatttgtataaaagaatctttttttaccttgatgtagaatcatggtggaaaaagttggaaacacagatctgtgcagttctacattcactgattattacagtgtgattttcatcggttttgtaagtacaggacttgccgtttcttttgatctcttgattgaaggaggatagggcattaaagtgcttttgacatgaggaattttcatttggttcttctgtcaactttcttgcttattctgctgaaccctctgtgtatttcccttccaggtatatttgaacagataagcaggcatgcagctctgagactcctgagttttatgccattatcaaaagcattttcaagaatccctcaattctatcctgaaatgatgttattctgataataaagctcagatctgcaactttattgttatatatttttcacttctgtaaaattaatggccagtttttcctgacaatttataggaacagtatctttcaacatactccctacattatccttcaatatctgcaatacttgtctttagtaactgtatttctggtaagattatgatttcatgagaaacaattgaaaatatatccgatctaattaaattaggtcagcctgctattgctctcaggtgttgcctgtcttcacgaatgattagtatcgattgacctctttcttaggtg

SEQ ID NO: 449273 - DNA, 355 bp, Homo sapiens
tgggattacaggcgtgaaccaccgtgcctggcccttagtgtcttctatatgcctggccctatgttgatgctgggtccttgtcccgaaaaagtatcctggattttggtatgctaagaattctttaaaagcctttgaaagggctcagcattcccatatccctgaaagccaggtagcagcctctgttttataataaagtcaccctcggacagccctcaccagtcacaagcaggcatagtgaatggggagcgtgttgggagcggaggtccgtgctggagaggagggatgctggcccgtgctcctgccgcagctcctgaggagctgtgaccttggaaattcctgccccggcatcagctga

SEQ ID NO: 449274 - DNA, 4049 bp, Homo sapiens
attgatgttcctttcctcacagcaacagataccacactacagtgggacaatttagacactcctgttaacctaacgtatgggtcatcttactctggaagactatcagatctggagtgtgaaaaatgttcttgccaatgagtttttgaacctccttttccaggtgtgtcacatagttctggggttaagaccagctactccggaagaagaaggacaaattattagaggatggttagaacgagagagcaggtatggtctgcaagcaggacacaactggtttatcatctccatgcagtggtggcaacagtggaaagaatatgtcaaatacgatgccaaccctgtggtaattgagccatcatctgttttgaatggaggaaaatactcatttggaactgcagcccatcctatggagcaggtcgaagatagaattggaagcagcctcagttacgtgaatactacagaagagaaattttcagacaacatttctactgcatctgaagcctcagaaactgctggcagcggctttctgtattctgccacaccaggggcagatgtttgctttgctcgacaacataacacttctgacaataacaaccagtgtttgctgggagccaatgggaatattttgttgcaccttaaccctcagaaaccaggggctattgataatcagccattagtaactcaagaaccagtaaaggctacatcattaacactagaaggaggacgattaaaacgaactccacagctgattcatggaagagactatgaaatggtcccagaacctgtgtggagagcactttatcactggtatggagcaaacctggccttacctagaccagttatcaagaacagcaagacagacatcccagagctggaattatttccccgctatcttctcttcctgagacagcagcctgccactcggacacagcagtctaacatctgggtgaatatgggaaatgtaccttctccgaatgcacctttaaagcgggtattagcctatacaggctgttttagtcgaatgcagaccatcaaggaaattcacgaatatctatctcaaaggctgcgcattaaagaggaagatatgcgcctgtggctatacaacagtgagaactaccttactcttctggatgatgaggatcataaattggaatatttgaaaatccaggatgaacaacacctggtaattgaagttcgcaacaaagatatgagttggcctgaggagatgtcttttatagcaaatagtagtaaaatagatagacacaaggttcccacagaaaagggagccacaggtctaagcaatctgggaaacacatgcttcatgaactcaagcatccagtgtgttagtaacacacagccactgacacagtattttatctcagggagacatctttatgaactcaacaggacaaatcccattggtatgaaggggcatatggctaaatgctatggtgatttagtgcaggaactttggagtggaactcagaagaatgttgccccattaaagcttcggtggaccatagcaaaatatgctcccaggtttaatgggtttcagcaacaggactcccaagaacttctggcttttctcttggatggtcttcatgaagatcttaatcgagtccatgaaaagccatatgtggaactgaaggacagtgatgggcgaccagactgggaagtagctgcagaggcctgggacaaccatctaagaagaaatagatcaattgttgtggatttgttccatgggcagctaagatctcaagtaaaatgcaagacatgtgggcatataagtgtccgatttgaccctttcaattttttgtctttgccactaccaatggacagttatatgcacttagaaataacagtgattaagttagatggtactacccctgtacggtatggactaagactgaatatggatgaaaagtacacaggtttaaaaaaacagctgagtgatctctgtggacttaattcagaacaaatccttctagcagaagtacatggttccaacataaagaactttcctcaggacaaccaaaaagtacgactctcagtgagtggatttttgtgtgcatttgaaattcctgtccctgtgtctccaatttcagcttctagtccaacacagacagatttctcctcttcgccatctacaaatgaaatgttcaccctaactaccaatggggacctaccccgaccaatattcatccccaatggaatgccaaacactgttgtgccatgtggaactgagaagaacttcacaaatggaatggttaatggtcacatgccatctcttcctgacagcccctttacaggttacatcattgcagtccaccgaaaaatgatgaggacagaactgtatttcctgtcatctcagaagaatcgccccagcctctttggaatgccattgattgttccatgtactgtgcatacccggaagaaagacctatatgatgcggtttggattcaagtatcccggttagcgagcccactcccacctcaggaagctagtaatcatgcccaggattgtgacgacagtatgggctatcaatatccattcactctacgagttgtgcagaaagatgggaactcctgtgcttggtgcccatggtatagattttgcagaggctgtaaaattgattgtggggaagacagagctttcattggaaatgcctatatcgctgtggattgggatcccacagcccttcaccttcgctatcaaacatcccaggaaagggttgtagatgagcatgagagtgtggagcagagtcggcgagcgcaagccgagcccatcaacctggacagctgtctccgtgctttcaccagtgaggaagagctaggggaaaatgagatgtactactgttccaagtgtaagacccactgcttagcaacaaagaagctggatctctggaggcttccacccatcctgattattcaccttaagcgatttcaatttgtaaatggtcggtggataaaatcacagaaaattgtcaaatttcctcgggaaagttttgatccaagtgcttttttggtaccaagagacccggctctctgccagcataaaccactcacaccccagggggatgagctctctgagcccaggattctggcaagggaggtgaagaaagtggatgcgcagagttcggctggggaagaggacgtgctcctgagcaaaagcccatcctcactcagcgctaacatcatcagcagcccgaaaggttctccttcttcatcaagaaaaagtggaaccagctgtccctccagcaaaaacagcagccctaatagcagcccacggactttggggaggagcaaagggaggctccggctgccccagattggcagcaaaaataaactgtcaagtagtaaagagaacttggatgccagcaaagaaaatggggctgggcagatatgtgagctggctgacgccttgagtcgagggcatgtgctggggggcagccaaccagagttggtcactcctcaggaccatgaggtagctttggccaatggattcctttatgagcatgaagcatgtggcaatggctacagcaatggtcagcttggaaaccacagtgaagaagacagcactgatgaccaaagagaagatactcgtattaagcctatttataatctatatgcaatttcgtgccattcaggaattctgggtgggggccattacgtcacttatgccaaaaacccaaactgcaagtggtactgttacaatgacagcagctgtaaggaacttcacccggatgaaattgacaccgactctgcctacattcttttctatgagcagcaggggatagactatgcacaatttctgccaaagactgatggcaaaaagatggcagacacaagcagtatggatgaagactttgagtctgattacaaaaagtactgtgtgttacagtaaagctaccactctggctgctagacagcttggcggtgagggagatgactccttgtagctgacatttggcaaaagcgtcactgaaaggcaagctaaatgtagttattttatcctgtggccctgaagcacaaaataaaaattctaattaaaa

SEQ ID NO: 449275 - DNA, 1444 bp, Homo sapiens
  misc_feature (1105)..(1105): n is a, c, g, or t
  misc_feature (1165)..(1165): n is a, c, g, or t
tggttaatcatcttctgtgcatattttcgtattgtaaagatcatgtatttctttcaaaagaacttgtggacattgagttcatagatacaataggatctagcccccattactcttttgttggagttcttgttttagttttcttttaatttagtgacttcatatcaccattatctaccaagaacatttggaatatttttctagtttgaggaaaataattaaaggatgctatgtagaagcccagccacttagcccagctcttcccttccagtcggaggacatataattctcattatgaattattagatattctaggagggtggccaaatgttcatttggtaataattttaaaagctcttatttttagtaccatgccatgtattgttcagagaaggataacatttcctgtcttctacagaattaccagaatcttaatctgtactgacatgtcaacagagtaatacaatacatgggcattgagttcatatcctcaagcctgtttatgtataataactaaaaataagagattctatcctcttttttttttataggctttctgtattctgccacaccaggggcagatgtttgctttgctcgacaacataacacttctgacaataacaaccagtgtttgctgggagccaatgggaatattttgttgcaccttaaccctcagaaaccaggggctattgataatcagccattagtaactcaagaaccagtaaaggctacatcattaacactagaaggaggacgattaaaacgaactccacagctgattcatggaagagactatgaaatggtcccagaacctgtgtggagagcactttatcactggtatggagcaaacctggccttacctagaccagttatcaagaacagcaagacagacatcccagagctggaattatttccccgctatcttctcttcctgagacagcagcctgccactcggacacagcagtctaacatctgggtgaatatgggtatgatgagcctgagaatgtttcctcagcatttaccgagaggtaacttaagaatgcagcaagaataccatgcatttccttaaaaaaaaaaaaaaaaaaaaaaaaatgggtgaaaactacgnttgctcgaagtctggtgccactgtattgatacacattcccatcagctttcctacagactncagtaattaatttttacagggcttagaactatggtcatgcacaagactagatgaggggttgaagcaaacattccaacagcaaactgagatgggatgtttccttttctacttacaaagaaaataaatagaaatagattttacatgctttatttctttgagacaagccattgtaaattgttactagactaagtagtagtataccagtcattgactggtcttttcaactccactcaaatttgtaaaaagcaattcctcttatactatcatcttttttgtttt

SEQ ID NO: 449276 - DNA, 4404 bp, Homo sapiens
ggagcggggtaagagggcgtgaggagggaaggagagggaggagagagaggagagagaagggcggagtaggaggcaggggaagggggcggggcggaagagtcacgtgatccggcatggaggcggtggcggcgaccgggaggagccgccggggcagaagccgcacttgttagtgtggggggaggtgggggcgggggacgccgacaccgtcaccgtcacccagggacgccgaggagaaggcgggaggggggtgggggcgagatcaggctccgaccccccgccgaggggatgaggggagcatgggtgccaaggagtcacggatcggattcctcagctacgaggaggcgctgaggagagttacagatgtagagctaaaacgactgaaggatgctttcaagaggacctgtggactctcatattacatgggccagcactgcttcatccgggaagtgcttggggatggagtgcctccaaaggttgctgaggtgtgtcacatagttctggggttaagaccagctactccggaagaagaaggacaaattattagaggatggttagaacgagagagcaggtatggtctgcaagcaggacacaactggtttatcatctccatgcagtggtggcaacagtggaaagaatatgtcaaatacgatgccaaccctgtggtaattgagccatcatctgttttgaatggaggaaaatactcatttggaactgcagcccatcctatggagcaggtcgaagatagaattggaagcagcctcagttacgtgaatactacagaagagaaattttcagacaacatttctactgcatctgaagcctcagaaactgctggcagcggctttctgtattctgccacaccaggggcagatgtttgctttgctcgacaacataacacttctgacaataacaaccagtgtttgctgggagccaatgggaatattttgttgcaccttaaccctcagaaaccaggggctattgataatcagccattagtaactcaagaaccagtaaaggctacatcattaacactagaaggaggacgattaaaacgaactccacagctgattcatggaagagactatgaaatggtcccagaacctgtgtggagagcactttatcactggtatggagcaaacctggccttacctagaccagttatcaagaacagcaagacagacatcccagagctggaattatttccccgctatcttctcttcctgagacagcagcctgccactcggacacagcagtctaacatctgggtgaatatgggaaatgtaccttctccgaatgcacctttaaagcgggtattagcctatacaggctgttttagtcgaatgcagaccatcaaggaaattcacgaatatctatctcaaaggctgcgcattaaagaggaagatatgcgcctgtggctatacaacagtgagaactaccttactcttctggatgatgaggatcataaattggaatatttgaaaatccaggatgaacaacacctggtaattgaagttcgcaacaaagatatgagttggcctgaggagatgtcttttatagcaaatagtagtaaaatagatagacacaaggttcccacagaaaagggagccacaggtctaagcaatctgggaaacacatgcttcatgaactcaagcatccagtgtgttagtaacacacagccactgacacagtattttatctcagggagacatctttatgaactcaacaggacaaatcccattggtatgaaggggcatatggctaaatgctatggtgatttagtgcaggaactttggagtggaactcagaagaatgttgccccattaaagcttcggtggaccatagcaaaatatgctcccaggtttaatgggtttcagcaacaggactcccaagaacttctggcttttctcttggatggtcttcatgaagatcttaatcgagtccatgaaaagccatatgtggaactgaaggacagtgatgggcgaccagactgggaagtagctgcagaggcctgggacaaccatctaagaagaaatagatcaattgttgtggatttgttccatgggcagctaagatctcaagtaaaatgcaagacatgtgggcatataagtgtccgatttgaccctttcaattttttgtctttgccactaccaatggacagttatatgcacttagaaataacagtgattaagttagatggtactacccctgtacggtatggactaagactgaatatggatgaaaagtacacaggtttaaaaaaacagctgagtgatctctgtggacttaattcagaacaaatccttctagcagaagtacatggttccaacataaagaactttcctcaggacaaccaaaaagtacgactctcagtgagtggatttttgtgtgcatttgaaattcctgtccctgtgtctccaatttcagcttctagtccaacacagacagatttctcctcttcgccatctacaaatgaaatgttcaccctaactaccaatggggacctaccccgaccaatattcatccccaatggaatgccaaacactgttgtgccatgtggaactgagaagaacttcacaaatggaatggttaatggtcacatgccatctcttcctgacagcccctttacaggttacatcattgcagtccaccgaaaaatgatgaggacagaactgtatttcctgtcatctcagaagaatcgccccagcctctttggaatgccattgattgttccatgtactgtgcatacccggaagaaagacctatatgatgcggtttggattcaagtatcccggttagcgagcccactcccacctcaggaagctagtaatcatgcccaggattgtgacgacagtatgggctatcaatatccattcactctacgagttgtgcagaaagatgggaactcctgtgcttggtgcccatggtatagattttgcagaggctgtaaaattgattgtggggaagacagagctttcattggaaatgcctatatcgctgtggattgggatcccacagcccttcaccttcgctatcaaacatcccaggaaagggttgtagatgagcatgagagtgtggagcagagtcggcgagcgcaagccgagcccatcaacctggacagctgtctccgtgctttcaccagtgaggaagagctaggggaaaatgagatgtactactgttccaagtgtaagacccactgcttagcaacaaagaagctggatctctggaggcttccacccatcctgattattcaccttaagcgatttcaatttgtaaatggtcggtggataaaatcacagaaaattgtcaaatttcctcgggaaagttttgatccaagtgcttttttggtaccaagagacccggctctctgccagcataaaccactcacaccccagggggatgagctctctgagcccaggattctggcaagggaggtgaagaaagtggatgcgcagagttcggctggggaagaggacgtgctcctgagcaaaagcccatcctcactcagcgctaacatcatcagcagcccgaaaggttctccttcttcatcaagaaaaagtggaaccagctgtccctccagcaaaaacagcagccctaatagcagcccacggactttggggaggagcaaagggaggctccggctgccccagattggcagcaaaaataaactgtcaagtagtaaagagaacttggatgccagcaaagaaaatggggctgggcagatatgtgagctggctgacgccttgagtcgagggcatgtgctggggggcagccaaccagagttggtcactcctcaggaccatgaggtagctttggccaatggattcctttatgagcatgaagcatgtggcaatggctacagcaatggtcagcttggaaaccacagtgaagaagacagcactgatgaccaaagagaagatactcgtattaagcctatttataatctatatgcaatttcgtgccattcaggaattctgggtgggggccattacgtcacttatgccaaaaacccaaactgcaagtggtactgttacaatgacagcagctgtaaggaacttcacccggatgaaattgacaccgactctgcctacattcttttctatgagcagcaggggatagactatgcacaatttctgccaaagactgatggcaaaaagatggcagacacaagcagtatggatgaagactttgagtctgattacaaaaagtactgtgtgttacagtaaagctaccactctggctgctagacagcttggcggtgagggagatgactccttgtagctgacatttggcaaaagcgtcactgaaaggcaagctaaatgtagttattttatcctgtggccctgaagcacaaaataaaaattctaattaaaatagttaactttaagagtagtaatcattttattt

SEQ ID NO: 449277 - DNA, 4197 bp, Homo sapiens
ggagcggggtaagagggcgtgaggagggaaggagagggaggagagagaggagagagaagggcggagtaggaggcaggggaagggggcggggcggaagagtcacgtgatccggcatggaggcggtggcggcgaccgggaggagccgccggggcagaagccgcacttgttagtgtggggggaggtgggggcgggggacgccgacaccgtcaccgtcacccagggacgccgaggagaaggcgggaggggggtgggggcgagatcaggctccgaccccccgccgaggggatgaggggagcatgggtgccaaggagtcacggatcggattcctcagctacgaggaggcgctgaggagagttacagatgtagagctaaaacgactgaaggatgctttcaagaggacctgtggactctcatattacatgggccagcactgcttcatccgggaagtgcttggggatggagtgcctccaaaggttgctgaggtgtgtcacatagttctggggttaagaccagctactccggaagaagaaggacaaattattagaggatggttagaacgagagagcaggtatggtctgcaagcaggacacaactggtttatcatctccatgcagtggtggcaacagtggaaagaatatgtcaaatacgatgccaaccctgtggtaattgagccatcatctgttttgaatggaggaaaatactcatttggaactgcagcccatcctatggagcaggtcgaagatagaattggaagcagcctcagttacgtgaatactacagaagagaaattttcagacaacatttctactgcatctgaagcctcagaaactgctggcagcggctttctgtattctgccacaccaggggcagatgtttgctttgctcgacaacataacacttctgacaataacaaccagtgtttgctgggagccaatgggaatattttgttgcaccttaaccctcagaaaccaggggctattgataatcagccattagtaactcaagaaccagtaaaggctacatcattaacactagaaggaggacgattaaaacgaactccacagctgattcatggaagagactatgaaatggtcccagaacctgtgtggagagcactttatcactggtatggagcaaacctggccttacctagaccagttatcaagaacagcaagacagacatcccagagctggaattatttccccgctatcttctcttcctgagacagcagcctgccactcggacacagcagtctaacatctgggtgaatatgggaaatgtaccttctccgaatgcacctttaaagcgggtattagcctatacaggctgttttagtcgaatgcagaccatcaaggaaattcacgaatatctatctcaaaggctgcgcattaaagaggaagatatgcgcctgtggctatacaacagtgagaactaccttactcttctggatgatgaggatcataaattggaatatttgaaaatccaggatgaacaacacctggtaattgaagttcgcaacaaagatatgagttggcctgaggagatgtcttttatagcaaatagtagtaaaatagatagacacaaggttcccacagaaaagggagccacaggtctaagcaatctgggaaacacatgcttcatgaactcaagcatccagtgtgttagtaacacacagccactgacacagtattttatctcagggagacatctttatgaactcaacaggacaaatcccattggtatgaaggggcatatggctaaatgctatggtgatttagtgcaggaactttggagtggaactcagaagaatgttgccccattaaagcttcggtggaccatagcaaaatatgctcccaggtttaatgggtttcagcaacaggactcccaagaacttctggcttttctcttggatggtcttcatgaagatcttaatcgagtccatgaaaagccatatgtggaactgaaggacagtgatgggcgaccagactgggaagtagctgcagaggcctgggacaaccatctaagaagaaatagatcaattgttgtggatttgttccatgggcagctaagatctcaagtaaaatgcaagacatgtgggcatataagtgtccgatttgaccctttcaattttttgtctttgccactaccaatggacagttatatgcacttagaaataacagtgattaagttagatggtactacccctgtacggtatggactaagactgaatatggatgaaaagtacacaggtttaaaaaaacagctgagtgatctctgtggacttaattcagaacaaatccttctagcagaagtacatggttccaacataaagaactttcctcaggacaaccaaaaagtacgactctcagtgagtggatttttgtgtgcatttgaaattcctgtccctgtgtctccaatttcagcttctagtccaacacagacagatttctcctcttcgccatctacaaatgaaatgttcaccctaactaccaatggggacctaccccgaccaatattcatccccaatggaatgccaaacactgttgtgccatgtggaactgagaagaacttcacaaatggaatggttaatggtcacatgccatctcttcctgacagcccctttacaggttacatcattgcagtccaccgaaaaatgatgaggacagaactgtatttcctgtcatctcagaagaatcgccccagcctctttggaatgccattgattgttccatgtactgtgcatacccggaagaaagacctatatgatgcggtttggattcaagtatcccggttagcgagcccactcccacctcaggaagctagtaatcatgcccaggattgtgacgacagtatgggctatcaatatccattcactctacgagttgtgcagaaagatgggaactcctgtgcttggtgcccatggtatagattttgcagaggctgtaaaattgattgtggggaagacagagctttcattggaaatgcctatatcgctgtggattgggatcccacagcccttcaccttcgctatcaaacatcccaggaaagggttgtagatgagcatgagagtgtggagcagagtcggcgagcgcaagccgagcccatcaacctggacagctgtctccgtgctttcaccagtgaggaagagctaggggaaaatgagatgtactactgttccaagtgtaagacccactgcttagcaacaaagaagctggatctctggaggcttccacccatcctgattattcaccttaagcgatttcaatttgtaaatggtcggtggataaaatcacagaaaattgtcaaatttcctcgggaaagttttgatccaagtgcttttttggtaccaagagacccggctctctgccagcataaaccactcacaccccagggggatgagctctctgagcccaggattctggcaagggaggtgaagaaagtggatgcgcagagttcggctggggaagaggacgtgctcctgagcaaaagcccatcctcactcagcgctaacatcatcagcagcccgaaaggttctccttcttcatcaagaaaaagtggaaccagctgtccctccagcaaaaacagcagccctaatagcagcccacggactttggggaggagcaaagggaggctccggctgccccagattggcagcaaaaataaactgtcaagtagtaaagagaacttggatgccagcaaagaaaatggggctgggcagatatgtgagctggctgacgccttgagtcgagggcatgtgctggggggcagccaaccagagttggtcactcctcaggaccatgaggtagctttggccaatggattcctttatgagcatgaagcatgtggcaatggctacagcaatggtcagcttggaaaccacagtgaagaagacagcactgatgaccaaagagaagatactcgtattaagcctatttataatctatatgcaatttcgtcccattggcacagcggggcctcccggtcagtcccaggctgcagctgtccaatgacaacaggaccctcactctactcagtgtcacaaggaatgatgtaggaccctatgagtgtggaatccagaacgaattaagtgttgaccacagcagacccagtcatcctgaatgtcctcatatgcccagacgaccccaccatttccccctcatacacctagcgtaccaggggtgaacctcagcctctcc

SEQ ID NO: 449278 - DNA, 3734 bp, Homo sapiens
ctactcttcttggtatccaaatattgccaataatttggaccttgggccttgggcctttgctcatcttttcaaagttgaggctttggactcactttaaaacacctggaaggctgggcttggtggctcacacctgtaatcccagcactttgggaagccgaggcaggtggatcgcttgagcccaggagttagagaccagccagggcaatatggccaagaccctgtctctacccaaaaatgtacaaaaattagccagatgtggtggcgtgcacctgtagtaccagctactcaggaggctgaggtgggaggattgcttgagccttggaggtggaggctgcagtgagccaaaatcacagcaccgcactctagtctggcaacataacaagactccatctattaaaaacaaacaaacaaacaaacaaacaaaaagaacttgggtctcctgcctgcattttaaagcgttttggtactcttcatttataaaattattacacctgtaattctcatttctcattattatttcctaaaatagtatggtccccattgctgagaggggtgcttctttttcacatctgccttttttcttactgtgattactgtaaccataggaaatgtaccttctccgaatgcacctttaaagcgggtattagcctatacaggctgttttagtcgaatgcagaccatcaaggaaattcacgaatatctatctcaaaggctgcgcattaaagaggaagatatgcgcctgtggctatacaacagtgagaactaccttactcttctggatgatgaggatcataaattggaatatttgaaaatccaggatgaacaacacctggtaattgaagttcgcaacaaagatatgagttggcctgaggagatgtcttttatagcaaatagtagtaaaatagatagacacaaggttcccacagaaaagggagccacaggtctaagcaatctgggaaacacatgcttcatgaactcaagcatccagtgtgttagtaacacacagccactgacacagtattttatctcagggagacatctttatgaactcaacaggacaaatcccattggtatgaaggggcatatggctaaatgctatggtgatttagtgcaggaactttggagtggaactcagaagaatgttgccccattaaagcttcggtggaccatagcaaaatatgctcccaggtttaatgggtttcagcaacaggactcccaagaacttctggcttttctcttggatggtcttcatgaagatcttaatcgagtccatgaaaagccatatgtggaactgaaggacagtgatgggcgaccagactgggaagtagctgcagaggcctgggacaaccatctaagaagaaatagatcaattgttgtggatttgttccatgggcagctaagatctcaagtaaaatgcaagacatgtgggcatataagtgtccgatttgaccctttcaattttttgtctttgccactaccaatggacagttatatgcacttagaaataacagtgattaagttagatggtactacccctgtacggtatggactaagactgaatatggatgaaaagtacacaggtttaaaaaaacagctgagtgatctctgtggacttaattcagaacaaatccttctagcagaagtacatggttccaacataaagaactttcctcaggacaaccaaaaagtacgactctcagtgagtggatttttgtgtgcatttgaaattcctgtccctgtgtctccaatttcagcttctagtccaacacagacagatttctcctcttcgccatctacaaatgaaatgttcaccctaactaccaatggggacctaccccgaccaatattcatccccaatggaatgccaaacactgttgtgccatgtggaactgagaagaacttcacaaatggaatggttaatggtcacatgccatctcttcctgacagcccctttacaggttacatcattgcagtccaccgaaaaatgatgaggacagaactgtatttcctgtcatctcagaagaatcgccccagcctctttggaatgccattgattgttccatgtactgtgcatacccggaagaaagacctatatgatgcggtttggattcaagtatcccggttagcgagcccactcccacctcaggaagctagtaatcatgcccaggattgtgacgacagtatgggctatcaatatccattcactctacgagttgtgcagaaagatgggaactcctgtgcttggtgcccatggtatagattttgcagaggctgtaaaattgattgtggggaagacagagctttcattggaaatgcctatatcgctgtggattgggatcccacagcccttcaccttcgctatcaaacatcccaggaaagggttgtagatgagcatgagagtgtggagcagagtcggcgagcgcaagccgagcccatcaacctggacagctgtctccgtgctttcaccagtgaggaagagctaggggaaaatgagatgtactactgttccaagtgtaagacccactgcttagcaacaaagaagctggatctctggaggcttccacccatcctgattattcaccttaagcgatttcaatttgtaaatggtcggtggataaaatcacagaaaattgtcaaatttcctcgggaaagttttgatccaagtgcttttttggtaccaagagacccggctctctgccagcataaaccactcacaccccagggggatgagctctctgagcccaggattctggcaagggaggtgaagaaagtggatgcgcagagttcggctggggaagaggacgtgctcctgagcaaaagcccatcctcactcagcgctaacatcatcagcagcccgaaaggttctccttcttcatcaagaaaaagtggaaccagctgtccctccagcaaaaacagcagccctaatagcagcccacggactttggggaggagcaaagggaggctccggctgccccagattggcagcaaaaataaactgtcaagtagtaaagagaacttggatgccagcaaagaaaatggggctgggcagatatgtgagctggctgacgccttgagtcgagggcatgtgctggggggcagccaaccagagttggtcactcctcaggaccatgaggtagctttggccaatggattcctttatgagcatgaagcatgtggcaatggctacagcaatggtcagcttggaaaccacagtgaagaagacagcactgatgaccaaagagaagatactcgtattaagcctatttataatctatatgcaatttcgtgccattcaggaattctgggtgggggccattacgtcacttatgccaaaaacccaaactgcaagtggtactgttacaatgacagcagctgtaaggaacttcacccggatgaaattgacaccgactctgcctacattcttttctatgagcagcaggggatagactatgcacaatttctgccaaagactgatggcaaaaagatggcagacacaagcagtatggatgaagactttgagtctgattacaaaaagtactgtgtgttacagtaaagctaccactctggctgctagacagcttggcggtgagggagatgactccttgtagctgacatttggcaaaagcgtcactgaaaggcaagctaaatgtagttattttatcctgtggccctgaagcacaaaataaaaattctaattaaaatagttaactttaagagtagtaatcattttattt

SEQ ID NO: 449279 - DNA, 3436 bp, Homo sapiens
ggagcggggtaagagggcgtgaggagggaaggagagggaggagagagaggagagagaagggcggagtaggaggcaggggaagggggcggggcggaagagtcacgtgatccggcatggaggcggtggcggcgaccgggaggagccgccggggcagaagccgcacttgttagtgtggggggaggtgggggcgggggacgccgacaccgtcaccgtcacccagggacgccgaggagaaggcgggaggggggtgggggcgagatcaggctccgaccccccgccgaggggatgaggggagcatgggtgccaaggagtcacggatcggattcctcagctacgaggaggcgctgaggagagttacagatgtagagctaaaacgactgaaggatgctttcaagaggacctgtggactctcatattacatgggccagcactgcttcatccgggaagtgcttggggatggagtgcctccaaaggttgctgaggtgtgtcacatagttctggggttaagaccagctactccggaagaagaaggacaaattattagaggatggttagaacgagagagcaggtatggtctgcaagcaggacacaactggtttatcatctccatgcagtggtggcaacagtggaaagaatatgtcaaatacgatgccaaccctgtggtaattgagccatcatctgttttgaatggaggaaaatactcatttggaactgcagcccatcctatggagcaggtcgaagatagaattggaagcagcctcagttacgtgaatactacagaagagaaattttcagacaacatttctactgcatctgaagcctcagaaactgctggcagcggctttctgtattctgccacaccaggggcagatgtttgctttgctcgacaacataacacttctgacaataacaaccagtgtttgctgggagccaatgggaatattttgttgcaccttaaccctcagaaaccaggggctattgataatcagccattagtaactcaagaaccagtaaaggctacatcattaacactagaaggaggacgattaaaacgaactccacagctgattcatggaagagactatgaaatggtcccagaacctgtgtggagagcactttatcactggtatggagcaaacctggccttacctagaccagttatcaagaacagcaagacagacatcccagagctggaattatttccccgctatcttctcttcctgagacagcagcctgccactcggacacagcagtctaacatctgggtgaatatgggaaatgtaccttctccgaatgcacctttaaagcgggtattagcctatacaggctgttttagtcgaatgcagaccatcaaggaaattcacgaatatctatctcaaaggctgcgcattaaagaggaagatatgcgcctgtggctatacaacagtgagaactaccttactcttctggatgatgaggatcataaattggaatatttgaaaatccaggatgaacaacacctggtaattgaagttcgcaacaaagatatgagttggcctgaggagatgtcttttatagcaaatagtagtaaaatagatagacacaaggttcccacagaaaagggagccacaggtctaagcaatctgggaaacacatgcttcatgaactcaagcatccagtgtgttagtaacacacagccactgacacagtattttatctcagggagacatctttatgaactcaacaggacaaatcccattggtatgaaggggcatatggctaaatgctatggtgatttagtgcaggaactttggagtggaactcagaagaatgttgccccattaaagcttcggtggaccatagcaaaatatgctcccaggtttaatgggtttcagcaacaggactcccaagaacttctggcttttctcttggatggtcttcatgaagatcttaatcgagtccatgaaaagccatatgtggaactgaaggacagtgatgggcgaccagactgggaagtagctgcagaggcctgggacaaccatctaagaagaaatagatcaattgttgtggatttgttccatgggcagctaagatctcaagtaaaatgcaagacatgtgggcatataagtgtccgatttgaccctttcaattttttgtctttgccactaccaatggacagttatatgcacttagaaataacagtgattaagttagatggtactacccctgtacggtatggactaagactgaatatggatgaaaagtacacaggtttaaaaaaacagctgagtgatctctgtggacttaattcagaacaaatccttctagcagaagtacatggttccaacataaagaactttcctcaggacaaccaaaaagtacgactctcagtgagtggatttttgtgtgcatttgaaattcctgtccctgtgtctccaatttcagcttctagtccaacacagacagatttctcctcttcgccatctacaaatgaaatgttcaccctaactaccaatggggacctaccccgaccaatattcatccccaatggaatgccaaacactgttgtgccatgtggaactgagaagaacttcacaaatggaatggttaatggtcacatgccatctcttcctgacagcccctttacaggttacatcattgcagtccaccgaaaaatgatgaggacagaactgtatttcctgtcatctcagaagaatcgccccagcctctttggaatgccattgattgttccatgtactgtgcatacccggaagaaagacctatatgatgcggtttggattcaagtatcccggttagcgagcccactcccacctcaggaagctagtaatcatgcccaggattgtgacgacagtatgggctatcaatatccattcactctacgagttgtgcagaaagatgggaactcctgtgcttggtgcccatggtatagattttgcagaggctgtaaaattgattgtggggaagacagagctttcattggaaatgcctatatcgctgtggattgggatcccacagcccttcaccttcgctatcaaacatcccaggaaagggttgtagatgagcatgagagtgtggagcagagtcggcgagcgcaagccgagcccatcaacctggacagctgtctccgtgctttcaccagtgaggaagagctaggggaaaatgagatgtactactgttccaagtgtaagacccactgcttagcaacaaagaagctggatctctggaggcttccacccatcctgattattcaccttaagcgatttcaatttgtaaatggtcggtggataaaatcacagaaaattgtcaaatttcctcgggaaagttttgatccaagtgcttttttggtaccaagagacccggctctctgcgcatccactttcttcacctcccttgccagaatcctgggctcagagagctcatccccctggggtgtgag

SEQ ID NO: 449280 - DNA, 3168 bp, Homo sapiens
ggagcggggtaagagggcgtgaggagggaaggagagggaggagagagaggagagagaagggcggagtaggaggcaggggaagggggcggggcggaagagtcacgtgatccggcatggaggcggtggcggcgaccgggaggagccgccggggcagaagccgcacttgttagtgtggggggaggtgggggcgggggacgccgacaccgtcaccgtcacccagggacgccgaggagaaggcgggaggggggtgggggcgagatcaggctccgaccccccgccgaggggatgaggggagcatgggtgccaaggagtcacggatcggattcctcagctacgaggaggcgctgaggagagttacagatgtagagctaaaacgactgaaggatgctttcaagaggacctgtggactctcatattacatgggccagcactgcttcatccgggaagtgcttggggatggagtgcctccaaaggttgctgaggtgtgtcacatagttctggggttaagaccagctactccggaagaagaaggacaaattattagaggatggttagaacgagagagcaggtatggtctgcaagcaggacacaactggtttatcatctccatgcagtggtggcaacagtggaaagaatatgtcaaatacgatgccaaccctgtggtaattgagccatcatctgttttgaatggaggaaaatactcatttggaactgcagcccatcctatggagcaggtcgaagatagaattggaagcagcctcagttacgtgaatactacagaagagaaattttcagacaacatttctactgcatctgaagcctcagaaactgctggcagcggctttctgtattctgccacaccaggggcagatgtttgctttgctcgacaacataacacttctgacaataacaaccagtgtttgctgggagccaatgggaatattttgttgcaccttaaccctcagaaaccaggggctattgataatcagccattagtaactcaagaaccagtaaaggctacatcattaacactagaaggaggacgattaaaacgaactccacagctgattcatggaagagactatgaaatggtcccagaacctgtgtggagagcactttatcactggtatggagcaaacctggccttacctagaccagttatcaagaacagcaagacagacatcccagagctggaattatttccccgctatcttctcttcctgagacagcagcctgccactcggacacagcagtctaacatctgggtgaatatgggaaatgtaccttctccgaatgcacctttaaagcgggtattagcctatacaggctgttttagtcgaatgcagaccatcaaggaaattcacgaatatctatctcaaaggctgcgcattaaagaggaagatatgcgcctgtggctatacaacagtgagaactaccttactcttctggatgatgaggatcataaattggaatatttgaaaatccaggatgaacaacacctggtaattgaagttcgcaacaaagatatgagttggcctgaggagatgtcttttatagcaaatagtagtaaaatagatagacacaaggttcccacagaaaagggagccacaggtctaagcaatctgggaaacacatgcttcatgaactcaagcatccagtgtgttagtaacacacagccactgacacagtattttatctcagggagacatctttatgaactcaacaggacaaatcccattggtatgaaggggcatatggctaaatgctatggtgatttagtgcaggaactttggagtggaactcagaagaatgttgccccattaaagcttcggtggaccatagcaaaatatgctcccaggtttaatgggtttcagcaacaggactcccaagaacttctggcttttctcttggatggtcttcatgaagatcttaatcgagtccatgaaaagccatatgtggaactgaaggacagtgatgggcgaccagactgggaagtagctgcagaggcctgggacaaccatctaagaagaaatagatcaattgttgtggatttgttccatgggcagctaagatctcaagtaaaatgcaagacatgtgggcatataagtgtccgatttgaccctttcaattttttgtctttgccactaccaatggacagttatatgcacttagaaataacagtgattaagttagatggtactacccctgtacggtatggactaagactgaatatggatgaaaagtacacaggtttaaaaaaacagctgagtgatctctgtggacttaattcagaacaaatccttctagcagaagtacatggttccaacataaagaactttcctcaggacaaccaaaaagtacgactctcagtgagtggatttttgtgtgcatttgaaattcctgtccctgtgtctccaatttcagcttctagtccaacacagacagatttctcctcttcgccatctacaaatgaaatgttcaccctaactaccaatggggacctaccccgaccaatattcatccccaatggaatgccaaacactgttgtgccatgtggaactgagaagaacttcacaaatggaatggttaatggtcacatgccatctcttcctgacagcccctttacaggttacatcattgcagtccaccgaaaaatgatgaggacagaactgtatttcctgtcatctcagaagaatcgccccagcctctttggaatgccattgattgttccatgtactgtgcatacccggaagaaagacctatatgatgcggtttggattcaagtatcccggttagcgagcccactcccacctcaggaagctagtaatcatgcccaggattgtgacgacagtatgggctatcaatatccattcacttctgcctacattcttttctatgagcagcaggggatagactatgcacaatttctgccaaagactgatggcaaaaagatggcagacacaagcagtatggatgaagactttgagtctgattacaaaaagtactgtgtgttacagtaaagctaccactctggctgctagacagcttggcggtgagggagatgactccttgtagctgacatttggcaaaagcgtcactgaaaggcaagctaaatgtagttattttatcctgtggccctgaagcacaaaataaaaattctaattaaaa

SEQ ID NO: 449281 - DNA, 1560 bp, Homo sapiens
  misc_feature (1221)..(1221): n is a, c, g, or t
  misc_feature (1281)..(1281): n is a, c, g, or t
ggagcggggtaagagggcgtgaggagggaaggagagggaggagagagaggagagagaagggcggagtaggaggcaggggaagggggcggggcggaagagtcacgtgatccggcatggaggcggtggcggcgaccgggaggagccgccggggcagaagccgcacttgttagtgtggggggaggtgggggcgggggacgccgacaccgtcaccgtcacccagggacgccgaggagaaggcgggaggggggtgggggcgagatcaggctccgaccccccgccgaggggatgaggggagcatgggtgccaaggagtcacggatcggattcctcagctacgaggaggcgctgaggagagttacagatgtagagctaaaacgactgaaggatgctttcaagaggacctgtggactctcatattacatgggccagcactgcttcatccgggaagtgcttggggatggagtgcctccaaaggttgctgaggtgtgtcacatagttctggggttaagaccagctactccggaagaagaaggacaaattattagaggatggttagaacgagagagcaggtatggtctgcaagcaggacacaactggtttatcatctccatgcagtggtggcaacagtggaaagaatatgtcaaatacgatgccaaccctgtggtaattgagccatcatctgttttgaatggaggaaaatactcatttggaactgcagcccatcctatggagcaggtcgaagatagaattggaagcagcctcagttacgtgaatactacagaagagaaattttcagacaacatttctactgcatctgaagcctcagaaactgctggcagcggctacatcattaacactagaaggaggacgattaaaacgaactccacagctgattcatggaagagactatgaaatggtcccagaacctgtgtggagagcactttatcactggtatggagcaaacctggccttacctagaccagttatcaagaacagcaagacagacatcccagagctggaattatttccccgctatcttctcttcctgagacagcagcctgccactcggacacagcagtctaacatctgggtgaatatgggtatgatgagcctgagaatgtttcctcagcatttaccgagaggtaacttaagaatgcagcaagaataccatgcatttccttaaaaaaaaaaaaaaaaaaaaaaaaatgggtgaaaactacgnttgctcgaagtctggtgccactgtattgatacacattcccatcagctttcctacagactncagtaattaatttttacagggcttagaactatggtcatgcacaagactagatgaggggttgaagcaaacattccaacagcaaactgagatgggatgtttccttttctacttacaaagaaaataaatagaaatagattttacatgctttatttctttgagacaagccattgtaaattgttactagactaagtagtagtataccagtcattgactggtcttttcaactccactcaaatttgtaaaaagcaattcctcttatactatcatcttttttgtttt

SEQ ID NO: 449282 - DNA, 1360 bp, Homo sapiens
ggagcggggtaagagggcgtgaggagggaaggagagggaggagagagaggagagagaagggcggagtaggaggcaggggaagggggcggggcggaagagtcacgtgatccggcatggaggcggtggcggcgaccgggaggagccgccggggcagaagccgcacttgttagtgtggggggaggtgggggcgggggacgccgacaccgtcaccgtcacccagggacgccgaggagaaggcgggaggggggtgggggcgagatcaggctccgaccccccgccgaggggatgaggggagcatgggtgccaaggagtcacggatcggattcctcagctacgaggaggcgctgaggagagttacagatgtagagctaaaacgactgaaggatgctttcaagaggacctgtggactctcatattacatgggccagcactgcttcatccgggaagtgcttggggatggagtgcctccaaaggttgctgaggtgtgtcacatagttctggggttaagaccagctactccggaagaagaaggacaaattattagaggatggttagaacgagagagcaggtatggtctgcaagcaggacacaactggtttatcatctccatgcagtggtggcaacagtggaaagaatatgtcaaatacgtgagttagattcctgtctatttacatttttcacaggattttcagctgcgtgagacttccagccaataataaaatgctatgactaccagccaataataaaatgctccaacttaaataaagattcgaagggaaaggaaatgagtgtttatatgatacttgctatggtctaggctttgtgattacacttccacatacatttctttccttgcaacaaccctaaaaaaagataatattgggtacgggggtacctgcatatgtcacatacatcacatctcatttatttctcgcaccacccttgtgaggaagataatattatacccattttacctgtggggaacctggtgctgaaagaaaaagtaacctgaatgtcatgatcagggtggaagatctgggatcaaaccgaaggactgactttaaagcttatattctctcaactacatcatttacattgtcctttattttaccttttccattaaaatggaatttttttcagaactagaaaattgaaaagagtaatgccaagaatcaagtatttgccttcttggagagccaactgatatatacactcattgccaaatgatcactaacgaaaattctaatcatttgattcctatttgcctgtatttcctctgtcactgcttattatcagaatattggtagttacatactttttacattatctatctcatcattctttctcatcctttttccat

SEQ ID NO: 449283 - DNA, 630 bp, Homo sapiens
ggagcggggtaagagggcgtgaggagggaaggagagggaggagagagaggagagagaagggcggagtaggaggcaggggaagggggcggggcggaagagtcacgtgatccggcatggaggcggtggcggcgaccgggaggagccgccggggcagaagccgcacttgttagtgtggggggaggtgggggcgggggacgccgacaccgtcaccgtcacccagggacgccgaggagaaggcgggaggggggtgggggcgagatcaggctccgaccccccgccgaggggatgaggggagcatgggtgccaaggagtcacggatcggattcctcagctacgaggaggcgctgaggagagttacagatgtagagctaaaacgactgaaggatgctttcaagaggacctgtggactctcatattacatgggccagcactgcttcatccgggaagtgcttggggatggagtgcctccaaaggttgctgaggtgatttactgttcttttggtggaacatccaaagggctgcacttcaataatttaatagttggacttgtcctccttacaagaggcaaagatgaagagaaagcaaaatacatttttagtcttttttcaagtgaatctgggaactatgtta

SEQ ID NO: 449284 - DNA, 289 bp, Homo sapiens
ttttggattttgagagaaaattctcatcttttttattgctaggcctgggacaaccatctaagaagaaatagatcaattgttgtggatttgttccatgggcagctaagatctcaagtaaaatgcaagacatgtgggcatataagtgtccgatttgaccctttcaattttttgtctttgccactaccaatggacagttatatgcacttagaaataacaggtaggtcagaaagttctgaaaaattacttgactccattaaatttactttatttaaatagcctgaatttgtaa

SEQ ID NO: 449285 - DNA, 313 bp, Homo sapiens
tcagtgagccaagatcgtgccattgcactccagcccaggcaacagtatgagactccgtctcaaaaaaaaaaaaaaaaagaaaaaaaagatgttcctaacatgagtgtctctgtttcagatgggtcatcttactctggaagactatcagatctggagtgtgaaaaatgttcttgccaatgagtttttgaacctccttttccaggtatgtttaaggtaaatgacagcaacagagggtagtagtaccagtacttctacatcttttccatcatatagtagccagagttgttgtatctaggctgcaaaaccatatatt

SEQ ID NO: 449286 - DNA, 416 bp, Homo sapiens
acaaggagttataatcttaggaaatgggtttcggagcaggaattttaacagtaatcagatccatgtaacttaaatgtgtgagtttcagtaattactgaaatgtagctagtgaacttgttggacattttggtttagaaataaatctcagaagttagattaaaatggcaagttttgtttctttttttagtgatctctttttatcttttaaaacaataggttatcaagaacagcaagacagacatcccagagctggaattatttccccgctatcttctcttcctgagacagcagcctgccactcggacacagcagtctaacatctgggtgaatatgggtatgatgagcctgagaatgtttcctcagcatttaccgagaggtaacttaagaatgcagcaagaataccatgcatttcctta

SEQ ID NO: 449287 - DNA, 4082 bp, Homo sapiens
attgatgttcctttcctcacagcaacagataccacactacagtgggacaatttagacactcctgttaacctaacgtatgggtcatcttactctggaagactatcagatctggagtgtgaaaaatgttcttgccaatgagtttttgaacctccttttccaggtgtgtcacatagttctggggttaagaccagctactccggaagaagaaggacaaattattagaggatggttagaacgagagagcaggtatggtctgcaagcaggacacaactggtttatcatctccatgcagtggtggcaacagtggaaagaatatgtcaaatacgatgccaaccctgtggtaattgagccatcatctgttttgaatggaggaaaatactcatttggaactgcagcccatcctatggagcaggtcgaagatagaattggaagcagcctcagttacgtgaatactacagaagagaaattttcagacaacatttctactgcatctgaagcctcagaaactgctggcagcggctttctgtattctgccacaccaggggcagatgtttgctttgctcgacaacataacacttctgacaataacaaccagtgtttgctgggagccaatgggaatattttgttgcaccttaaccctcagaaaccaggggctattgataatcagccattagtaactcaagaaccagtaaaggctacatcattaacactagaaggaggacgattaaaacgaactccacagctgattcatggaagagactatgaaatggtcccagaacctgtgtggagagcactttatcactggtatggagcaaacctggccttacctagaccagttatcaagaacagcaagacagacatcccagagctggaattatttccccgctatcttctcttcctgagacagcagcctgccactcggacacagcagtctaacatctgggtgaatatgggaaatgtaccttctccgaatgcacctttaaagcgggtattagcctatacaggctgttttagtcgaatgcagaccatcaaggaaattcacgaatatctatctcaaaggctgcgcattaaagaggaagatatgcgcctgtggctatacaacagtgagaactaccttactcttctggatgatgaggatcataaattggaatatttgaaaatccaggatgaacaacacctggtaattgaagttcgcaacaaagatatgagttggcctgaggagatgtcttttatagcaaatagtagtaaaatagatagacacaaggttcccacagaaaagggagccacaggtctaagcaatctgggaaacacatgcttcatgaactcaagcatccagtgtgttagtaacacacagccactgacacagtattttatctcagggagacatctttatgaactcaacaggacaaatcccattggtatgaaggggcatatggctaaatgctatggtgatttagtgcaggaactttggagtggaactcagaagaatgttgccccattaaagcttcggtggaccatagcaaaatatgctcccaggtttaatgggtttcagcaacaggactcccaagaacttctggcttttctcttggatggtcttcatgaagatcttaatcgagtccatgaaaagccatatgtggaactgaaggacagtgatgggcgaccagactgggaagtagctgcagaggcctgggacaaccatctaagaagaaatagatcaattgttgtggatttgttccatgggcagctaagatctcaagtaaaatgcaagacatgtgggcatataagtgtccgatttgaccctttcaattttttgtctttgccactaccaatggacagttatatgcacttagaaataacagtgattaagttagatggtactacccctgtacggtatggactaagactgaatatggatgaaaagtacacaggtttaaaaaaacagctgagtgatctctgtggacttaattcagaacaaatccttctagcagaagtacatggttccaacataaagaactttcctcaggacaaccaaaaagtacgactctcagtgagtggatttttgtgtgcatttgaaattcctgtccctgtgtctccaatttcagcttctagtccaacacagacagatttctcctcttcgccatctacaaatgaaatgttcaccctaactaccaatggggacctaccccgaccaatattcatccccaatggaatgccaaacactgttgtgccatgtggaactgagaagaacttcacaaatggaatggttaatggtcacatgccatctcttcctgacagcccctttacaggttacatcattgcagtccaccgaaaaatgatgaggacagaactgtatttcctgtcatctcagaagaatcgccccagcctctttggaatgccattgattgttccatgtactgtgcatacccggaagaaagacctatatgatgcggtttggattcaagtatcccggttagcgagcccactcccacctcaggaagctagtaatcatgcccaggattgtgacgacagtatgggctatcaatatccattcactctacgagttgtgcagaaagatgggaactcctgtgcttggtgcccatggtatagattttgcagaggctgtaaaattgattgtggggaagacagagctttcattggaaatgcctatatcgctgtggattgggatcccacagcccttcaccttcgctatcaaacatcccaggaaagggttgtagatgagcatgagagtgtggagcagagtcggcgagcgcaagccgagcccatcaacctggacagctgtctccgtgctttcaccagtgaggaagagctaggggaaaatgagatgtactactgttccaagtgtaagacccactgcttagcaacaaagaagctggatctctggaggcttccacccatcctgattattcaccttaagcgatttcaatttgtaaatggtcggtggataaaatcacagaaaattgtcaaatttcctcgggaaagttttgatccaagtgcttttttggtaccaagagacccggctctctgccagcataaaccactcacaccccagggggatgagctctctgagcccaggattctggcaagggaggtgaagaaagtggatgcgcagagttcggctggggaagaggacgtgctcctgagcaaaagcccatcctcactcagcgctaacatcatcagcagcccgaaaggttctccttcttcatcaagaaaaagtggaaccagctgtccctccagcaaaaacagcagccctaatagcagcccacggactttggggaggagcaaagggaggctccggctgccccagattggcagcaaaaataaactgtcaagtagtaaagagaacttggatgccagcaaagaaaatggggctgggcagatatgtgagctggctgacgccttgagtcgagggcatgtgctggggggcagccaaccagagttggtcactcctcaggaccatgaggtagctttggccaatggattcctttatgagcatgaagcatgtggcaatggctacagcaatggtcagcttggaaaccacagtgaagaagacagcactgatgaccaaagagaagatactcgtattaagcctatttataatctatatgcaatttcgtgccattcaggaattctgggtgggggccattacgtcacttatgccaaaaacccaaactgcaagtggtactgttacaatgacagcagctgtaaggaacttcacccggatgaaattgacaccgactctgcctacattcttttctatgagcagcaggggatagactatgcacaatttctgccaaagactgatggcaaaaagatggcagacacaagcagtatggatgaagactttgagtctgattacaaaaagtactgtgtgttacagtaaagctaccactctggctgctagacagcttggcggtgagggagatgactccttgtagctgacatttggcaaaagcgtcactgaaaggcaagctaaatgtagttattttatcctgtggccctgaagcacaaaataaaaattctaattaaaatagttaactttaagagtagtaatcattttattt

SEQ ID NO: 449288 - DNA, 4112 bp, Homo sapiens
tggttaatcatcttctgtgcatattttcgtattgtaaagatcatgtatttctttcaaaagaacttgtggacattgagttcatagatacaataggatctagcccccattactcttttgttggagttcttgttttagttttcttttaatttagtgacttcatatcaccattatctaccaagaacatttggaatatttttctagtttgaggaaaataattaaaggatgctatgtagaagcccagccacttagcccagctcttcccttccagtcggaggacatataattctcattatgaattattagatattctaggagggtggccaaatgttcatttggtaataattttaaaagctcttatttttagtaccatgccatgtattgttcagagaaggataacatttcctgtcttctacagaattaccagaatcttaatctgtactgacatgtcaacagagtaatacaatacatgggcattgagttcatatcctcaagcctgtttatgtataataactaaaaataagagattctatcctcttttttttttataggctttctgtattctgccacaccaggggcagatgtttgctttgctcgacaacataacacttctgacaataacaaccagtgtttgctgggagccaatgggaatattttgttgcaccttaaccctcagaaaccaggggctattgataatcagccattagtaactcaagaaccagtaaaggctacatcattaacactagaaggaggacgattaaaacgaactccacagctgattcatggaagagactatgaaatggtcccagaacctgtgtggagagcactttatcactggtatggagcaaacctggccttacctagaccagttatcaagaacagcaagacagacatcccagagctggaattatttccccgctatcttctcttcctgagacagcagcctgccactcggacacagcagtctaacatctgggtgaatatgggaaatgtaccttctccgaatgcacctttaaagcgggtattagcctatacaggctgttttagtcgaatgcagaccatcaaggaaattcacgaatatctatctcaaaggctgcgcattaaagaggaagatatgcgcctgtggctatacaacagtgagaactaccttactcttctggatgatgaggatcataaattggaatatttgaaaatccaggatgaacaacacctggtaattgaagttcgcaacaaagatatgagttggcctgaggagatgtcttttatagcaaatagtagtaaaatagatagacacaaggttcccacagaaaagggagccacaggtctaagcaatctgggaaacacatgcttcatgaactcaagcatccagtgtgttagtaacacacagccactgacacagtattttatctcagggagacatctttatgaactcaacaggacaaatcccattggtatgaaggggcatatggctaaatgctatggtgatttagtgcaggaactttggagtggaactcagaagaatgttgccccattaaagcttcggtggaccatagcaaaatatgctcccaggtttaatgggtttcagcaacaggactcccaagaacttctggcttttctcttggatggtcttcatgaagatcttaatcgagtccatgaaaagccatatgtggaactgaaggacagtgatgggcgaccagactgggaagtagctgcagaggcctgggacaaccatctaagaagaaatagatcaattgttgtggatttgttccatgggcagctaagatctcaagtaaaatgcaagacatgtgggcatataagtgtccgatttgaccctttcaattttttgtctttgccactaccaatggacagttatatgcacttagaaataacagtgattaagttagatggtactacccctgtacggtatggactaagactgaatatggatgaaaagtacacaggtttaaaaaaacagctgagtgatctctgtggacttaattcagaacaaatccttctagcagaagtacatggttccaacataaagaactttcctcaggacaaccaaaaagtacgactctcagtgagtggatttttgtgtgcatttgaaattcctgtccctgtgtctccaatttcagcttctagtccaacacagacagatttctcctcttcgccatctacaaatgaaatgttcaccctaactaccaatggggacctaccccgaccaatattcatccccaatggaatgccaaacactgttgtgccatgtggaactgagaagaacttcacaaatggaatggttaatggtcacatgccatctcttcctgacagcccctttacaggttacatcattgcagtccaccgaaaaatgatgaggacagaactgtatttcctgtcatctcagaagaatcgccccagcctctttggaatgccattgattgttccatgtactgtgcatacccggaagaaagacctatatgatgcggtttggattcaagtatcccggttagcgagcccactcccacctcaggaagctagtaatcatgcccaggattgtgacgacagtatgggctatcaatatccattcactctacgagttgtgcagaaagatgggaactcctgtgcttggtgcccatggtatagattttgcagaggctgtaaaattgattgtggggaagacagagctttcattggaaatgcctatatcgctgtggattgggatcccacagcccttcaccttcgctatcaaacatcccaggaaagggttgtagatgagcatgagagtgtggagcagagtcggcgagcgcaagccgagcccatcaacctggacagctgtctccgtgctttcaccagtgaggaagagctaggggaaaatgagatgtactactgttccaagtgtaagacccactgcttagcaacaaagaagctggatctctggaggcttccacccatcctgattattcaccttaagcgatttcaatttgtaaatggtcggtggataaaatcacagaaaattgtcaaatttcctcgggaaagttttgatccaagtgcttttttggtaccaagagacccggctctctgccagcataaaccactcacaccccagggggatgagctctctgagcccaggattctggcaagggaggtgaagaaagtggatgcgcagagttcggctggggaagaggacgtgctcctgagcaaaagcccatcctcactcagcgctaacatcatcagcagcccgaaaggttctccttcttcatcaagaaaaagtggaaccagctgtccctccagcaaaaacagcagccctaatagcagcccacggactttggggaggagcaaagggaggctccggctgccccagattggcagcaaaaataaactgtcaagtagtaaagagaacttggatgccagcaaagaaaatggggctgggcagatatgtgagctggctgacgccttgagtcgagggcatgtgctggggggcagccaaccagagttggtcactcctcaggaccatgaggtagctttggccaatggattcctttatgagcatgaagcatgtggcaatggctacagcaatggtcagcttggaaaccacagtgaagaagacagcactgatgaccaaagagaagatactcgtattaagcctatttataatctatatgcaatttcgtgccattcaggaattctgggtgggggccattacgtcacttatgccaaaaacccaaactgcaagtggtactgttacaatgacagcagctgtaaggaacttcacccggatgaaattgacaccgactctgcctacattcttttctatgagcagcaggggatagactatgcacaatttctgccaaagactgatggcaaaaagatggcagacacaagcagtatggatgaagactttgagtctgattacaaaaagtactgtgtgttacagtaaagctaccactctggctgctagacagcttggcggtgagggagatgactccttgtagctgacatttggcaaaagcgtcactgaaaggcaagctaaatgtagttattttatcctgtggccctgaagcacaaaataaaaattctaattaaaatagttaactttaagagtagtaatcattttattt

SEQ ID NO: 449289 - DNA, 810 bp, Homo sapiens
ttagtagaggtccacggatctgggatgaacacaggcgcgcgtaatgccacaggtagggagacaaaaataaactgtcaagtagtaaagagaacttggatgccagcaaagaaaatggggctgggcagatatgtgagctggctgacgccttgagtcgagggcatgtgctggggggcagccaaccagagttggtcactcctcaggaccatgaggtagctttggccaatggattcctttatgagcatgaagcatgtggcaatggctacagcaatggtcagcttggaaaccacagtgaagaagacagcactgatgaccaaagagaagatactcgtattaagcctatttataatctatatgcaatttcgtgccattcaggaattctgggtgggggccattacgtcacttatgccaaaaacccaaactgcaagtggtactgttacaatgacagcagctgtaaggaacttcacccggatgaaattgacaccgactctgcctacattcttttctatgagcagcaggggatagactatgcacaatttctgccaaagactgatggcaaaaagatggcagacacaagcagtatggatgaagactttgagtctgattacaaaaagtactgtgtgttacagtaaagctaccactctggctgctagacagcttggcggtgagggagatgactccttgtagctgacatttggcaaaagcgtcactgaaaggcaagctaaatgtagttattttatcctgtggccctgaagcacaaaataaaaattctaattaaaatagttaactttaagagtagtaatcattttattt

SEQ ID NO: 449290 - DNA, 3336 bp, Homo sapiens
ggagcggggtaagagggcgtgaggagggaaggagagggaggagagagaggagagagaagggcggagtaggaggcaggggaagggggcggggcggaagagtcacgtgatccggcatggaggcggtggcggcgaccgggaggagccgccggggcagaagccgcacttgttagtgtggggggaggtgggggcgggggacgccgacaccgtcaccgtcacccagggacgccgaggagaaggcgggaggggggtgggggcgagatcaggctccgaccccccgccgaggggatgaggggagcatgggtgccaaggagtcacggatcggattcctcagctacgaggaggcgctgaggagagttacagatgtagagctaaaacgactgaaggatgctttcaagaggacctgtggactctcatattacatgggccagcactgcttcatccgggaagtgcttggggatggagtgcctccaaaggttgctgaggtgtgtcacatagttctggggttaagaccagctactccggaagaagaaggacaaattattagaggatggttagaacgagagagcaggtatggtctgcaagcaggacacaactggtttatcatctccatgcagtggtggcaacagtggaaagaatatgtcaaatacgatgccaaccctgtggtaattgagccatcatctgttttgaatggaggaaaatactcatttggaactgcagcccatcctatggagcaggtcgaagatagaattggaagcagcctcagttacgtgaatactacagaagagaaattttcagacaacatttctactgcatctgaagcctcagaaactgctggcagcggctttctgtattctgccacaccaggggcagatgtttgctttgctcgacaacataacacttctgacaataacaaccagtgtttgctgggagccaatgggaatattttgttgcaccttaaccctcagaaaccaggggctattgataatcagccattagtaactcaagaaccagtaaaggctacatcattaacactagaaggaggacgattaaaacgaactccacagctgattcatggaagagactatgaaatggtcccagaacctgtgtggagagcactttatcactggtatggagcaaacctggccttacctagaccagttatcaagaacagcaagacagacatcccagagctggaattatttccccgctatcttctcttcctgagacagcagcctgccactcggacacagcagtctaacatctgggtgaatatgggaaatgtaccttctccgaatgcacctttaaagcgggtattagcctatacaggctgttttagtcgaatgcagaccatcaaggaaattcacgaatatctatctcaaaggctgcgcattaaagaggaagatatgcgcctgtggctatacaacagtgagaactaccttactcttctggatgatgaggatcataaattggaatatttgaaaatccaggatgaacaacacctggtaattgaagttcgcaacaaagatatgagttggcctgaggagatgtcttttatagcaaatagtagtaaaatagatagacacaaggttcccacagaaaagggagccacaggtctaagcaatctgggaaacacatgcttcatgaactcaagcatccagtgtgttagtaacacacagccactgacacagtattttatctcagggagacatctttatgaactcaacaggacaaatcccattggtatgaaggggcatatggctaaatgctatggtgatttagtgcaggaactttggagtggaactcagaagaatgttgccccattaaagcttcggtggaccatagcaaaatatgctcccaggtttaatgggtttcagcaacaggactcccaagaacttctggcttttctcttggatggtcttcatgaagatcttaatcgagtccatgaaaagccatatgtggaactgaaggacagtgatgggcgaccagactgggaagtagctgcagaggcctgggacaaccatctaagaagaaatagatcaattgttgtggatttgttccatgggcagctaagatctcaagtaaaatgcaagacatgtgggcatataagtgtccgatttgaccctttcaattttttgtctttgccactaccaatggacagttatatgcacttagaaataacagtgattaagttagatggtactacccctgtacggtatggactaagactgaatatggatgaaaagtacacaggtttaaaaaaacagctgagtgatctctgtggacttaattcagaacaaatccttctagcagaagtacatggttccaacataaagaactttcctcaggacaaccaaaaagtacgactctcagtgagtggatttttgtgtgcatttgaaattcctgtccctgtgtctccaatttcagcttctagtccaacacagacagatttctcctcttcgccatctacaaatgaaatgttcaccctaactaccaatggggacctaccccgaccaatattcatccccaatggaatgccaaacactgttgtgccatgtggaactgagaagaacttcacaaatggaatggttaatggtcacatgccatctcttcctgacagcccctttacaggttacatcattgcagtccaccgaaaaatgatgaggacagaactgtatttcctgtcatctcagaagaatcgccccagcctctttggaatgccattgattgttccatgtactgtgcatacccggaagaaagacctatatgatgcggtttggattcaagtatcccggttagcgagcccactcccacctcaggaagctagtaatcatgcccaggattgtgacgacagtatgggctatcaatatccattcactctacgagttgtgcagaaagatgggaactcctgtgcttggtgcccatggtatagattttgcagaggctgtaaaattgattgtggggaagacagagctttcattggaaatgcctatatcgctgtggattgggatcccacagcccttcaccttcgctatcaaacatcccaggaaagggttgtagatgagcatgagagtgtggagcagagtcggcgagcgcaagccgagcccatcaacctggacagctgtctccgtgctttcaccagtgaggaagagctaggggaaaatgagatgtactactgttccaagtgtaagacccactgcttagcaacaaagaagctggatctctggaggcttccacccatcctgattattcaccttaagcgatttcaatttgtaaatggtcggtggataaaactttcccgaggcaatttgacaattttctgtgattttatcgtcgacc

SEQ ID NO: 449291 - DNA, 3132 bp, Homo sapiens
ggagcggggtaagagggcgtgaggagggaaggagagggaggagagagaggagagagaagggcggagtaggaggcaggggaagggggcggggcggaagagtcacgtgatccggcatggaggcggtggcggcgaccgggaggagccgccggggcagaagccgcacttgttagtgtggggggaggtgggggcgggggacgccgacaccgtcaccgtcacccagggacgccgaggagaaggcgggaggggggtgggggcgagatcaggctccgaccccccgccgaggggatgaggggagcatgggtgccaaggagtcacggatcggattcctcagctacgaggaggcgctgaggagagttacagatgtagagctaaaacgactgaaggatgctttcaagaggacctgtggactctcatattacatgggccagcactgcttcatccgggaagtgcttggggatggagtgcctccaaaggttgctgaggtgtgtcacatagttctggggttaagaccagctactccggaagaagaaggacaaattattagaggatggttagaacgagagagcaggtatggtctgcaagcaggacacaactggtttatcatctccatgcagtggtggcaacagtggaaagaatatgtcaaatacgatgccaaccctgtggtaattgagccatcatctgttttgaatggaggaaaatactcatttggaactgcagcccatcctatggagcaggtcgaagatagaattggaagcagcctcagttacgtgaatactacagaagagaaattttcagacaacatttctactgcatctgaagcctcagaaactgctggcagcggctttctgtattctgccacaccaggggcagatgtttgctttgctcgacaacataacacttctgacaataacaaccagtgtttgctgggagccaatgggaatattttgttgcaccttaaccctcagaaaccaggggctattgataatcagccattagtaactcaagaaccagtaaaggctacatcattaacactagaaggaggacgattaaaacgaactccacagctgattcatggaagagactatgaaatggtcccagaacctgtgtggagagcactttatcactggtatggagcaaacctggccttacctagaccagttatcaagaacagcaagacagacatcccagagctggaattatttccccgctatcttctcttcctgagacagcagcctgccactcggacacagcagtctaacatctgggtgaatatgggaaatgtaccttctccgaatgcacctttaaagcgggtattagcctatacaggctgttttagtcgaatgcagaccatcaaggaaattcacgaatatctatctcaaaggctgcgcattaaagaggaagatatgcgcctgtggctatacaacagtgagaactaccttactcttctggatgatgaggatcataaattggaatatttgaaaatccaggatgaacaacacctggtaattgaagttcgcaacaaagatatgagttggcctgaggagatgtcttttatagcaaatagtagtaaaatagatagacacaaggttcccacagaaaagggagccacaggtctaagcaatctgggaaacacatgcttcatgaactcaagcatccagtgtgttagtaacacacagccactgacacagtattttatctcagggagacatctttatgaactcaacaggacaaatcccattggtatgaaggggcatatggctaaatgctatggtgatttagtgcaggaactttggagtggaactcagaagaatgttgccccattaaagcttcggtggaccatagcaaaatatgctcccaggtttaatgggtttcagcaacaggactcccaagaacttctggcttttctcttggatggtcttcatgaagatcttaatcgagtccatgaaaagccatatgtggaactgaaggacagtgatgggcgaccagactgggaagtagctgcagaggcctgggacaaccatctaagaagaaatagatcaattgttgtggatttgttccatgggcagctaagatctcaagtaaaatgcaagacatgtgggcatataagtgtccgatttgaccctttcaattttttgtctttgccactaccaatggacagttatatgcacttagaaataacagtgattaagttagatggtactacccctgtacggtatggactaagactgaatatggatgaaaagtacacaggtttaaaaaaacagctgagtgatctctgtggacttaattcagaacaaatccttctagcagaagtacatggttccaacataaagaactttcctcaggacaaccaaaaagtacgactctcagtgagtggatttttgtgtgcatttgaaattcctgtccctgtgtctccaatttcagcttctagtccaacacagacagatttctcctcttcgccatctacaaatgaaatgttcaccctaactaccaatggggacctaccccgaccaatattcatccccaatggaatgccaaacactgttgtgccatgtggaactgagaagaacttcacaaatggaatggttaatggtcacatgccatctcttcctgacagcccctttacaggttacatcattgcagtccaccgaaaaatggttagttaaatgttaggcaactcactgccagtcttgctagtgtcatttgtgaaatagtcattttctgtctttgcaacatcattgaatgcattttcttctcttcttttctttaattttttaaaatttaataattttacaaattttatttttttacttttttatcctgtcctcaaaatctgttgctgtgaatgcattttcaatgtattatatatgctaatataagtgatcagagccaggatttagtattactcatggtggctaatgtatgaaatgacattccttatccgtatattaagaggcaacaggatagtcagtgcatctgagtactactttctttagaaatttgtgtctcctggccgggtgcagtggctcacacctgtaatcccaacactttgggaggctgaagcaggaggatcaccttagctcaggagttcaaggctagcctgggcaacatagtgagacctcgtctcttcta

SEQ ID NO: 449292 - DNA, 741 bp, Homo sapiens
ggagcggggtaagagggcgtgaggagggaaggagagggaggagagagaggagagagaagggcggagtaggaggcaggggaagggggcggggcggaagagtcacgtgatccggcatggaggcggtggcggcgaccgggaggagccgccggggcagaagccgcacttgttagtgtggggggaggtgggggcgggggacgccgacaccgtcaccgtcacccagggacgccgaggagaaggcgggaggggggtgggggcgagatcaggctccgaccccccgccgaggggatgaggggagcatgggtgccaaggagtcacggatcggattcctcagctacgaggaggcgctgaggagagttacagatgtagagctaaaacgactgaaggatgctttcaagaggacctgtggactctcatattacatgggccagcactgcttcatccgggaagtgcttggggatggagtgcctccaaaggttgctgaggtgatttactgttcttttggtggaacatccaaagggctgcacttcaataatttaatagttggacttgtcctccttacaagaggcaaagatgaagagaaagcaaaatgtaagtacttttattatctcaaaaataattcgtctatgtacagaataatttatctcaaaattctgatgacaggtagaggatttgaattgacattttcccaaagaagatatacaagtggtaaataaacacctaaaaaatgtgcaacataattag

SEQ ID NO: 449293 - DNA, 3917 bp, Homo sapiens
gatgacaggttcttggagacccagctgtgtgctgtgttgatgggcaaacatgaggtgggccccaggggaaaggagctgttctggactctgtgaatgctgctgctcccaagggcggtgcccaggtgagatgcctgcgggggaagcagcaggagctaccacctccacccagccactgcattctggagcagcgcttcccaaacttcagtgtgtgcaccgatcacctagggccttttttttttttttcctttttgtggagaacgggtctcgctagattgcccaggcaggtctcaaactcctgggctcaagccatcctcctgcctctgcctccctaagagttgggattaccggcttgagccactgtgcctggcttgtttgttttgtattaattacatttttatagagagagatggggtcttactttgttgcccgggctggttgcaaactcctgggcctcaagggaacctcccatttcagcctcccaaagtgccggaattgcaggcgtgagccactgcctggcttgttttttttgttttttgtttttttttttctgagacggagtcttgctctgtcgcccaggctggagtgcagtggtgcgatcgtggctcactgcaagctcggcctcccgggttcgctccattctcctgcctcagcctcccaagtagctgggactataggcacctgccataacacccggataattttttgtattttagtagagacggggtttcaccgtgttagccaggatggtgtcgatctcctgaccttgtgatctgcccacctcggcctcctgagtaccttgttaaacacccaagtctaggccccatcctagacctacagaatcagaattcctagtgttaggctgggtgcagtggctcgcacctgtggtctcagcactttgggaggctcaagtgggaggatcatttgagcccaggagttcgagaccagcctgggcaacatagtgaaaccctctctacaaaaaatttaaaacttagctgggtggtgcatgcctgtggtcccagctccttgggatgctgaggtgggaggatcgcctgagcctgggaggttgcggctacagtgagctgtgatcatgctactgcactccagcctgggcgagagcaagatctcttctcttaaataaatttaaaaaaagaatccctgggccaggtgtggtggctcatgcctgtaatcacttttgggagcccaaggtaggtggatcacctgagatcaggagttcaagaccagcttggccaacacggtgaaacccccatctctaaaaatataaaaaaaattagctggacatggtggcctgcagtgcaatcccagctactctggaggctgaggcagggagaatcgcttaaacccgggagctggaggttgtagtgagccgagatcacgccattgcactccatcctgggcgacagagtgagactctgtctcaaaaaaaaaaaaaaaaggaatccgtggtgtagtccgagcgcggtggctcacgcctgtaatcccagcattttgggaagctgaggcaggcagatcccttgaggtcaggagttcgagaccagcctggccaacatggcgaaaccccatctctactaaaaatacaaaaattagccaggtgtggtggcacatgcctgtaattccagttactcaggaggctgaggcaggagaattgcttgaacccaggaggcggaagtagtggtgagctgagatcataccactgcactccagcctgggtgacagagggagactctgttgcaaaaaaaaaaaagaatccctgatgatagaacctgagaatctgtagttaagaggctccccgggtggtcatgcaaaccagtgtgtgggaagcagtgttgagagtgcctcagagaagctcgttccatgaaaattgtgtgcagaccccagggccccattttcagaggattatgcagcttgacctgcaggaagccactgctgatgcctgttgagtggctgcctggggatgggcactgcccgatgacgggcaggaggaccactacctacacctggctgtcctacagtagttttcaggtgtctgtgcctggcaccagccaccagcagtatccctgcgtctggccctggtcctctaggagcggaaggggagaagggcactgccgtgggagagagacctgccatttagattacatttggctttgagggttgaatggtgtgtttgcaaagccaggaatgatcatgagctctgtctgctcccataggcccatcaaatggctccagacatgttctactgcatgaagctcctggaggagactggcatctgtgtcgtgcccggcagtggctttgggcagagggaaggcacttaccacttcaggtatgacttcctctccgcactaggggctggtccgggtcttgtccagggaaatgtggacttcttgacatggagcagaggactacttcaaagagagaggtgcggagaccctgtcctctctcgagtcacccctactctgtcctgctgcagacccaagctcagaccctgcccagggattaagaaaatctgggtggttgtctgctcagggttatattccctgaaaggtcttccttgactattctgtctctcccctctgccatcggtcccatcgctgtctgaaatgttcctaatagggtgttttcttattttgctgtccgttttcaactctgcgatggcagcacacagctgccagtgcctggagtggtgctggcatgtgcttagtagctcctggcagcaccctgggccatggcactgcctgtgatcccagagcctgccgaggaactgcaggggaatttgctccactcatgcccagggcataccccgttctggccctgcatggatgggaatgccggtgcccagagctgagctggctggagcagaggttttccactgaggccagttctcttcagaacaacatcttccccatacatgttgctctcagaggtctcctgcggcagatgctaaaaaaaagaaatggcatgagctgttagcacccggagccaagtcttgacttaggcaaggttgtgggttgtgtcccctgatggacaaaccttgtccggttggccttcccacccctggtcaggctcatctcggtggttgatggcttgatgagaaagtgatttaagcaagagggctgccaggaaggccagggagcattttggtgcaccagagggaggtgttagttactgtggcaacttggaaattcctttggagcagagttgtgactggagggtgtctcactgtcagactgactagagataaaaaaggcccctcaggtaggagtgaaatctctctctcaaactctaggaaagcccgagtcatactctagagaaagttctgatcagtggtcaaaatgttccagagggctgagtgcagtggctcacacgctttgggaggccaaattcaggatggcttgagtccaggagttcaagaccagcctgggcaacatagcaagaccctgtctctacaaaaaattgtttaaaaactagccagggatgttggcgcatgcccgtaatcctagctactcgggaggctgagatgggaggatcacctgagcccaagagtttgaggctgcagtgagctatgatcactctactgcattcaagctggggcagcagagtgagaccctatctccaaaaaaaaaaatatggccaggtgcagtggctcatgcctgtaatcccagcactttgggaggccaaggtgagcagatcatgaggtcaggagttcgagaccagcctggtcaacatggtgaaaccccgtctcttctaaaaatacaaaaattagctgggcgtggtggcaggcatctgtaatcccagctactcgggaggctgaggcaggacaattgtttgaacctgggaggtggaggttgcagtgttcgcgcaattgcactccagcctgggcaacaagagcaaaattccatctc

SEQ ID NO: 449294 - DNA, 3979 bp, Homo sapiens
gcgcggggatgcggctgtgggcgccggggccgggtagctgctccaggcgcgcgagctaaccgagtgcggcgagggcctaccaggggcgacagggtttctctccgcaagcgcgcgatgcagcgggcggcggcgctggtccggcggggctgtggtccccggacccccagctcctggggccgcagccagagcagcgcggccgccgaggcctcggcggtgctcaaggtgcggcccgagcgcagccggcgcgagcgcatcctcacgctggagtccatgaacccgcaggtgaaggcggtggagtacgccgtgcggggacccatcgtgctcaaggccggcgagatcgagctcgagctgcagcggggtatcaaaaagccattcacagaggtcatccgagccaacatcggggacgcccaggctatggggcagcagccaatcaccttcctccggcaggtgatggcactatgcacctacccaaacctgctggacagccccagcttcccagaagatgctaagaaacgtgcccggcggatcctgcaggcttgtggcgggaacagcctggggtcctacagtgctagccagggtgtcaactgcatccgtgaagatgtggctgcctacatcaccaggagggatggcggtgtgcctgcggaccccgacaacatctacctgaccacgggagctagtgacggcatttctacgatcctgaagatcctcgtctccgggggcggcaagtcacggacaggtgtgatgatccccatcccacaatatcccctctattcagctgtcatctctgagctcgacgccatccaggtgaattactacctggacgaggagaactgctgggcgctgaatgtgaatgagctccggcgggcggtgcaggaggccaaagaccactgtgatcctaaggtgctctgcataatcaaccctgggaaccccacaggccaggtacaaagcagaaagtgcatagaagatgtgatccactttgcctgggaagagaagctctttctcctggctgatgaggtgtaccaggacaacgtgtactctccagattgcagattccactccttcaagaaggtgctgtacgagatggggcccgagtactccagcaacgtggagctcgcctccttccactccacctccaagggctacatgggcgagtgtggttacagaggaggctacatggaggtgatcaacctgcaccctgagatcaagggccagctggtgaagctgctgtcggtgcgcctgtgccccccagtgtctgggcaggccgccatggacattgtcgtgaaccccccggtggcaggagaggagtcctttgagcaattcagccgagagaaggagtcggtcctgggtaatctggccaaaaaagcaaagctgacggaagacctgtttaaccaagtcccaggaattcactgcaaccccttgcagggggccatgtacgccttccctcggatcttcattcctgccaaagctgtggaggctgctcaggcccatcaaatggctccagacatgttctactgcatgaagctcctggaggagactggcatctgtgtcgtgcccggcagtggctttgggcagagggaaggcacttaccacttcaggatgactatcctccctccagtggagaagctgaaaacggtgctgcagaaggtgaaagacttccacatcaacttcctggagaagtacgcgtgaggacgcctgagccccagcgggagacctgtccttggctcttcctcccaatgcccgtcaggctgaactcgcctcccccgtgactctgcctcgggcctcgcagaggccgctggtcacttcgtcatcattttgcccctggagacgtctttctttgtgccttgatgttgagagcgcctctcttttgagcaaacaagcattctatatgcaaccagagtagaggggacctgctcagcaggtgtgaccagggttctctgaatctgttattgtttttgcttctggaaagttcatttggggtttacaacaactaggatgtgttgggtgagatgtttcagatctggagaaatgagcaggtgtcgggaaatgtgtgacttaaccgtggtgagggctggaaatccaaactcaccaccatgatctgtgaaataaagcccttagcggtgtgaagcatccggtcctttgaacagaagggcctggaaggcccctggggctgagaaagggtccgcccggtggcctggaggcaggcgccgggagcgcagtagcacgtggactgggcaggatgttgcactagcttggggtagatgctgggggctgcggccacggtcagagggccccactgtgaggcgtgggtgtgagccaggctgcaggaggaactgggcctccgcttcccagcaacgcagccaggcctgagaattctgtgcgcccggcgggctttgggaatgaggggttcccttgaacatgcgtaggctggaaccccgtctgagaggtctccctgaatttcagtgacacatagtgcagcccggcagtgtcccacttccgtggagagagccgctggaatggtgtggacccatcccgcgggtgaccggtgcctgttctcccctgaccgagcctgtgagcacatcgccccctgctggcgacagcggggaaatgagggctgaaaatatcctccccacaagggcaatccccgggacctgccgagcagccaaggccctgtcctttcttgaatggtggcgagctgaatctggtcggtttcctagcttttaggtggtaaaagtgcctggcagcttggctgccgtggaggagtcagtcgtggttggaggttcattgccgtgctttcatgcagagtgttttgccttcatgttagcttccggctcccctcccaggctgcagactctgacctgtggcatcaggcttctcccagtacaggagggtgccatcccccagcatgcggcttctctgccattagcagccctgggcgggccgaccacactcgaggctgcggtgctacgggcttagccctcgcctccctcactgggagcttccccatcctccctgccttccccagtgggaagttagggaagctcaggagcctgggaccccgcatgtcccaaaatgggattggagaagctggagagaaagcagaagaggccgaggagtgaggcagcagcctctatgctgtgatttccacaccgggtccgtgcagaggaaacagaaactcccaactgtccttacccaccgacatcacagcccctatgaagaaagtagccacaatctcaaataacaaaagggaatgttctaaaactttttcttccttaaaaaatggagaaaattgcacttgtgcttgctgtgtggtatataaaccaggattagtcccagggtcgtgaggtttctggtgaaaaggttaaatcgtagaagctagtatattttttatatttttgtaacaattgcttttttcatgggggaggcggggttagtatttatagtcctaacaagtccagtaattttttataaatcttcagattataaacagcccctaaaaactttacaacgtttacacagttttttaaaaagagactgtatacacttgatttgctttcaaaataaataaggtcagctagtctaggaggttaacgtcgggtaggaatgctgatcatgataggtttggttttctacagattctgttccggtgcctttcctatccaggcaccacctgagaaagttgtcatttgaggtcgcacttggaagttacatctgtgaagtttctgtcattcgtccagatctgtgtgtgtagcatgtgctgaggaagcacgtgctgggctgtgcctcagacagtgcatcaccgggcacccagaggcttgcctggctattcctgttctggtgtgtgtggagtgttggggaggaacagatgcagatcaacctgtggctgttttcccgtctaggttctcacaggtatctcctgacagaggtacttaacaatggctctgctggaaatttctataaataaaatgtccaaaatggtgac

SEQ ID NO: 449295 - DNA, 4077 bp, Homo sapiens
gcgcggggatgcggctgtgggcgccggggccgggtagctgctccaggcgcgcgagctaaccgagtgcggcgagggcctaccaggggcgacagggtttctctccgcaagcgcgcgatgcagcgggcggcggcgctggtccggcggggctgtggtccccggacccccagctcctggggccgcagccagagcagcgcggccgccgaggcctcggcggtgctcaaggtgcggcccgagcgcagccggcgcgagcgcatcctcacgctggagtccatgaacccgcaggtgaaggcggtggagtacgccgtgcggggacccatcgtgctcaaggccggcgagatcgagctcgagctgcagcgggctggagtgcagtggtgcagttatagctcactgtggcctcaaattcctgggctcaagtgatcctcctgcctcagcctcttcagaagctaggactacagggtatcaaaaagccattcacagaggtcatccgagccaacatcggggacgcccaggctatggggcagcagccaatcaccttcctccggcaggtgatggcactatgcacctacccaaacctgctggacagccccagcttcccagaagatgctaagaaacgtgcccggcggatcctgcaggcttgtggcgggaacagcctggggtcctacagtgctagccagggtgtcaactgcatccgtgaagatgtggctgcctacatcaccaggagggatggcggtgtgcctgcggaccccgacaacatctacctgaccacgggagctagtgacggcatttctacgatcctgaagatcctcgtctccgggggcggcaagtcacggacaggtgtgatgatccccatcccacaatatcccctctattcagctgtcatctctgagctcgacgccatccaggtgaattactacctggacgaggagaactgctgggcgctgaatgtgaatgagctccggcgggcggtgcaggaggccaaagaccactgtgatcctaaggtgctctgcataatcaaccctgggaaccccacaggccaggtacaaagcagaaagtgcatagaagatgtgatccactttgcctgggaagagaagctctttctcctggctgatgaggtgtaccaggacaacgtgtactctccagattgcagattccactccttcaagaaggtgctgtacgagatggggcccgagtactccagcaacgtggagctcgcctccttccactccacctccaagggctacatgggcgagtgtggttacagaggaggctacatggaggtgatcaacctgcaccctgagatcaagggccagctggtgaagctgctgtcggtgcgcctgtgccccccagtgtctgggcaggccgccatggacattgtcgtgaaccccccggtggcaggagaggagtcctttgagcaattcagccgagagaaggagtcggtcctgggtaatctggccaaaaaagcaaagctgacggaagacctgtttaaccaagtcccaggaattcactgcaaccccttgcagggggccatgtacgccttccctcggatcttcattcctgccaaagctgtggaggctgctcaggcccatcaaatggctccagacatgttctactgcatgaagctcctggaggagactggcatctgtgtcgtgcccggcagtggctttgggcagagggaaggcacttaccacttcaggatgactatcctccctccagtggagaagctgaaaacggtgctgcagaaggtgaaagacttccacatcaacttcctggagaagtacgcgtgaggacgcctgagccccagcgggagacctgtccttggctcttcctcccaatgcccgtcaggctgaactcgcctcccccgtgactctgcctcgggcctcgcagaggccgctggtcacttcgtcatcattttgcccctggagacgtctttctttgtgccttgatgttgagagcgcctctcttttgagcaaacaagcattctatatgcaaccagagtagaggggacctgctcagcaggtgtgaccagggttctctgaatctgttattgtttttgcttctggaaagttcatttggggtttacaacaactaggatgtgttgggtgagatgtttcagatctggagaaatgagcaggtgtcgggaaatgtgtgacttaaccgtggtgagggctggaaatccaaactcaccaccatgatctgtgaaataaagcccttagcggtgtgaagcatccggtcctttgaacagaagggcctggaaggcccctggggctgagaaagggtccgcccggtggcctggaggcaggcgccgggagcgcagtagcacgtggactgggcaggatgttgcactagcttggggtagatgctgggggctgcggccacggtcagagggccccactgtgaggcgtgggtgtgagccaggctgcaggaggaactgggcctccgcttcccagcaacgcagccaggcctgagaattctgtgcgcccggcgggctttgggaatgaggggttcccttgaacatgcgtaggctggaaccccgtctgagaggtctccctgaatttcagtgacacatagtgcagcccggcagtgtcccacttccgtggagagagccgctggaatggtgtggacccatcccgcgggtgaccggtgcctgttctcccctgaccgagcctgtgagcacatcgccccctgctggcgacagcggggaaatgagggctgaaaatatcctccccacaagggcaatccccgggacctgccgagcagccaaggccctgtcctttcttgaatggtggcgagctgaatctggtcggtttcctagcttttaggtggtaaaagtgcctggcagcttggctgccgtggaggagtcagtcgtggttggaggttcattgccgtgctttcatgcagagtgttttgccttcatgttagcttccggctcccctcccaggctgcagactctgacctgtggcatcaggcttctcccagtacaggagggtgccatcccccagcatgcggcttctctgccattagcagccctgggcgggccgaccacactcgaggctgcggtgctacgggcttagccctcgcctccctcactgggagcttccccatcctccctgccttccccagtgggaagttagggaagctcaggagcctgggaccccgcatgtcccaaaatgggattggagaagctggagagaaagcagaagaggccgaggagtgaggcagcagcctctatgctgtgatttccacaccgggtccgtgcagaggaaacagaaactcccaactgtccttacccaccgacatcacagcccctatgaagaaagtagccacaatctcaaataacaaaagggaatgttctaaaactttttcttccttaaaaaatggagaaaattgcacttgtgcttgctgtgtggtatataaaccaggattagtcccagggtcgtgaggtttctggtgaaaaggttaaatcgtagaagctagtatattttttatatttttgtaacaattgcttttttcatgggggaggcggggttagtatttatagtcctaacaagtccagtaattttttataaatcttcagattataaacagcccctaaaaactttacaacgtttacacagttttttaaaaagagactgtatacacttgatttgctttcaaaataaataaggtcagctagtctaggaggttaacgtcgggtaggaatgctgatcatgataggtttggttttctacagattctgttccggtgcctttcctatccaggcaccacctgagaaagttgtcatttgaggtcgcacttggaagttacatctgtgaagtttctgtcattcgtccagatctgtgtgtgtagcatgtgctgaggaagcacgtgctgggctgtgcctcagacagtgcatcaccgggcacccagaggcttgcctggctattcctgttctggtgtgtgtggagtgttggggaggaacagatgcagatcaacctgtggctgttttcccgtctaggttctcacaggtatctcctgacagaggtacttaacaatggctctgctggaaatttctataaataaaatgtccaaaatggtgac

SEQ ID NO: 449296 - DNA, 3582 bp, Homo sapiens
tttggaccctcctcagctcccaaagtgctaggattttagacgtgagccaccgtgccagcctaagtactgagtcattaactacacgttctgcactgtgctgagaactttagaatgttgtattttgcttactcctcgcagctgccctcattttacagatgaggaaactgagactcggggaagtaaagcgacttgcacagagttggactggaggcatgcagtggggccacgggtgaaaggctaggtcagggatgggaagtagtgctggctttctagatgtgaattctctgttgcagacgatcctgaagatcctcgtctccgggggcggcaagtcacggacaggtgtgatgatccccatcccacaatatcccctctattcagctgtcatctctgagctcgacgccatccaggtgaattactacctggacgaggagaactgctgggcgctgaatgtgaatgagctccggcgggcggtgcaggaggccaaagaccactgtgatcctaaggtgctctgcataatcaaccctgggaaccccacaggccaggtacaaagcagaaagtgcatagaagatgtgatccactttgcctgggaagagaagctctttctcctggctgatgaggtgtaccaggacaacgtgtactctccagattgcagattccactccttcaagaaggtgctgtacgagatggggcccgagtactccagcaacgtggagctcgcctccttccactccacctccaagggctacatgggcgagtgtggttacagaggaggctacatggaggtgatcaacctgcaccctgagatcaagggccagctggtgaagctgctgtcggtgcgcctgtgccccccagtgtctgggcaggccgccatggacattgtcgtgaaccccccggtggcaggagaggagtcctttgagcaattcagccgagagaaggagtcggtcctgggtaatctggccaaaaaagcaaagctgacggaagacctgtttaaccaagtcccaggaattcactgcaaccccttgcagggggccatgtacgccttccctcggatcttcattcctgccaaagctgtggaggctgctcaggcccatcaaatggctccagacatgttctactgcatgaagctcctggaggagactggcatctgtgtcgtgcccggcagtggctttgggcagagggaaggcacttaccacttcaggatgactatcctccctccagtggagaagctgaaaacggtgctgcagaaggtgaaagacttccacatcaacttcctggagaagtacgcgtgaggacgcctgagccccagcgggagacctgtccttggctcttcctcccaatgcccgtcaggctgaactcgcctcccccgtgactctgcctcgggcctcgcagaggccgctggtcacttcgtcatcattttgcccctggagacgtctttctttgtgccttgatgttgagagcgcctctcttttgagcaaacaagcattctatatgcaaccagagtagaggggacctgctcagcaggtgtgaccagggttctctgaatctgttattgtttttgcttctggaaagttcatttggggtttacaacaactaggatgtgttgggtgagatgtttcagatctggagaaatgagcaggtgtcgggaaatgtgtgacttaaccgtggtgagggctggaaatccaaactcaccaccatgatctgtgaaataaagcccttagcggtgtgaagcatccggtcctttgaacagaagggcctggaaggcccctggggctgagaaagggtccgcccggtggcctggaggcaggcgccgggagcgcagtagcacgtggactgggcaggatgttgcactagcttggggtagatgctgggggctgcggccacggtcagagggccccactgtgaggcgtgggtgtgagccaggctgcaggaggaactgggcctccgcttcccagcaacgcagccaggcctgagaattctgtgcgcccggcgggctttgggaatgaggggttcccttgaacatgcgtaggctggaaccccgtctgagaggtctccctgaatttcagtgacacatagtgcagcccggcagtgtcccacttccgtggagagagccgctggaatggtgtggacccatcccgcgggtgaccggtgcctgttctcccctgaccgagcctgtgagcacatcgccccctgctggcgacagcggggaaatgagggctgaaaatatcctccccacaagggcaatccccgggacctgccgagcagccaaggccctgtcctttcttgaatggtggcgagctgaatctggtcggtttcctagcttttaggtggtaaaagtgcctggcagcttggctgccgtggaggagtcagtcgtggttggaggttcattgccgtgctttcatgcagagtgttttgccttcatgttagcttccggctcccctcccaggctgcagactctgacctgtggcatcaggcttctcccagtacaggagggtgccatcccccagcatgcggcttctctgccattagcagccctgggcgggccgaccacactcgaggctgcggtgctacgggcttagccctcgcctccctcactgggagcttccccatcctccctgccttccccagtgggaagttagggaagctcaggagcctgggaccccgcatgtcccaaaatgggattggagaagctggagagaaagcagaagaggccgaggagtgaggcagcagcctctatgctgtgatttccacaccgggtccgtgcagaggaaacagaaactcccaactgtccttacccaccgacatcacagcccctatgaagaaagtagccacaatctcaaataacaaaagggaatgttctaaaactttttcttccttaaaaaatggagaaaattgcacttgtgcttgctgtgtggtatataaaccaggattagtcccagggtcgtgaggtttctggtgaaaaggttaaatcgtagaagctagtatattttttatatttttgtaacaattgcttttttcatgggggaggcggggttagtatttatagtcctaacaagtccagtaattttttataaatcttcagattataaacagcccctaaaaactttacaacgtttacacagttttttaaaaagagactgtatacacttgatttgctttcaaaataaataaggtcagctagtctaggaggttaacgtcgggtaggaatgctgatcatgataggtttggttttctacagattctgttccggtgcctttcctatccaggcaccacctgagaaagttgtcatttgaggtcgcacttggaagttacatctgtgaagtttctgtcattcgtccagatctgtgtgtgtagcatgtgctgaggaagcacgtgctgggctgtgcctcagacagtgcatcaccgggcacccagaggcttgcctggctattcctgttctggtgtgtgtggagtgttggggaggaacagatgcagatcaacctgtggctgttttcccgtctaggttctcacaggtatctcctgacagaggtacttaacaatggctctgctggaaatttctataaataaaatgtccaaaatggtgac
